United States Patent 8,067,671 (METHODS FOR GENETIC CONTROL OF PLANT PEST INFESTATION AND COMPOSITIONS THEREOF) - sequence listing, part 3

SEQ ID NO: 1481 - DNA, 7053 bp, Heterodera glycines
ttttggagtgaaactcgcaaagaataggaaattcgaattgagtgacgggagagagcgaagaggcgggacgttggaaagagtttacccccccccccccccccccattcattcgaatgagaaatgaaatgacatcagccgtccgctgttgctgagatgatgaactttgattgactgttcttttttttttttgcaaattagtcttttttaatttaattagcatttcgatatatatgaattatggaaggggttgaccctgacactttgctcgaatggcttcaaatgggtgtcggcgaccagcgtgatttgcaactgatggcattggaacaactttgcatggttatgcttaattctcatgtttaaagcttttagcttaagttctaattctttagactcttttaatgagtgataacatcgaccgatgttttgagatttgtcctccaagaacttttttgccagcactcggacggattttccttgacgagtcagctcctgaaaacatattggaggtgagtaacagtaacagttataagaaggattgagctcaaatagacttttttttacagtgtaattttggtaatggtaaggctggtcccctcccccccccccccttccctattcggtaattgttttttactggtcccataaaaaagagaaaattgcatttttattggtcttatgacatcattttcgtccaattttgtgtgaattttactcgagaataaaattgatgcatatctgagcaaaaaaaaagaagccaatttaaattcagggttcgagaaattaattaaaaatttataattaactgattttttcatatgtttccaagtcatttgttccttgtcatctcatttttttagtgttaatttctatcattcgaaaaggtcacggctcgtgccatcacttattatttggatgtgtccaatgagtgtacccgtcggatcacgcaagtcgatggtgctataaagtcaatttgccaccggttggtcattgttgaactgacggacagaacaagcaaagatttgggtgctgttttagtcataaacaaaagtagcaaatattgcttttgatttagcggaacaatgcgttaaactgctggaacatatttgccaacgggagaccagtgcagtgcatgacgcggggggactgcaggccatgctgcacttgataaagtgaatcttacggtaccgtttgcaattttctgcttctccgataggcaccatgttcatctgcacaaagacacaatgcattccgccatggccgttgtcaccaaactgtgcagcaaaattgagccgaccgacgccaacattggcgagtgcagcagaaaccttggtgatttgcttgaacatgacgatgagagagtggcagagtgtgcactgcgatgttttgccgcaatgaccgatcgtttcgtgcgacgtcaaatggacccaatggcgttggcctctcccagcagattggtggcgcatctcttcgaccttattggttcatcttcgacagcgcacgaaaatgctcccactgaattatcttcgaatggggaaaactgcagaattcggaagagaagttccgctttcatctctatggttttctcactctttgtcaatctgtgcaaaagttctttcgccctcactgaagaaattctttcgtgagtttccaatttatttttcttgcatttttaattctcttttagctcgtccaaattggttcctgctttgaaaatggttctcaatggaaaggatgaacgttgtatcaacgtaagtttgtcaacacttcttgttttttattttggtactttgttttaggattcgttgcgtttcattgaccttctaattgtcttactctgtgaaggacggtctgcaatttccaaaaaccgagttttattaaacgattcgggtacacaaactcctctctctctctctttctttttttttatccaaattcttttaagttgctcctcccgcttttgacaaaacgcatcgcaatttaattgacgcaattcgattgcgtgacacggacgcgttaattgatgccgtcgaaaatggaacggttgctaaaaaccgtaattctcaaagactcgtggtttcaggttgacccgaactttgtcgacgacgttggccaaactctgctcaattggtgttctgctttcggcacctccgacatggtcatttacctttgtgacaaaggagcagaccccaacaaagggcagcgttcttcttcgcttcattacgccgcgtgttttggacgagtcgaagtgagctgcatttggatttattatttgctgtaataaccaattatacttcaagattgtaaagatccttcttcgctacggagcgaaccccgacctgcaagatgtgctgcccaatggcattcattggccaataatctaaaaaacaattaaggaagagggacggactgcgctcgacaaggcccgagaacgaagcgacgaaggtcatcagcaagtgtgcgagattctccaaaaccccggtgcttacatcagcgtaataccaacgagcgcacaaatgcacaaacattccgatgcacaaggccaagtggacgcaaaagtggcaccggaccatgacaaaattgactctgaattgggagagaaattcatccaacaattgttacccctcttttgtacaatatttagggtattttcttatttcttgtctttgttttatggttttacattcagaattcgttgactgttggtgtaaggcgaacaacgttgactttgattcgcaaatgtgtgtttcatatttcggcaaaagcatttttcgaaattaccgaagcgaaaatgaatacaaatggagaagaaaatggaaactttgtggagtctttggttggagttctaatgggcgtctttgaaagtaaagaaaacaatttggatgcaaagcaacaagcactgatggttggtcctagaactgttgccttttcccaataaaacgatttagacaattaaatctgtgttggttaaaagccccgatttttggactgaacagctggtccggcttggactgtctgagaaaattgagcagttggccatggaggcggtggatgcagcgacaaacaatgcttcttcatcttccctcagtgcggcgaatgttggtccgaatttcccagaattgtccgcttctgaaaagcaattgacccaaagaaggaccatttcgactgattgtacttctctcagaaaagaaataacgaatagtacgacagacaggtgatatcattattacaataatggtaacaaatctgcaagccttggtctttgctttaagtccatcgtccccttctgtgagtctccgttccgagtcagccgcgccatcaaacgatgcttcacattactcggtaattatccatcaaatttgtttcttttaagctcaaacctcgacccacttgcccaaatggcggcaatggtcaattggtgtcccgacgaaaaaaattaaaaatttcgcagctattttttctaagcttaaaaaatgtgctgatcacgaatctgaacttagattttgaaaatcattgatttttatctatgatttttcatcaactacttgatatttcaaatttttttattgtttttaaaatttattttacaatgaatttgggttagaaaaatgcactaaacactaatttgagttctaatttttcaaaaacaatatcttgtctatcatttctcatcaaacatcagaaaaaataatccacagccaagcggattcgaaccccttattaagggccaataataaaatttcaaaaaatcgtaaaaaactaaaacttaactcctccaaacctcattcgaaagccctttttgagctctacaacagctgcgtatgagttttttacaccagattaattgtctaaaattttttgggaaaatcaagtatttaatgaaaaatcatagataaaaatcaatgttttcaaaatctgagttcagattcgtgatcagctatcttttaagtctagaaaaacaagctgctttaacatttttttttcgtcgggacaccaattcttgaccattgcccaaatggcttttgaacataactcatttcaaaattacagaatgaagaaatcgctgttcatgctgataattcaacaccatcgccgaccgttgaaatattacacagacataatgcaccaaatactgaggaagaactctcaccttcaaatcacggagacggggccaactctccacaatttgataatgaattggtggaggcagccactaccattgccaatgttcttggagtgcaaatagtgcaagacgtttctgaatcatcatgtgaactcaaccagcaacaacagaggcaacctcagaactcagccaaggacggctcggaagatgtgtggacggtggaggagaaagtgttctatcgctggaaggactggaggctgatccgctccaaagattctctgtttttgtggtgcgacgctgtcgcattggagttgaggtggtttggttttgtttgtcatccaattattttgttccatagtgatggctcgaacggatggctgcgctttctgatgaatggcaggctgagcactttgtacagcagcggtacccctgaatatggggcggacaatgccgaaaaccgcaccgaattcgtcgaaaagttacttaaagctcgggcaaccgtgccagctggatcgcagaccaaatcggtcctttccgtgccacgctctgtgacattggaaattcaatcgggaaattggaatttggcatcacccgaagtcggcacactgttattgacaaatcgagaaggcactcaacagaaaatggtcgtgaaagaggaccttccagggttcatttttgaaacgacgcgacatcaaaaacatctgttttcagccgattcaactttgggtttatacttttaatcaacatggaattcagaattattcaataataatgtaggacatgattttgtgacgggttgggccgcgcggggtggcggaagacgccttcgctactttaaactggaggttcaaaaacagaaagtgtacgaattggcgcaagagatttgggacgcttacctgaaaaaagctcgggatgagcccagagaattggtcttggaagttcagaaattttcgaatttgctttgcaaattgacgaaatcaattgcgaaaatggaagagaaagattcttgtgccaattcaacagaagaagtaagttcaactgaagaagtaatggtttcattaatttctaaacttttattttagctgcgaacaattcttgccaaaatccgtgacattttaattgacgagcgtcttctgtccgtatttgaaatatcagtgtcaggattggtgccctctttcctgggctttattgagcaggttcatctcaaccgaagtggagttctcgccaaatctttcgcagaggtcttcgacttatttattaataatagtattcccatactttagattttctctgatgcaaaaaaactttctctgttggtccgtaaaattgttctcgtattggaatttgttgagaaattgcctcaatatctctacgatgtccccggcggttctccttttggctttcaagtgacccatttgctcattttcgaagctacaactcgattttagttgcttacgcgacgtttgcgctttcgttttgaattggaaaatcagggaaaaggcaacaaagcttcgaatcaatttgcgaatatgtaatggaattcggcttgaaattttacttgtcaaatttcagaacaaatcgctttttgaagagtgaaccgcttgtgtcagttgcttcattgaagtcgtatttgtaccaacaactcacgaattccaccaagtcaccaaacagcttatcaggaggcatattatattcttattttgcctagtttttcgtttttgccgtttagtcactccaagcgatgacccgcttcaccagccgaatgtgtccagtgctctctcgaatctcagctttggtcgacctcccaccgctgcttctttgagaatggcgcgcaaactccctaaaacagcggcagataaaagcgccggcgtttcttccgtcactggacataaacacaatgtcacgtccggcggtgatcttttgtctgctcgttccgcttacgtcgctgctggctgtttagagaaagtcggcgggaccatcaaagtgaaaaaatcatttgggtccgggaaagcgacgaaaaatacgacaacgaagaaaggaggagcaaatttaccgaagagttctggcgaagcgccgtcgaaaggacagcgaaatgcaaacggacgggaacagtcgacattaaatgaagtgagccaatgtcaattgaaaaatcaaagcatgaaattcaattttaaaaaataaaattattttagaaaaactcactcgacacaattaatgtaatttctcagcaacaacaaaagtcaatgtcaacaactaatttatttgatgtttgtttcatattttatattagtcatttctcatttcctttaggctgaccagcgaaagagccgaagttcttcagtgtttaatcaggcggcaagtgccgagtctctccagcaccaaacgccgtccctagagaatttgttgtccaaggctcgtcttcatgattgcagcattccggaggaatcattgggttcgcctaattccggaagccccgagccaaagaatctaccagcatttggaaatcatgcaaattttgaaaatcggtttgacaaaagaaagggaagtgaggaaatgcacggactgtcaattggtgccaggttggaatcccctatgaagagcatttgacccgtgaaattaagctcatttgctggtggctcacagcccgttctgaactcttcttgctttgctcgtgaacggcaacaattgtcctcctcggaaagattggcaccgacccaaaatgaatcctcaatcgaaaccataaatggtttggagtctgaattgtcttatgacttagtaaaaattcattgacagaagtcagcaaaaggacggagaatgcatttgcaagtcctcagatggttcaaaagtcaaacaacgcatttgaagcacaactgacaccatttggtaattgcacttccgagaggaaataattaaatctgtaattaattcttttt

SEQ ID NO: 1482 - DNA, 4431 bp, Heterodera glycines
cggaggaaggcaaaatcgaattgtcggaatgtggtgacacaaaaagtaatgaacttttgagtgagacgagtgggacgaccatgccgaaaaaaacgtcgcacaaatatggagaacactgctcgaacaaaggggagtcttcaaattcgcaaagtatgctttataatggaaaagcatcctaattattgtggtatgcgatgaacaatggtcgagcacccgatccccccccccccctccgtaagacggacaaggaatagaaaaaattcctcaaaggattttaacaagctctattaacctgcctaatgattatcaaaacaatgtcaatcttaaaaaagtttgaaaaactacaaaagttggactattcgttgtctgatggtcaaagccttgcacaaatgtctcacgatcaaccaaactttttcagctgaaactcgtcaaaatgtgcctggatccagccacaactcatcttcgcaaattcaaaatattggttcaaatttacgcgttaaactgggaaattacgccgaagttttccgcaatatgatgcagcaagtaaaaaataacaaaaataaacataaaatcaaataaacatttaggtgttggagtccggtgaaaattccgacatttacgacgtggacgaattcgacaacgacatttacgaggacgagttacattttatcgagtgcgatggcatttcatccattttttcttctgctaatttgattcactttagcgattgtgaacatcccggaagtgatcatggaggagggatcagcatctcttccgactcttcctcaattgctgatcgttttgcagagcatgttcaaaatatcggaagcacttcggtctccacggggccactgggcacaagcggtggcggagctaacgctgcgtcatcgatgttcagcgatgccacaacggcacttcaatcccaaattgagtctttttcgtccgttgcctctgcttttcgtcgtcagttttccacctcttccacttccgccaaccaatcaataattcccaacacgggagcctctcgtgccgatgcttttgcagccatccgtgccgccattgagcgaagtgaaaacataatcccttcgttaccaatcgatgtgatcatcggatcatctcctgtcaatgaagggcgaaatcatcgatggcgacaagccctactggacgaattcaatgcttttattccgccttcaatgggcagtcaaagtgatggacgacagcgaagcaacgaagaaggaaattgtggacgagcggctcgaacaatggcaaataaaacggcgatacaacccggtggttggaatgacgattttgtgcttcgtcgtcagttcggggcactcatcccagccttcgaccctcgccccggtcgaaccaatgtcaatcaggtctaaccaagcgcttccatttcaccgtaaaaaacactgcttcagacacaagatgttaaattgccggacagtattcaattctgtacatacagacgcaaagggtcgttgattagagaggagcctaaaggagggggaacttcttccactgccaaagaaaagtccccgattcgattgtttatcaaaatgactggcaaagaccaagtgaaaaatgaggaggaagaattggtggaactgaaggacgatgactcatcactgttccgttatggtgattcccaattgttcctaagtttactcttattaaaaataatgcacttaagtgcaagacttgctggtgacgagtcagaaatgcggacaatcgccgaatgtgtttagcgctgatgcgaattctctgatttgggaaaacacttttacgctgatttattcggttaatgagaatgaggcggcagaatgcccaacggaggacacggagaaggctatgactaacaatttggacgagacaaatcctttggttgaacaggtgggcggggaagcgtatccagggagagggaagtttctatctgtattttacaatttctcaattttcaatattaaggcattgaacgtgatcaaaatattacacgaactttctcgctcaattagcaacttcgaccaaattattggtgttgaagtcacttttccgactcttcctgaagaatcatttcacagtacaaaattgtcgcaaaaactttgccaagaactgactgatccattagtggtttctgcaaaggcgttgcctaattggtgcaactatttgggtgcgttatttaaacataaacctttgaattataaacattcgaatataattttttagtacacaatttcccatgtcttttttcgatggacatacgaacaagttttatgaacacgacaggtttaaaaatatattttttctattttttaacaaaatatttagcttttgggacctcacgggcaattgcgtatttacaaagtcgacgcgatcacttacttgaccaaaatcgttctgctacttcttcagccgcttccaacatggcaggccttcgaagagaggaccattaccctgagtacagaataggacgagttaaacatgaacggataaaagtgcaccggtcggcagaactcttcctggaaaatgccgtcaaagtgctaaaatttcatgcgttgcgaaaggccattttggagattgaatatttcggcgaagagggcactggcctcggcccaacgctcgaattcttttctttggtttatcggcattaaaattcaaaacaatgtatgatgtttgaggttgctgctgagttccaacgacgggacctttgcatgtggcactgtgaggacagtgttttggaaaacgaggcgaacgatcagaaaggcggaggattcattgggtcgaaacctaccggtttttacgtgcactcaaatgtcggtcttttcccagccttttggccgtcaggctctaatgaacgagttttaaatctcttccaaatttttggaatattcattgcaaaagcaattcaggtgagcttctttttcttgcttttcatggccccaaatttcaggacaatcgtcttgtcgacttgcccctttcgaaaaccttcctcaaactgatcacttcgcctaaggttttcttgttttgtttgtgtatttctttatacccattttgcagcttgcctcaggcgatgggccatcaattgaatccgttttggatttttccgatttcgcactgattcaccccgaaaaggtcgtttatacaacaaatttactatttaagcactgcctattttagatgcgattagtaactgctctgctaaaattcattgagcaaaggaaatccatccaatcggacgaacactttgactctgccgaaagggaaaaacagttcgacgaattgcgcgttgaaatgggtgaagccaaaataacagttgaaggtggaatccagcccccacattaattgtcttatcaattattctgctcatctgttagatttgtccctaactttcgcggttaatgctcccgctcgatgtttcccctacgaatgcgttgaattaattccaaacggcgcttcggttgaggtgaatggttccaatgtcgaattgtacgtgaaaaggcttgtcgactttcatttgaatgaaggaatccgtgagcaggttcatttaacatttgcttttctggacttggcttttccttttttagcttttcatgttccgcttcggcttcgacttggtttttcctctttcatctttgacttgctactcgaccagcgaacttcaggtgtcaaatttctcagcaacagtagtaattcatcttttgctcttacatttagactttgatctcgggagaacagagtccaagatggacacgagaagatttgttacggtattcggaaccaaaacttgggtgagaactgaccacagtcacacgattccaataataacccattcttcaacagttacactcgcgactcagtcggttttctgaacttcgtcgaagtgctcatgggtttcaattcggcggagcgtaaggccttccttcagtttacgaccgggtctttttctctttccttttttcgcatttttgggtgtttttaggtgctcttctttgcctcccggtggcctcgccaacctccaccctcggtcggtcttttcacttccctttgtaaatgcggaaatctgtttttcagtctaactgtcgtacgcaaagtcggttctggagatgggtcttatccggtacgatttttcgctctcatagtcagtgtaaatttcacattcagtccgtcaacacgtgtgtgcattacttgaaactgcccgagtacagcagtgccggaatactcagagatcgtcttttggcggcaacagcagaaaagggattccatttgaattgaacgaattggcggggaaaagcggggacgagtcagaagccattcattttcatcaatattttccattattatgtgaccacatgactgtataatatgattcttgatcggtgatcaattaaacagataatttgagtcaactttggccgtttggactaa

SEQ ID NO: 1483 - DNA, 2597 bp, Heterodera glycines
  misc_feature (18)..(18): n is a, c, g, or t
  misc_feature (35)..(35): n is a, c, g, or t
  misc_feature (88)..(88): n is a, c, g, or t
ctcaattgttcgtccacntttcttcgattcggtgnaaagatgggccgaccgcgactttggagaagatctcagtgggtgtttctcgatntattgggcaatgaatttgcaaattaaggaaattttttggaagagattagttactccgatttggcaagttacgcgcagttgatccatcacaaagtgagaatataaggcaaagcaaaataaggaatcctttgtttttttactttctttttactctatcgttttcttttcatctctcctttccctttctctctttctttttcagctctctcctcactctctccctctttctcttctctcccccttctctcttgttctccttgcactcttctacctctatctgtttgtctcactttttgcctcccttcaccattttcaggatatcattatccaatgtctcctccgtcacttggccgatcggtctctctctttgcccgctttttgcgatttttgttcggctattgcgacggatttgcgtgacgattttcacacgcatttttggcagatttttgatgcaatttcaaatttggttttggcatcgaaaggtaaagagcaatgcagtgataacgaattggagtgcacatttcgcgcgatggaacaaattgtgcgaattaattttcgattcatttcagcgcggctaaaacaattgtttaggcatggcttttatgtcaattagttccctaattaccttcccctccctcccttttagccgtcttttaccgctctttgcttttccttctgatgggcgcctccgttttatctccgcccgaactttttcctttgtttttctaaaatcgcctttcccccacaaattggccaaatttcttctcgtcaaatgtttttctgattgtggccatttgcgcgacggactttcgctgtttttcttcgacgcttttttaggagttgaagaaaatgaggcgaaattggaggaagtgggtgacgtggtggagaaaggggaatcctttcctttgcactcacttttagctgatcgatgcattcgtcgtcccaatcttcgaaatgccaactgagtccggactaaggcgcttttccgttacatttctcagcgatgtttttcgaaaaattatttccgataaaaaccatgtcgtttcaacgggaattgtcgccaaattaaacgtgtgaattaccaactgaaattttccataaacttttttcttccttttttagaaacgatttgaaagtgccgttgacccaaatgaacttcaaactctcagcgagtggcttctcctttgggtaaatgccaaaaggcattcgcatttcgtagaagaaaatgccaaaaaattgttgcctttggttgttacgaaaattgagcaagcttcagcggattgtaccgagcttttcgagcagtatttgcaactcatttccgcggtatgaaatcgttgtttcccgactttccatcgctgtgccttcagcttttgctctctctcccgcccacttctgaccatctatcgtccgtttgcgccgttctcgccaactttggcaccgactcgtgccgtcttcctgcacttctccgctgcttggcgcggcttcgtccgcttccccttttccgcttctccgtcatggatttggtcggccgcgtcgcctcttcgcttttggcgtccgttcccgcagattttggaacagtttcacaacaacagctccaacttctccgtgaattgctcattttctacaaaagtattctcactgatttgccctccgccggcgatcattcacctttctgtgagcatttcaatttgtcttttcttattctttttaccttttctcagcgtcttgccaaagcccggctttttgtgttcggcttcatcttccaattcggcgttttgtggtcgccgttttgcacaatccttcagattatccgtccgatttctttgacttcgctttgctcatttggccccatctttggctcgtcaacgaaaagcccgaaggtgagaaaggccattcttttttgaagtgaaagtcattatattttaagaatttcgattctccgggctgggttcgtactctctctctccccccccccggggggactttcccagcttcacagattttcttaataaatttttttttttactcaatttataggatcagatgcaataaatgatttggtgatacaaagcatacgaaaggggacaaaacaaaggctgacggagaaggaaacggagagactttggaacggaacttacgcaacactgctcaaaagggaatgaatgagcagagaagggatgcgatttctttacatttgttgtttttcgttgttaaattatttggcatttttaaattttgcccattttttaacatttttgggcattttatcttattttgccacaaatcttcccctttctcgtgctttttccctaatggcagtcctcacttaaattccgtcttgcttcggttccttggtaaccgcaagtgctgtccattaggtgtggacaaccctcggccattccgtgggttgctcagcgtccaatggctttttgttgggaatctgtcgccgttaagtgccgtcgggtctctttttcccctcctccttggtgccaatgccatccccccccccc

SEQ ID NO: 1484 - DNA, 2385 bp, Heterodera glycines
tccccccccccccccctatccgccgtttcgtttgtcattgccattcgttccaaattcatctcctccgcaaatgcgctccctttttcccgtgctatttctcctgcactttgctcgtcctgccgtttctctgatctgctacagttgcaccaccactctgtccgccaacattgacgagaacgcccaagttgcgctgcgtttgttcctcaattccgtctacgaattgcctccgggtatttccctgtcccttttctcactttgaccctccccaattagtccaccgtttctgcaacatggagcaggatgttgaggtcgaccagcagagactgctggccgtggtttggtgtgactttttgattagtttcagttcaaaaccattaccaccgtccaatgttcgactcccaacgaccaatgcgtgaaagttcgcgcagaaaacgacggtttggcgggggggggggggggcggccctttcgtccgtccaccgttagtccatccgttttaggcttggagttcgtcatccgcgggtgtaagtcgcgcgtgtacaaaacggacgtgggcattccgcagaatgtgcactgcagacaaggcagcccatcactgtgcttttgcaaggaaaacttatgcaattccgcaatttccgcgacggcatcgatggcgacgactatttttatgattattttttatcattttaatgccaaattataacatttggctgaccagcgaccaaaggtcaatttgtggtgaatcactttattatggtagagaagaaatatttagatgaatgataaagaggagagaaaagggagagagagagagagacaggggagagagaagagaaaagagacagaggaaaggaaaaggggagaaacaaagaggagagagacaaagaggagagagagagagagggacgggggagagaaaagaggaaagagagacaaaggagagagaagaggggaaaaggaaggaagggaaagagaaaaagaaaaagggaataaatgataaatttcgtatttcgtacatttttatcaaaagggatatgagatgtttggataggtatatgtacatatgtacaacggatgaattgcctattgcgattagaacctgttggttgttaatggattgggaatgattagccacgaaaagagacgaatgatcgacggacgacggagggggggggggggggggacaataacaatgatcggtgactgcgtcaccaattatcacaatttttggctttgtgtgcaacggccactcacaacaaaaggagcaaatttcgccatttgtcccaatgctttgccaatttcgtccgttcttttcgcttctctttgtccattttatccctttgcttttccttttttctgtgctttttgcagcgaatcccagcgaagatttggtcgaatttctcttccaacaccagcaaatttgtaattccttcctcttttattggcattttatcctttgccattttcaaaggtgggagtcctttttcggatgctcaatgggtgccggtgttggatttgtgcgagatcaaatgcgacgaggaaagggaaatttgtgtggagaatgacgaaatgaaacagcagtgctccaagtgtaagagagagggaaggggaaaaactgtcccaattacggcgagggaaggatttaatgatcgggcaaatggccatgatcagactatttttacttgatcaacaaattgggaatgatcggaatttcctgctgatcatttagacaatgaccagactattacttccgctgaaaagacaaataccaactgatcaataaagtcccttagtttggataacacttaagattatgccagtaaatatgaatttcagtgccggatgcctgcgttcgttcttggatttcaaacaaaagtgccaatcttcgctcttcaagtgttgtcgttttcacgcggccgccccctcaaaaacaaagccaaaccaacggcagtggcaaaggagcaaacgcagtaagacataccgaaaagaaggccaaataagagcaatcgaagcaggatcagcaacaacagcagaagaacaacggacgcgatagggacggaacggagaaacgaaatgcgagcgaacggcggaggtcaccggcgcaaatgtcgacgaaaagagcgacaatgacgagcacagtgacagtgccgaggacgacgatggcgaaaaggaggacggaggagaagccgaagaaggcaatggcacggcaagaaacgacggagggaaaagccaaaaaaggggcgaaagggagcggcaaagaaaggtggacattagtcccagtgaagcggaaggaggaaggaaagaagcaagtgggcaccggaagcagacggggaccgcacattctgaaaagtgtgatcgaattgctgagggaggaatgaccgacggg

SEQ ID NO: 1485 - DNA, 1442 bp, Heterodera glycines
  misc_feature (30)..(30): n is a, c, g, or t
cttttatcaagaaagataaaataaaatttntggaatgcctctttgagataattttcaattcatagggcttttttgggtcttattgcattttaaaagacttttacaaaaattctgaaataggcacaaaaaatggcgaaaaacggcataataaaattgatcctagaagcttcaaaccaagctaaaaactcaaatttatgtttatctcaacgttcgcacaaaaattttaggaatttggcaatttcagccctattaatttttattctgtatcaacaacatttaaccatctacttaacattattgtgttattagagacgcgtgggttttaagtcaaattcttttttccaattgacatctagcagatatcgttaagccttctcaaacatcggggatgccaaagctgataccctttgattctgttgtgtagtgaatttattatatatttaaattcacgccaaatgatgatcatttattgttataccgtatcacccaattattgtccatttaatgagtggacttcgttcactcatggtcttttccttattcatttttcattttgtcaacacacacagcagcaatggcatttgctccttcacaagttattgattaattcctctgactcatcacttcgttctccactttttacttttgaataaatattgtctttactattttgttgtgccaatcgcacgacacaacaactggcgcagtcagcatttcttttcaatttcaaatcattttgagtatttgctattagcggggtgatcagacgaacaaggatttggcacttattatttttccttttctcaatcacttctctccgcttttcattaaattgcctacccttgcccgtaacacatcgttctcgtatcgataagccgtaaaaagcctctgtcgcaaaacgagacgaaaagcagggcgggaacactcacgccgtaaaaagcctctgagtgcactttcgttctgaaagtcacttgtgtggacagccaagtcacggcggtgaccgctggttgcaacgcacttgtgcgacttccaacagcaaaaggcaattatctgatcacatcacatcatcaatcactcacttatcaagccaatccgttgtggtttctgaccgaagctaagcaaaatacttattttgactcaaacaaaaacatttccaaatcaaatcactctctcctctcattcatttcacttaaaatctgagaaatttttcatcacgatcaaatgcctgccgaacaatcaacggagctcaaagacattctgcaggcgatccattcgcttttacaaaaaagcacacaaccaaatgttccatcccagaattcagaaatggacttgttttgcaaactcagcgcacagatcgccgaattcgtctacacaccggacgacaatcacacattcgagcagtggttcgaaagattcggcactttcatcgcagatgaaggaaa

SEQ ID NO: 1486 - DNA, 6836 bp, Heterodera glycines
attattcatttaaaaatgttttaccagcaatcaaaaattgtgttgctgttgtagacctcaaaacacccctcaatattgaaaaaatttatttaatattgttgtgtagtgaatttatatatttaaattcacgccaaatgatgatcatttattattatactgtatccccactttgttgtgcatttaatgagtggacttcgttcactcatggtcttttccttattcattcattttgtcaacacacacagcaacaatggcaattgctccttcaccagattgattaattcctctgactcatcacttcgttctccacttttactatttgaataaatattgtctttactattttgttgtgccaatcgcacgacacaacaactggcgcagtcagcatttcttttcaatttcaaaatcattttgagtatttgctattagcggggtgatcagacgaacaaggatttggcacttattatttgttttcaatcacttttctcatttttataaaattgcctacccttgcccgtaacacatcgttctcgtatcgataagccgtaaaaagcctttgtcgcaaaacgagacgaaaagcagggcgggaacactcacgccgtaaaaagcctctgagtgcactttcgttctgaaagtcacttgtgtggacagccaagtcacggcggtgaccgctggttgcaacgcacttgtgcgacttccaacagcaaaaggcaattatctgatcacatcacatcatcaatcactcacttatcaagccaatccgttgtggtttctgaccgaagctaagcaaaatacttattttgactcaaacaaaaacatttccaaatcaaatcactctctcctctcattcatttcacttaaaatctgaaaattttatcacgatcaaatgcctgccgaacaatcaacggatcttaaagacattctgcaggcgatccatgcgcttttacaaaaaagcacacaaccaaatgtcccatcccagaattcagaaatggacttgttttgcaaactcagcgcccagatcaccgaattcgtctacacaccggacgacaaccacacattcgagcagtagttcgaaagattcggcactttcatcgcagatgaaggaaagaatttgcccgaagcaagccgagtgcgactgatcatcaacaaattgggcgctgaggagtaccgccgctacacggagagcattcagcccactgcaccggaaaagataggttttggtgaaacaatcaacaagctcaaagcaatttttcccgaatcaaaatccctttttgtcaggcgtttcgagtgttttcagcttaagtgcgcggacaatgacgtactttcgttcggagcaactgtcaacgcaatggcagagcgcgcaaaattggatttgacgaaggaccaactaaaatccctcatttttatcacagggattggtgaccacaacgcagatctcagacagcggtgcctcaaatcactcgaagagaacgcaaccttcgaacaacttttggccgagtgtaagcagatcattgcccttcgccacagcactgcagctttggctcgtggaaaggagttcaatgctgtgcagctgcgcccgcaaattttgaaggacaaaccgagggtcagcaaatcaccaataagaacacgaacattttcgaccaacacgcggcacaacagcacttcatcacaatcacaaccaccatcagcttgtacgcgatgcggcggtaatcactggaactcggactgccgtttccaaagggaagtgatttgcaataaatgcggcagaaaagggcatattgcgaaaatttgccgtaatcagaacaacactccccaacattcaggctttaaatattcccgcacaggctcaaataagcaaaatgccaacatcatcgactgcctgcacatcatgccatccgattggaagacggaaaatgaaccgtacattgagcggcatgttcggctcaatggaaaagtgcacaaaatggtagtcgactccggctcaaaattgacaatcgtgagaaagctcatttgggtcaaattgggccaaccgtttctcacagaaacaaagctcaagggtcgttcattcacagggaacattttcacatttatggggaagttcaaggtccaagcagcattggacgatggaatgcccctcgatttggaatgttttgttatcgattcgagggacacactcgatttgatgggacttccatggataagagcatttgaacgcgcctacaaccaagtggtggcgacaactttgtcaatcgaaaatgttgccgacagtcgttggtgcaaccgatcaaacagcacgtcgacgcaattggagatggatttacagaacacatttccaaaaatttttgaggaaacattgggactttgcaccaaaatcagggcccatctcaaaattaaagaaaattcatctcccgttttttgtgcagcacgaccaattcccatcggcgttaagcaagaagtggacaaggaattggaccgtctcatcgatatgggcgtcctgaaaaagaccgactacagcagttgggcggcaccaattgttgctgttcggaaagcaaacggaaaggtacgtttgtgcttcgatttcagcacaggactaaatgccgcattggaaccacaccaccatccactgccacgacctgaacaactttttgcgcagctctccggcgcgaaagtgttttcgcaaatcgacttcaaagacgcatacttgcagatcgctgttgatgagcagtcacgcaagtttttaggcgtaaacactcaccggggtttatttgagtgcagtcgtttagccttcggaattaaaagtgccccaggcatttttcagtgggtcatggaccaattgagtaacggaattcccggagtgcttggctacatggacgacttcatcatcgcctcccgttcaatcaaagagcattatcgaacgctttatcaatttttccaacgaattcaggaatttggtttccacattcaactggggaagtgcaaattcctcgtccagcagatcaaattccttggccaaattgtgacaccaaatggaatcaaaccggactcgtagaggacaaaagcactgcaagacatgcctcaaccacacgatgtctcaactctccggtcgtttttgggtgccatcaattattatgggaaatacatcaaaaatttgcacgaaattcgtgcaccattagactcattgctcaaaaaaggagctaaatgggaatggacacgggaacatcagaaatcatttgatgaagcaaagtctgtgttgctgtcagacttagctcttacacacttcaaccccgatctcacaatcatcgtcaccgccgacgcgagcaacaaaggaatcggagcgacaatttcccaccggttcaacgacggaaaagagaaagttttccaacacgcagcacgaactctcaccaaaacggaacaggcctattcccaaattgagaaagagggacttgggctaattttcgccatccaaaaatttcatcaatttatttttggacgaaaatttattctccgtactgatcaccgaccattgttgggaatttttggctcaaagagtggcatccccatattttcagcttcacgattgcagcgttgggcactgattctgctcaactacgacttctcgattgagtttgtcagaacggactgcacaggacaagccgatgctttgagccgactgatcagcgaccaacgatcatgctcaaaagacgaagacgtcgtcattgcacaattgttggccgacacggaagcagatgtggcacatgtattcaacacgcaaacggaacaattgccactcaccgcaagggaaattgccgaggcacagctcagtgacccgctgatcagagaagttttagagtgtacaatgggacggtggccaaacaaaggccttaatcccgaaataaaaccatattttactgtccgaaacaatctgtccataatctcagattgtctcgttttcaacggacgtacgatcattccacaggcactgcgcgatcgaattttgaaggcacttcacctcgctcatcctggcatcgttcgaatgaagagcctagctagagaattggtctactggccgtcgatggacgctgacattgaatcacttgtcaaaagctgtgttccatgccaagaagccgccaaacaacccacaaaacatcctctccaaccatggccatcaacaacatccgttttcgaacgtgttcacattgatcttgccggaccatgcagtaatggtaaaacttacctggtggtaattgacacttattcaaaatggcctgaaattttccagttaaacaatacttcgtctcattcagttatttcacagctacaatggttgttcgatcgttatggtgttccaaaaacgcttgtgtctgacaatggaccccaattttcgtcatccgtttttaaggaattttgcaaaaataatggcattaaacacattttcagcccgccatatcatcctcagtcgaacggagcagctgaacgctacgttgactacttcaaacgccaactcaaaaaatgtagtggtgaccgaaattggcttagcaaatcacttctctcatatcgctcaacaccaattgctgttttaggccaacgctcaccagctgaattgtttttaggccgaaaattgcgcacaaaattgtcactcatgaggcccgaaaccattccaaagcaacaacatcacgaacacacgtccaaaatgaaattgcaatttgacaaaaagcacaatgtaaagccggtacagtttaaaattggagagcaagtccaatttctcaattaccgaaatggcaaaacactttggctttttgggcgcattgtttcaaataaagggcttatttacgaaatccgttcccctcagcttggcaatcgaattgtcacgcgtcatgccaaccaaatccgaacaacaatggcacagagaggggacgaaacatgtccggtcgccgatgacatcatctttgcgagggaggagcatggaactggaaatgaaacgacggacgatcaacagacaaacacgcagccacaacaacgggcagcgcaacaagaagaacaagggcaaaaccaacaaccacttcctttgcgtcgttccgaacgaacgaggaaacgtgttcgttttcttagtccgacgcacactggacagagttacgatcactgataaatcaccacacacattaccccaaaacaaaatcgaatttttaaccttttcatttaaggggggaggtgttgtgtagtgaatttattatatatttaaattcacgccaaatgatgatcatttattgttataccgtatcacccaattattgtccatttaatgagtggacttcgttcactcatggtcttttccttattcatttttcattttgtcaacacacacagcagcaatggcatttgctccttcaccagttattgattaattcctctgactcatcacttcgttctccactttttacttttgaataaatattgtctttactattttgttgtgccaatcgcacgacacaacagattcaatgcggcattcatccgtccctcgacgccatttgaacagtccattcagtccccagctaaataatttagcataataatcgtcgttgagtttgaggagtttactcagtgccaaaactattgacgccgaaccagtacttgaccagctcgcctttgtccgtgctttcctcgccccatccgattagtttcaatgatccttcttggtaatcacccttgtcagtctgattgacgatggtgtgctaaaaggattttgtataataaaatttttacaatttgatgggttagtgtacgcacagaagactcacaaaaaatccaccgataaatgcctaccaaaagacaaacaattttaatttaataaaatttgaatttttttttaatcaattaaattttatttaaatcatttattttaattaacaatctacatgcagtaaatagaatatcgaatattcactcaaccaaattttatactcatgtacgaatactcgcagggattcgatatccgttttcaaccaataccatttcagaatacccaacccatactcgaacaataatcgattgttgagttcgggttaggaattcggaatggaccaaaatgaatgtcaagttctgcctagcagccttgacagcgcccagaaactcgttttcacgattagacatctcttttaaaaatatgcaaaataaaagataattgaatttttaatgatttacaataagctcagttttcaagtagagccgagaaacattcttatcgtcggtcacttaggttccactacagaattttttttctgaatgcttaaaacaaatatttccaatgattttgaatgtcggaaattgaatttttgcttatcagcatttagtatttgatcattgttcaacaccaacttaccatgtaaacattgacctgtgtgctgttttggccatataaataggcatccacataccaatccacttgaacttggatgggtccgttcgtcattatctcccgcatcattttttcctcccgattttcgtccgctccctcccaatgcgtcggtgcgcctttcagttctgcggagcgtttaaaattataaacagcctaattatttctagtctcaacttgactgtatcaagctcattgtcagttcatattataagtaattgaatagacacagtatgaagagcaccagtggactaattaaattatattggttaaaatttaaatctgagcaataattaattcttgactattaccaaaaagtcaagaaaattaacattaaatcaaaaagacaccctctttggcgtattttcaaatttgatagagaatgataggtaagaataatccagctcaatatgtacaatgtata

SEQ ID NO: 1487 - DNA, 2896 bp, Heterodera glycines
  misc_feature (2878)..(2878): n is a, c, g, or t
tattactgtaattaccgtaagctaattggcttgattgacctccgccgaagcaatgtgattaaatttttttttaaattttcattttgccaaaatgcccgccgcattttctcattcaaacattaacaggtggtggcaatggtggctgctgctccttcagcggtgctcaacagcaacaatgttgcgcttctgggggcggaggcccatgttgcggaggttgctgaaatttttagaaaattttcagatttttattaattttttcttcgtcctcaaggcggaggaggaggtggaggctgttgtggcatgagtggcttccagcaacaacaatgttgtgccaattatggcggcggtcaatgttgcggaggtggtggactaaagcgaatttaaaaattttgaaaatttgcacccctaatctttgggaaattttcaggattttagacgtgaaatttcatattttcaaaacagtgtgcctagttaaaataatcaatgattatatcaaagtgattaacagtataggattggacgaagctatgggttttgccagaatttttacgggaaaattttcgtaaaaatctgggccaggatcctccttctccacaaatcggattttacatagtcccggaaatcactttccgattcattttccaggaaaataggtgggccatgattcccctcttccccccgccccgataaacgcatttttatcctggaaatcccttgtcaattcttcattttccacatgtcatgctagccccgcccccattttttcaacccaacaaacatatctgtcatgatcaccccatcaagctaacgaactaattgcgcttcaggcaacaacaacggtgttcaacaacaaaactggggtggcggcgccgactgttgcgcgcaacagaaccaagtggcgtacaacggcggctgttgtgccggcaattggttcaacgagcagggaaacctgtgcttcccggtcaacttcaacccgtgcagcacacagtgcagtgagttaatttttgtccggggcgacacgagaccagagttgtcgcgagccgagaaaagtgtcgggattcaggattcgggccaggcacccaataaaaagttcgagtcaggatttagacagaaatttgtcgcgattcgggacgataaaagggtcgagtttcaggattgaggccgggcgggcacccaataataagtttgggtcaggatttaggacgagagaaatgtcgggattcgagactcgggattcgggcggcataattttcattttcgattttctttgttcacagatccctccacttgtccacctccgcccgtacattcacaacaacaacaacagcaacaagagctccagttagtgtttgaatgtcccagctcgggatgctatcgggtaagtgtaaacaaaaaaatggtatacatcatactgtaatattgaggacaccatgaaagaaatggccaatgaattttcaaaaaaaaagtgccatcaaataaatacgttgtgcctacccaaatcatcgatgccaaaaaaaaaatttacgcgaccaagactctcgagcatagtcaattgatatttctccattaaaaatcgtcaaaaataccgtacattttgatcaaaaattctaaaaaaatactgtatatttctcgctgaaaattcaaatactgtatattttttggtgaaaagcctcaaaatacactgtatgtttctcgaccaaaaattccacaaaaaatatcataaattatctatcatgccgatcgctagtgatcaatgactctgatcactcccattttgccacagtgtacgccgtccagcggttgctcaaatggtccatgtaacgcggcacatgcctcactctgtccaccccaatgtccacagcacgcgtgctgctgtccgcagaattcgatcggatgcactcggttgctgaaaagacagtgcgtcattttttcctactgtgtttttccccggtattaccgtactccgcccttcccccctccgcctaatctcgggattttcttcggtgttgggtcgttcgttactcatatgacaaaaaattattcgtaattttgctcaagacaattcttgaaatcatattcaatagcccaaagtgtctttattagcctgcaaattttaaaaaatttcgttaaatttcaaaaaagttatagccagaagaactcaaaaaaaagggtttttgagcatttttagtcataactttttgggaatttaacgaaattttgtgaaattttgtcaggataatggagaactcttagggctatcgatgataattaagcaaaaattatttgtttttatgggttttttagtattcgtcacctttactactactgtattcgatcagtacgaccgataataccaaataatttatagagatttatttttaaccatattttttaaaattctaaaaatttagtgaatttttttttggaaatttgggtgagtgagacgccttgggaagttgcgggcattttgccatttttttttcaaaattttcccaaataaaatttgaaccccttcacacagaattatgatggaaatgggcggcgtttgtgtggtggacgcaattgccgtgcgccgcaaaaaacattgattaattgaaagcaatgaaaaaagaatttgccaacaaagttcaatttcttcttcacctaatcaacaacaacaaaagcgacctcgtgccattttttaactaaattaaatttttaaattttattttattcattttgccgaaggtttcaatgacaaattttaattggttacccgaagtttttaagaatgattattataaaactgctgagattgtgacaacttaaacacaatttatggttaatcaaattttgtaaaattttctgaaaaatgggattaaaaatttttaacttccgngtaaaacaattttgtcaa

SEQ ID NO: 1488 - DNA, 1557 bp, Heterodera glycines
  misc_feature (1551)..(1551): n is a, c, g, or t
gatcaatgctgatcaataggcaagctcaagaattccaatgccatccctaaataattcacttcgtgaaggtgattgatcaaaaatggatcccgaagaggcgccactgattgacgacgagggaagtccggctgcagtccaagcgctgcttggctcatcactgttggaagaagcatcctcattgaaaagcacctgtgcgttgattttaagttcaagaaccattaacgttctcggacaaattcattatttttctgatcagttttcctaattgatcaattaatgtaaccagccaattgtctgatcagctcctgtccaattaatcataatttgattcctatcgaatttcaaatccacttatgcataatttggaatacatggtgaccaatttgtatttgattagcaactattttctggcaaaatttgaatccaataagctcttgcctggcacttaattcatcctcttctgatcagtccctgatcctaattagccataatctgattttttagcagtcactgaccataagtttatcgctctctaatcaccaaagacattagtttttccatttgatcaacagtattttctgatcaatttgggatccatattgcctggcatttaattcattttcttctgatcagtccctgatcccaattaatcatattctgttcatcacttagcagtcactgaccataagttaatcgctctctgatcacctacttttgctcctctttgctgcttttccttctcctgcttccgttcacttgccactgctgtcgttgttgatgcggcagaatgcaatgatcgggaaaatggcgaaaacggggagtagaaagaattcggcgcggacaatgaggcagtcggggacactttaaataaaatggaaacaaaatgccaaaatcatcaacaaaaaaattctgaatgtgtgagcgtgcgcgttgtgccaatgcccaaaaaagaggtggagcatttgtgatacaaaaagtgccaacataagaaaacagcaaacaaatccccgccataaaattttaaatttaccctagatttcgtgttcgggcggcatttatcggcaccgcccggttaataaatttgatcagggcgacctcttcttgatcagtctaatcagggaaaagcgacaccaaattacctttgtcagccaaatttgtgccgtactgatccatcgtggtaacagtttgcgatgccggaaatggcccagcgacaaattgtgacgatgccattggcggtagcccaaaattgccgttcgacggatttccaaagccttggccagctgcactaccgtactcagcagccgggaaagcgccggtgccgccaatgccgccaccgtacggcgggctgccatattcgcttgtgccgaagccgccagcaccagtgctggctggtagaatgccaggaatgccaccgccggtagtggcgcttccaccgtaaccgttggcaccaagtggactaccgtatggtgtcccaacagtgccgctgccggcaatgccgccaccatacggcagactgccatatgcatttgtgccgaagccgccagcaccggngctggc

SEQ ID NO: 1489 - DNA, 7839 bp, Heterodera glycines
  misc_feature (2421)..(2421): n is a, c, g, or t
  misc_feature (2429)..(2429): n is a, c, g, or t
cgacaatagttcagcatgtattcgggtgtctgctggcacatgccttgggctgcccactgctggcagccgtaaatgtgcgagtcacggcacgcaaatgacgacagtgcaccaccgtaaccggcaccattgaccggtccgataccgtaaccgccgtaaccatatccattgagattcccggctccgtaaccgtaaccggctccctcagttgaaaaactaccgtaaccggaggctgaactctggtcaatcacgggaccaccaccgtatgcagcagcaacattggctggaccaccataaccgcctgtgccataagctgtgcccggctggccatagacttgctgttctacaagtgcaaaagcattgtgtgcatgtgtgcgcggtaaaaaacagcggattatggtagtgctgctgcgtgggaatgcctaccgtagtacggtgaaagtgacggcgggtacagtaagccagcagcagctgaagagccaccaaagcacccgacaccgcaggattggggacaaagtgcgcattgggcggcactggcggtcatggcacagtcgactgatcggcacaaatcactgctcaaggtgtggagacacagaattgagagcaataatcaggtgataaaacgagaataaagaccacataggtgtgtgatcaactagtcatataatataatatgattgatcagtgtttgatcagattagaattgaataaatcggagactgagcagaaatcagagatggttaattaatcaatcaaatgatcagactgattgtaagagtgaactgatcaatcagaagaatttagagaatgaacggattagcaaatgatcaggctaaaagcgagctgctcaatcagtcaaaaatcgaattggtcggatcaaatgatcacactaaggtgaactgctgctggtcaatcagccgaaatcagagaagatcagatcagctgatcaaatacctgatcaaccaaaccaaattctgtaagtaatcccgaaaatcataatggatttatggtttcatttgccccgccggtgacctgtcctaattaaaccagaaaatagtacccgtaagcgcctcccattcctgctccgccaccgtacgggaacggaccaccagcgccggcaccgtaaccgccgatgccgccgttaccgtacccggtggcgccatacggtggaacagcgattcccggctgccagtacgtgttcgtcccgtaggacggcccttcgtaggcgctgatgccagccgcatagccaccgctgtacgggctgacatacgcgtagctgggcttcccaccgtagaagctgctggtgccgggcccggttgagtacggtgggtaaaaggaacctatgccaatcggttcgggtattatattctaagatcactgcgtacagatcaggaacgtaatcaaccgataattccatccacataacctagcaagccaacaaactaccgtagttggaacggagcgagttggggtacgatggatagtaattggatgaatagtacggtgatgctggcgatgccaatgcacaagacaggaacaagcagcacagagtggagataatggcaacgaaggggggcattgacagtcgatgaggcactaacatggaaatgtttaacattataactcaaaacccatataatggcacggtgccataaagaaaaaccgagaaatgcgccccgtcctacagtaccaagtatctacagtaaagaatacagtaataaaattacataattgcccgggaaagggtggacttattaaacacacacacgcaccatcacttatcgtccgctcattcctccttctgctgctgttcttaattttgtcactgtgatgatgaaactgtaacggtatcgtaatgatgttgtttttggccatcgcactgtcgtcgctgccgctgctgctgcacactgtcatcaatattttgggcaattaataaatgctacaatttatatcaataaaaataaagagtgttggttgtgcaactactaattattcatgaaaatgcaatggaatgcaccgatagcagcatgtccaaatataaatgctgtgtcttctgcggcgccggccgtcgccctcccccttttttgtgccagcgcgcggcccccgcggggcggtgcctatcggcctcgacaaaggggacacaatagcccacggggggtgggggggggagcgattggggtgccaccgcttcgaccgcccatccaacccgttgaaaatcgtaaatcgccgccgcttccctcccattgtgacatcaaaaatatagcaagttgcgcaacggcggttgctcgggattaaccaatgcaaatacgacgacgccggggggcacaacaggggaaagcgtcaaccggttggtctgcatcccatgggcgactacccggaatgcctgccggatcccctccttccccgctaccgttcatccctaanttccctgncctccctcctcccccggttttaaaattccccaccttcccaattcccccggtttgggccggggatatcactccccggccggccccctccccttgctctagcccttgttacaacaaattctctccgtcccgcaccccccggcggtgcggttttgggtgccgcgctcattccgtcagagtctccaaaattgtaattcctgttgctgctattgttgttgtaaatccaccaatcctcccccccccccacccccctccctccaccaaatatgatttggtgattgccgggctccgctcggtcagctcttagccccgcggcgcgtgcgcacggattgggacggtgacggatcagtgacagatgagcggacacacagcgacgaaatattacgcgctgcaaatgcggggaccaaaaattgaaaagaatgtggaccaaaaaattattaaaattttttgtgtcaatgcctacattcttagtacaaccgaaaatttaaagtctacaatttttttgtaaaaaaaaagttgtggccttggaaactaagaatagttagtcattgaaataggacttagaagtcgataaactgaactagagccgtgtttaaagtgattgataaacgtgcaaagactaaatatcgtggtacgctccagtgttagacaaaatgactcattacgccaaatagtatgtaatttgcgtaattttttgggcgctaattcaaaaattacactgataaatgcttttttgcacaatttattttggtcagccatacctcgctttatttcgaactaaatcgaacaaattttgtatctaaaaaaagttttttgaaaaggagaatctttttctaagtgaatgctaatgcaatttgacatctcagaaaaaagttatgagagtttcaaatttttatcacgttataactagggctgggatttttatgtgctaaaaatcctgaaatatgtaataaaatatgtgctaaaaaaacccaaaatatgtgctaaaaaccaaaaaaaggcctaaatatgtgttaaaaatgcaaaaatatgtgctaaaaattggaaaaaccaatggtatttacgcaaaaaaaaaacatatttaatatcagtctttatcaattttcgcccaacgccaatcaaaatgttggcgatatcaatcaatttgtaaagtcccggattaatttttccatcagttgaataagttccttccgggaactttgaaatccagtgacgatttaacacagcgttcgatttggctgctttaggcatttaaatatataaagaaattttctaaatgcttaagaaacgtaaagtagtcaatttttagggtccattttcagattttcttgtatttttcttacgatttttctcaaaaatgccaaaatatgtgctaaaaaatccaaaatagctcaaatatgtgcgatatgtttttatgtgccaaaacgccaaaatatgtgtttttatgtttttataagtcgctttaaatcaaaaattgttcggagaaaatgctatttttgggcttctctcgccataactaagccgcaaaaaaaatatgttaaaacataaaaatcccagccctagttataactcaagtcctaaactgctgatttcaatcaaaatgcgaaaactaatctttttctattggttctaaataatgttgctttttactagaacccggtaaaaaatctttccgagaacgggaatagataaagagcacgacgggaaacggaacgggatttccggctttttcccgttcccgtaaaaatcccatcaattttaacgggaatctgatatatttcaacatcatcgcttttcgtaaaatacgccaattttcgcagtcaattctcaacgattttccatcccttcgcgttgtcactttccatgacggcatttcgctcgcttttccgcccgatgacagtgccaatgcgtcggatggccaagcgttggccaaatggctgttcacggctcatcccaacaattttatgaagaaactcattgtcaaaattgagtcagaaatggagcaacaatggttgtcaacagtggaacatatcaaagcagtgattatttcaatttcattattgtttttaccatttttaaattcgttttacacattttcctctgcttcttctccggttgctttcggcatttctattgactttccgtcgtcctttccgattgactccattttgccatttgaactgaccaacgaaatgatttaggtataattgaacccaatgaccgcaaactttttcccccggaaaagcagcgcagaatttacgacaacaaaacaactaaagggtgggccgagtattatccacctgcattctggctacaccaggccaccagttagagaggaacctttttgttgcaaattcatgccatgattcagcttccgcttcaacatgcgtgccatcgctacgcataagaagccgtggaagaagcttgtggcgactgccctccacgaagggatccattgcggtgcagtttatctgcgtggtatacctaagcgagacaataactgccgaccgatggtcaaggcttacgggaaaaaactgtcgccacattttgacgcgctgagtatgatggtggagacggcgtttccttttgttaagccccctggacgtgtacgaatgtaaaaggaaatatattaaacaccaattttaaagagattgtttatagaggagctcctccggcgacaacggcagttgtgtggtggtggtaggtgttggttgtggaaattttaaagagaacaacaacaaatcagagaaaaaaaacatttctcattttggcgtactatttctttgtctctgttaataagaaaagctgaatttacttcgtgacgtttaattttttttctacatgataaatccattttaaattttgcttaccgatagagaaagaattaacggatttttaacgctcgaattttagttttttacgctcccatctaaagttattcagaaaacaaaatttcgaacgtccatatctttttgctctgtgttaaaattcttagtatttgcttagaaaaagcttctcctaatcaagagctttcgaatgatatcaagattatccagtttggatggcaaaaaccctcaaaaatgactctgaaatatggtcattttttaaattttttttctctgtaaagaaatagtacagcaaaatgagatttcgttcttgtcattgtattttgtttctcataatgctagtagtgaacttttttttcagttcgcctattttttaaaaattttgtttgaaaatgtcgcacaatccgaagaaagcggagaaagaaatggaaaaagcaatgtgaatattcaaattttaattcccatggctaatcacttcgctgtttcagcttcatctctgccgattgttggcttgaggtgttcgatttgcttccgccatctcagcttggactggaaattgcgatgattagtcaccgatttgaccgccgcgtggacgaacacttcaaaacacgaaaatggaaattgggctacatgaaaattcgaagcaaaattggacagaatagcgcaaatgaaatgataattgtcaattccaatggaaaagaattgccaattccgcaaattccgttgccgaacaaagtcatggcattcagaagcattgcgatcttgtaaaaattaaattttaaatggtttctgccattatattttctgattttcagcttcttcgacgaaaatgtgatcacttttctcggccgttttcaacgtttttacgacatttgtgaaacaatgttgtacattcgcgctgaaaatgttcgcattttggagtttattgtgctcaacactttgccaacgctcaaggacaccatcaaaaatcgattgcccagacctttgcagtgttagtttcgaaggcgccatttttcccgcttttccgcccgacgacagtgccaatgcgtcggatggccaagcggtggctaaatggctgttcacgcctcgtgccgacaatttgtggaaggtgctcagcattgtgaattcaacgatggaacagtggttgacaaatgtggaacaaatcaaagcggtgatttgcccaatttaattcattttttaaaattttttttgtcttatttttaggcattttcggatgcttcttctcctgtttctttcgtaatttactttgaatttccgccgccctttccgattgattccattgcgtcatttaaacggaccaacgaattgaccagggagcaattgacattgtcaccgtttgaagaagaagcaaatgttttgcagctcatgcgttgttcatgtgaagaaggaagtgaggaaaaatggcaaaaggcgctgaaagaattgttttgttttcatccacaaaaccaaattgacatttggatcggagacgacgaatgcgacgatgggtgaattcaattttaaaaatctaaatggtaattcttacatttttattttttaaggcttatcggtgcttcttccgccgggccgagtggtgatcagaaagagcagaaaaaatgaatcgatggttgattgattggttgatgtgattatgtgatccaaatgttggacttagccatttaaatattgttgtatttgatttttgcttacaaatccattaaaataagttaggctttaccaataattttaaataaaaaaaaccctacgggaaatagattatttaatgatttattttttgtcccccccatttttcagccgcttatttttttaaacctttaacaattaacataaatttgattttccatgttaatcattttgcttttccctttcagcttcatctctgccgattgttggttggaagtgttcgatttgcttccacgatttcagcttggccttgaaattgcgacgattagccaccgttttgattatttcgtcgacgaacacttcaaaacgcgcaaatggacattgggcaaaatgaaaatgggaaagaatggcgcaatggaaatggaaattttcaattccgccgatggaaaagctttgccaatcccgcaaaatccgttgccgaaaaaattcatcggattcggaagcattatgatcacgtaaagtgaatttataagtgatttgtgaccataagtaccacttatttccagcttcatcgaccaaaatgtgatcacttttcttggccgttttcatcgttttttcgtctcatgtgcaacactattgtccattaccactgagaatgttcggatttcgcaattcgttgtgcgcaacatttggccaatgctcaagaacaccattcgtgagatgcagtttaaagtcatcgcttttcgtcaaatccgtcaattgatcccgtccattctctgcaattgtccatccctttgccttgttttctatgacggcattttgcccgatttccgcctgaggacagtgccaatgcgtcggatggccaagcggtggccaaatggctgttctcgccacgacaatttgccgaagatgctccttgtcag

SEQ ID NO: 1490 - DNA, 1494 bp, Heterodera glycines
ttccgatttccgacatttatggggtcgctttccgatttccgaaaaaatttgggagtcggaattccgatttccgaaatttttgataaaaagtcggaaatttttttttttgaattttttttccaaaaatttaacaatttttgtacaatttctgttaataaattgcactgaaattttcaaaaaacttcaaaaagataccgagtttgaataaaaattgcaaaaaaacaaacaaaaaaccattataatttatcttcacagttttaaatactctaaaataaactttgcaggaacaacattttcctttcgttcgaatttaggtcatttcttaaaaaaacccgaaatattcgtgattttaaactaaaatttaagaatacaataaaaaaaataataattttgattttaaactcaatcgcggaacattctcatttcttttttctttgaactcgccatgtttcagaataatctgtttcataataccggtactctgtgaaaaattgggaccttactagccgactctgcgaaaaccatatcggtaccagttttttcttctttttttttggtttgtaacggtacgaattggtatttatccaaagtgaacattttttttgtttttttttaaatttttaagaattcaagttattctatttttctgcttaaaatcataacttgaatcaaatattcacaaaatcaaagaacgagacgaaataaaaaaaattttcaaaaccaccaaatgtgaaggtgtaacattgacctggaagatctttattttaaataaaattttcattttattgctgtaattaatttaattatattttgtttctttgctttttttacgtgtaacaatatgaacattcttcatttgcatgtgaatacataataggtaatttcaagggtgtttttaacaactatgttttccctcaccctccctatcccctccggcatattgcattgattttttgttgtttcttttttacggatttaaaaacttaattattttgcataaaaattattttttgagaattttttttgaagaaatttcaaatttaattaaattcagctacattatttaccgataatggatatttttgacgaatttattgttgttgacgaaaaagcattcaatggtctgaaagccgaggattgtaattcatcagcagcaggtgttaacgtttatgtgccaccagcttggcggagtcgccggtaatgcatatgctccagggatggatcggatccgactcccgaaaattatgagctccggaatcttggtttctaaaaattttgggccttgaaattacaatttctgtaattttgtacatcatactgtaattccgatttccagatgtattgaaacctagtaattcggttaggaaatttttgaggatcatatcaattcctgatatatagggctggtaattttatgtaaatacatattttttctggtttcaacggggggtaaatagtaagaaaaacactttcttttttgtgtttgcgagacct

SEQ ID NO: 1491 - DNA, 10856 bp, Heterodera glycines
gtgattgatgatttgttgtatggaaggggggggggctgctggtcagcagcgcagcagcgaggaatggcgcgtgcatggggagctagagaaagagaagagagtgaagggaaaagtgagagagcgagacagcgagagtttgtgtgttgggtggtgttgtgtggggtgagagatcgagaaatcgttatagagtgaatggaaaagtttgagaggaaaattagagtgaaaggaaaaatggaagagtgaaagagagagtgagagaaacaaagagagtgcagatggatagagaaatgtaaacgatgaccaacaagtgaacgcatagcgggcattataagcgtcatttttcagaaaataggggggcgggtgtcttaatgaattaattttaattatttttctagtgtttttcaggttcaaaaaatttttttctcaaaaatgtccggcaaattgatcgtggcagaaagtgacacgagcttggacgctacaaattcggtgagtggagggggaatttaatgaaattccaacttttaattttttttttcttgttaaagttaattattgacacgaccaaagatgtggcggtggacgatggcattgccatatcagctctacagcagcaggttaagggcggggggtcgggatttaaagataaattaaaaaaaataataataacttttttttatttttttttttgcaaggtccaaaacaatgacggaacggtggaaaaggacggcgacgtcgtcggtggtacaacaatcggtggcacaacgcacggcggaacgggccctcaaattggacaagaggtagagctggagcggcaggaaaatggcggcgtcgttgatggcccagcgcttggtggaaccgacatcggcggggcgcaaaacaatggcggcactacggaaatgaacaacggcaccaccgacacagcagctgaacccgaggtggagttttaaaattttgtaaaaccaaaaaaaaaaaaagaaaattttgtccaaattaaagatgcaaattgccagtggcagtggtgttggtggcacaacggagcgtgacgccgggtctgaccgggtgctgaggagtgcaaccaaggcagaactgatgaaattgcaggtaaaatttgaaggagttttaaacgaaaagccttttttcgggtgtaaattgtcatttttttttcaatcaggcaaaacagcgtcgtcaaatgggcaagcggacgggaggcgcgccacgcggaccaaaaattgtggcaggtgcatgcgcgtcacccgagcggaaaaaacgtcaaacgaaacattacaataaattaaaccgagcaaatgtaaataaaaaataaaaaatttttcattttttatttttttgaaattttaagatcaccgtgaccaatagtgccccgaatgttccaacaataattagaacgcttgaaggcgagaggagttaccgcgtgaaagctgtgttggcgtcctatactcatacgaacgggaaaacagcgtatttcctcgactggttgcgtaagtggttgtgatacaaattaaaaaaatttttattttcatttcttctcacatttttgtcactatttgtttggttatggacgagttgtcaccgaatagctcctccataatcaaacagtccggggtttgaatgtttgttgccgagttgtcgctgaatagctccgcgcaagcgtttaaattccgttccccctctttctctctctctctcttttaattttatatcagagtcgtaaatataatgattattaattaggcgcaaggggtcaagagtgttggattcccagcgagtcgtgtgattgtcttgaaatggcaatagacttcacaaagaaggcgaatgtccacgatgttctccgtggattacttggcgagccaattgctgaaagtttggccaaagaaataatggcgagtcccaaatttatagaaggtcattcattttttttttttttgaattttgaattttcacaattattctttaagtttgtgaattattgggccgggaccctgcgacggtgttgaaatttgatgaattgaatatttcttttgctccgtcgctcaatgtggaggatattcaatataaaaaagtttttgttgttaaaatttttaaatttcacttctttttttttccaggcagttgggcagttgggcgaatttataaaaaattgtttggaagcggcaccggcaccagagcaaagcgatagtgaagacgaatgaaaggaaaaggctaacaataacaaattcaatcatttttaacatttctcaccaatttgctcttacataacacattcctcactatatttcctctcacaacaacataaacatttctcacccatttctcactaatttcctcataaacatttctcaccaattttacaattttcaccagaaataaatttaatcgtacatatttataaatttaattaattacaaaatattgatgaaaaatttaatgttccatgtaataattagtcagagttttacaatatggacatttctgggggtgctcagaaagggtcaaatgataaattaaacaattacggcatagcccgacatgtccacactggccataaaattgggcagtgtggacagtgcacaggcagagtcccccctcagtgggataaaacaattgtgtgggaaaatggacggctcccaatgggtccccccaccgaaaaagttcccgagttttgcggccttcttgttgcgccgcctccaatgggttgcgtgccgttattgccattagcatttgctggagcgtcagcggcccaaattcgcggctgatgcgcccataagggagtcccatgcgcattctttctttgttcctctcccgcacactttcgcacgccctgcaccgggccgaatggcactcgccgcatccttcagcagaacagttttattcaaatttattttatttttaattaaaaaatacattacttgctactccaaacagcgatggtgcaattgatgaacatttacgccgggacattttattaatttttttttttttgggggcttgtgtaatacagtgaatggaccttacacccgctccattttcaatccatgtgccacccccccccttctcagtgtctttgccagattcaaattcggcaacccaattaattatcaccccagatttcatccgaagcaaacacaaaaaaaaaattgagggactgtctcaaaaaatgtttattatgcagaattaaatatcaaaattatggggattgcatcatcaaaattcatatcccaaaattatctttcggtcaaatttcattttttcttcattggcgccaaaagatcggttgcgcggcagttggcccacacgcattcctcacacatctcaaagccgaaggcaaaacggtccccctccaggcgcttcactttctgctggttgttgtacagacgattccaatcatctcaaaaattttaattaaaatttgcagaaattattagtaagtattaccatggcacaaataggtggtcagcaaaaatttgccttttgccaatttccacaactctcggtcgtccactttgcgtttctttgttgccaactcatccttcggctcaacatttttgggcgtctcttcatgtggcttgggcgactcgggaccaattattttatgttgctcagcaggagcagtagcaagggtagcaacgcgtctcttcattttgacaaaaattggtaaaatgattctgggtttttggcaggcaaaatgttttggcttttagtgggcgtgtctaaaaccgtgactgttttcaaatggtgtgtgtaggcgtggccacacttttgcgcatataaaagtaaaatttttcaacctcattccaatttcattctcctgccatggttcttgtaagcacattttgcgctcagcttctcaactgccctgtcaagtcattgcgcgaccggctcaaccacccagaggatcgggcgcttgtgcttaaacacatcattgggcgcaaagcacgcaccacatacaacgaccgtaatggattgaccaaaactttcttcgtcactggaatttcggtgcacggcgccgcctttcttcccgcatatgggcaattgcgcaacccattcaacatcaatgtggcggcgcatttttatgcacggcaccgcataaagcttcacttcccgtatgcaccgtgcataattgaacgcttttcggggggaggggaggaccggcactatccaatggaacttcttgagctgattgatgacaacatggacatggacatcaacaacaatgagcattggctgggccgtcttttcactgaaattgacgaaaaacaatcgtcgtcaaactcatccgacacaacaatgcgcctagtatttgagggagacatggatgaagacagcggacgcaatgaatgctcacagagtactgtaccgttatattagttttgtttttgctcactaattatgcatttttcttccttaaaatgaccacttccatctattaatttgaaattgcattttccattccttaatttttcaaaaatcgtgtcttctttagcttaattatgcactttttctacctaaaaatgacatcttctaatgcttaattatttcataattacatcttccattcactaataatgcacaaatttttaattaaaaactaataaaatggcataaaatgtacacaatttacaatttgaggtacaaaagaaatagtcgtgtgtgtgtgtgtgtgtgtgtgtgtgtgtgtgtgtgtgtgtgtgttgtgtgtgtgggtgtgtgtgtgtgatagataatgtacaaattacaatgtgtgtccaaaattcaacacattgaaattggccccgatgattccctttcccacaaatgggcgatagcacttttgcaaaggcacggaaaccacccgacctccctccctgatgtttgcacgaaggaagttggggtatgtgatggatatcggctcgtattcaccacttgtcgcgtaccggaccacctcctctttgaagttctcatagcgcatcccctgattgttgatcacatcataatttagcgtcagcccgcgcactttgagcacatgttccaattgggctccctcttccgcacccttgcgtcgcagacaaagaccgtactaaaaggtggtaaaattgaaaagtaaacaaaaatgaactgaaaatgcacttgttttgccccgccactgcaaaattccacaatgtcgtggtcggggtattcgtcggtgaactggcccaaatggggaccagttttcagcgggcaccgctcctccgggtggacgaggatgaggctgtcagtgtctaaaataaatgtttgtgcacaaaaattttttttggtagtttgacttaccagtgtacaacagatccgagcccggtgatctgaacaccttctgcattgccttgagtagaacgaggcgcgctgctgaggtggtccatagtgaaatgactgaaattttataaaaattaacaatttattgtgagtgtgtgtgtctcaccaatgttggagcatgagtgctcatccacccagtccttcttctgcagataggtgatgagtatgtgctgctcgtccaactcgtcgattgatgtcacttcgatggatttgttgtccaggtactccgccaaagtcgctgggtcgtcagtgatgagtgtttgagcgagtccaaagttgcgaagcgaaaatcgaccccctaattttttaaaaatatataataataatggacgacagtactcacataagttgttcaagcagagcttggccagggaccgcttccctttgttgaccgccattttggttgggtcgatggtgatgtcgaactgctctgcgcactctcggacaaactgttgttccttctccgcatcgcctctgatgctgttgtcaaatccactggcctggatcttctgggccataaactcagcgatgtacgggcggaagagcttgtcgtcactttgctcatactccaacacgcggaagacctttgtgacgaggtaaccctcgtccaacgcctcgttgagctcaatggaggtgcacgtgctcacccacccccgctgtctgtcattgtgctcgcagtggtagttgggattcacaccaccagtcggatgctctttggcacaagtgatgcacagggggaagcaaagccgctctccaactttaaccggcagaacgggcacgtcgacgcgacggggtggcacaacccacactttgagcagtgccaaagggtaggggttgtccgctgcactgcgccaatccacttcctggttcaacacatgcacgtttggctgtccgatagggtaacgggttgtgaagctgtgaaggaaacaatgttaatttgttacaactttaactgtgctcactttatgtacgggtagagcgatgtgaagtcataataggagattttctctcccggtccagccttgcgcagcagcttcagtggtccagttcgccctcccataaacgcgtcgcggatcaccagcgggccatcatcgacgtagtcgtcaaatgccttgcgcatttctttgctcctctccagcatccgatggatttcgcattcccagtagacgtccatccggttgacctttcccctcagaaattccatccgcttggaatcccgttcgcgcacttgtcccgcagtcttcccattggggagcagcatgttgtcgttggggtaacaccttttgcacccgtgacacgtacagccttaaaattgcccattttataataatggtgaaaaataattaactcaattaccattgacttcaattgcgcgcctttccgcctcaatccacccatccaaggagtagggcccaatgcgcttttcccctccagccgcgtgggctgtctgcacttgcactccatgctccttggcgtaccagtggaagaagcgtaaggcgagcaggctttggttctgcgcgttgtcatagccgcgctcgggcacaatggccaagtgctcgtcgggcaggtggtttgtgcggaagtgtcgcatgcatgcccctgcgatggtcatgcactcacgcaacacatcgatcccgtcgtggttctccttatcgtcaatcccgtcaacgtagtcttggcgccgtgaaatttcgaagaattcccggcgaaaggcgaccagagctgccatcaatatttccacatcgttggtgcaataactggaaatccaacaaaattattggtattgtaaaataatttgaacacacctagctaacgcctcatccaatttaaagggctcatggcgatgctcggcgtaccattcgtcaaatttctgcctcttgctgggcatcattccactagccaagtagtcttcgggcgtcgggtgaatctcacggccgtagttctcgggtcggttggccaaatgggggaagaagggcttgtcctcgacgtccagaccgtaggaggggatgagtgccgccagcgcgcacggcatcaaattgaaagagtcccggaagacaatgttcgggttgcgcctcttctgcttgcgtaccttcatctcatacattttgttgccctgacatttttaaaatatttttagacaaaaaaatcataattgagtgtacccgtcgaagcatctccgggttgaacccaatccggaatagctcgcgaaagaccagaaccatatcgaaccgtccgccaaagtgtgagtaggcatatgtgtcgtatttggctggtagttggaagatgagccaatccacaaatgcctgcagtgggttgtccgccacaacacgtttgtccacacgagtgtcctcaaagggccgatggcagaaagcgacagttcgatgtggaccacagattctacagcccgctgttaccctccgccaatttccgctctcaatgcactcagggcacgcgactcgggcagcgatgaagttgggctggtgctctctcttctctggctgctgggggtccactggctgatgctgcatggtttccaagtcgaaagccacaatgcggtacgggtcctgctcttttggctcaatgggctgaatgaagcacccccgctcgggattgtgaaatgtgttgcacagctgacaataggtctcgtggcatttgtgaccctaaatccagcaagaaatacaaaattttattttatttttaatgtttacttttctcccatctctgttatgtactcgtgtgtcccatataacaccgcagtccttgcattgctttgacttggcgcaaaagttggatgccaaatggtgttggaggcacccgttattgcgaaactttttattgcaacccgcacattgatggaaaaagccgcccaatggaacacacgggaatgcaggcccgacacgtgagcaaagcaaacagcgcgccttacaggaattgaggtgccttgacggacgctcataaggcttttcgcagtcgaggcagtagggttgtccaaacaagccatgcaatttctgcacaccatcaaaatgctggttgttcaaatagagcacaatgggagtgtcgtaatgatcgttgatgtatttgtacaagggcttgtattgtcccgatgatccaaagatgaacactgcaaatcgttgctgctgttgcgtgttgttccagtggtcgaccacacgcggcacacaaatctcagcatcataggtgttccgaccggtccgtacaccaatttgctgcatcagttgtaaagcatcccgcctcagacatccctgttgtcccctccgactgtgcaagtagtcgtaaaatctccaacggggccaaccgcacgttttggccaccattgtcgcctgcaaggcgtagaagaggcagtgtccgtcggggttgcaaatcttaacaaaattgttaccaaatttattttttattgtgatgttggaccttaatcaaacaagtttccgtcacccgatgatgcactggtgctagacttcgccgagcaccgcccttcagcacccttcggccgggcagtccagaacggtcaactgtggtcaccaccacagtgaatggctcgccccacagtgtgacgttttgctgctgcttgctctgtgccactttggtgaactggttgaggatggtgtttacggtgttgtcggtgatttgtcgaaccgggatggggatgtccccgccggtgagcaacggactgctgatcatgcagccgagatgcgtgggttcaattccacgtccacgactctcctccatcgctgcgtcaaggcagtactggaagatgccggccaggagtccctcaggatttgcttctggcacatcctcaatgctgaaccgcgacttgactttgctgtactggaagcggggcacatgctcaacggtgctgtccagctttttgacgtattcctttgcagactttgatgatgatgagctgctgccgccgccctcttgaagcacctctccaagcaattcattgatgagaaagccgcgacgcggctttttgcttgggaccgatagaatttggtcaatggaaaacaaaaagggatgcttgggaggctgattttgcattatctaattttacagggaaaaataatgaattgaatggataaaatgaacaatcttgacacatatttttgaggcatggaaattgtcgttgtgaatgcaaattaatggataataataataattttaaaaattttaaaccaactatgccctgaagagcagcgcactgccacccatgaagcacaagacgacagggcacctaaacggctcgggtaattagtaaaggtcacgcgcacaaccccaagccctaaaagacacacaagtgctgccaggataaacggagcccaataattggagcaaccgccctggttaacagcaataaaataaaaattttattacaattttattattaaagtgagtaaggatatgagcagatgtgaatgaaatgtgatttggactgagtatttatgaagcctaggggcggggtgtccccatccgaataccaattaattttctcgaactctccttccttattgtcggcaaattcaaatttcctttgaagttatctccttcactattgtcggcaaattcaaatgtcttttgaagtcaatattaactattgaataattaatgagcccatgagaaccgggcacaaaaatattttaattcactcttcattcattcattcaatcaaatttcatgaccaatatgatgcccaagcgattaccagccgagcttctcttcgaaattatctactcactgcccataatgtgcttatttggcggggtaacacccaagccaggtgggaaaaaaaaaattttaaatttcaaatttttcgcaaaatttaaggccgtccaccatccggtatcgcagtggtcaatcgaattatggaaatatttcgggccaagcgtcacccaaacttcacccaaattgtaataataatttaatttaattttgtatattttgttaatttgtaaactcagaaacggcttgctctcaactttgacatgatcagtgcaaaaggatggatgtcagacggacagctctacctgcatttccgtttcaacaacaatgagctgtgtgacccgggctttttcaatgagttcgcccgatatatttgcttcggcaaatctgggcgcattttctgctcccgaattttggtcgactcgcacaattcgctcgtaaaacttttgaactatttttgctttttcaattttatggtaaaaatgttaaggaaaatggtgcactttgcaatgtggtgctcaaccacatcacaaaaagtgcgaacccgttctcaatgaagaagtgcacatccatcgatcttgtgcaccgcgacaattttccggcaatcttgaaggcaacaccgagcgaaatggtagcatgcgggattgagccaactgagccttttgtcgccaatgatgatgatcaggcatacattttgaagaacccgcattttgatgatgatgaaaatggctatcttgaagtttatgctcaatcatcggggtttttattttttctttttttca

SEQ ID NO: 1492 - DNA, 1214 bp, Heterodera glycines
  misc_feature (75)..(75): n is a, c, g, or t
  misc_feature (100)..(100): n is a, c, g, or t
  misc_feature (115)..(115): n is a, c, g, or t
  misc_feature (160)..(160): n is a, c, g, or t
  misc_feature (169)..(169): n is a, c, g, or t
  misc_feature (172)..(172): n is a, c, g, or t
aggacgtttgataactaagtttgaaaatttattacatcccctaaggaagaaaaaatttattatcaataaaatttnaatacttaataataccataaaattnattattaaaattaantaatatttaaaattaataatttaattaattgtttagtgaatttgntcgattggncgnccaattagcgcccttttcgctgttccccagccatcccttcggcactttgttccccccaccgccaccaccgtctttgtgttcgccgccggctacggtattccgtgcgcccgctaccgtaactgctgctgctgctgaacacggaccgcatactgtagaggaggaacaaagcaacggtaatcagacagacaatccaactaaacaacagcagcagcaacaacaaaatgatcagaaaaaacaggtgaaaatgataaatattttgaattaatataaaagataaaattaattttaacttttaaatgattaaaaagaaataattataaaaaagcatgttaaagaaaatataagcacaccatttatggcttttcattttttttaattctattaataacatttaaatatttaattcttttttttaaatttattttgggttttcttttttaataatcaggaaaacacttaaatattttaaaattttaagataaaataaaaaattttaaaatttatttctttattttttgtaaattgttctggtctttttaaattgtttttttttgtgttttttatttatttttattttaaatttttaaaattttgcccccccccccccgaaaattcgttcccatcccatcgcgcgacaatatattcaaattttataggggcaattgttctgctgtcccccccccctcccaaattcattcattttgggtgcgatcatagcccaattttgggttgcaacggaacgccaatggaattaagagttgacctaaaaataaaatgtgatggtgcccgatttcgcaatgtgccgtgtcgcgcggcaccacctcaattttgattttggcatccgccgtttgtgggaacccataaaatgtgcctccaaaattgggaaattctagtgaatttcataaaaaaaaagttttttttttgcttttttaatccattcaaaatttaaggaggttaaattatccgacatttgcgcctatgcccaaaatcgagttgaaacttaagttttccataattttcaaatattaactgattttcaaga

SEQ ID NO: 1493 - DNA, 5115 bp, Heterodera glycines
  misc_feature (61)..(61): n is a, c, g, or t
tcattagctgctgggatgaggccaaaatcgggtgatcatttcgacgtcacaaccaaaatgnatactgtagcggcggcgtcatgggcgacccatttgaatttggcgccgcccgctgaaagcattggccaaatgttgtcaaaaggggagggccaaatgaagcagcagcagcaaacagtcatggcaaataataacaacaacaaaagcagaaaagtgccgaagcgacggtcgccgtcttcggacgcattgacgcgatgttcggcggcaccagcggatgccgcgggggccaacggcggcgcagggcattggacgcccggtaaggaaaaagagaaaaaatgagactttttgccattcgccgtgggaaattttgacttttttgattaacaataagtttttccagaatgatcaaaattttcaaaaaaaaaaaatttttttaaccaattatcatttaattttatttttttggtgccaataaaatgcatcgtttggtggtggcggtgccgaaagaaaccgccggaaaaagcagtagtgaacgtgttttttaatgagatgctgtaagattttatgacctatttttcagaaagccgtgccgtagggcaccgccggaggaaattttagaaaatttattcataaatttgtttgtcgcttttgcaaaaaaaatttcacattccatataaaaatttaaaaaaatatgaaatctcccttaaaaatggctgtaaataatggtgggattcaaatttttttttttaatatccttctgcctaagggctaaaaggcactgatgacaagaaaagaattgaaaatttgccaaaatttaattatgtataaaatttagaaaatttccccaaaaagaatacatttaggctaaatattaaatggccagcggatcatttactcattttttggtctctaaaatgccatcgtttgatcagttaaatttaatttctcaattcttcagtcattcaacagtataagcatggcccgtcgcaacaacagcagcaaatgggcaccgcttcttcttcttcttcttctgttggcattggcattaataataatggtctatgaaaaaagaaaatttaaagcaaaaattgttttaatttgtttttatttttagcgaaacaattaaaaaacgtgcataaaaatgtgatggaattggcagcaggtgaacaaatattatattatatgtactctaaattaaattaggaagaattattgaattttataacttggacttccaaccaaaattaagaaaatcttttaagattattaatatatttgttcaaatgccaattataatagatttttatgccaaaaataaggaaaaaaacacaaaatcttcaaaatattacaaaaatttgcaaatcttaattttgttaattagagcttaaaagaataaatattacatgaaaatgcaattttatatcctttttcaattttattgattttctaaattaaattcattatttttaataaatattttatttaaataattttgtctttgaccgaattaataattctccccaattttccccattttccctttttgatgtcacttgttcctcctcttcatcttcccattttccgcttcttccccctcctcctcctccttttcttccgcatttttcttcttcttccgtccctccgcttccgtcgttgcccaatttcaccgcccctccgcttctccaattgctaatgttacgcggccgaattggcggtgccattgacgagcatggcatcttgggtaaacgattaacatttaaattaaactaaattttttatttttattttaatattaaaatttcaggtcctccattggatctccaaattgatcagccaacaacaaaatttgccgattcaacaacaacgacaaagacaacgacggcacatgtgccaccgatcatttcacaattggtgggcactgacagcagcagcagtagcagcagcagtagcaacaacatcactgaacagcacaaattggacgcaaatggaggcaaaataaaaaaaattatttaataaataataataaaactcaaaattcatttgtccttatttctaagatttgcccttatttttgtctatcgtccttataaaatggcaagattattgaaaatttatgagtaacatattggctaaccttgattagttgaatgaaattaaaatttagatttttaatcccaaattatttttagcctatgatgtcacttattttggaaaattttcgatgcgaattctaaattaaaattttattgttgtcaattgagctattaattttttaatataaattaaacaattgtccattgataccatttcatacacaaaatactttttaaactttatttcctatttaattttttgccgaaacaattaattaattaattggttaattaattaattaatttagcaaattgcccctcctcctcctcttcttcgtcaatgctcggcactttgttagcgctaccgccaaatgattgccgaacatcgcccactgtgcctgcgtcgaggaccgaattttgtagcggattggcactgtccaatgggaacaaaaaatgtgccgaaaatgagccgcagcagcaaatgggccaaaatttggtgccaaaatcaaattaaatatttattaataattaattttttgaaggaacagacgccaaaattgttgcatttttcgagcactttgacgacgatgaacaacgacaaaacattttccaatttgaacagtgacagtgaacaatcttcatcatcgtcggggggacaaaattcgccaaattcggcgcacacttcgcattcccagtgattaaaatttgaaatttttttaaatttaaaattaaaattttgaatccgcttacagtacttccgattcgccaccgtcaacgctgcccggcgcgggcagtacggtgacgacagtgtgcggcagtgaccgtacccgccgtggcagttcatcgccgtaattttaccagcaaatagatttttattcccttttttgatcagtaaacatatgaaagctaagcaatggaatatagagaatagatataatctaatcttttttaaaagcacaggacacagagagataccatctgatcagaaagaacaattactgtaaatttttaactgttaattgacggaaatttgataaggaagataaactgatcagtgcttctagtgatcagcagagccttatcctatttgatatttcataagtgctgccgatcactttgaatagatcagaaacactgacagaaattcattgagaacaagctttttaaacctgtaatgatcagaatgttcagtacaatcgattgatcaacaaaaaaaaaaaaagcatccggcaactatagttgtccgattaagcatggaatgagtgaatgataatctgctttttgactgcttatcaatgcttggatctaatcagatattcactgacccagcattaattgttgggactgaaatttagatcggaagctgataagcattcttgcttctgattagtttaaattgctgatcagcgagtgatagcttgagtttctgatcagaaattactgatcgggagggggaagtgatcaaaaattggaggctgatcaaaaatttgcttgacattggcagcacttcgggctgttccggcgacgactcctcctcactgctcgcgtgcgacaaaacgcggggcggcggcggcagtcgcattggcgacgaagcggcggccaatcgccgcccgacgcactcacaaagttcgccgcccgcagcgaccgcgtccgcgacgacgacgccaacgcgcgcaaaactgcggaacagcgaagagttggaaagggtcagaaaaatgaaaaatgattgaaaaatgcaaaaattggcaaaaaccaatttcgaatgggttttagaaatgaaaatgacaacataaaaacaatgaatcaagaaaaaacaattaagtaatttttattgtttatggccaatagtgctgtttaagccgaaaatttcccaagactcgagaccgagctcgagattcggcccagagactcgaggccgagaccgaaaaaacccgagacttttctcgagtcgagaccgaagaccgagactctcgaacagcactaatggccaaagcttgaatgaaaaaaccaaggttgtgcatttttgtaatttttgcatccgagtgaatcaaatcatttgaaataaatttttacaaaattttgaacaaatcttttagcttttttaattaaaacaatataaaatttaaaccccaaagagaagttatgatttgaaattatgtttttattttaaataaatttttgaaattgtaaatattcccccccccccccttccattcaaattttgccatttcttttggtcctgttttaaaagtttgtttttcgcaacgaattgctgcagtacatggaccgacgaaggcgcaacaacgaagcggccaaacgctgcagggcaaaccgtcgcgcggtgttcgaataccgttcccgcaaggcacagctgctggaagcggaaaacggaggtgcgcttctaattaatggcgcgagccaattagaaagggcactcactaattgaggctaatggctaccttaaaagtctaccgttttcctaaaaattgcagtcccgaagtatccctacctaattaatggccaatcagagaaggcactaattgaggcgataccgtatttcctaaaaaaaagaagcaatcccgggaagtactgttttagagggcagtattaattgagaaaatacggtacattaattaggctcacacttattgcggctaattattctaataaaaaaaaaactcttcccacgctttaactctgtccgatttccccgaatttcttgtgccttccctgacaattccgccccaaaaatattagagaggcatcggcattctaaccgaaaatttataaatgaggataagctgaattaaattacaattaattttttgtcctttttaataaaataaataaataaatttccattttaatttagaggaagttttaatttgaatttaataataattgattcccgatgggaggcagagacgacaacaagttgtgcacctattagcgctttttactgttgaattgattttttttggaaaatgtgccaaatatattattcgacaattctatttatcccccc

SEQ ID NO: 1494 - DNA, 8875 bp, Heterodera glycines
  misc_feature (9)..(9): n is a, c, g, or t
  misc_feature (841)..(842): n is a, c, g, or t
  misc_feature (870)..(870): n is a, c, g, or t
tttatttantttggcattaattttaaaaaattgtaattcgagcccacaaaaagccgaaaaaactcgaaagagagagccggcaaaaattggaaattcagataacttacggccgaatgtataatctaaaaaaaaattgtaattcaaattccaattaaattttgttggccttgctttccatgccattttcatcatcaattgttggcattattttttgccccggatgaaaatgtttcacaatgtgcaaatttattatttaaaatatttttaaaatacatacattaaaaatgacgttcatcaattattctcactcttttttgtccaattgtctttcttatttttatccatttcattaatccattcgctttcctttgaatatcccattttaatgtattattttttcttctccaattattattatattaattattgtttacggtttaaaataataaaaattgttcctttttatttaaatttgcgatataattattttttatttaattttttataatttactttttaatttatcccatcccttcgctgtcaaagaaaagatctgaagactgaatcgactgactgatttgatcagtcatagccacccgaattggttgaatcaatttcagcattttgaatcgaagaaataaatcaaaaattgttttcaacttgcgcatcccccgggggaatatctttccggatcccgagcactgctaagatcatcgagataagccttttcttccaacccgctgcccatctgtcacattttgtccttaagcagaccaaaaaaaaaattaagcacaaaactttatttattttgattttgttagttttttaaaattatttttannactaattttttaaagcttaaatcttctntttaattatttgccttttaattaatttcttttttaattaattggcaattaattaatcggaaagattgaaacaaatatgaaaattgaattttaaacaaattctttatttacctataactaaattaattagaattccaattgaatttcgaatttttccccccaaattttatttaattagcataaagcaattagcaaaatcaatcagaaaaattgaagaaaatatgagaattgaattaaaagaatttttttttaattttactaaaaaattaatgaatttaattcccattaaatttttaaatttaccgcacaattttaaaaatgtttttgcgacggactgtcaatgcgtggcatttcgcccactgtttgaaaaatgtgccgcgcacattgtcctgctacgttctgttgctgttgatcatccactgggacaggtacaaagtgttttggtgggcggcacagcctgccgggcagcagcagcagcagcagagccaggcgcccggcacggcgccgacgacgccgcaggcgcagaacggcgccggcgggcgcgaccacgtgttcatttacagctcattcctctacaacagaaggtcagtcaaagcgaggacacaaatttggaaatggcaaacagagctgatcagctttatccatcatgtggacgttgggcgggtagtgtgaattttcatcgaaatttttgaatttttctgtttcgagtttgggttttgcatttgccactttttaggatataagaaattctatcctaatgatccggttttttttcttctatttattaattcccgggactttaagctttcatttgataccaagtttaagcaaagtaagaacaaagttatggccaaagaaacagaagatttggactcataaagtgcgctagagcccatggcacacagctgtcagctcaccttatccattgtttttgggttttgttgatccgtatttttcgcctctgctggtttgactcagtctgatcagcatcaggatgaatgaccgaaacattggcatgactgttttgagtggagttggcacgaaaagcatttttaagttttaggcctccctcaaatttttcggagcctggcaaagtgcaattgattgtactctttttggcacataagtttcatcgaagcactgacggattggtttgtgttgtggccaaaaatgcgatttctgttcagaaaatggcactgcaaaaggtaaatttgatctatgagcatttaaaaattgaaatttcccttttttttgcattttgtcccttctttttaccattgttttggcactttgtcctttttttctattttttggcatttttccctttttcattcttttttgacaattttaccccttcttttgataatttttggcattttcgtcccttattttgccatgtttttttggcattttgtcttttattttgccatatttttttcggcattttaccccttatttttccattgttttgccctttcccataggaaattgttcattcattgggcatttgtgccttggatttgttcgtgctcagctgctctgtcgacggactgcccagggacagtacgctgtttgaggacagtaaccgctcctacgcctcgtaccgtaacatttacagtttggtgttgacggacgggccaaggtcacagagacagtccaccaaattgacagtaagtctaattcatttttaagtattgattcttgtaaaatccatgagggaaatcccctaaaaatttcgtgggcgggaggggggggttcggttgagatggcacaaaaatattataaatcggagtctgtgattaggtgctaaaactatgccagaattgtgccaaaaattgcatttaaaattccatttttcattgcttcagctttttttaattaaaaaaattttaaactatatttcggttatttaagctttacccaaaagtgcccagctacaagtcgcgtggactcgttctgtgcataagccgagtgtttctgttcgagaaatggcaattgctaatcaccgccctggagacgtatcgcctgtttaaagttaaatgaggaaaatttcattttgttttttaatgatttttaatatctgacaaaattttaaaatgcaatttaatttaacaacttttaaactaatgcatttccttttaaattgaaaagaattttatattttttattaatattaatgaatatttattaaattattttaacttattttaaattatttataatttttttatccatttttggtcgatttggtggtggcgtacgtccaaagtgccattttggccgtttacgagctgatgaaggcgtacgagcgggaaggactgctgcgggttcgacccggcattcgttttccgcaccagcgcggaatgccatgggacccaaacgcggaaacggagtccgacgcaaattaaaaaaaagatttaatactctagaattttaacaaaatattttaattgccctaaatttcaacaattatcaaattttccaattaatcggggctaaattgaatatttgaatacctctgagcctaaaaccgcgaaaatatttcattttggcatcatagcattaagcaaaattcgccattttagcatcttttcgacaaatatggataattttgcttaatataaaccaaattttgcaattttgtatcgttgatagcccaaaattttctttattatcctgcaaaatttcaaaaaatttggtaaacgtttgaaaaagtagcatgaaaataaataatacatattttggccataacttatattaatttgataattttattttaaattttggatgctaatagagaaacagctggggatatcgaatgacatcaaaaatctaaatattattaaagtaaaactatgccatattttgtcgaaaaaatagctaaaatggtgggttttacgaaagcatgagccttaggcaaaattgcagattcaacggccaaattctgcttgcccacgactgcttctacgagtaccggcacagtgcccaattcattgggctcatcgactgggacgacttgcttgtgccgtcccggcactttgccacactgccggaggcatttgcggccgcttctgccgcccacccggacaccgcctactttttggtcaacaagctcgaggcaagctttgaggagcagctgggtacggtgtttttgtgggggaagaaacggtatttgtgaaacaattttaaatttttggcatttattcaaattcacttcggatgccatcctgtggtttttgctgacaagttttggcaatttttgtggatcaacgtggcggattccgttgaccatttatggaattcatgaagatttaggccagggattcgattttcggtttctctttgcctcgaaaattttgtttttgtttttttgaaacccgtccattaaggtttttcttggcaaattgaagccgtatttttttttaccgatttcagcgcggttttaagccaaacgcataattttgtgtaaatgcaagagaatttttgggttgcctcaattaaaattggggacctcgtaaattgttgaacttggtttttctaattttatcaaaaatttactgtgcccatatttcggtttattgcttttccactcataaaaatgccataatttgcgcagtgacaaagccgagtcggttcagcctgcgcaaagtgttgcggcacggcattcgcattgcccaaatgtacaacgacgagaaaatggtggtgcggccgacgcaactgcgcggcttttggatgcacaattcgtttctgttggagagcggcaaacggccagtgaaactgtacaccaactactccattctgttgcatttggccaacgaggaggtgggaatagtgccatcagtggtgttgttcttgaagagtttcctgtctcggttctcgactcgagaaaagtctcggactgtactaattctaggaatattggcctagacccgataaaagtctcgggtttattttgaatattggcctagacccgataaaagtctcagatttttcaaggcaacctgaatctcgggctaaagtctcctcaaaaaccaaaaattcggaccaaaaagcgagccaatcaacgctaaaatggctttatttttttacaattatgttcttttgcgaatttgtttgatcactgatcgaaaaaaacattaagcgagtgcttccgggcgaatttcaaacgccgtttatggccaaacatgacattgatggcattcatttgcacgcctcgacattactcaagaacttggataagcaagcaaaagtaaataaatcatattaagtaatattttttgttttaatacaatatttaattctagtggataaatttttggaaaattttatgttctttgcgaattttaaacattcaaacaatgcattttctttggatagcaaattttataataaaaaaacgcactcaaattaattttggccaaattattttttaattttttccattaaatcgtcataaattcgctttttcgtcatggtctcgagtcctaggaatctcgaacatatgcttaaaaattagcaatgaagttatttttctttgacttctggatttcttggttctacatgtaatacatctttttttaatgtgtttttcctttcttcttctcaattcagtcccgtgccgcgcatcaattgccctccgcgcagccattttacgcggcattggtcgcgtgccatagccgaatttttgcctattacaaagcaccggggtgaacaagtcgcgctgtctgtcctacagtctgtgcgtgctgcccgaagtgccgcaggcgctctgtgccatcacgcgtaacactttcggcacgatgttgaccaaaggggcgaggacggcaattcacgtgagggaacagagcgaatttgggcacggccgatgcacggacgaaggcggaatttgagggggaaaatatggacaaatgaattgttggataaacaattttgaaatccagaaaaattaattatttgaattttaaattatttttaataacttttgaagatttaaatatcgaacgatacaaataaaattaaattggtttgatttgatttggtttcaattaatttatttgttggattaaattatcaaaatcaaatcacaaaatagagcaattccaaccaactgcaaattgacaagcaaaaatatccaaaatataaagaaaatcaaatctcggcatgaatttcattaattaattaaatattaattaattaagtatttttcagttcataaatttttgtacaaataaaatgtaataattttacatgtcaattcattacattcacttttgagaaaatataaccaaatggttgtactcctctcactaattggccaattacctaacattaattaattaattagtgttaattaccaatttcgccccattttcacttccattgactctgcgcaacgccaaaaaaaaagaaaacatttgcccgtcggcggagtttcgtcgcccattttctccgttttcatttacgcccattcggcccgtctctccgtttttctgttttcacttttttttgctgcgcattttacaatttttgagttccaccgctgcgtcctttgcccaacccaaaaaaatgaaaatgaaaatgcaattaattaatttaaatttttattttcttttttttaaattttcttttttcgcccatttgtttgcccctccggcgaatttccaacggccgaatgtttttttttgtgtcaccgccgcgtaacggcccaatttttggggcaccgaatcgttccactcccgcaacaaaatgacgacaaccaaaacgacgacgaaaacgcaaaagatgacattgccccgggcgatgggccccgggggaagaagcgtatttaagcggagagaagtgggggaagggcatcagttgcagttcaaccaacagcagcagaagcaaaagtgaggcaataaatattcaaaacaattaaaatatatttaaaataatattagttaaattatttcaattccaatttcagtttaatttttaatttaaaataataattatttaaattcaataattgaattaaatttcaaatcaattacaattttaatattttagatggccgacttcgacaaacacgctgcccagcgcgaggcggagtcgctccgcactttggccttcttcggcgtgtgcctgtccaccgtggccacggttatcgctgtgctttccgtgccgttcgcctaccagcacttccagcagatcggcgcccaaatgcagaacgaagtggacttctgcaaaatgcgctccggcaacatgtggcgcgaggtaaagccgaaaaggcggaagggaaaagccgggaagtttcaaaaaatttcaacaaatttccaggtcacccgcacccaggcctactccaaggtgtcgcacgacagccgtcacaagcgtcaggcaggcggttgctgtggctgcggagtgtcgcccccgggcccgcccggaccccctggcccatcgggacaacccggcggagacggacaacccggaggctcaggacagcccggagcaccaggtccacaagccgtacttggaattccatgaaatttaccttgaattcttttacaggccaggcagctcctcgcccgtacccgccaagcggcggatgcgtgccgcaatgtgaggccgcccagcccggactccccggcccgcccggaccccccggacccgagggacagaacggccaacccggacagtcggcaccgcccgcgtctcctggccgccccggaccacaggtcagcttttcctgaaaagcttgtccaagcttttacaaatcccactgtttttagggacctcctggacccgatggacagcccggcaaccccggagagtctggccaacccggccagcccggcaaactcacccagggcccgcccgtcgttggaccgcctggcccatcaggaccccctggccagcccggacagcccggcgagaacggacagcccggccagcctggaaaccccggcccgcaaggataccctggcgacggcggaagccccggccaacccggcaaccccggaggcagcggcgagcccggacagcccggagcacagggatccagcggccaatgctgtgagtggatttagcaaatccaaaatccatttttctaaaattgttcgactttcagaccattgcccaccgccccgcaccgcccccggctactgagtgtgatcagtcgaccatcgacaattggagaagaacccccactgatgatccacgaggctgctgtcctttcgtctctcaccattttcccgatcattttggcatttccaaaacgctgatcggacaattctcaatgttatttttgtatttgtgcaaaatttcgttggattgttctgtcgcacaaaaaaatcaaagaataaattgatcggagctcaacaattctttctgaattcaagcttaaattttatttaaaatttgcaaactttttattttgttacttttaaagcctttttcatttacattttatggattaaaaaaaatattaaaattatttttttatttccagctaaaagatgattattaatattacataattttaaaatgtgattcattaaaatgaaattactaattaaaaatttgttggaagttgctaccaatggtcttttcataaaactgccaaaaaatgggggggggggggaaacgtatttgattgtgccaaatggttttgcaaatgtgtaagaaagtgatgatcgttttcttacaaaagtctgtattagttcatattttaaagatttattataattagtgtacaatttaggcatttgcaaatcagttcatattttgtttactatttttttatagaataatgaaagcttaaaaaaacattaaacagatgtaaatttgtatttgattattaaatgttttcatatttatcgaaatcaaaaataataaaaaaatttcttcgatttctttcggctttcgatccaaattaaaataagtatttggaacaaaattaatgaataagactcattaaattaacacgagaagggcgacagatgaaccacttaaatgccactgatgcaaca

SEQ ID NO: 1495 - DNA, 4911 bp, Heterodera glycines
  misc_feature (55)..(56): n is a, c, g, or t
  misc_feature (92)..(92): n is a, c, g, or t
  misc_feature (97)..(97): n is a, c, g, or t
  misc_feature (99)..(99): n is a, c, g, or t
  misc_feature (101)..(102): n is a, c, g, or t
  misc_feature (109)..(109): n is a, c, g, or t
  misc_feature (120)..(120): n is a, c, g, or t
  misc_feature (184)..(184): n is a, c, g, or t
  misc_feature (194)..(194): n is a, c, g, or t
  misc_feature (198)..(198): n is a, c, g, or t
  misc_feature (220)..(220): n is a, c, g, or t
  misc_feature (227)..(227): n is a, c, g, or t
  misc_feature (232)..(232): n is a, c, g, or t
  misc_feature (237)..(237): n is a, c, g, or t
  misc_feature (4854)..(4854): n is a, c, g, or t
ccagattggacgttatggcgtgttttcaacgaggtacttacaatggttcaagtgnnttatttgaaagtaattaaatagtccttttaagatgnatggnananngaggganaaaaaataaanaattaaaagaaggagagagaaaaaagagagaaagaaataaaagaagggaaaaaaaaagaaaaanaagagagaangaanagaaaggaaagagaaaaaaggnggagagnagaanagaanaaaaaaataatttatgaagtgcaaatcggctaaaattaaaaatgatttatataaattttgaaatcatcgcaaattctctttaaaagcacatataaagcctttccctaggaacaatttaattgttttgattagaaaaacctcgaaaagcaaaatttcttaagaaaaattgggtttggtggtgattttaagaaagtcatccacccacatttttagtggttaaagtcatcttttgatgctccaatattaaatgttattgtattccgttaagaaatttaaaaatccatttcggcacaaatgccaaaaaaggcaaaatggggatacaaaagtcatactaatggttttaaaccaacctaaaaatgctttttagccttatcctggtaaaatcagagagtgaatgacattcattaaatctgaagatattcggagaaaaaataatatacaaaaaatgaaaaatttaatatgattttaagaaaactgaaattacaaaattgatcatcacttttatagctgctcttttgaattcaaaaagattttcttgaccctttggataaaacaaattttatttaacaaaattttttttcatctttcattttttgttgagcaaattttacctttttcgcaaaattatttaattattttttctcactttctgaaacaacaaataaatgttaataaatgaagaaaaatagattttatacagaataaaaacatataatgctgagcagataaattcaacaaaaaataagttattttctttaaatatgaaaattaaaaaagaaaaaagcttacaacaccttcgattcccaggacgtctccgttccaagtactaagaaggcccaacgttgcttaacttgccagatcggacggaatggcgtgttttcaacgtggtatggtcgtaagcgaaagtgctccatttgaaagcaattaaatagtcaatttttaatgcattttttctctttggttaacttatcattaatcaaaacaaggatcgataaaaaatttagaattcacttaaataaggtaaaaaaaaaagaaaaattcgatagtttttttcgaaatgaaagagcaaaaattcggagttttgaattctttttttaactaatttcccaactgcaaatcggctaaaattaaaaatgatttatataaattttgaaatcatcgcaaattctctttaaaagcacatataaagcctttccctaggaacaatttaattgttttgattagaaaaacctcgaaaagcaaaatttcttaagaaaaattgggtttggtggtgattttaagaaagtcatccacccatcatttttagtgcttaaagtcatcttttgaggctccaatattaaatgttattgtattccgttaagaaatttaaaaatccatttcggcacaaataccaaaaaaggcaaatggggatacaaaagtcatactaatggttttaaaccaacctaaaaatgctttttaagccttatcctggtaaaatcagagagtgaatgacattcattaaatctgaagatattcggagaaaaaataatatacaaaaaatgaaaaatttaatatgattttaagaaaactgaaattacaaaattgatcatcacttttatagctgctcttttgaattcaaaaagattttcttgaccctttggataaaacaaattttatttaacaaaattttttttcatctttcattttttgttgagcaaattttacctttttcgcaaaattatttaattattttttctcactttctgaaacaacaaataaatgttaataaatgaagaaaaatagattttatacagaataaaaacatataatgctgagcagataaattcaacaaaaaataagttattttctttaaatatgaaaattaaaaaagaaaaaagcttacaacaccttcgattcccaggacgtctccgttccaagtactaagaaggcccaacgttgcttaacttgccagatcggacgggatggcgtgttttcaacgtggtatggtcgtaagcgaaagtgctccatttgaaagcaattaaatagtcaatttttaatgcattttttctctttggttaacttatcattaatcaaaacaaggatcgataaaaaatttagaattcacttaaataaggtaaaaaaaaagaaaaattcgatagtttttttcgaaatgaaagagcaaaaattcggagttttgaattctttttttaactaatttcccaactgcaaatcggctaaaattaaaaatgatttatataaattttgaaatcatcgcaaattctctttaaaagcacatataaagcctttccctaggaacaatttaattgttttgattagaaaaacctcgaaaagcaaaatttcttaagaaaaattggttttggtggttattttagaatgtcatccacccatcatttttagtggttaaagtcatcttttgatgctccaatattaaatgttattgtattccgttaagaaatttaaaaatccatttcggcacaaatgccaaaaaaggcaaatggggatacaaaagtcatactaatggttttaaaccaacctaaaaatgctttttaagccttatcctggtaaaatcagagagtgaatgacattcattaaatctgaagatattcggagaaaaaataatatacaaaaaatgaaaaatttaatatgattttaagaaaactgaaattacaaaattgatcatcacttttatagctgctcttttgaattcaaaaagattttcttgaccctttggataaaacaaattttatttaacaaaattttttttcatctttcattttttgttgagcaaattttacctttttcgcaaaattatttaattattttttctcactttctgaaacaacaaataaatgttaataaatgaagaaaaatagattttatacagaataaaaacatataatgctgagcagataaattcaacaaaaaataagttattttctttaaatatgaaaattaaaaaagaaaaaagcttacaaaaccttcgattcccaggacgtctccgttccaagtactaagaaggcccaacgttgcttaacttgccagatcggacgggatggcgtgttttcaacgtggtatggtcgtaagcgaaagtgctccatttgaaagcaattaaatagtcaatttttaatgcatttattctctttggttaacttatcattaatcaaaacaaggatcgataaaaaatttagaattcacttaaataaggtaaaaataaaagaaaaattcgatagtttttttcgaaatgaaagagcaaaaattcggagttttgaattctttttttaactaatttcccaactgcaaatcggctaaaattaaaaatgatttatataaattttgaaatcatcgcaaatgctctttaaaagcacatataaagcctttccctaggaacaatttaattgttttgattagaaaaacctcgaaaagcaaaatttcttaagaaaaattggttttggtggttattttagaatgtcatccacccatcatttttagtggttaaagtcatcttttgatgctccaatattaaatgttattgtattccgttaagaaatttaaaaatccatttcggcacaaatgccaaaaaaggcaaaatggggatacaaaagtcatactaatggttttaaaccaacctaaaaatgctttttaagccttatcctggtaaaatcagagagtgaatgacattcattaaatctgaagatattcggagaaaaaataatatacaaaaaatgaaaaatttaatatgattttaagaaaactgaaattacaaaattgatcatcacttttatagctgctcttttgaattcaaaaagattttcttgaccctttggataaaacaaattttatttaacaaaattttttttcatctttcattttttgttgagcaaattttacctttttcgcaaaattatttaattattttttctcactttctgaaacaacaaataaatgttaataaatgaagaaaaatagattttatacagaataaaaacatataatgctgagcagataaattcaacaaaaaataagttattttctttaaatatgaaaattaaaaaagaaaaaagcttacaacaccttcgattcccaggacgtctccgttccaagtactaagaaggcccaacgttgcttaacttgccagatcggacgggatggcgtgttttcaacgtggtatggtcgtaagcgaaagtgctccatttgaaagcaattaaatagtcaatttttaatgcatttattctctttggttaacttatcattaaccaaaacaaggattgttaaagaatttagaattcacttaaataaggtaaaaataaaagaaaaattcgatagtttttatcaaaattaaagtgcaaaaattcggagttttgaattctttttttaactaatttcccaactgcaaatcggctgaaattaaaaatgatttatataaattttgaaatcatcgcaatttctctttaaaagcacatataaagcctttccctaggaacaatttaattgttttgattagaaaaacctcgaaaagcaaaatttcttaagaaaaattggttttggtggtgattttaagaaagtcatccacccatcatttttagtggttaaagtcatcttttgaggctccaattttanattttattgtattccgttaagaaatttaaaaattcatttcggcacaaatgccaaaaa

SEQ ID NO: 1496 - DNA, 6343 bp, Heterodera glycines
  misc_feature (4705)..(4705): n is a, c, g, or t
  misc_feature (4838)..(4838): n is a, c, g, or t
  misc_feature (4880)..(4880): n is a, c, g, or t
agggctaggagttttcttggatattcagaaaaaacagccatgccagggctaggagttttcttggattttcagaaaaaaaaataggtccagccagggctaggagttttcttggatattcagaaaaaacagtcaagccagggctaggagttttattggattttcagaaaaaaaaataggtccagccagggctaggagttttcttggatattcagaaaaaacaggtccagccatgggtaggagttttattggattttaggaaaaaaattaggtccagccagggctaggagttttaattaatattattttaattaattttaatttaaaatattatgtgttgaccaaaatgtagcataagagcccaattgacatgagaacactcacagaaattgtcaacttttttacatgttccgtaactaaaaatgcattaattatttttcatagattaattaattcgctaattcaaaatagggttctataaatggaaatcaaatttaaaaaattccaaatttaatataatcgtttctctaatcctaattaaacggaatgactttgtgctgttcttctccaaatgatcagccaaatcagcgcatagcacacaaattcggcacaatatgaaattaaggcattgatgtcagtgtaataagcagtttcgggctgatgggctgggtcaccgagatggcacatcaccggtctaaatgatccgaaaacaaaatttaaattcaaatttaattgcccattttgtgtccacttttcccaatgggctgcgcttccactgtaagtgacaaaacagaaaaatgccaatttaatacaacaaaatgcgatgatccctttgaaggatgtgtattttccacgtgatttatacctaaaagtaaaaaataaattaattaaaaatggaatgatttattaatagatatctaattacgttaattttagttaaaaaggtgggaaaattgaaaaaatatttttaaagtaaattttggaagacaaaaaccaattacttttggataaatgcctgaaatccttctaaaaactcataaaaatcattatttaagatgtatctttcgattttagtgtgttttatttgaattttgtaagtgcctaaatacgactaaaaatgccgtgccacttagcaaaaacatacaaaaaaatggaaatccatacacaaccgttctatttctccaattattactagggataatatttttaggtttttacctatttttttcatgagctccctagggtctgaaatgcacgaaaaacatgttttttaggggttgttaagctacttttcgagttattagtgcctattttctaggtttttatttttagcgcctaaaaaactaaaaaaaatttttaaaaacttattttcacctattttggcgttttgcccaaaatttgttaacaaaaatgcaataaaaaagaaaaatacaacacccctatgaattgacccgaaaatttctcaaaaattcacctccaaaatttatttattttattttcttgacgataatttttgattttgaaaattatgtatattcttaatgacttggcaaaatatttttgctttttgatgaaaattttcaattttacacccctaaatttggaactttttggcacctattttctcatttttagcacctattttggggttttttaggacctaaaacctacctattgaaaaacaagcactggtaagaatgggggtctgagtgcaaaaattagtgagaaaattggagtaaaaggaaaaaatttagaaataattattaaatatattcgataaagtaactgtgcaaatgacctagtggctagtctccttcactttccgtgcttctttcccctggttcaatccctctacagaaattaaagtattttgaattttctttttttatactcatggctttcctatcgacaaaatatgattcttaattttttaaattgtattttatcattttttaaagaaaatccatacaaattgagcctagtaatctcaaaaaccagcctttttttgttgaaatttgttaacaaatcacactcaaattttcaaaattttccccagcggcgcctatcggcaccgccggacccccttcttccccaaaagttttctggaaaaagcgcgccgaaaaaagtgatccgaaaagtatgtaaatctgaatttctattaatattcgatcatttaaagtacaagaaaattagtttgaaaatttttattaatttaaatagctttaacttttggattttataaaataaaaacctaaataaaaatttaattatttaatattttcacttgaaataaattaaaatttgaattttttttaaattttttgaattttttttaatttttaaaaattcccggttggtcccggttcccggtcccgaacaaaaatcgaggtcccggtcccgacttctcaggtcccggcaagtcccggtcccggttttgcccaaaattcccggtcccgctctactctagtttttagcacctataaatattagcccctaattattaccatagtgggaacataacgccaaacagacgatcaattccaatgccaagttgcaaactgacagcaattgatgagccaattagaggcagtaattgaatgaagaagcaatgcttaagcaaaatgtaattgatgccaaacagaaaaacgaagaatttgatggaagttccaaaaaggagaaaggaagagcaaaaggcgaacaaagcgatcagagttttacacggagaatggagcgatctatgcgaaattggttttaaaataattaaataaaaaatgaattatttcagtccaggggtagagcacgaacgtgatctgcaacatttttttgcgcagttcgcaacctttgggtttttagcagattttaaaaaatgaaaatttatcgacgcgattgtttcaaatagggttaagccccaaccccgagcccccccccccacccgagacctttttgggacctattccccgacccgacccccgactcgtcgctaccccaaactcagaacattcttataaataacgcactcttgctggcgctaacgaaatcagatgattaaagctaaaaaaaggaagatttacgagcatttaaaaataaaaatttagtttttcgttaaaaaaattttgttgatcactacccgatcggggtccccgacccccgaaaattgagcccccccccccccccgacccgacccccgacatgtcgcccccgaggtccccggcccccgatattttgccccccgagggctcggggcttaaccctagtttcaaatgaaatattcttgaaagaagaaaatttctaaaattcattttatttttaaaaattgttttttaatgcgcaattcggggccatgatttttcgagtgcgcatttctgctcctctgttacggattatttaaaacaattcacttcgttttaattgttacgtagacgagacaaaagtttaagcaaatgcccgtcagacaaatcaccgaaatgattccgtttatcaatatttcgctggcaatcaagcctttgttggcgtactgctcgtaaaactaaaattgtttatttaatttcataaattaattttttttcattttttagtcttatttccgctgaaggtttttgttgcttatttctttgaaatttttcttccaatttcgatagtatttgcgaatttcgtgcttaaaaatttaaccctatttgtcaattcaaaattaaaattcaccggatcaatcgctgcaaccatttattttgcaataaattgatacagaacaatgtaaaattgagaaggtgagatttatgctaaaatgttatttaaccaaaaaaaagctacagatcgccaactgaaaaattaataaaaatttcatacatacagagaaaagaagcaaaaaatctaattattttttaaaaatttactagaataaaattataatacagtcatggtcatatgtttaacacaccccaaaattttttttataaatttagccgtaatttttttactaatagcatatgttagatgctttataccgatcgatagcttatttaattcttggcattgttcaaattttaaaataatccaaaacatagtgttgttaaaaataatttaatttttaaaattactttatggaaactaaagtgatgaaaacaattaataaataataagcagtaaaagggcgaaatgataaaatgcaatttttgaggaaagtggcacaaattgattctttcttttgattggccatcatcgtttagctagtttatgcaatttgagtgtaactttcctcctttgatgttcccgatgggactcactgaccaacttaattagttgggtgctatgtcgtcgctatttaaaaacatcataatacgctttatttaagaaaccatcaaaataaaaaattgctactttatagcaaccaaatttttaattcttctatcatttgatagccctaaatgttctctatttgcctgcaaaatttcagaaacattgttaacattcaaaaatggccaaaatgttcaaaaggtttttgagttcctcaagtcataacgtttttgaaacttcatgaaattttttgaatttttgcagactgatagagaacagttagggctatcaaataataggggatgttcaagctcatcattataaaatgtacaaaaatatggacacaaatgcataggtaaagatgaggtattatacaaatagataagaggtaaaaaatagaaacaaattacagctaatntaaagggcaaactaatttgaaaggcactttcactaattgcttttttgaacaataaaagtgctcaaaaatgcaaaaagcgagtgtttttgtaaatggattggctgctgttaattttgccgggtttgtttcgatntgctccattgactttggccttgtttgccgccgtgggactttntgagcggttgaagcttttcgatgctccaattgaaatggattttgagggacttttgtgaatatgaccagcggttggttgatctgataaatctgctgacgaagaatcactgataattttggatttgccatttttggaagtgtcatctttgggtgtgccattcttggaggtgccgcttttgggtttgccctttttggaagtgtcatctttgggtgtgccattcttggaggtgccgcttttggatttgccatttttggaagtgtcatctttgggtgtgccattcttggaggtgccgcttttgggtttgccctttttggaagtgtcatctttgggtgtgtcattcttagaggtgccacttttggatttgccatttttggaagtgtcatctttgggtgtgccattcttggagctgccacttttggatttgccgtttttggaagtcctatttttggatgatgaagatgaagaagtgacaacataaatttgcggctgtttaaattccgttaaatttaatttgtggttttcttttttcttttttctattgtgagcttctaatgtttgtgatgccgttgcggacatgaaatgtgccaatgttggtgactttaggtcttgctcttgcacagttttgcttgcatttagctcatcccataatttggccgcgtttcggttgtttatctcttaattatgcttccaaagttaatttaaaaaaattttattaattaatttatgtttaaatttttttaatcaaattttatgttattaaaaactattctatatgagtttaaatatattatcagactttaaattctattttgtttattttcgagaatcaaaagataataaaaaaatattaaaattttattttagctcactcataaattcggtgttcaatgtcggcttttgtttgacactttctgaattgttcactttgcttttaaatttgggcaaacagccggtggcaaaagtttgatgcaccaaaaagtgaagaaaaatgatagaaataatgaatttcattttcacttttatcaaaatgaataaatagttgtttgttaaaataaataaataaataaatattcaaatattcttattttgtttaaattaaattttttgcaaaattcactaaaaaatgctcagaagaattcgctactgattttttacttattctttctgtaaaataatacaatgaatttattaatatttttttataaatattaaattgccaatttattgattttaataaatataaaattattctaatttattttatttttgattgaattgcattagattgttctttttgttaggaaaaattgatattttcatttgaataaataaaatattaaattaaatgttttaagataataaaatatgtttaattgataaatatgatataataagtttcgatttacagatcgccaactgaaagaagaataaaaatttcatacaaacagagaaaagaagcaaaa

SEQ ID NO: 1497 - DNA, 1260 bp, Heterodera glycines
caaatttttattcttctatcatttgatagccctaaatgttctctatttgcctgcaaaattcaaaaacattgttaacattcaaaaatggccaaaaatgtttaaaaggtttttgagttcctcaagtcataacgtttttgaaacttcatgaaattttttgaatttttgcagactgatagagaacagttagggctatcaaataataaaaacaactccgccccattagtagcatttaatctcaccaatttttttgttacaccatgttttactaatgttcgggtggtcaaccccgagagatgaaagttcacaattgcatttattttccctttgcatttgtctctttcttttcctcttattttccccactctctaattgttgtgtcttcctttatttatgtaagacactattgatttattatgtccattgcatgtcctttcccctcattcattcagttgctttttatgcacttattttcacttcgcctaaatatttgttctcctccaatttatttattccgcttccgacttcgcctatttatttaaattgtttaatttatttgttttacaaataaacattttattgagtcggcttgaagaccgaacaattggcgacgcctgtcttaaaaaaagaagctcaacgtcggaatattttggcaatttcggacagattccgatttgctattcatcaattcttcaaaaaagcaatagacccaataagggtgagcttccgccaggcgcggttgattcatcataaaaaaaccaagatacccaggtggttgcggtttccgccaggtgcggtttactcaacaaagacaaggaaattcaccgaattgccggacatttcaccattcgagccaacggacgacaagagccgaatttcgtaatggattgagcgattcaaattcgcgttggattgcacagcaccaacagcggacgacgaagtcaaggtaaaatgtttgatgaataagctgagcgaatcggctttcagcgaatacagcagatcagttctgccgtcgtcggtcacagatttcagttttaaagtgacgaccgaaaagcttgagaagctatttgccaaggctcagtccatattcatcgaccgctacgagtgtttaaaagcggtgagaggagaaggcgaaacattcaggcagttcataaatcggcacagaaaattgctgaccgaattttaaattcgatgagctgacaaaagagcattttaattgcctcatggtattgatggcactcaaagcgcccaaacaaagctgca

SEQ ID NO: 1498 - DNA, 2752 bp, Heterodera glycines
aggaaagtccaaagccaaaataattgccgaacaaattcaaagaaagaccaacactgaggcaactacaatatgttggcgatgtggctttggcgtgcatcggcctgacgaatgccgttacaaaacgagcaaatgccgcaagtgtgagtttgtcggccatttggacaaacaatgcgagcgtgtccaagagtggcgcaaacgccaaaatgccaaaaagaaaggcaacaaccgcgttggccaccttcgtattggaatgaccacgcatgccgtcaattctatttcgctgctaaaaacagcggttctgttcaacaagaagccagttgaattccatctcgacacggggtcggacattgtcgtcattgatcaattgacgcacgaatatgttggacgaccaccgatcgaaaaatgtaacgaaatcggaaaggctttcgacggcacaaaaatttcctttattggaaaaggattcggtacattcaaatttggcaaaattgaagtcgagcaaacattttatgttgcaaaagcaggctcactaaatttgctgagctgcaaaatgatggatttatttgggctgttagatgaattaaagctgaaaatcagcaatcctgcagtaaatgcatgccacgcgaatggcaaaaaggctgaaaatttaatcccgaatgaagcaacgcagattgctgggacagaagtcaaaattcaaggcctggaaaaggcatttcacgaaattttcagtgaggaattgggccattgcctaaaggagaaggctcatcttgccctaaaagatgacgcaaggccagtctatcgcaaagcccgaccagtaccctacaattcgttagaggtggttgagagcgaactgagccggttggaaaagatgaacgtcatcaaaaaagtcgaacatttggagtgggccgcacctattttgattgttaaaaaggctgacggatccgcccgactttgcattgattactctacgggcctaaacgatgctcttctcgactgtcaatacccacttccaataccggaagacatttttgcgacgctaaatggaggcaaaattttctcacaaattgatttgcgagacgcctatttccaagtcgaattggacgaaaattctaaaaatttgtgtgggctggcaacccacaagggcaattaccggatggaaagattaccgttcggtgtaaaatcagcccccgccatatttcaatcaattatggataaaatgttggcaggattggaatttgccatcgcctatttggacgacattataatcgtcagcaaaagcattccggaacacaccaatcacttaaaagaagtttttggtagaattcaggcatacggattccgcgtcaaattggcaaaatgcaaatttttccgggatcaaatcaaatatctcggacagattatcgataaaaacggacgccgaccggatccagcaaaaatttatgcaattagtcaaatgcctgcaccaaacgacattccatctctgcgatcatttcttggtatggtaaaccattaccaacaatacgtcaaaaacatgcggttcattcgaaaaccgctcgacgatttgcttaaaaaggaaattgattggagttggagtgaaggatgcgaaaatgcattccgaaaaattaaggaaattttggcatccgatttgctgctaacgcattatgatccaaaaatggacatcattgttgcagcggacgcttccgaattgggcatcggagcagtcatttatcacaaatttccggacggaaacatcaaagcaattgcccatgcttcaaaatcactcgcccctgcggaaaaaaattattcgcagattgaaaaagagggcttggcgttggtttttgccgtacaaaaattccataaaatgatttatggacggcatttcacattgcagactgaccataagccccttgtcagcatttttggcagcaaaaagggaattaggcagtgcagtgccaatcgtcttcttcgctggtcattaatccttttggcctacgattttaccatcgaatacataaacaccaaggattttggccaggcagatgcgctctcgcgcctcatcgccaaaggaaatgagcccgaagacgagaaaatcatcgccatgatcaatgcggaaacagattttgagacgaatttcgacaacacaatttcaaaattgccattaaaattttcggacctaatcgctgcttctgagcgcgatgaaaacatttttcaagtccaaaaatttgtcaaaaatggctggccaaatgaaaaggccatggacaaagaaaatcaaattgtccgcgatttatgtcgaagaaaggaagaactttcaaccgaaaagggatgccttatgtatggagaaagagtggtaatcccgaaagtcttccactccaaaattctgaaattgctgcacaaaggacatcccggcatgaaaaggatgaagcagctggcacgtcaatatgtgttctggccaaaaatcgatcaggacattgaagattttgtccgtgaatgtgtgccatgtcaggctgctgcaaaagcgccaattaagacaaatttacagtcatggccaaaaacaacaggcccttggcaacgcgtacatatggattttgccggaccgtttttcggaaaatattttctgattgtggtcgactctttttcgaaataccccgaggtattcgaaatgtcaacaatttcaacggcaatgacaattgaaaagctaagatatttggcttcacggcacggaattccagaaacattggtttctgacaacggcaca

SEQ ID NO: 1499 - DNA, 1200 bp, Heterodera glycines
  misc_feature (1059)..(1059): n is a, c, g, or t
  misc_feature (1064)..(1064): n is a, c, g, or t
  misc_feature (1105)..(1105): n is a, c, g, or t
taaatagagtttcgttaagtttaattgattatttaagcataattatctatatttatttacgaagtttattttctttattttggttaacgattttcaaaattcagctgtctgttgatgttctgctgctgattgttgttaaattgtacaacagttgtaccaatattattcgcttgaaggagagcaaattgtgagcgaaatgcgcaacgatattgggcactgaaatattaattatataattcttaatgggttgattaaacagcgacccaacattattttaagtattttatctttatttttggttcgtctttgctctggcttgaagacttttcgttatattaatgaatattttttaaaccaattaaaaaatccagacccaggcctaaaagcataggcatgtctggtgtttttctggattttgtccagaaaaaaaaggtccagccagggctaggagttttcttggattttcaggggaaacagtccagccagggctaggagttttattggattttcagaaaaaataggcccagccagggctaggagttttcttggattttcagaaaaacaggcccagccattgctagtggttttattggatattcagaaaaaaataggtccagacaggactatgagttttcttggatttgcagaaaaaaaggtccagccagggctaggagttttcttagattttcagaaaaaacaggtccagccacggctaggagttttattggattttaggaaaaaaataggtccagccagggctaggagttttcttggatattcagaaaaaacaggtccagacatgggtaggagttttattggattttaggaaaaaaattaggtccagccagggctaggagttttattggattttaggaaaaaaataggtccagccagggctaggagttttcttgtattttcaggggaaaaacaggtccagccagggctaggagttttattggattttcagaacaaaaaggcccagccagggctaggagttttcttggattttcaggggaaaaaacaggtccagccatgggtaggcatgaatttctgatccanacttntttgaaaacttttattttcgtgtgtttgcacttgcaaagtnaagcattggtgcgctgcttccgtatgcccaacgtttggaaaaagcactgatcgggacgacacaaaatcaattgcaaatgggtccaaactgagcag

SEQ ID NO: 1500 - DNA, 5648 bp, Heterodera glycines
gttatgactagagctgggatttttatgtgctaaaaatcctgaaatatgtaataaaatatatgctaaaacccaaaaaaatgcaaaatatttgttaaaatatgcattaaaaattggaaaaaccaagtgtatttatgcataaaaattccataaaaatctcattcgttatcattttcgtccgcctaattgaaaaaccaatacatttggaagtgttttggggtaaaaatggtctttttctgttaaaattatttttataaatttaaagttccagcagagaacttcgaaatccatgataaattaagaattcgatttggctttttcggaataaataaagaaattttgaaaatttttaggctagctgttttaaattccataaaatattttcttactttaacaaaaattaattttactaataattagttttgaatttaaactattttgatattttctaaacatttgatagccctaaatgattgctattaaactgcagaatttcaaaaagttccgtcaagtttcaaggaagttatggccaaaaatgttcagaaaaacttagttttctgagtttctcaggtcataacttttttgaatcttaacgattttttttgaaatgttgcaagagaataaaaaacactttgagcgatggaaatatatcaagatcttaaaacttggtttattttgggtgaagttatgaataattttctgtcatggtttcttgactgacgcccattttgatggttttgactaacgtcccagtaccgtataaatcggttgaatctatgactgaagaactaaacgtgcaagtgataaaattaatagcaaaaattaatatttaaaattaaatgcaaaataattattttgcttttatttgattcacttgcacttttcatacttcgtctcagcacgaaacgaccaaataattcaaactaacaattgcaacggcgccggcattttggcgtcaaacacttctttttaacttggcaccctaattaattggaatgattgaaaactgatctccaaaaaagaatatgtttttttcttgccatacaaaaaagtttggctcaaaattcccttttccggacattttttggcatcaatgctgaacaaaaaaaaaaaatggaagaaagtctttcaataaaatttgtaaaatatgcagatgacagaaatttttttgtcatcttgaagccatcaaattgattggcaagtaagcttactagaggatttttcatttaaaaaaaacaaaaatttcatccaatattttcgtaaatttaagacttcattcgtttctccaaaaatttcatgcatttttttccataaattttccttcatccctatttttccctaatgttacaattttcaaaaattatgtattgtgcattcattattatttgtattaaatctagcatttattttgagcaaaatattttaagaaaaaaatatcgaagaaaagttgatcctcgaaattacattattagttatttgaaaaggtttaaaatttttattaatattcaattaaaaaaacattgctttaaaataattaaatttaaatatttttattgacactgagattatttttcggttcgcccctactgagaccattttcggttagacctagcacccatttaacatcttggaaaaacctgaattttcttaaattaaagcatttaatagagaattttataatttcgtttccgggttccagaattatttttgttattggaaccactcgagcttgtacatattaatgaatattatttaaattcaaacttacaaatgggttgaaaacccaaaaaatttatgtttatttttgaaaaatataaaaacttcttaactttttttggatcatttttaggaatattttatactagctttttttcaaagaatatacagtcatggtcatatgtttaacaaaccccaaaatttttttataaatttagccgtaatttttttactaatagcatatgttagatactttataaaatcacgtggaaaatacacatccttcaaagggatcatcgcattttgttgtattaaattggcatttttctgttttgtcacttacagtggaagcgcagcccattgggaaaagtggacacaaaatgggcaattaaatttgaatttaaattttgttttcggatcatttagaccggtgatgtgccatctcggtgacccagcccatcagcccgaaactgcttattacactgacatcaatgccttaatttcatattgtgccgaatttgtgtgctatgcgctgatttggctgatcatttggagaagaacagcacaaagtcattccgtttaattaggattagagaaacgattatattaaatttggaattttttaaatttgatttccatttatagaaccctatttttgaattagcgaattaattaatctatgaaaaataattaatgcatttttagttacggaacatgtaaaaaagttgacaatttctgtgagtgttctcatgtcaattgggctcttctgctacattttggtcaactcataataattttaaattaaaattaattaaaataatattaattaaaactcctagccctggctgggcctttttgttctgaaaatccaataaaactcctagccctggctggactgttttttctgaaaatccaagaaaactcctagccctggctgggccttttttctgaaaatcaaagaaaactcctagccctggctggactgttttttctgaaaatccaataaaactcttagccctggctggacctgttttttctgaaaatccaagaaaactcctagccctggctggacctgttttttctgaaaatccaagaaaactcctagccctggctgggccttttttctgaaatccaagaaaactcctagccctggctggacctgttttttctgaaaatccaagaaaactcctagccctggctgggcctattttttctgaatatccaataaaactcctagccctggctggacctgttttttctgaaaatccaagaaaactcctagccctggctgggccttttttctgaaaatccaagaaaactcctagccctggctggacctatttttttctgaaaatccaagaaaactcctagccctggctggactgttttttctgaaaatccaataaaactcatagccttggctggactgttttttctgaatatccaagaaaactcctagccctggctggacctatttttttcctaaaatccaataaaactcctagccctggctggactgttttttctgaaaatccaataaaactcctagccctggctggactgttttttctgaaaatccaagaaaactcctacccatggctggacctgttatttctgaaaatccaagaaaactcctagcccttgctggacctgttttttctggacaaaatgcaggaaaaccccagacatgcctatgcttttaggcctgggtctggattttttaattggtttaaaaaatattcattaatataacgaaaagtcttcaagccagagctaagatgaaccaaaaataaagataaaatacttaaaataatgttgggtcgctgtttaatcaacccattaagaattatataattaatatttcagtgcccaatatcgttgcgcatttcgctcacaatttgctttccttcaagcgaataatattggtacaactgttgtacaatttaacaacaatcagcagcagaacatcaacagacagctgaattttgaaaatcgttaacaaaaataaagaaattaaacttcgtaaataaatatagataattatgcttaattaatcaattaaacttagcgaaactctaattatggcaacttatagaagaaaaaattttaaacttttgtaactgtcaatttatgcataagtgaaaaacaaatatttgtataatacctcatctttatctatgcatttgtgtccatatttttgtacattttataaatgatgagcttgaacatcccctaaacatgtaaccttttcaatttcactttttgtccaatttagtaaaacatggtgtaacaaaaaaattggtgagattaaatgctactaatggggcggagttgtttttattatttgatagccctaactgttctctatcagtctgcaaaaattcaaaaaatttcatgaagtttcaaaaacgttatgacttgaggaactcaaaaaccttttaaacatttttggccatttttgaatgttaacaaatttttttgaaattttgcaggcaaatagagaacatttagggctatcaaatgatagaagaattaaaaatttggttgctttaaagtagcaattttttattttgatggtttcttaaataaagcgtattatgatgtttttagatagcgacgacatagcacccaactaattaagttggccagtgagtcccatcaggaacatcaaaggaggaaagttacactcaattttgcataaactagctaaacgatgatggccaatcaaaagaaagaatcaaatttgtgccactttcctcaaaaattgcattttatcatttcgcccttttactgcttattatttattaattgttttcatcactttagtttccataaagtaattttaaaaattaaattatttttaacaacactggttgggtattttatttttattttttattttatttatttatttgtcaataaagaaaaagtccacaaaagggaaaaatccgcttacagtgaggacaaaacattaaaatgtcctcaagaaagcgcataaacaattaaaaacgagatcgccgccaaaaaataaaatataatgtgagatcaataaaaaaataaaaataattaccaaatcactttttgtttaatgaattaataattcgacttttatttttccggtcaatcttacagaaatgaaatagttttaattttatttttaaattgatttaatgagtttatttcaataagctttttatcgagttggttccaaatttttgttacccgccccgcaaaaggtataaattttttgcctaatttatatttcgagttaagtctataaaagggaatgttaaagcgtttagaaggtttaagtatttcaaagggattcagatctgttcggccataaattattttatgagccatgaacagatcagacagctttcgcctgctttcaagtgttggcagttgaagtattctaatctttgttggtatggaatgggtggaaggctgcatttgaaaagaactcttttggtgaaatatttttgacatttttaaattttttaaatattttttagaagagatggattccaaacctcaggagcatattccaataacggtctaacataagttttgtacaaaataatccaaatcctagaagattttgatttaataacccgataaagagcgcatacgtaaatatgcattctttattatttgtgtgacatgattggaaaattgcaatttattatcaatatttatgcccaaatccctaattgtatccacaacatttattatatttccaccaattttatatatttctttggggtttttattccccaaatgaagtacaaaagtttttttaattgagattctgatctgccatttatttgcccattctgataaattatgcaatgctttatgcataatttctgtttcggttcttgctttataacaaatatacaatttaacatcatcagcatataatttaattctta

SEQ ID NO: 1501 - DNA, 3937 bp, Heterodera glycines
tgtaaattttgaagttgaataactaaaatttcagaattaaattttgaatccgaaaattttgtaaaaaatccaatttcttttctgattagaataccacaaccacctccactagttttcgatttccttgatgaaaaaatatagttgtaattctcttttacccaagggcaaaaattgatttcttccccgtcttcggtccaagtctcggtaattaaaagaatgtctattttttcggtttctaaaataagtgctatttcatcgattttattcattagtgacctaatgtttattaggcagcatttaacattccctttattttttattaaaaagtttggatgggtaattttttggtataaattttttaccgaccggaaaaatttttgtacttttgtataataattatgggtaatttgtagtgatttggttggataatttaaaatttttttcgaatatggtcaatgtcctgcctcagaaaatcgtgcgccgtgaaatttgcgcctcgacacttatcgatagacatttacttttttgtttttgtttttttcaaaaaaggcaaatttaatgccaaggaaaacaaaaatattgaagatttaataagccacattaatatatgtagatatagtttaaaaatgttttggattattttaaaatttgaacaatgccaagaatgtttaatttggttttgcctaggaaaaaaattttgataataggttgggctagtcaattaaaataagattttgaggaatttggaagcttttggcaagaacaattaccaactcatttgtcagacaaaaaatttctcgaaatcgtcaattgggttgttaggagatttcataaacccgtcaaaatgaaagtttattagagaaaacaaaagtttcatacatttctaaatttttcattcttgatggtacacaattggcacaccaaaagttttaaatttaaaatattagtccgaattttgcagaaaatcttacttttttcatgataaggcctaccagtatgcaaaattttagttttcaatttttaaaattaaaaattcaaattctattcatcatctattcccttatggactcccttatgttttctgttttaccatttttgcattagcgccaaaattattgtgcaaaaatataattattttattatatgtataagacaccaaaaaacattttttggaggtaacaaaattaattaaataatcaattgaagcaattttttttttttgcaaaatttgcaaaagtaagcttttttgtttgagtaaattcatctcatacatatgtaaataaacgaatctgatattttatgcatcatttgaaacaaagaattttacatctttacattgagattttatggtgatgatagctcaaaaaaattctaatcaaattcttattttattattagaaaattatgcttagtttaaaattgaaataattaagcctaattaaaagcagaaatcatacttatattatattcaatcaaatttctttaattccgattatttttttatcattattgctttgaccaattttcagctctgattatttgaacttagaatgaaaaaattctttgtaatttggctcattttccaatgcgatttttttggcgaagtgttcggcaacgcttgtaaatcaaaagaggaagaaccaattcaacctattcgcctgctgaggatgagaagtggcgtatccgagaagcttgtatcgggtaaaaaattaaaataatttttttttgttgttatttaaaacgcaccaatttgaattggtttaaaaattaaatttcataaaatgtttaaaacattccagcaatacactcaaaaacgcttttaagataccattggatttattaaagaaaaccaacaaaagcattcaacaccaaaaaaaccagttacaataacaaagcccaaaatggaacctgttacggtatccaaatccaatgctgaacctgtcactgtatcgaaatccaaagctgaacctgttacggtaccgaaatccaaagctgaacctgttacggtatcgaaatccaaagctgaacaagaaacggtatcgaaatccaaagctgaacctgttacggtatcgaaatccaaagctgaacctgttacggtatcgaaatccaaagctgagcaagaaactgtatcgaaatccaaagcgaaacgatccgttgggcctccaaattctgtagcgagaccaaatgtgctaacaagaaagatcaaaagtgcagcagcagtaccgcaattcaacgtggaatcagacagcgcatggattacgatatccccgaaaaaatcggggagaaaaagtacggtagtggaggcggtcgaacaattgaatccaccttctccaatgaaaaatgaggagccaaagcagaaagtcatagaaaagcagcagaagaagagcagaaaaagcgcaaaaattcgcactgatagtatctatgttggcactgttatagaaaataccatgggcactgataaacaaaacgaaaagaaagccatcgatgtgcaaaatgacaaagctagtactgataaacagattcacaaagttggcacatatagacaaaatgacaaaatttctgatggaaaagatgccaaggttgacactgatacacaaagtgccaaatcgggaattaatggactaaatgccaaggtgggaactgatggacgaagtgacaaagctgtcattgttgcaaaaaatgccaaatttggcactaatggagaaagtgacaaattgggaattggtggactaaatgccaaagtgggagctgatggacaaaactacaaaattggcactgatgcaaaaagtgccaaagttggcactaatggagaaagggacaaattgggaattggtgcactaaatgccaaagtgggagctgatagacaaagtgacaaagttggcactgataaacaaaatgcaaaaaatgccttcgatgaaacttgggaagagagtattgcaatgaaggacaaaggaaaagcagaaaaagtacaagaaattgactttgactactttatttggatgtagcaagaagtttgtaaggtcgatgagcatcagatttatattctatgaaaccttttctacaaatttctattccaaagtttaaccaaaactaataaagaaattaaattttcatgaaatggactcatttttaaataatatctatttttttaaatattaattttcaattgaaaattttattgtaatttttgattataaatttttctaaaatccgaaaatatttacaaaaaatgctaaaataccgaaatattacgcgcgttttttaaatattaaattaaattgaatattgttataattgttgaattcttcgaaaaaatcagcccgacgtttggaaaagggagaatcatcgatgagcaaatattttgacgattctcttaggcgatcaagatcaagctcatcatcattagcaagtgaatttttggtttaaaattttgggaaatcaagcaaatagcttgctgaataaggtgtttttcattagttcgtcgacacttgcggaccaatatttccggatgaaaatgccaacaaaaaaaatagaatttttaaaaaggtatttttaaaaatttctaaacaaaaattaaacaatgaccgacaatcaagtactgattgagattctcgctttcgaacagggcgctggttttttcgggacaaaatcttagcgaaagttttaacgaaatctgttggacaaataaatttttcgtttacttttcacccccccccccccccctcttttaacgaggagggagccaaaacagttaatttaatttatttcatttttaatgaaatatttatcccatttaaatcagttattccaagatttatattctatgaaaccttttaatatctatttttttaaatattaattttcaattgaaaattttattgtaatttttgattataaatttttctaaaatccgaaaatatttacaaaaaatgctaaa

SEQ ID NO: 1502 - DNA, 1351 bp, Heterodera glycines
aaaaataaataaacaaaaattttagtttgactaaaaggatttgttttagtctgcacatgcttatgttttttataagcgtaataaaacggaaataaataatgttttattttatcacattgaccaatcatcgacctttttcgtgtattttttggcacattgatcaatcatcgtgcccgttgaatgcctgatctactctaagtgccttaattcattatccatttacgctacacaaatttatttttcaacctaattcttgggtatattttaggaatttggtttccagttttctggtgtccaaaattctggcggtgtccaatttaccggttcgctcctgccctctccagatccccactttgctcgatcatataggatcaattgtcgcctcatttgatctattaatattcctctcggggaagcttcttctctatctcacaacaaattaatgtccaaaatttgcatgacaggcacaaatttcattcgcaataatttggtgcttcatcgtcgcgtaaattcatgccaaagttcaactgctggtgatgaacagaagaagacaattgagcagaagaacaacggaacaagtgatggagaaggtaaaattaaattttaaaaatataaaaattagttttttaatatatttatttagggaataaaaaattttatagaatttatgtgggtcccaattctgaccaaaacccaccaaaaattggctgaatttttatttttcgttttatcacattagaaaaaggccaaaatagggcaaattgaaataggaaaattattcataaattcgcccaaaattaaccaaattttaaaatgttgatatcattcgattgacctaagtgtttttattatccttcaaaatttcaaaagtttcgttacatgaaaaattaactttttaaattttagggccatcccaaagagaaagcacaagacgtcccagtttgggagatctgttgaatgctcgtcgtaaatctgaagcggaccgagaatctatggacacactttgggagccaatgaatgaaggaattttccgattttaaaaattaaaaaaaatcaattaagaaatttttaaattagcaattaacttctaatacttggcagtcattaattaatgctcattaaataattagttttagaaattgatgagagcataaatatgtgttaaattgcacaaaaagaccaaaactatgaataaaatgtatggaaaaaatgttaaaaagttgtccgatgtaattgcatcgaaataaaaaataataataagtgatagaaaatatattgggagtcaaccgcaatctgcgacatttttatccagatccgcggaatgtgtcaaaacctttttcgatcaacaata

SEQ ID NO: 1503 - DNA, 9795 bp, Heterodera glycines
ataaaatttgaagtgaatcggacaaggggtgcgcgagttttggtgcacaagtcttggggtgtgcgagggggcggggcgtcgggaaaactccgtttaaaatggtgcctgaggcgaaattctttcgccgttcagcttaggggatagtggaatggaggcctataaaatttgaagtcaatcggacaaggggtgcgcgagttttggtgcgcgagtctcgggggtgcgcgaggggggcggggcgtcgggaaaactccgctcaaaatggcgctagagacgaaattctttggccgttcagcttatgggggtggtggaatgatggcgtgtgaaatttgaagtgaatcggacaaagggtgcgcgagttttgctgcgcgagtctcgggggtgcgctagggggcggggcgtcgggaaaactccgcttaaaatggtgcctgaggcgaaattctttcgccattcagcttagggggtgctgcacagacgacccaatgcgccgtctgaacttcttcaacaattcaaatgtttcacccctccccgctcttttctcatttcagtctgcatagcgacgcggacccctcccatcccatagattcttatctattcatctgcaacggcccgttctccaccaacccatcattttcattccatttctcccctttatattgatttcttgtccgttttctttatttgttctgtccaatatttttatatttgtgcttttattatgcttattttaacttactaactaacaaattaataattaattaattaatctaacaaagaaaagcaaagaaaagcaaacgaatcgtaaagacaattaatgaaacgaaaaagccatgaaaaaactttaagctaagaaaagaaaagcaggcaaaaaaaaaaaaaaagaaagaaagtaaaccaaaagccaggcccttaaacgaaaagccatgaaaaagtaaattttaatagctaagaaaagaaaagcctgcaaaaagaaaagccaacgaaaagccatgaaaaaaaaaataaattttaaagctaagaaaagaaaatcctgcgaaaaataaaagccaacaaaaagccatgaaaaataaaaacaattttaatagctaagaaaagaaaagcctgcgaaaaagaaaagccaacaaaaagcatgaaaaagaaaaacattttaatagctaagaaaataaaagcctgcgaaaaagaaaagccaacaaaaagcatgaaaaaaaaaataaattttaaagctaagaaaagaaaatcctgcgaaaaataaaagtcaacaaaaagccatgaaaaataaaaacaattttaatagctaagaaaagaaaagcctgcgaaaaagaaaagccaacaaaaagcatgaaaaagaaaataaaagcctgcgaaaaagaaaagccaacaaaaagcatgaaaaagaaaaacattttaatagctaagaaaataaaagcctgcgaaaaagaaaagccaacgaaaagccatgaaaaatttaaaaaaattttatagctaagtaaagaaaagcttgagcgtattaaaaggaaaagcaaacgaaaatgaaaaaaccatgaaaaacatttttaaagctaagaaaaaaaaagcaggcgaaaatgaaaaagaatcgaaaaagctaagaaacgaaaagccatgataaataaaaataaattttaaagataaggaaataaaagctggcgattatattaaataaagaagcaaataaaaagccaagcaatgaaacggaaaaaaaacgttcaattttttctattataatgcttttattttttttttatagcgaacaattttgaattgtactttattcctatggctcaacaacaacaacaaaatgtcttgggggaaatgccaccctttggccaagtcaaaattgaaaaataaataaaaataataatttcaattcttttaaggttgcccagttagtacaaccgatactcgtcaacgcggcacatcagcaattggcggtgctttcttctattttacatattaaattgttgtcgaacttccatttcaggagcctttctgtgtggacggcacgcacaaccttcaatttttgaatggttgcgtttctgcgtttgggcagccattgccgtatgtttaatttacaaatgccatttcgtaatgtgttgagtttttagcccgctgtgcctgatcgtcgtttcggttgatcaccgagcagctcagcaaacgccagcgggtccgctcgcggtctccaactgtgtcctgcgcaccggcgaagggcaccgcgttgaagcctccgggtggcagcaacatgcgggtgtgctggcttccctgtccgtcggcaccacatattggttcttcaactgtgttgcgcggacccgctacaggcagctggactgctggttccgcattggggttggaggccccaatgcgcttgtggtaccacatgtggccccacaggtaagtttttttcattttaattttaaaatgattttttttttaaatttatgtttaagcttccggcaaacattccgccaacggtgcttgttcagactggtgctggtcgtgatgcgactcacgtaccgccaaacgtgaccaccgctggtgctgaacgacgcgcggacctggacaacaacaacaacaacaatgtgaggaattgatcttttactatgatttgtaattttgttatttaatattgaataaataattttgtctaggacaatgttggtattgagccgcgttcaagttgtagtccgagtcgtacagctggtgcgcgacgaacacaaaggcgtgttgccgaaccggtgcgtttgagggttcgattcgatttgtccccagaagtagaggaaatttggggggtggaaagacaacggccatatcccgcccgtaaaattagtgtactgccctccttcgccatttcaccaatacacaccaataaatcgggtgcttgtccaatttgcatttgtccgtttgtaattggggagactgccacctcactccactgttttcacattttccaccattgttgtattgtcccctggctaaaaatcagccgtatatgtcccatttgtaaattttatttgccatgaataaatttttgattgtaataatttaaaggccggttgtccaattggtgagggcttcgtcattgagcgctcaacagcgatgaggaatgtgccacgcaacacgcggggcgagatttgtgaactgcgctttctgccgctggagaacgcgcaacggcctgaccttttgatggaagtcatcatccagcaactcctcgaccgtgtgctcgagggccacccatgcccttcgatggtcggactgcagcttcatccgccaggcttcgatcggccatacgtcatcggacttcgcccgccagagcaaaacaacgcagcggcattggcggcagctattgagcggcttaatgagcagtcggcggccggcattgatctgcttgccggaacaacagtcaccaaagtcttggcggtgtggccccttgacgtcattcgtgctgaaccccaacggggaggtgagacatcggagtttttatatttaatagtggtaaaaaaataggtgcatgtgaccgtgacgtggagcatcacgtttccaacagcgtccagtcactggtcaggattaacaaccccaacgaccggcactgcctcgcgcgtgccgttgtcttggggatgcgtgactgtgagacgcgagtggccggcggcggcggcaaagcggcatttaacctgttcgccagtcgtcaagaccaacacgggccggcagcagctcagttgttgactcgtgccggcattgatgtcaatagggatctgtacacgctcgacgatgttcaacatctacagcaatggatcaacatcgaacacggtgtgggccaaattcggctggtcgttttcgaaaaagagcaggaataccgcatagtgttcaaaggggaggggtgagtttttccttttgttttcattttcgggctaattgatttgattgaagattggcggcgaaatttaacctttgccttgtgttggagcgcagccacttcaactacattggccgtgttgagcagcttttcgatgtgcccaactactgcattgactgtgagcgcagggcggacgcgcgctaccacgcctccggatgcaaagttgtgtgccgcctttgtctgcggtacgggcctggttatccatgccaaactgaacaggtagattaggattagaaaatattcaaacaaaaaataataattaagctaccgaatggtggaagtactgctcgaaagtgcggtgattgtctgttcatcttcccaaacgatggatgctacaactaccatttggccaattatgctccagctccaatggacggccgtgggcagcgacaacgtcaacccatctgtcaatggcgccgagtgtgccgtgcgtgttggtgcatcgcctacgagggcaaacaccaatgcccgcgagaccaagcagccgacgacgatggaaactgccgacgctgcaatgggccacactccgtcgatgagccttgctacatacagccggttgatgcggattcagttcggcagcgtgcatcgattgctgttgacaacgacgactctaacgacgacgatgacgacgaagatgagctgccgcttcgtttgtgcttcttcgacgcagaaacatcacaggacaggccattgcagctgaacaaccgcactgccaagaagcacgtgccgctgctcatcgtcgctgaagtcatctgtgagcgttgtcttcaggctggtatcggcgtcaacgatggtcttggaagaagggctcctggctgcgtttgcatgacaggattggtgagaggtcagcttttgcgccaatggtcgtcgccgccatttgtcaacgcagcgggagacaacagtcctgcgccatttggagcaccagcattcaaccagcgccgcttcttcttccactcctttgacaacgaaggcgccgacccagtggatcaatttttggattttttgctccatcatgggccaaagaaagcacacacggtgtgcatcgcgcacaacggtggcaagtacgatttccatctcgtacttgaagcgctacaccgccgtaatcatccgcccaaacacctgtgcaccaccgggttgaagatctactcaatgcgtctgtgtggtcgtcaccaacggcgagtcacatttaaggactcaatcaactactttttttgtgccttggacgcgttggtgaagagcttcgaagtgccggaccatttggcgacggtgaagccattcttcccgtatctctacatacgacgacaacatctgctgcagcgtctaattggtctaccggctcaagagttctactcccccggcacgatgaagtccgacaaacgagcgcagtttctccaatggcatgccaacaacaacaacaaccccggcagcagatttcagctacgcgagcagctggtcatgtactgtgtcaacgacgtggccatcttgagggagtccgtcatccgattccgccaactcatcgccgacaacacgcaaggcctcgacccattcctccacgcgtcgacagctgctggccttgcgcttgccacttttcgccgctgtttcctgcccgccaatcgtctggtccactcacccgagggcggctacttgcgcgggcgccgtgcttcggcagaatcgcagcgctacatccgattcttcgaactggagcacccggaggcccaagtgcagtgcgctagctggtccgtcggagaggcgcacatagaagacagtggctaccgcgtggacggactttggcgacgagaagcgcctctgcgtcccctggccattgaatggcttggatgctacttccatggtaactttgctgtttgtttgttttttctttttaaatcaacaaaattaggctgtcctgtgtgctttcccgaccgacagcaacagctggcggccgggcgaacagcagaggacctctacgaacggacggagcggcgcctctttgagctagagcacgaccatggctgtgaaatccacaaggtgtgggcctgtcagtggatggagcggctccgtcacgacccggacctgaaacgccgttacgatgccgtgttcgtcccgttcccacttgacccgcgcaacgacgcactgcggggagggcgcactgaaccgttcaagctccaccacgtgtgcagtgacgacgaggagattgtgtgcatcgacattgtcagcctgtacccatacgtcatggtgggttttctgcgaaggtgttcatttcttacggataaaaaaaaaaaatcagaaggccaaccgcttccccgtgggcaacccacgggtcctgacgcgcgaggtgctgctccatccgccaacggcacccctcccgtggactgcacctgaaaccaacatcttccgcggtttgctgctcgtgcgggtgcttgccccacgcaacatccgggtgccgctgctcggctaccgcacaaaggatgggcgcttcaccttccctttgtgtgcgtggtgcgccgaccgtcggcagcagcggccgtgccgtcacggtgacgacaagcgctcgtgggtgaccgcctacacccacgtggagctcaacaaggcactgcagctcggctacgtggtcaccgatctttttgaggttggccactgcttaaaaactttgtcatagaaaatacaaattaggtctgggactacgacgagtgggacggcacgctgttcagcagctacgtcaacacgttcgtcgggctcaaggtgcaggcgactggatggccggaggcgtgcgagacagatgagcagcgtcaggcatttatggacgagttcgaacggacggaaggcatccgcctggactcgaccaaaatggagttcaaccccggcctgcgcctcatcgccaaaacattggccaactcgttgtggtaaatattttagggggtgaaaattaaaaaaaaaaatgacatccacagggggaagcttgcgcagcgcgtgggccagacggagattcgctacacacggactccggctgaattctttgcgctcctcgatgacccaacggtggacaagttggactttgtccacgtgtccgagcacatggaccgatgcgttgtgcggaagcgacccgagttcgccagggcgccaccgaccaactgccttccggtagcagccttcgtcacctcgtacggccgcctccatctttacgactacatggagcaggtgttggccattgatggcgcggagctgctctactgcggtacgtttgtttgtcacatttttcgtggacaagcccatcttttagacaccgactccatctactacgtcaacaagatgggtggtccgtgcgttgctgagggcgaggcgctggggcagatgaagcgcgagcacatcgatcgccgaattgtcgagttcgttgcgggtggccccaagaactacggcatccggcacaccgctcgggacgggacggacgagcgtgccaacctgaagatccgcagcttccgcctgtcctacgcggcccagcagctcctcaactttgacgcgatgaaggagctcacgctctccacatacaacattgacggccaaatgtgagttttcataaatgattaagttatttaataatatgaaattcatttttttttttagcgacgatgcgttggacaacgaagacctctacgtgtatggcggcggcgaacatcgtgcaattagggtgaacttcccgcaaattgaccgcaacgtgtacgccgacctctacacgcacgaagcgcacaaagactacaggcccttctacgccaagggacgcgttcgcccggggatgcagacacgcccctttggctatgtggaggatgaaggaccgccgaacgatggacaacggacgcagcgacgaaagaggaattttgttgaccaggatcccacccagccggggcactctgggtggttttgattgtgattttttaaaattgttttgtttatttaaatttgtacaaatcatgttatcaaaataaatcatttacggaaatattcgggtacaatattagataaattggtaaatgactggtgtacaatatcaagagactttgccccagtgacaatgaccttccccgaaatatagactaggcacgtgactccattcaacaatttacaacgaagggctgggaaaatggtagggtaatagatgccacccagcgtgttttggagtcgctctacactgattcgctgggggtaggtttgaacaccaacaatgttgaccacacgcagctggtggatgtccagtgtgatgctctgtgtgtgttggatgcgccgcaaaacgcgtgccgccattttactcgcactgcttgggtggggcactccggtgaggaccacacgcgccgattggaagaccagcgcagccacagttttacccgctattgtacgaatgcgcattatgatagcgtggaagcgcctggggttgtactcggtgtttgcgccacgttgcgcaattgtcaaaaattgctctcgagttaagggttgaacatttattttaaaaacaacagtacaattggaaattgagtacatctacaaaacaatggacaaaatttcaagcgggaaaaaagttttgtggtccccgcctccaaattcaacgacacacggcaaattagggtggcgcaagcggatgccatgctttatgtaatagtgcatccggacctttaatttgcgtggtaacaaaaaaataataataataaaaaaccgtaatgccgaggtagcctcggtaagctggggcagagtgggtgtccaggatggataggtcgttgcaacggaccggaaaattgcgcacggacgggcggagatgtgcagtgcgtaactgaacggagcgcaaatgctccacaatgtcccggcgtttctctaggcttttgaaaagcacaagcagctcatgggcactgcatttgaaccgcttgcagaggtagtccacgagcggaacagggcgacggcgttcggcgcaaccacactttttcggagtgcctaatttaaaatttaaatgccaaataaaaaccaaaagcaacttgatcgggtcaactccgcaccaattggagctaacggctcacgcttcatctcctcgtcaatgaggctgatccagctgggatcctccgcctcctcctcttgctttttcgttggctctttgttcactttgttggcgtcctctaaatccatttcgggataagcgttatttatccaatcagtggcaagaattaaatccatttcaaatctatgaaaatgaaaagatataaataaaatgagcattccataaaaaataaataaaatggacgccttccaacaattcaaaagggaggatggacaattacgtcaccccttcacaatgattgtgtctgggagcacaggcagtgggaagtcagagtggataatgcgtctgttgcgtaatgtggatcaaatgatctctacccccattgaacgcgttatttatagctatggggagctgaacactaatgtgatgaatctgcagcgcgtcggcaaagttggcaatgtgccagtcactgtacacagcggcgttccacgcgcggaacaagtgcgggagtgcgctaaaaaagaaaaaaccttgctggtgctggatgatttgttggtggggatgagtcaacaatatttggacacactcttcacccgtggctcacacaattggggcgtcagcgtaattttggtgactcaacacctgttcaacaaagagctgcaagtggcgcgcaccaattcgcattatttattgttaatgcgaaacccagcgggagcgttgcagatacgcataatcgccacccacctcttcccgtcaaggactgcacattttattgaggcctatcgggacgcatgcgcgaggggagattggctaccttctggttgacatgcacccgagactc

SEQ ID NO: 1504 - DNA, 2840 bp, Heterodera glycines
atttcaagagggaaaaaagttttgtgatctccgcctccaaattcaactacgcaaggcaaattggggtgccgcaaacggatgccgtgttttatgtagtagtgcatgcggaccttgaaaattttgtggtacagacaaataaaacaattttaaaaaaccgttatgccgaggtagcctcggtaagctggggcggagtggtgtccgggatggacagatcgttgcaacggaccggaaaattgcgcacggacgggcgcaggtgggcggtgcgcagttggacggagcgcaaatgctccacaatgtcccggcgtttctctaggcttttgaaaagcacatgcagttcatgggcactgcatttgaaccgcttgcagagatggtccacgagcgggacggggcgacggcgttcagcgcaaccacactttttggagtgcctaatttaaaatttaaaatgccaaatgaaaaccaaaagcaaaacttgttgctggcgcctcctcaccaattggagcgagcggctcgcgcttcatctcctcgtcaatcaggctgatccaactgggatcatccgcctcctcctcttgctttttcgttagctcctttttctctttgttggcgtcctctaaatccatttcgggataagcgttgtttatccaatcggtggcaagaattaaatccatttaaaatctatgaaaatgaaaaactataaataaaaagaaaattccattaaaaaaaagtaaaatggacgccttccaacaatttaaaagggaggatgtgcaatttcgtcatccattcacaatgattgtgtctgggagcacaggaagtgggaagtcagagtggataatgcgtctgttgcgaaatgtggacaaaatgatctctacccctgttgaacgcgttatttatagctatggtgagttgaacacaaatgtgatgaatctgcagcgcgccggcaaagttggcaatgtgccagtcactgtacacagcggcgtcccacgcgcggaacaagtgcgggagtgtgccaaaaaagaaaaaaccttgctggtgctggatgatttggtggtgggtatgagtcaacaatatttggacgcactcttcacccgtggctcacacaattggggcgtcagtgtcattttggtaactcagcacctgttcaacaaagagctgcgtgtggcgcgcactaattcacactatttagtattaatgcgaaaccctgcgggggcgttgcagatacggaccatcgccacccacctcttcccgtcaaggactgcccattttattgaggcctaccgggacgcatgcgcgaaaaattttggctaccttctggtggacatgcacccagagagtccggaagagatccgccttcgaacaaatatatatgaacaaaaacaaatagtttacctaccaaaatgaaagggtcacaaataataacaataaataaatgctttttggagacactgtgtaatgccaaaaaggcgaaagcccttattcgaggcgcatccgatgagcaacttttgtgccttgtcgaaatctgcctaaacattctaaagggacgggtccctttgcgtcctcggcatttgaataagctgaaagctcatgcacaggtgcttcgccgtctcgcccgcacacgctgctctcgctcagccaaaaaggttttgctacagcacggagatggcctcccagctattgtggggctcattgcgtcaattgctctcccgcttattgctgatgtcattgaaaaatataaatagttttccaaaaaattaaaaaacaagaaaaaatgcagcatacaaagcgctatttgctagtccccgaagagatttatcatagtttggcatcaccgccaccgtctgacggaacaccaattgggctggtccgtacccgaattaaacaaataaaaaatgatgacgccataaatgaggcggaaagggcagtcaaatatgagcaggaagttaagcgtctcaacaagctcacaaaggacgaagatgaacgtcccgtgggtgttaaattagaaaatttgagtgacgtggttgacgccatgccaaaaccagtcaacgttacaaggccaattgttgtttctacgcgtcgccatcttaaagtggggcgtgcgcgaaaagaaaatgttgaacaattagaagatactgatgatgatgattatcaaaacccacggtcgtcaagttcaaataaacgacaacccacacaaacggaaatcttaaaattaatttataaaaacgcccaatctctaggggtgtcggaggaagggcaagttttgagagctggtgggcgtccatttataaccagcagtgttgatgacattgttagtcacctgttgaacaaggacaagcgtggccaaaataaagagccaacggcattcaaagaatttgttgaaagggcaaggcagaatccgctcttgagtaggcatttatttcccgaaggtcaatccggcaaaggaatttataaaaacaccccacttaagtttaagccatcattatggatttgaaaaagcttcgtttgctcgagtttttgtacaaggacctaagttcgcctgtcgcattcacgagcgttgaaccgctgctgagagaggcgcggaaaagtcaaccaaaaatcaatcgaaacgatgtccaaaattatttgaccagccaacgtacatacacactgcatcgccaggccaagcggcgctaccgccgattgccaacattggcacccggcttgcatactgaatggcaggccgatttggctatttttgaccgacttgataacaaaatcatggctttcagtactttgtagtctgtattgatacccttagtcgacagggtgtttgtcgagcccgtaaagaccagacgagcgctaacatgatc

SEQ ID NO: 1505 - DNA, 9236 bp, Heterodera glycines
  misc_feature (4501)..(4501): n is a, c, g, or t
  misc_feature (9136)..(9136): n is a, c, g, or t
  misc_feature (9213)..(9213): n is a, c, g, or t
  misc_feature (9220)..(9220): n is a, c, g, or t
aataaaccaaaaaaaagaaataaaagcaattcagacagactactgaataaaataattataaaaatgaagaaaaacacagatttttttttttttttttttttggtcgttttcgagagtgagaaatagggcgtcggaaatttttttgttttcgtttttgtgtttgttttcgtatttggttttttttctctcttcactatcggcagtaattatatggctgtaagtttttcgtaagtttggcattcgacaaaaaaaaaacgaagggtcaaaatcgattcatttctaattgattcccattcccatctcagtgccgttgaccaacaaaaatagaggaaatgaggcgaaatgtggacaatgacagtggtgcaaacaatggcgcgaacatcagcagcaacccgaaaattgcccgggatgcggaaattgctcatgttgtggacactggaaatggcgcaaatgacgcgcttggcgacggaatggacattgggcactgcccaaactgctcgtggcattgtaatgtgtgcagtaagcgaatttttctgttctgcattcgatttcgttcaaacatttctttgattcagtctgtcattaccgcctaatttgtttaatttactatcaaaaaccacaaaacggtcaaatttttatttttttttccctgttatcaatttaatcaatgtttttgggctgattttccactaactaattcaatttgctaccaaacaacaaaataatggtcaatttttttttcttctctacttttttcgtcaaaaaaaaaaacattgccgccaaaagttcaattccctattaaactaatacagtacaacaatgcgcggtgcggagaacattgcactttgaacgctaatatcatacttatcttttactgtaatcgccgatgagcctggacaattccatttttcgatttccacgatagggatgggctcttaaatgttacaacagctaatgggaaaagcgtcgctattaacaatctccacttttcactaaaaagcatttcccactcattcatcaattcattcttcatccaaagcacatagtgctctcatctcaatcgtcaaacgctccgcaattcacagccttaagcttaagcaagcaaccgcgcgaaccctaccgcctattccctcatttgtttccaaatttaattgttacatctaattattctaattttgttttcccgtttcattttgcttattatttgcgctcatatttgaattgttttaactcgcgctctcatttcaatcaatagaatagtcgtaagactaagagcagaccaaattttttttttttctcttttcaaattgtccaccccaattttcaattgaactatcctttggatagaaagaaacgaaacaatggaagaccaacaagttacaataacgagtgtagacaggacattatttcaaaatctcagtcaccctcctaattccggtgctcccttttcattggtagaaaaagtataccaaggcactgtacgtctagaggatgccgctaaccgaagtctaagagtaattaatcgcagagctgtacaaaatacagatgccattaaccaagtatctgtaacggttaatgctaacatggacactctctccacaagacttgaccaagttgtagagaaagttgaatctctggaaagccaagtggagaattgggatgaccctaatgctgataaattatcacaaaacgggaatgccactgtggtactaaggggccgcgtggggttacttgaagaagaggacgatgaagacgaatttctaaacgttttgacaactgtggacccatttgctagtcaacttccggcatgcagagatgaaaatcttacctctttcgataactgggcccaaaaatttagagaccttttggattatgcgggcacaacatggtcagaaaaagaaaaattaggccgactcaaattttctcttgaagggcaaatcagaaagctctttgataagcttccggacaataaaaaggacactgtagataaggcattaaatgccattagggacaaattagattcccctgaacgctgggaaatgtcaaaaagggcactgtgacatgcaaacagcgagaaaccgaaacagtccgggaatttttgtcaagactttcgccattggttactactgtgtgtgccggtcaaagtgaggcacaaatacagtcacgactaagggatgaatttttggaaagggtcaagcccaatttaacctttcttatccgactgactggtgtcactaagaaccaagattttgaggctgtgttttcccaggcacaagaattagaacttcttttgactaataccaatgaaaataacgttttggacccgctcaaattcactgtccaagctataacccaatctccggtaaaccaatcgggttatcgtactaaccaattttcttcctccaatgtgaattcatgggcacccgctggacaaagatatacgaataaccgtcaggttaatcagcaaacacaaaataatcaaccaaatggttcaggaagaggctattttcggggtaaccacggtgaatccaacaggcctcaatttcaaagaaatagggctaatcaataccggtcgaaccgaggccgaggggaccgcaattggactggccgtccaaaatgccatcactaaggaagtaaagagaataatagggatggcatcattttatagaagacatatacctaatttttccacaatcgttgagccgttaacccgtttaactcgtaaaaatatgaccttcctttgggaagatgagcaaaaggcagcgttttccaaaattaaggaaattctttctcaagaaccctcactttcctttccaaattattccaaaccatttcatatctttaccgatgcttctattgttggccaagctggtattttaatgcagaaaaatgaatttggcactttttctgctatttcttattgcagtaggactcttagcgcttccgaaaggaagtggccacccgttcaaattgaactgggagctataatttattcactaagagaattcaaaccatatatttttatgtcagatgtggaattacatactgatcataaaccattagcctatctcttaaaaaaggcagaagctcatccaaatttagcacggtggctaattgaactacaaagttaccaaattaaaatagtgcacataagtgggaaacaaaatagtttagcagacgctctgtcaagagcacaggaaaatattacggtcaaagaagtacaggacttagatgaacttgaggacattgctgagtttccaatttgtttaaacctatcaattgaccagcggttagtttttgatccattcgttaatacattaattcttagaggcaaagatggtaattcgtacaatattgatttaaagaaagagcaaagggccgaccctcaaatctctcaatttattaactttttacaaactggcaaattttcgaatgaaatataccaacagaccatggaatctcttactgatcaagccaaaaacctcgttattgactctggaattttgtattttaggtaccaggatcagtcaccacgaatttatataccaatctcattaagatcccttatttttgactcatttcactcttctcctcttggtggagggcacatggatttaaaaaagacattgaagaaatgtcgaaaatattattggcctttcctatattctgatattttaacatggtacaaacaatgtattacttgtcagctaagacattcaccgacgcctgcattcagggcagaaatgcaaatggtccccgccaatactttatttgccagagttggtttagatctagccggtccttttcctattactgaacgtggcaataaatacattttaaatatcatttgttggttctgtaaatatgtaatatccgttcccttacccgatgccaaatcgcatacaattgccaaagcttttcttagtaattgttatcttaagtttggtggttgcaccgaattagtgagtgacgatgcgacagcatttacttctgagttctttcgtgaattttgctcgttattatatattaataagaaatatgcagttccacattggtcgcaaggaaatgcggccacagagcgcacttttagaacatttaacaatattttgtcaaaatatgtcactaaagagcaaccagattttgatgaatttttagactatgccaatttttgttataatacatctgttcattccacgactcacgaaaccccatattttttaatgtttgggcgtgatccgattttctgtattgatcaaataatagatcctaggattagagaaccaattgcatttactgatgagacagaatttaaacagaaattagtgacctctcttcggagagcatggaagataaccgcagaattacatgctgaggcacaggagaaaatgaaaattcaatacgataagactatgagaactcctaatttaaagattggggacagggttttattaagaaattatgatggtaaacgtaacacatccaaaaaatttcattttccatnggaagggtgcctttagaattatagaaattgagggaatatatgccacaatcactagctgtaattcgcctcaagcaaatccacgccgtgtccatataaatcagcttaagaagtgttatgaaaatttaggggggcctgcctgcacttcacctaggcttagttcagaagagagaaattctctcgcagagttagaagcggatgaaattcacaatttgccgggtcactcacatcctactgatataccaaaacattctttttctcttatcgtgattctgatgatgaaatacccgctaatgagcccaatattgataataatgaggttaaaacatcactaacaccgcaaaatatggtctaagacagcgcgaaaaattaaaccgaccagcacgctttttagaataatttttttttctctcttctaatttttcacttgcactttattttctttatttattatttttctccttcatctattgaccattagtttgcttgtttcgatttaatttttttttattcaataatttcctaaaacaatttaagcaacattcgtgctaatccaagcaattctaattctaatggtcaaaaaacgttcagcccatcgtccgaacgaaaacatggccgcctttttcttttctttaaaatgatataaaatttcaaaattgcattgtttttctaaaagcttttaatagaaaacgcgagcattgagtagactcttcagagattctaatttaaaaaataaaagtcaaaaaacattttaatcaataagataagtttatgtgtattaaacagaaagagcaccacaaaaatttagaaaagacgcttctaccaaatgctaagacaaatttgtcatttttataaaaaaaaattgtttttatttaataactcataataactcttcatacactaattgtgacccagctggtactgcgtgatggaaagagcagaaaaagttttacaaaagctcgaagacataattataaaattacaaatttatagcttaagtctgagcctagatagtgccaatagcctgagctagagcttttataactagataggtcatttattgacgcctaaattaaaccagagttaaaatttaacactttctagatttttaattaaattttttggttaaaataaatgtgagaattttaatttttaccaaaccggtttttaatgcttacacatgcagtcatttttttccctttggttttacattttgcttaaatcgctattttaaaatactaaaatattttaaacattatgttttggagctaacttttattttgtattagcttaaaattttttgttattaaaaaatttcttttaaacctaatgaagcactagtcttgctcgctataactttgttttataaattatttaataaatgaatttggaaataattttaagttttcaattgtcaatacaaatattttttaactttatgattatccttttacttaaatttcttcaaaaacttatataaatcaatgaattataattatgatggcgctttattctcggcgacggcccaatgtatcggcgttgccgccagtgagtttcggcgaaatcattaacaatcaaatggctttgtttttgatttcaaattaataaaaattaaaaaataatttcatattttattattacattttacttaagtatatactaatgttagtgcttcataaaaaatttatagaattttgataaatcaattttatttatttttttctaccgctctaacttgtcttaattctattaaaattagtaacacaatttttttgatgataattttaaacaatttcatagaaatatttttatattttttccataaaacattaccaaaaatttaatacgcttacttacttaattacttaaatttttgttttagcatttcataaaaacagccatttttgatatttttatataaaacattaacttttgagtattttccataaaacacattcattaatttgttttttaattaaaataatctaaaaaaaagaaaacaacacaaaagcgcattcaataaggattttaaaaaatacattaaaatatatattttttaattgaaaatgatattcataagacataataaaaaatttaattgtttctataaaataaaaaaataaattttcataataattatttattctacttattttgacggaccttattaaatattaatgacctaatgaaaaacgaaccaagtcgatgcgtgaaagcttgttaattaacatttatgaatataaatagtagctataattaaaattatacaaatttaatagaagtaaatttatgccagtaatttatatgtaaaatacaattaatggtatcatgagaatcaaatgaaaaacatatttaaatagaagaaaatatttaaaaaattaacaattatttgaaacaaagagtataaacaaaaaactaataaatattcatttttcattataaattttaatatgttcatttaatgattttgtttttgtattattattacattttaagaatttcaatatagataaatatattttatattataattaaattttataaattatttctcatattattaaaaattgttacattaatgtaaaagaacccgacacagtacagcaattattttaaaggttctatccgatttttatttatggataaaattataaagaactcgttcttttaaatatatcatttaaatttataatacttatgttattaattcagtttttaaggattaccaaaaaaatattaagcggcaaattaaaaattatcaatgtaactacaataaaatttaacttaatgcgaaaaatttaaaatttcaaaatatgaaatttatttttatagtagttttgcaagaaaaatttaagacaaaaaaattaactaaaatgcaaaagtttataaaattctttttttgagaaaaattttggtgagaaattgtaagtactggaataatgtatttttttaaggaaatttttggaggtctgacagaactatttattgaaaagatgaaggtgttgtttttcgagcgattaatttggtgaacaattttgttggttggtgcaatgattttaatgcttcataacatacggattgtttggtcaaaaactcccgggggtttggaaatgtcttcactggcctccttctggtttggtccttttgcaacaacgggaacctggtcatttgccgtttttgagatctccgtcgcaaaagccaatgaagctggagtcttttgacgttttcggagacgttcttcgaatttcttcatgagctgttctttgataagcgccggtcggacgaacagacgggccaaattttgttgagaacggagtcgagcacgctcgcgcttccatcctccgagtgccatgtgttggtgtgtgggtgttggcatgactaccttgagtgggcgtggtgttgttcgctgcgggtcgtaccggccgagtagaaagacggcggttggttcggccttaacttcaagatggtccaagattttggtggtggcttccctgtcttcctgaacacgctccgatgagcgaccggcattactttccgggaggccaatgaacaccaatgtgcgttggcgttattgctctgcgagtgcggcagtgattgggtccaggtccagttcgggtgtcattgaacgtttggcgggaggcagagtgatgtttgttgcgttggctcgcttcatgtcgaataatagaaaagaataattgttttttgagatcttaaggactacagaagagtcaaaaatgaataaccacttctatgaaaccatccaataaattcttagcaataataatattattagtatataaataaaacattattcaaaagcaaaattaataatcgataaaagcatctttattttaatataggtttaattatttgtaaattgaatatcatgtaaaactaattaaaaatctttaaacgttataattaagtgagagacgaagaaggtcatcttttttgaaagatcagaaatataataaaagaaaaataacttttcatcaatatttgatttaaaatttttaaatacgaaaatttaatttaaaccttaattttataattttgagatttcttaaattctcccaggagagtacaaatgcggtgcctccagttcgtcaatgataatatctaattaatttattaaaaatttttcttgttatctaaattaataattaaaaaattataacaaaaacaaatatatcaatacttttgtaataaacatgcattttttgtagtttagtagatggataaaaattcaataaaactatgtatttaaaattaatttatttttatctgtctccctttaaaatttatacaatacttttaataagccctcatatattcgtaaatttattttaaggaatcatatatataaagaataaaatttaaataatcctcagtatagcattattttatttttatttgtaaaaagttcattgttcagttgtggtatacgatgaatcgttaatacttttctaaatttatacgatttaaaaatacatcttcaatttctacaagattagaaaaagacgcctaagaatgtgttgtgttcttccacttagaacacacaaagaaaaagaaataaataaataattttattgattcggtaggagggcaaattggaaatataaataaatgaatgatganagggaagaacaaaaagtgggaggaggtgtccacttttatggacgagggaaggggcggatggacatagaaataacaantaaagtncataagtcagatcgcc

SEQ ID NO: 1506 - DNA, 1076 bp, Heterodera glycines
  misc_feature (24)..(25): n is a, c, g, or t
tataggtttaattattgtaaatgnnaatatcatgtaaaactaattaaaaatctttaaacgttataattaagtgagagacgaagaaggtcatctttttgaaagatcagaaatataataaaagaaaaataacttttcatcaatattgatttaaaatttttaaatacgaaaatttaatttaaaccttaattttataatttgagatttcttaaattctccctggagagtacaaatgcggtgcctccagttcgtcaatgaaatatctaattaatttattaaaaatttttcttgttatctaaattaataattaaaaattataacaaaaacaaatatatcaatacttttgtaataaacatgcattttttgtagtttagtagatggataaaaattcaataaaactatgtattcaaaattaactgaacctttcgtcactaaacttttcgtcactgaacctttcgtcactgaaataaaataaagaattatttattagtgaaaactatttttttttaaataaagttatgtatttgaaaaattctaaaaattgttagttttgtgtcaatttaacatagtattttaaacacataaatattattaaaatatcagtctttctaacaatttgtttacattcaaagcaattactttgccatggaaatcggttcggtgatgagaataacctttaaccctctcggccctccaattgtggtgtgggtcatttctgataaaaatatttggcaaacaaataaaaaggaatgaagagaaggcaaccagcggtcattcttatgattactcccttcattttcctaataaaatgcaagaaaataactcatcatccgacgaagagggtcaattgctttcatcttcatctgggaatgaagaagcggctaaccaagaattaattcaattcatcgaatttaagtcaaagcgtggtgcctcacttcttgcacgtaatgggtttgagtaccaatttgaacgcaattcggccttagttgataatgttgaatattggaagtgtgttaaagtgagtaacaaaataaaatcaaagggatttttctttggtcagaggccaccctactgcgcgg

SEQ ID NO: 1507 - DNA, 1222 bp, Heterodera glycines
catccaaggcatcaccaagccggccatccgccgtttggcccgtcgtggaggcgtcaagcgcatctccggcctgatctacgaggagactcgctcagtgctgaaggtgttcttggagaatgagatccgtgacgtggtaatttgcatttctcattaatgctatttggggaccaaatttagggtgcgtttttcgaattttaaaactaaaaacggaaaatttgcgtgaagtgctgaccagttaaaatcatttatgtgcctcaggtgacctattgcgagcacgcaaagaggaagactgtcaccgccatggacgttgtctacgcgctgaaacgccaaggacgcacgctgtacggatttggcggttgagcgggacggaaagaacggaggagagaagagaagcatcaaaaactatcccaaaaggccctctttagtgccacaaccattcaaatggacgaattgacatgctttttcaatttttccatcaacagtaaatttgactttttctgtttttgttttgttaatttgggttgggccgggacctcggatgaccgggaattcccggcccggtcccggtcccgtggcactctaatttaaagttgtcatcggattgggcctgcttcaactgatatttttgtgctcgtctgttttatgaacacggtcagtttaactcattaatgctaattggttttcaatttggtgccaatttcagctgcacggttctcgcaaatcgatgtgcgaaaaactgatggccaaaggcgagcgaatttcgatcagaatttatccgtttgcttgttggttgatctgcttcgaggattttctgccgacagagtgcgttttatatggacattggaatggattactgatcagagaatagaccaaatattttgaaagtgatcggaactgttcagagaatgtttgtaattgatcggaaaagtgctcccaacattctctgatctaagaagccctcggaaatgaaaaaataattttttttttttttgcaaattcaggcaaaatttccaccgctttgaaatgctcgtgttccaatcgccgattgtacgaattatgctcgaaattttgaacatcaccgtgttcatggtgaacaaccatttcacgatcattttatctgtttaaatgtttcctaatttggcattctgtcactcaggaactgagcagtcgtaaacacatgtacttccaaatatccaattttgctgggatgatttcccatgtt

SEQ ID NO: 1508 - DNA, 4453 bp, Heterodera glycines
atcagagaaagaccaaatattttgaaagtgatcggaacgtttagagaatgtttgaaattgatcggaaaagtgctcccaacattctctgatctaagaagccctcggaaatgaaaaaataattaatttttttttgcaaattcaggcaaaatttccaccgctttgaagtgctcgtgttccaatcgccgattgtacgaattatgctcgaaattttgaacatcaccgtgtttatggtgaacatcaactatttcacaattacattttttaaatgtttcctaatttggcattctgtcactcaggagctgagcagtcgcaaacacatgtacttccaaatatccaattttgctgggatgatttccatgttcattggctcctacagctcttatgtaattgtgccgcttggtgcttcgatgttgcacgaatatcggcacgtcacatttttcaacaattttatttcaaaaaacgaaatttttcagttttttgctgctcttccgtatcgtcgacttctgccaactcttttggtccgtgcaaaagttcgtcgccgacatcttcggcattctcgacatggtgccgagcatatcgcacaattccgccccattgccaccttcggcggtggcacaatgtgagcagaacaccagcgaaaaagtggcacaattatcttttggcactttgtgaaaaagtggcacaattatcttctggcacttttactagaattttcgagagaattttttaattaaaaaataattcaaataattcccattcattgtcctttcagtttacatttgctttgtgctctgtgtcgagatgcttttcgtctctttgttggcaaccttttgcttccaaccctcgcgctgtgccttttttgacaattattggaaacggaatgccaaggacaatgccaacggggaatgtgccgaggacggatatgaacccttgaatgacgacggcattgatcaaaagcagcagcagcaaacattgacgagcaccatttgagaagtgaagaatagagtgataagcaaaatgtgatcgggaaaaagtgatcgaaatttcgttttgtttattttttcgccaaattcactcataattacataacaaggccatcattaggtaaactaaagttggtcactgattgagtaatactgcagaattgcggtcaacaggcaaattttttgaaaaattagaacattttcttaccatacatcattaaaatttaaattattttttcttttttgaaaatgtgactccaaaatcggtctacgaaagttgggcccccacgtttgggccccagcaaatttttccactataactttctataacttttttcttggtcatccaaagccaaaaacttggtatcattcgaaagcttaacatgtttagaagctttttctaagctatttcttcgcgattagacaattaccaaaaaagtcatacatgaaaattacaaaaaaagtcaaaatttttgaaattttttcttaataaattttttccaggcttgaaaatcatttcggtttttgtaaggctaatagagcatgtgaagggctttcgaatgataccaagattattagatttggatgccaaagaaaaaagctatagtggaaaaacatgctggggccgaaccgtggggccgaactggcgggttccgacatttagggaaagggaaaattttataaaaatagaaacatttcgccaatgctacacaaattttttgtataaaaatgcttattttttcttcccctctcctcattccattctctcattattcttcctatatcccccggtcactttgttgctgcaaatgtcttcagaaattctgtacgtttattatatttcttttaatgacatttcgcatttaattttgtcaaattttggccaaaaattgtgagatgaaaaatttcaaaaccaattttgaaagattagctttttggaggctaaaacttcacattttacttcctattcattgcttttcctttccctttgattcattaatttcgccaattcatttttcagttggtctactgtttttcttctattggtcgattgtgccaccattcttttttggttcttttttggccatgtcaaaaaacgacaacgcccacataaaaacgaaatgtaaaataaattaaacgagatatcgaaaaattcgtcaattttcagctttatctgcggcgactgttggcttttggtgttcgattttcttgcgccttctcaactcggcctcgaaattgcactgatcaaccgccgctttaactgcatcgtcgacgaacacttcaagacacgcaaatggaaattgggctgcatgcgaatttgccacaaaattggagaaaatggcactaagcaattgcaaattgtcaattccaatgcaaagccattgccaattccgcaaaatccgttgcccaacaaagtcatcggattcagacacattcagatccagtatgattgattaaatttgatttgctttgtgaccattatacatatttttcggcttttcagttacatcgatcaaaatgtcatcgcatttctccgccgttttcaccgtcgtattttcgatgtttgttcaatggttttgtacattcacacagacaatgaccgcattttggactactttttgctcaacatttggccaatgtttcgtcattcaatgcgtctgatgaatttgaattccatctctttacgccgtctgcgccaattggccggcccgtcactgctcagcgattgtccatcacttcgctttgtctcttttaatgaagccattctgcccgcttttccgcctgatgaaagtgtcaatgcttcggatggccaagcgctggccaaatggctgttcacgccccgtccggatggtcagttcaagtggttcagaggctttgtcaattcaccggatcaatggtctccaacgatggaacagctgaaaacggtggagcattccccatatttaattggttttttttgtcacatttttaggcattttccaatgcttcttctccaattacttaccgcatttccttggcgttttcgtccacttcaattgattccgttgtgccatttgatgatctgatcaacgaagtgactggggagaaattgacactggaacaaaatgacacaaatgattgttggctcagccgttgtccaattgcatgggattaccgaaagtggaaaaatctgtcagatggaatttttgatcaaatgaacccaattgacattctgatcagtgatggcggattcgacgacgggtgaacaattttaaaaattctaattaaagggtaatagtgcagaattgtggtctcgattttttctaaagtacttgatttttcagaaattttttttaatataaatttccttttcaagaatttggggtaaaaaatgcatgataatgaatctgaattatggtttcgagaatcaatatttttgtctatgattttcaacaagtatcataaaaaaataaagttaaaagcataataaaatttgtaacattattttcgccaaaaacaaattggaagttttgtgttatttgagtgtaatcgaatcatcgtttttcagtcttcttctcgacgccgcttctcccgggccaagtgatcagtagaagaaaggacttaaccaattgattggtgacgaaattgtctgaccgaaatgattttggcattttgccatttaattttgcctaattgtttgtctgtttgtatttgacctttgcttgctcgcaaatgcgtccatttccaatgtattttatgtgtatgtaattcaataattgtgagtaattattcgttgataaaatggttaacaataaaaacggtaaaagctgtgcaaattcgcgatccaacacaataaatgccttggcacaacaaatccctgctgaccttttaaaaccagtggctaccatttgtgttctttattgctaaggtttttgcttatttatttaaatttcgcgcaaaaaatggtaattagcctgaaaatgtattaaattaaaaatctatcaacaagtaatcgtataaattttcaaaaatctccggttgcccaaaattcgattattggtagggagtccaatcatatggaaatccatatttttttcctggattgtgtgaggcctgaaacgcacaaaaaacatgtttttagcttggtttgaagcttctaggatgactttccatatccattttttccatattgcgcgtcgatgtgcgaaaaactgctgatggcaaagggcgagcgaatttcgatcagaatttatccgtttgcttgttggttgatctgcttcgaggattttctgccgacagagtgcgttttatcaatgaacattgagagggcctactgatcagagcatagacaaaactttttgcttagacaagtgatcggagctgatcactgatcagagaatgtttgaaaaattactattacgtttgaaataattgcatttattcaactgaaaaattatgaatcaaacaataaacacttcatccctttgctc

SEQ ID NO: 1509 - DNA, 1273 bp, Heterodera glycines
atcagaaatttccggattcattactctaaaaaagttcaaaattaaggtctacaactaaaatatgtgtgtgacgaataaaatattgcatctttattttaaattggcataatgtcaatatttttccataaaaattctcattcataagctcattttcttattatgaaaagccaaatcattaggggtgtaaaaaagtctcggtctcggtctcgaaaatcgagaccgagacttgaaaacccgagaccgagaccaaaaaaacccgagacttttctcgagtcgagaccgagagtctcgaacagcactaattggctcctacagctcttatgtaattgtgccccttggtgcttcgatgttgcacgaatatcggcacgtctcacatttttcaaattaaattaaaggaaaaaaattctttttttttcattttcagttttttgctgctcttccgtatcgtcgacttctgccaactcttttggtccgtgcaaaagttcgtcgccgacatcttcggcattctcgacatggtgccgagcatatcgcatgatcccgccaaattgccctcttcggcggtggcacaatgtgagtagaacaccagcgaaaaagtggcacaattatcttttggcactttgggaaaaagtggcacaattatcttttggcacttttacagaattttcgagagaatttttttaattaaaaaaataattcaaataattcccattcatttgtggtcctttcagtttacatttgctttgtgctctgtgtcgagatgcttttcgtctctttgttggccaccttttgcttccaaccctcgcgctgtgccttttttgacaagcagcggaaacggaatgccaaggacaatgccaacggggaatgtgccgaggacggatatgaacccttgaatgacgaccatacatgatcaaggggtggtaccggccgagggccatacgatgtatgattgtaccagggggggtggtacgaggccaaatttttttacgatggggtccaaaaattcaaaataaatttgacgacctttttttttttttgctttttaaaatcttttttgcggcgcggttttctcaaaaatttcgcgaacgcgggagccggcggtgccgataggcgccgccgggaaatttttaaaatttacgtggattttgtaacgaattttcatccaaaattgggagaattttcggaattttaacccagggaccaactttttttcttctttaaaaaacctttttttgcgatgggttttttttaaaaaactttttttcggggggggggg

SEQ ID NO: 1510 - DNA, 2971 bp, Heterodera glycines
  misc_feature (2777)..(2777): n is a, c, g, or t
cccccccccccccccccttacgacgaacgatggggggggggggggtggtaatagaccaccccttgatcatgtatgatgacgacggcattgatcaaaagcagcagcagcaaacattgacgagcaccatttgagaagtgaagaatagagtgataagcaaaatgtgatcgggaaaaagtgatcgaaatttcgttttgtttatttttttcgccaaatttactatcaaaatttaaaaagctgtgttgctttgtcttagttgtataactgttgatttgaataataggtattcatttcgttttagtcttccgccaaaatttgctcacatccgaattaacaatgcctattatcacattagatgttgtggccattttttctttaattggtacaactcatgctattgccaataagtttcagtttgtgccgttttcattggctctcgcaaaatgacgtcagtaggaaatatacggaaaaaaaatgatccaagtagagatcaggcacgggcttttgttgttggactgacaggggtttcacagccacactggatttacaggtttttagaccataacccatgctcatatatgtggaaaattccgtaattcatactacaataagattcctggatactgtaaaatttaaaatttattatttggcattatttgaaaaaattaatggaattttaaaggccggaaattgcccacccaattctttaacaaacaaattgttgaaggaatgacagcgacagaaaagagcagcttttgcatatgcacacattgttcactcacatcaatgactccaaaattgatcggaactggggaaatgaaaaattaacccataaaaaatcggggaacagcctgacacagaaaacactggaacaaaaattgtgttcattcacttcaaatatttcgcaagatttccgaccaaagttggatttggcatttacaaatcctttaatccctctgaaatacaaaatatgaaaaattggaaaccttacacatttccaaagacttcgtttatcattttttcctaattacatttttgtgtgacatttttaatccatttaaggcatttttactggatgtgactatgcaaaatgtgattttcttccagggatcgggtgggagaatgcgttgtggagcacgattttcgtcaattcttttatcattgagtctcctgctcgtctgcttcgatttgggtataaatagatcaatcaggtttattgttagccatttaactcgaacagacaattcatgattcgaattagtcaaaatgggatttttaagccataaaagatgattttaggggtttgcctgagcaaatatgtggaccactacgagacgctcagctatcaaccggtggttgaccgtcaaaaacggtcattggagacggaccacgaggacacccatgggactgacgtcgatttgcacttccgatcgcacaataggtttcatttgtcaatttaaattggtggcaattacgtgccaaaaattctactcttcgcccgcatttgtgttgttgttaatgtgtttgaagctaacgctaagctggccttagtgtccccgtaactttattccaaaaaccgtttaaatgtcaaaatttttttgtgttagaatttatttgaatttcggcattggagaagcttaaacaagctagtccctttttgaacgcaaaaattgattaagtacggcactattgcggtttagcgggcccaatgaaagaccataagggggaccctgaattaagacagtaatgaaaataaatcaaaggggaccctgatatggtctttcataaggcccactaaattgcaaaaatgctgatttgtgcaaaccgatatttataaatttgcacagaaaatccctttgaatataaaaatccaaaataagagcaaaaacacaacattttagtattagacgcttataccaagttatgtttaacaaaaatgtaatatttgtgtaaaacaaagtgataattcatttatatacatcaatatttctaggactttccatctcaaacttcgaccgttggactttacaaattcgctgtttaccgacgaccacattatcgacgtggacggcgttcatcacacgcatttgatcagaccaaatcgctttttgtacgagggacaaattgtcggtatgccattgcatttaattacaaaacacccatctaaattagtaagttacggtttcttttttctggtccactcggttttaaagggttattaccagtaaaatggttacacagataactcgagaaatccaaatccactggtttaaaatccacagttttcgtggtacaagaagaccatttcttatgagtagtttcgaaaagtacgtcgaaaattgctgtgttgtcaaagaaagggttcactttcccactgtttttcatttattttccaaaaaaaacaactttggtctttaggtgactcaacttcgtttgtccatggcactttgttggacggcatttttgacggatttattttcacgggcgacggccgcacattcaccgtggagaaggcggctcgctatttcgacattggccaacgtccggcccatttccattcattcatttacgcggacgaagagatcaatcacaagcgattccgacggacgaaaagggaagcggacgaggacggacgagacaatgatcagcagcaccacgaacgtattcaattttttggcgagaattttggaaatttgaatttaaaattgggaatttatgtcacatgacggtttttcattccatcatgcatcacaaattgaaagtaatcctggtaacggttntgattttaagaccatgtactcatttagtaattcagcaaaattgctagtaatatgacgaagtatgcatttgtttagtagtagatcataactagggctggcaaaatatgcacatgcatatttttttctggactatgggaggccttaacgcacaaaaacatgttttttagcttggttttaagcttctaggatgactt

SEQ ID NO: 1511 - DNA, 3260 bp, Heterodera glycines
  misc_feature (1678)..(1679): n is a, c, g, or t
aagaatcttaggtaggaataaaatgccaaaaaaccagtaaatctttgatttttctcaattgtcgtaactttgctttttacagcaacccacggccgcgggccgaccaaacagcgggcagagcaaatcgttggatttccaacagtcagccgaccaccggcaccacaacagtagacagtcacctttctcctcctatatgaagcaccaccaaacgcagcagcaccattcgttgcggcacggggacaacgacgtcgaggacgccattgagttgctgtccttcccgcaaaggtttgtggctgggtgtatttcagtaaaaacctaggtaactcaatggtctcatcattcggccaaatttttgtaaaactccgtgaatcatggcgtttttggtttgtgaccaggggtgatacacttttaaaaagacctccgtgatcactgattgtaaaattgtccgtgattgaaatttaatccaaattacgtccagccctttacccataaataaataaactcgtgtcatgggatattgatgcttttggcggggattcttttctatacctcgtactaaaccgcactttgttgctcttccagttacttgggcaagaatcggacaaggcgtgagcagtcgctgaagccggaatggcgggagattcgcggcaagcgcatctacgaggtgcgcacctgcaccatctatttgcaggcggaccacaagctgtacatgcacatctacaacaaggagggcaaccgggaccacgccaggcaataatcaacgaatttttgattacgaaataggttgtatatgagaacaactgttgagcgaaaagttggtattagcctattattacgcatttttggcacaaatttaaaaaatctcttaaaatatatatatataaaaaaagagttcaaaaccttgtaaaacattaattttaggacacgtgaggagattgtttcgctgctgtacaatcacatcaaggcggtgaacagcatctacgaaaacaccgactttcacggaatcaacggcatcaattttgccattcaacggacaacggtttgtttttgaggtgtgggttgtaggctttttggaatttacaaaaattttataaaaatttcccaccctcagatttacacgccggacacatgcgcaggtgcgtcgtcggcgaattccgctgcgactgtcggcaacaacccgttctgtgaggagaacgtggacgtgtctcactacctgaactccaactcgcagaaggaccacagcgcattctgtttggcctattcgctcacctaccgcgactttcttggcggcacattgggcctggcatgggtggccagtcccagtcaaagtcggtgatacagtgttaaattattcatttggtctattattgcttttatatattttttatactgttttaggcactgccggcggcatttgccaacgtttccagcgctacaatgagcagcaacgcggtggggtcaaccggtcactgaacacgggcatcatcacgttggtcaactacgggaacagagtgccaccgcgcgtgtcacaactaacgttggcacacgaaattgggcacaattttggctcaccagtgagtaactttttttcgcaaattctaggaaggcttcaagactttgtctcaaaactaaatttatttccattttagcacgattttcccgccgattgccagcctgnngtgcccgacggcaacttcatcatgttcgcctcccgcacctccggggacaagccgaacaactccaagagtctccaaatgctctgtggctaacatcagcgaagtgttgtacgaagtgctcggacaggttttttgaaaaattattattttttacaattaaattttagagtcccaaaaaccagcagtttggacggaagaaaaactgcttcactgaccgtgagtttctcatgcattttaacatcttttgggtttacgagagatctgggtttcgggttcttttttcgggattttctggttacatccctacaaatcttggtacgctttctggcttcgggattttctttttttcaataaaaatcagagaaatggaatgcccaattcatttttatatatttaatcaatcgttaaatacaaacctccttttaactgtttccttggtttcacagagctcaagtcgttctgtggcaaccaaattcgggaggacggcgaggagtgcgactgcggcttcaccaagcaggactgtcacgagaaccaggaccagtgctgtgcaccacgggagaacaatgacgagcgcacaatgtgccgacggttggccggcaaaaagtgttcgccgtccgagggcatttgttgccgagcggcggactgctcatttgtgcagcgcaacgggcgcgtgtgccgggaggagtcggagtgccaacacgagcagaagtgtgacggaacgcaggccaaatgcccggacagcaggaacaagccggacggaaaggcgtgccaggagagcaccaaggcaagtcgggcgagggtgggcgttcattctgtaatgttatcagttcatggcttggcccaggcctgtcgctgtgttttttgtttataaaatagtcaatggatgtgtgccctccccccctcaaaaactaaaaaagtcatattttttgggtaccgatttttgttaattttcgttcggaatagaaatgttttatttttgaaatattttttaacaaatcgcaaaaaaacatgctagagatgccctttacaatacaaacttaattttgttttattttgtccacaggtttgtcagaacggcagttgcagtggctcaatttgtgcgcaccatggcatgcgcgactgtttcctgaccgagggcaagccggaggacttgtgccagttggcctgccaaacggaagcgggtatggacaggcatgggtgcttggcatagtatcttattataacgtcacatcgggtaacgggtgcatcccaaaatttctccgtccaaattttgccgggacaaaataccattgccaccttttgaggatgccaagcagcggccgacatcccgcggttgaccgtatacacgcaggaggggcgcaagtcgggccatttgctgttgccgcccggctcaccgtgcaacgactaccagggctactgtgacatcttccgcaagtgccgttccgtggactccaacggcccattgtcacgactgcgcacgctgctgttcaactcggaaaagatccaagagttcaaggaatgggttaaggtgtgtattttaaatttttctatttttaatcgtaatttttaaatgattcccttcca

SEQ ID NO: 1512 - DNA, 7717 bp, Heterodera glycines
ttgaatttttttttaaatcaacagcgggcgcgtagaatttcgatagctacgcgccaaaattttttgtaggcataaatgctatgccacaatttcagctaagatttcttcttcgaatgggtctgcaattctactcgcccgctgttgattttaaaacaaaattcaaactttgacgcaaagcattttaaaaataaaaaatgatttcatcgattttaaaaattaaagaaaaaatttaaatttatttattgaaacagaaaaagatattatgagttaatgaaagaataaaatgaattttattgaaatagctaatcaagatgcctattggttttttaataaataaaaattctttcaaagaaagtttaaaaaaatagattgattgatttttatccaacaacggacagataaaagggcaataaaatttaatcaaaagcaattgcaaattaattttaaaaaatcaaatgatgtaattactgtaattactataaaaatacacgaattaatttatctactaaaatctaaatccatttattgctttattaaagggattcttaaaaattagcaataagaaaaataatcacaaattaaatgaaaattattatttatttagtcaatatttacactaaaagaaaattttatcataaattgatcatggtttgaacagaccgagtaaattgccatgcaagataaaagcgaatgtaaaactgaaaaaaagaaatctaatcttaatccataatgaattaaacggaatgtcaaaaggcgttcatggtgcacgataggaaaatatttatagaattaataaagaaaaactacagtttttgtttatctacgtcaattaaaatattaaaactaataataaaaagatagcatttgggaaaaaagaattataattaatttttatgtgattttgaaacataatttactaaatttacatttctatgagaataaagaggtgaacgtaatattaaaaattaaacattcactactgacaaggcaccgataattgaaaaaaataatttattaacaaaacaaaaaatgagagagaaaaaagaacataacattattcagtacaagaatcgcaaaagtattaacaataattgaatatttaaaaatatttttcttaattgttaaatccaaacgatatacagaatgtaaaaataaaattatcgtaaaaaatattaaaaaatgtttattcaataatttataactttaataaagaacaaaaaaaatagaattgttattatgctaataaaaaaatcaatttattaattaatcaatttgaatttgtaaaaatttaaacacagcgatatattttgaaaccaatataatcggagaagggtacacttgataaataaaattgaatataattataagtatacaaaataatttttaagaggcaaataaaagggaccttttaaaataattgaaaatattagttaaaaattattaaaaattgttacattaaaatatattatgaatgcttattaaatggatatcgggttgttactattattttagtaatttttaatttaaaaatttggcaattagagatggtggcttccgctggtttaccaaaaagatataactaaatttaaaaaaatcaataaataataatatatatagtttcagaattcagtcaaatttggaaacagtaaaatttcttggacgcgaatctgtaaattaaaatgtctcaaacaaataaaactaatttattcataacaaaatccgtaaataaaaccagaaaatttctaaatttagaaaaaactaaagcataagagattgtcttgaaatatgatgaaaagaactagggttgctccccgtccccgactccccgacactaattcggggaattggggactccgagagccgggaaaaattgatatttgaatacattacattgtcagattttgtccaaaaatgaccaatttttgcagttgtttgagccagtttttttagaaaattaagattttaagggtccggcggagccgataggcgccgccgggaaaatttttgaaattttggctatatatttaacagattttgaataaaaaattattaattttgccaaaaaaactcaattcataccagtgcatgtttactcccgtttttttagtatcaagaaatgaacattttgcaacatttttcaaacatttgggaccaaaagatcaaaaaaaaatttgcgtcagactttaaaatttcttgataaaatagtgatattatgcaataaaattttaaaattataaatatatttaagaaatcagaacaattttagtcgctaccccaaaattagaaattcttataaataagaacaatgtaagccctggtttaaaggccagcttctaacgaaatcagattattaaactgacaaaaaggaagatttacgagaatttaaaaagaagtcgcccccccccccccccccccgaggtccccggcccccgaaagttcgcaacaagaggaccccgagacgcaaccgctaaaaagaactgaaaacaaatggtcgcgttccgctcaaaacgacgttttcaaagccgtgggaatgtcacgactgaacgtcagccgcgaatgtccgtcgagcggacaaatggggaggacggggaggaatgaaagaagtagcgaacgaggagtgattgatggatgaaatgatgagaaaattagggcaaacgggaaatgatgaaagaaagaaaggggtgaagggagggctcggctgacgtagggcacgtgaattatgggaaagaaagcgataaaaagcggatgtggcgccttccccgcgtgaaggacgccggaggcagcgcaaaaacgccgatcggaccatcgacggagcgacggacgaaacaacacatccccaaagcggacagccgacgaaaatcggcgatcatttgatggaaagaggcgaatttgcgggagagcgaaattcgcccggaccctccgccccccttttctcctgtgattagccccctccccgcaattcacccccctccattgtgccattttcccaatgcatttttgtcccctttttcacacatttccccccccccctttttgtatttctcgcacatttattgtaagtgtagggtttaattacccaagtttgagataaacttgcggagtatttttggtgcgatttcttgggataataatctattttcaagtcttatttaccatcccaatggccgttttcgttataaaatacacaccaaatatttcctagaaccatctcctttaaaaattggtttcagaccacaatccttaatagaactttcgataaattatgattaaaacataccttagaaaaagaaattgttaaaatttgccggaaactcttcatcatacaattcctggatttttttgatttcttcgatatcataatttgtttggtttggttttattttgaccttcaaatttaattcattaactttttccctttgcagtttttcattttggtaaaatcttcgaaattgcatatgtgaaattttaaacggttcctccgcatttatttgcaggtagaatttgctcaaaattatgctataaaaaggcaatacgtatcggcattattttttacactaagccttccatttctttgggtggaaaataatccgtaattcaaaatttatttgctaaattaaattaaataaaatattttatttttaattttttacctcaacctacgggcaccgaataagtagtgattatcatcgatatttcctggtttaataaattgatttctgcatagctttgttgcagtttaaaaaacgactcaaaaatcacatcaaaattgttttgtttaagtgatcttggtgggataatgacgggatctgttatgctttcacattaaatctcaaatgaaattagtttaatgtgccaattttttttttaattgcttgctcgatcaaatattctaatatttttctaaaacttttttcaccgttttttctgattctttgaatatgaatctcgttatgttttctttaatcccgaatttttattttgtttggttgtttttgatatttctatgtaattttctttttcggatattttattttgtttttaaaataattttttatgtttctttttttttctcttttcggaatcaatgtcaagaaatttttttgcctccattacttcttcctaaaattttaaacttatgtatattagtattttaaataaaattgcttttaaaactttgaaaattcaaaattatttaaagtttttttattcaacaaaaataattatgcaagataacatcgcaatattgccgtccaaactcaagcaaaataagaattttttatggcgtgaaaagactatagcgagccaaaaatgcaaaattttgacctccaaataatgcagccatttaatgattaattacttttgaaagctgtcacatttcctcacaaactttttgatttttttttttgcaatatttcagctcaaatattttaaactcaaattaacatataaatgccatcgacttcatggaaaaaaatcctatggacaaaggaaattgtctcttatttataactcaaaaattttttaattgattttcactattaaaaaatttaatttgtcttttgtatgttatttttgataagcaagttattttcttcagccaaatatatgtaatttattttgaatactcctttcaattgttaaaaataatgttttattaattgtttatagttatacgttagtagtatatgacccattaatccggtgtaaaatcccccccccccttcccttaccaaaatctcccccccgccttttcttttcctcccatcgcccttcatttccaagccagccgattcacaactcccttcctttgcgcaaatgtcctttacgcttcgactgcccttcctattccacccaaaagttgcgtaagaatcgattcgttcataaggaaaactccccaattcagcaacaatttgatttaaaaataaacccttaaaattggcattgattaattatatttttttgtagtttgaaatcaattttcaattacaaataatattaaattttttcattaaatattagacttttcactaatttttttcgtttatttttaatttaataatttctttgtttagcggcggttttttctattctttccaatttcgcttccggcactcttttctcgtaaattaaaaaaaatttttaaaatataaattaagaaaaatttcagaaattttccaaaaataaattttgtttttttagcatcatttgctgcttactttcgctcaagtgcgccgatcaattcccggatttccgtcgccggtaattcaaattttcaggggtatttttggcaatttttgataagatatctaattaataatgttccaaaaatttttaagcataatcttttggttttttgagcatatattttacaccccgtttcagttttggcctctcagttccaaaaagatttgcattgtttatagaatattcgatgcagaatatttttctgtgtcggtgtgcaaaatttagtgggaaaaaagttctatagagtgaagtaaattcggttttttgtcgaaaaacagagatagtacgccaaagtgagagctgttttttctctgcactctctttattggtagacatttcgttttttgaaacggttttggtaaatttttacaagaaaaacgtaaatattttataacgatcaatttttagtatttagccgttgttttcatttttcgttttttacataattcttgcaatttttaggaaaaactattattgccgctttcttgcatagtgtatatattttttggattttaccgggttttttcactttcagcacactaaaaataaatatgaagaattttgcaaccttttttgtttttgttcagtgatcttttgccttctttttagctcacccattgtcattttcccaatgaaaaaacaattagcctaccgaacagggccaagtgctgttaaatcgcataaaacaaaaaaggtagaattttttgtttttttttgttttttcaaagttcctatattaaagccgccttgtgagcataggcattggacccaaatcaaattagaaagtgaagatcatcttctgtatgatctgatgtacgatgggaaaacttgcgaattcacccacattgaacgcacttcctattcacacacttgcaaacgatgccgatcctatcataaattttgccttgttcgatactccgttctttctgatctgatcaccccctggcagccacgcctataaaagcacaaaaaaatgaaaggctgggtgttattggatatttgtgagctggtattaaagcctagaaagcagggatggtaccaggattttggaagggggtggggtgattagccttccgggatgaaggccttttttcataccatttttgaaggtgttctcgaaattgttgttttggtattttttaatttaccctattttattttaagttttaaaaaataaaatccaaaatccagaccgtattttttcaaaaattttcattaaattatgtcttggggctgaatatctttgttactgtgaccatccctgaacaaagtgaaaaaccagacaaatcatgttttcctcattgcacagtccaagtccgccatctatagctatgatcgagcttggtgcgaaagtctaggcaagaaaaaagaaaaagatcgacaagaagaagaagcagaagaacaaggggaagaagaagaagaagaagaagaagaacaccgaccagaagaagagcgacaagaacaagagcgacaagaacaagagcgaccagaagaagagcgacaagaacaagagcggccagaagaagagcgaccagaacaagagcgacaagaacaagagcggccagaaaaagagcgaccagaacaagagcgacaagaacaagagcggccagaagaagagcgacaagaacaagagcggccagaagaagagcgaccagaagaagagcgacaagaacaagagcggccagaagaagagcgaccagaacaagagcgaccagaagaacaagagcgaccagaagaagagcgaccagaaggagagcgaccagaagaagaagatcgaccagaaggagagctaccagaaggagagcgacccgaaggagagcgacaagaaaaacagagacaagaggatggggaagaagaagacggggacgatgatgatgatgatgatgatgatgataatgaggatggcgccgtccggtgcaaagtgattttgcgaagaggaggcgaaggagacgatgatgacagtgctggagggaattcgggagggaatggtgcaaaggatggcggagggggagatggagaaaaaaagggaaatgatgggaaaaagcaggaagaaagaggagggggaggagagaaagcaaacgagcaatacaaaaatggttcaaccgaaacagccggaaaagcgagcgaaccgtacgaggaagcgaaggtacaaaccattctgagcggcaaaaaataagtgcatgaaaaaataaagttttggcggtcgatgccgagttaggctgttaacagggccaagtgctgttaaatcgcataaaacaaaaaaggtagaattttttgttttttttgttttttcaaagttcctatattaaagccgccttgtgagcataggcattggacccaaatcaaattagaaagtgaagatcatcttctgtatgatctgatgtacgatgggaaaacttgcgaattcacccacattgaacgcacttcctattcacacacttgcaaacgatgccgatcctatcataaattttgc

SEQ ID NO: 1513 - DNA, 5549 bp, Heterodera glycines
atatcaatgaaagcggacgggtaaattaaagtaaataggtattctatgaggtgtagataaaattttcagaaaaaataaaccctcttaaggcaaagaagcagaataaaccaacgatagagtgcagaaactgaagagattttgctggaaaagaaacgagaataattttaaatgaaatgctctctagagagagagaaaggggaggagagagcaagagagagagagcaagagtgaaatagagacaaagaaatagtagagagagagagagagagagagaagatagagagtagagagatctggagagggggacaagaaagtagaaagagatagtaaagagggagaaagtgagagagaaagtgagagcaagaatgcaaaagagagagaaagagagggagagaaagagagagggaaatggagagagggagaaaggaagagagatagagagaaaggaaaagagagagaagaaattgagaaagagatagaaaggagggagagggagagaaaaaaaatagagagagagagaaagagagcgagagagattgagaagagagagagtgttgagccggttaattgctcaaacaattatttgtgaatgtcgaacaccaaaatatttatttaacacaaatggaaaaataatacaaaaatatttgtcggagggacggagcaaattggggagcaccaaataagaaggaaatataacagaatgaatgtgtgctggacgaagggaagggcaggaataaatggggaaaatcaatatggggtcaaagagcccaagagagggaattgcaaatatttgaattatttgcctctctaacacctccccttttaagtccaactgatcagtgccatgatcagtcacacataggacgatcggctggggtcgatttgaaggcggtcaacaggccggcgatttcgaatcggataacggcggactggcggtgattgattggatggcgggacttctgccaaattttggtcccttaatggaattgggaggccaaaagtgccattgatcacatcgagcgggtcttcgatgtcctcatccggaatttgacgtgcgcggatttggttggcatgaaatcggccgcgagaattgtttggcaattcgacggtgtaaattacaccctttttgtcgatgattttgccgtgtcgccattccgctgaattgtgccgacgtgtgaaaaccaattgtccaatttcaaatgatcggaattttgcgccgtgtttgcgattgaattggtcctccattttatcgtccttgacaattggaattgacagcggaggccggaggagttcgaggcctattcgaggctttcggccaagaaataattcggccgggcattttccatccagtgtgtctgatggcgttgtgcgatatgtgagaagaaaagtgtcgagcacattgccgtcgactccctccccttttattttcgcaaatgccctcttaaaggtgtcaaccatccgctcggcttgtccgtttgattgtggcatgtacggcgccgtaaaaatgtgatcaattccattcgatttgacgaaaccttcgaattggtgactttggaattgagtgccgttgtcggaaacaattgtttccgggatgccgtagtgcgcgatcaatgagcgcattttggagattgtggccgatgcatttgtagaattcatttcaaatatctccggatattttgaaaatgagtcgacgacaatcaaatacatttttccatgaaatggtccggcgtaatcgatgtgaatgcgtttccatgggccatcagattttggccatgactgcagtgtcgtcttgattggatttttggcgacagctgcgcatgaagtgcatttttggacgaacgcctcgatttcggcgtccatcagtggccagtagacatacattcttgccaacgatttcatccgtttgactcccggatgtccctgatgaagcattttgagaatttgcttctgcagagatttggggatgaccgtccggtcgccgaacatcaggcagtccttgacgattgaaatttcgtcgcggcgccgataaaattgaatgaatttggcttcgtccagcccttcaattggctgaaaatttttaggttctggccaaatatttttgacaaattgacgaatttgttggagtgcctgatcatttgccgtttcttgggccaaatttttgaaggtgatcggcaaatggttgacattgttgatcaaatttctgtccaatgccgattccacttcgaatgaggcaataatgacttcgtcgtcgtcggattttgacttttggacggaaattaggcgagataatgcatctgcctgtccaaatttgtctgttttgacgtattgtatttcgaagtcgtaagccgtcaaaatgagtggccaacggacgagacggttgtgggagtgctttgggacaccatctttattgccaaaaattttcttgagtggctggtgatccgtcagcaatgtgaatttcctgccgaagatcattttatgaaagcgtttgacggcttccaccaatgccagggcttctttttctatttgcccgtaattttgctcagccggtgtgagtgatcgtgagaaatgcgacactgcttttattgagccattggcaaatttgtgtgatatgacgccgccgatgccatgttgtgaagcgtcggctgcgacgatgatcggcagatttggatcaaaatgcgtcaatgccagctcagattgtagcattgaaataattttggtgaatgcattttgacatttgggtgaccaatcccatttggcgtccttcttcagcagttcgtccaggggctgtcggataaaccggaaatttcggacaaactcctggtagtaattgaccatgcccaaatatgaacgcaattcgctgacgtttgaaggaattcgcatttccgcaattgctgtgattttgcttgggtccggccgacgtccattttgatcaatgatcacgcccaaatatttgatttcatttttgaaaaatgaacatttgtccattcggactttgaacccccattctgaaattcgggtgaaaatttggttcaaatgttggcagtgttgatcaaatgtcgcactgacgatgatgacgtcgtccaaataagccaatgcgaatgggaaatcggagagcatattgtccatcaccgattgaaaaatcccgggggcggatttcactccaaatggtagtcgctcatattggtagtgtccccggtgtgtagcaattgtacacaatttctttgaagtgccgtccagttcgatttgcagatatgcatccgacaaatccaattttgtgaagaattttccaccattcagtgtggcgaaaatgtcggctggcaatggcagaggatgctggtttaattggagagagtcgttgagcccggtggagaaatcagcgcacagacgagcagttccgttcgctttcttgaccaccaaaattggggctggccagtcagtgtgttcgactggtgtgatgacgttcattttctccaaccgatccaattctgcattgattattggcagcgtggaatatggcactggacgggcgcgcttgaacgttggatttgcgccttccttgagcaccagattggctttcattttggagcagtagccaaggccatctgagaatatttgctcatatttttgcggcaatatttcgacgaattgttggattttgtccgcatcatttgacgaaatttgattgatttgggcgggattgatcattcgccgtatttcttccagaaatccaaacgcttccattgccggtgtgcccaaaagattcaatgatcccgatttggcaacataaaacggctgaattgtctgatcagttgcttggcggggctttggcctttgatttgcccgtgaatttttgatttgggcgaccatttccgttggcgatgatttgccatgctgaattgcgttgattttgggctttggctactcaaaaatttttgcttccgcctccgtttttagctgtgtatttaagtcctcgacgactttgtcgaataatttggacgtttttgtcgtctttgtgccctctgctgtgagacgcgcgaggatatgttggcgtaattttgctttgctcagaaaaatttagtgcttcagaatttgttcgcatattttgatttaaatgaaatactttaaaatgaatccataaatcacttttttgcaaacacaaaatctaaaatttcttctttcgttgctttattttttataggtaagcattggcgaagtctccacttaaaatcaaaatttttcctccaaaaataatatcattattatgtaattctcttaattttttgtcaattatttcaataacatatttaggtgccataggggcttcatcaaaaatgaacacatcagtatttcgaatttcaattgcttcattagaaccattttcaattgatgaagaagaattgctatttaaatctaatggtaatttaaaacggttatgcacagttcgtccattttttaatagtgttgctgcaattccactaaaagccatgttcgtaacttttttaccaaaaccacgggctaagtgaaataaagcaatttgaacaaaagattttcccgtcccaccttgtccatcaatgtaaaaacaatttcctttatttttttcaggatgttcaaaaacatttttaacgcaatcaaaaatttctttttgttcctcattcattaaggaatatttgtttaatgcaaaagtgagttcctttttagggttaattatttgttcttctgaaatatttcctattttttctgttatttttggcatatccgtaaagtcaagtaaacattttccatgatttaaaaggtttttatcaataagtgacaaagccatttgataagcagtattttcagaatgtaattttttaaggtcataacttaatgcgtctttatatttatcccataataagcctggtttttttggttcacagttaatgagaatatttgcaaaaagtgagcgaaggcctcttggaaatttaaattggctcgcttcgtttaaacatttatcccattctaagtcatctctagttaagcccaaagccaagcaggcatctgaatatgatgtatatttaactccatttacagtttttaaatcttcaaagcctgtcgcatgtttatgaattaataaataacgtaaataatataattctttgttttttggatttatcgtatagattctcccaatcactttgtgtggaccttttcttggccacttccattttctattttttttgtcaaaagtgcaatatgttggcatttcaatgtatttgaattttggagcagttggattttctttaaaaaaaaataaaataagcagttaatttactatctttttccatcgcttcttctatattatcgttgtttgcatcatggtcaaaataaattgtttgttcgttttctaaatgaacctcaagcctttctattgaatgagatttaccctgtaattcaagttttaacaaccgaaaacatgcttcaacagggcttaaataacgggcttccaagtattgaccaactgcatcatattttcaaaaatgtttttttcaccgtttggctctttctttaca

SEQ ID NO: 1514 - DNA, 6545 bp, Heterodera glycines
caaatatttgatttcatttttgaaaaatgaacatttgtccattcggactttgaacccccattctgaaattcgggtgaaaatttggttcaaatgttggcagtgttgatcgaatgtcgcgctgacgatgatgacgtcgtccaaataagccaatgcgaatgggaaatcggagagcatattgtccatcaccgattgaaaaattccgggggctgatttcactccaaatggcagccgctcatattggaagtgaccccgatgtgtagcgattgtacacaatttctttgattcgacgtccagttcgatttgcagatatgcatccgacaaatccaattttgtgaaaaattttccaccattcagtgtggcgaaaatgtcggctggcaatggcagaggatgttgatttaattggagagagtcgttgagcccggtcgagaaatcagcgcacagacgagcagttccgttcgctttcttgacgaccaaaattggggcagaccagtcagtgtgttcgactggtgtgatgaccttcaatttctccaatcgatccaattctgcattgattattggcagcgttgaatatggcactggacgggcgcgcttgaacgttggatttgcgccttctttgagcatcagattggctttcattttggaacagaagcccaggccacctgagaatatttgctcatatttttgcggcaatatttcgacaaattgttggattttggccgcgtcatttgacgaaatttgattgattttggcgggattgatcattcgccgtatttcttccagatatccaaacgcttccattgccggtgtgcccaaaagattcaatgatcccgatttggcaacataaaacggctgaattgtctgaattcgttgaattggaaggtggcggtcccgcgtccgatgaatttgcaccgctttccgtcgaaaaagcgtgcttcctctgaacatatttgaattggtggtcggcccattgcgttgtaatcatcttcattgatgatgatgatttccgcacctctgtccaggatgaaaccaattgttgtgccgttcacattgatcggtgctttaagcagatttgatgaatggacggaattgatgtaagcccgcggggagcatcaccgtatttgtgttgaaatttctgcccatattttggtgaaatgctcgaattttgtcgcattgccgatcgatgtggcctctgcgattgcatttgctgcatatattttccttctttgggcaatcctgtgcccaatgcaattctccgcaacgatagcagttgctcggcggtattttggcctttgatttgcccgtgaatttttgatttgggcgaccgtttccgcgattttggtgcttatttggcgatgatttgccatgctgaattgcgtttattttgggctttggctgttccaaaatttttgcttccgcctcaaatttggtgatttcctccggcaggcagtagcgcttgtattcgccgaaggcggacgggttgagcttagtcaccagcaatttgactttggcttcgtccgccatatttgccaccgcgcaatccaatgcaaattggaagcgctccaaccactcctcaaattcttcggcattttctgttgaaaatgggtgaatgtccggcaaagtgatgttttgtgccggctgagttgcggtggatgtcggtgcgctctgctgcttgatcgcttgcgtcaatttttccaaaatatcggcgagcgttttgtccattgttgatttggaggatggacttagacgaagaaactgcacatagcagaaccgcacacaagattagtgattggttttttgaagatttctgcgaaatccaaaaatcaacacgagatttttgaatttccactttcgaacaatttcaacacgagaaaatgttcgaattgttgaggttctgtagaacgggcgtcgccaatgttgagccggttaattgctcaaacaattatttgtgaatgtcgaacaccaaaatatttatttaacacaaatggaaaaataatacaaaaaatatttgtcggagggacggagcaaattggggagcaccaaataagaaggaaatataacagaatgaatgtgtgctggacgaagggaagggcaggaataaatggggaaaatcaatatggggtcaaagagcccaagagagggaattgcaaatatttgaattatttgcctctctaacagagagaggtgaaagataagatatagaggagaaagacaagagagagagtagagagagatagagagaggtgagagggacaagagaggagaaagataggaaagagggagaaagtgagagagaaaagaaagagaaagagagagagtgattaaattttagaaccgagagacaagagagagattgagcagagagagaggagagagacagagatagagaagatatatagaggagaaagacaagagggagagaaaggagagagggacaaaaaagtgagagcgagagagagaaaggggaggagagagcaagagtgaaatagagacagagaaatagtagagagagagagagaagatatagagtagagagataggagagagggacaagaaagtagaaagagatagtaaagagggagaaagtgagagagaaagtgagagcaagaatgagagagagagaaagagagggagagagaaagggagagggaaatggagagagggagaaaggaagagagatagagagaaaggaaaagagagagaagaaattgagaaagagatagaaaggagggagagggagagaaaaaaatagagagagagagaaagagagcgagagagattgagaagagagagagaggtgaaagataagatatagaggagaaagacaagagagagagtagagagagatagagagaggagagagggacaagagaggagaaagataggaaagagggagaaagtgagagagaaaagaaagagaaagagagagagtgattaaattttagaaccgagagacaagagagagattgagcagagagagaggagagagacagagatagagaagatatatagaggagaaagacaagagggagagagagaggagagactgacaagagagtgagagaaagagaggaaagtgaggaaagagagagagaagaaagagaggagagagaggagagggacaaaaaagtgagagagaaagagaaatggagaggggagagcaagagagagagagagcaagagtgaaagagagcaagagagagagagaaagtagataaattatagaaccgagagaggcaagcgggatagagaagagagagagacagaaagagagagaatatatagaggagaaagacgagagagggtagagagagatagagagaggagagagagacaagattggagaaagaaataggaaagagggcgaaagtgagagagaaaagaaagagaaagagtgaaagagagagaaagagagagagcgattaattttagaaccgagagacaagagagacagatagagaagagaagaggagagagacagagatggcttatgctttcttttgtaaaaaatttttcgagttactattgaccatgcttgagaaaataattctaacccaaactcaatcggggagaacaatttgagtgagaagcatccatatacctcatattctgggaccgagatccttcagcgataacatttggctaaggtttacagtctcctttacgataagagctccaatgattaataattacaaaaaatttagagccaatctctttggtatagattaaaatttcttctaggttgtgcagattggcccattcactcatttccactgcccaatggttaattaaatgcagtggcaagtcaaaatctcaggaacaatcgagcggtcattaactcattctcgatagttcaaaaattgcctgcccctgtcccactctgcctccactaaatcacccacctccctgtcccactctgtatccattaattaattatctcaattaatatttaatagccccccgcccttcccccagtggaaagccaagattcaattcgtgacgacggtcccgaggggttaactactaatttttattctattttaactgaataactaaaattgtatttatttattttttgttaaatttttaatatttctctcattttttctatcatttatcattcaatgaactttttttcatctcaaaatttaaatttaaaaacgaatcattttatatactatccattgtttcaatttagataccattaatcaattttaatgggattttatggaactgtaactgcaaaaaggtggaatttatactgttttttttaagttttaggtagattcagtattttcggtttttattacattattctaaggaatttcctgcaaaaataaaaaaattcgctttaatttagtttattttttgttgaaatattttttaattttaatgtatttattttttaatttaattttttggtttctttatttttgataggccatattttttaaaagaattcgattttgaatgaagaaaacataattatttcggttttaaaatgttttcattttataatttggaatttcgctacttttattatataattaaattcttggttagtctcctacacaaatccgcaataagagatttttaaaaaatatggctaattttgaaaattttttcaaataaatgatttgttaaatattgctattttttcttgttcatatattttgcaatgaaaaaaaaattaaattattgttaattaatagagaccggacttttaggcacgaaaacttctcaaataggcacctaaaataggcacgaaaaatgtgaaaaaaggcataaaaaatgaacagaaacgtcaaaaaagcacaaaaaattgcaaaaaggtagcaaaaatcaacatttttctagcaaaaaattttccaaaagaccttttttcaactttttttttctcctatgttatattaactatttcagaaccggagaaaagggaataaatttttggttttcaaatttcaaaaaccaaggtataactgtgagtccggcggtgccgatatgcgccgctgggaaaattttttggaaattgtaagaaaaatgatgagaaaaattgctaaaaattaaaaaattttccattttttttcaaaaaatactgaaaaaggcaaaaaaaaggcaccaaaaagttcaagctataagcttcaaaccaagttaaaaactcgttttacgtgcatattaggcctctaattataaccatttgtgcgctttaattccattcttattaatgtttgtaatttttaatttaatttctattgaaataaatgacaaaattgtcttttttgcggaaatattaattttttagttattgacttttgtaaaattaattaatttttttaattattaaattatgaattgttgtttactttcatgctcactcaatcgcaaatatcttcttcttgccccgatataatatgtaaataaattttgtttatgtacataaaatagcacatttataaacttaatttattatttttttaagctacaaaaataataaatataatgtcattttgtatatttctttttgctaatattatgtctattttataaattcttattttctttttgcattaatttacttttccactaaatgttggttttcattttcaaaagaatattttaattgaaatttgatttctaataatttacatattaataattccaatatcatatatataatgtacaaattatatttttgtgtttgtaaatattttttattgattgattcatttttaaaaaaaggtgttatattcactttcccaaaaatgttctaaaacatgaaaaattttttgatgaaaatcattgataaatttttcaagcaaatttttgttgtatttttattttctgaaaaatttccgatttccgacctttttagggtcggaattccgagttccgacttccgaaaaaattttgacccccggaatttagatttccgaaattttttgcggtttcggaatgccatccctgataggcacataagaaatgaagattattggaaaatatattttttatttaatagattatatttgtcaaaaattattaagcaccaactcaataatgtgcaaaaagttttaaggtcgttttattttttaattaagtgatcattaatgtattagtgcaatatgagttaaggaaatcaaatatttaaatcaaaattttatgaatctaaaggatattaattattttttatttaaaataaaagttgttatttttgagatattataattagcttataaattaatttatgcatttatacatttaatttatttcattctataattacattttaaattatctgacaattttccaattattttttcattagcctaattcatttggatttaattaatattttttatttatatttgacggggagtttgagtttatgcgagcatcggtaaacattggaatttcgggagcatatttatttagtcatcatttttaccaaaatataaaatagtttttcactaaaattttataagaaatgatgaatttttctttcattaaaatatgtttttttttattaatttgattttttatatgataatttt

SEQ ID NO: 1515 - DNA, 2310 bp, Heterodera glycines
ttagaagcatctaaaaatatctaattaataataataatgtgtttttaaatttatttaatctgtttttgaaaatataaaaaaacatcggtcacttgaaaaaataaattctaaaattttgtccaggaaaatccagggtttttcctggtttgcctggacatggacctggattccaggaaaatccaggcctggatccaggtccaggtcgatctctaatttctacctattaaaaaatgttcagccattacgctgggccgattcggcattcactgctctgccgaggtgtcgccctttctcgccgactttgtccgcccctggtgcatgtcgttgcgcaatgtgcgcgacaatgaggagaaggagtcggcattccgtggcatttgtctgatggtcaattgcaacccgcagggcgtcgccgccgcgttcattttcctctgcgacgcgatcgcctcgtggcagacgcccagcgaagagctgcgcttcatgttcggcagggtgagccccactttctcccacccccacccaattagtgttcttaattgggtaattatagcataggttacctcaaatttttcttagttttcaaccaatttttaataatttgtctcaatgtgtagcctaactacatggagacgggcattttattgtagtttttgtaaaaaatttgaattttttttatttgaaaatttaaacaaatttagtttttggaatgaaaagattggaatgcgaaaatcaaagaattctaatgcatttcctaacaatcttttctgcaaaattattgtctcccgtccaaaatgtaaacatttttcgacggaaagggagaaaaacgtatcaattcgcattttttacgaattttgatgaaaattcactaaattaaatgatagcaacaatacatcatattaaataattatttgccacatttttattttattttcagattatttacgccttcaagtcacaagtgggagaggagaattggaacaattttgtcgctcaaattccggaaccgttgaagcaaaggctgggcacacagtaccaattgtgatcgtcgacgagccccgctgcccacgactcacagacacagaaccattctcaaaattcattccaaatttcacggggacggacgaaattcggaatttaatcccccgccatatcggaaagtcaaagttcggaaaaacatggacctttctcaaaacggagtcaatcaaaaagcacactctaattttgataacggaaaatgcaaatttgcaattggaattttgaaatgcgaattttacggcaacaaaatatgagaaagttgacggaaaagtgccgaaactgcttttggcacattattcgagaaacgtatcccaaattcaaatttcgtgaattgttggaatgggtcctaattatttcgtccgtctcccctcacctccccagccacacacataccatcacattttgtgttactgttattttgttgttgttgttgctgatcagcttggatcattttgcatccgttgtcgttctgtccgtcgctcgccatttttactttgttttttgtcctttccgttttcatttgttttttgtttatttattattttttttacttttttgttttgtttttgtcccttgtcctttctcagactttttatgttaactcattcatttttgtactttgtttgttcctttgttttgttatgtgttgtatttttttgttgtcaattttggcgagcgacaaaattatttctgtaaaaaagaaatactgttgaatctcactaatttcgagaatggtctttccgacagtataattaagattttttgggtttgaacgactaaatggcaaagctggtgctttaccaaacgttttttaaataatcctattgttacaggagtagggtcccaattatccggggaaggccttcctgcaaaattgtcatttttcaaatccacaacaaattttattccatcattaattttacaaaattaataattaaaatttgatcaatgtttcctccgaaaaaacatttcacatcacaagtacccttgttctttgtcttcgtattcctttgatgctctcgctgaataagccaaagctggtgcgcacggcggagttaaagatccgcatcggaagtgatgaagggcgacacggctgatccagcttctgcgagcgacgtccaacgggatgatgttgcgctcgcccggctcattcaagcggagtccactcttgtcgcagcattgcgcgcctgcgcgtagaaccccaacgaggactctgtcccctgttggctcactaaataattaatttatggtatttacgggtaatgtaaccaatttttg

SEQ ID NO: 1516 - DNA, 2459 bp, Heterodera glycines
atgggtaaataccaatcggcttacggcatcgttgcagcatgacaaagacgtcaaaatgcccgtcatgtaaagccggcgcttcgtgttttcgcatctgtccccgctttttgtgaacgattgaccgcttccttagaaaaataaataaatttagtctccgattcaaaattccttttccatttttaattaatttaattcttaaagataatttttgttgaaaggtgccaatattaaaatttataaaaaatccagttttttaaacaaaatcgattgatttggacctttcttttctatttgacttttaaaatataggcaaagatagttcattattaattacttccttaccagcaatttggcagtcgacccattggctcgatgtgtaaaccggctcgaagcgtgggaaaccaattgttcccaattttccgggcaccaattcaaaggggagcactgcgacgactgccaagtcaaatgctgcgccatttagtaaacggaaggcggggtggagcacaaagcctagcacctttgaaaataactagattaagattaacgctttcaaaattttataattaagtttttcgcccctattatcggatttagacagagtaatggctaattaaatttaaaacaaaaaaccgaaaaatcatagatttgaatgtgaataaatgatttttcaaattaaatagctggcttagcagaaaggttaggggtacaatgaatcattcagcagtaaataagacaaatttttggggattttgccataattataattgggtaataaatgtgttattgtaaaactgcaccttcttggaaacgctctcctccacactttgcccgtcctcgattcctgcataagcgattgatccgtcaccgtctttcgctgcttcatcccagcaatgggcacacgtgaggacaagagaagggttgaacagcactccgctgcatctgctcattaggccattcttaatggatacataaattaatagttaatccatattctgggagttttttccaataaatccatgaaagtttaagtttttagaaaaaggcataaaatgtcaaaaaaaaacaaaaattgcaaattgtttgataaagttttaaacgggtttaatgttttcttctgttttttttaaatttatactgaatttttttttattgactcacttggtttttgatgagaaaatgaacaaagtacgtcgcgttgtcataagggccagtttccaaaccaaacatgacgcgactcgttggcattgcgcatcgacgagattcccgaactttccgctgttgctgaagcgatcggaaattcagccttggactaaaacaagtgattaaaattgtttacaaatatttcattcatcatacaagttgttgcatttgtcagcagcgatcaatccgatgacgatgaccaaaattgggaagagcagaagaattttgtccatcttgcaatttttaaatgtggcaaaatgtgccaaagtcagaatcttgcaaaagttttaaaaattttaaaaaatggaaattaaataatggaaaaatggcagtcatgggtagggagtccaaaaatatgcacataaaatcgcaaaatatgcgcataaaatatgcaccaaaaatggcaaaatatgcacataaaaagtgaaaaatatgcatataaattttccaaattaagggtgtaatgtctctaaatttcttcaaatttgttaaatattaagtaaaatcttcaaaaaatggctaaatgtggtattaaaaatcattttagaagaaaaaaacatgataaagcaaaaatttactcattttttgcgaaaaaccaacccaaaaagcgaaattttgctttttttgcttatttttgacataaattaaccatttttgagaaaatttatttattcaatatttttcgtgaaaattttgctaaaaaattatttttttggaaaattttccggtttttgaggtcaaaaaggccaatttgtctgttggggggccgttctattagaggttttttggaaaaatgcccaaatatgcacataaaatatgcaaatatgcacataaatcgcgaaatatgcacaaatatgcaaaacatgcatatggaaagtcatcctagaagcttcaaaacacgctaaaaacatgtttttcgtgcgtttcaggcctcccacagttcaggaaaaaaatatgcatgtgcatataattggactccctagtcatgggtccatttttgtacttttcgtaaaatggcctagcaccgtggacggcgggaggggggggctatgccgcacaaacaacgctcactcatcacccattgatcgatgggtcaaggtcatttcgcagcggagccaagccgtggtcatttcggcgcaccttattttatggcactatcgcacaaagggacggtcctctgaccagaagggggaagaggggggctcgagtggaaataagcaatgagagagcggcgagatggcccaaaagagagagagaga

SEQ ID NO: 1517 - DNA, 1195 bp, Heterodera glycines
cgctgagttgggacaccacaaaaatcctcaaattttctcaaaagaccacaaaaatccgcaaattctcatttttcataaaaccctcttttaccctctaaaatagggttaagccccgaccccgagcccccgacattttcgggcctattccccgacccgacccccgacatgtcgccccccgaggtccccggccatttgtctcaatgtgtagcctaactacatggagacgggcattttattgtagtttttgtaaaaaatttgaattttttttatttgaaaatttaaacaaatttagtttttggaatgaaaagattggaatgcgaaaatcaaagaattctaatgcatttcctaacaatcttttctgcaaaattattgtctcccgtccaaaatgtaaacatttttcgacggaaagggagaaaaacgtatcaattcgcattttttacgaattttgatgaaaattcactaaattaaatgatagcaacaatacatcatattaaataattatttgccacatttttattttattttcagattatttacgccttcaagtcacaagtgggagaggagaattggaacaattttgtcgctcaaattccggaaccgttgaagcaaaggctgggcacacagtaccaattgtgatcgtcgacgagccccgctgcccacgactcacagacacagaaccattctcaaaattcattccaaatttccaggggacggacggaattcaatcccccgccataccggaaattaaaatccggaaaacagggggtttcgacctttcttgaaaacggagtcagtcaaaaagcacacaccaattttggtaacggaatgttaagtggaatttggaaatgcaaaatcattaatgaaataccgcaatttgacggcaaaaaatatgaggaaagttgacgacaaagtgccgaaactgcttttggcacattattcgagaaacgtatcccaaattcaaatttcgtgaattgttggaatgggtcctaattatttcgtccgtctcccctcacctccccagccacacacataccatcacattttgtgttactgttattttgttgttgttgctgatcagcttggatcattttgcatccgttgtcgttctgtccgtcgctcgccatttttactttgtttttgtcctttcccgtttcatttgtttttttggttatttattatttttttttactttttt

SEQ ID NO: 1518 - DNA, 5553 bp, Heterodera glycines
  misc_feature (5535)..(5535): n is a, c, g, or t
ttcctttgttttgttatgtgttgtatttttttgttgtcaattttggcgagcgacaaaattatttctgtaaaaaagaaatattgttgaatctctttaatttcaagagtagtgttttccaacagaaaattaataatgaatagatttttaattttttttggttttgaactactaaatggcaaagcttgtgtgacaaattttattccaccattaatttttcaaaattaataattaaaatttgatcattacttcctcgcccaatacattaaaatcggcttaaggttggaaattcaacaataaatagcgatggaatggccaaatggatgtaaatttgaataattgaacaaaatccaacaaattttgacagaagagtcggacaaagatgaagaaatgatttaataggcttaattgacaacagatcaatgctgcctcccccaaacatgaaaatcggtttattgtcttattacatcacaagtacgcatgttctgggtcgtcgtattgtattgacgccctcgctgcgaaagccattgccggtgcgcaaggaggtgttaaagaaccgcatcggaagtggtggagggcgacacggctgatccaacttctgcgagcgacgtccaacgggacgatgttgctctcgcccggctcattcaaacggagtccgtttttggcgcagcaatgcgagcctgcgcgtagaaccccaacgaggactctgtcccctgttggctcactaaataattaatttatggtatttacggttaatgtaaccaatttttgaaaaaaacccactatttgcacacaacgcctgagccactgtcgccggcgcatgctgcatcggagtgtcctcgaaagcaaattgtgcccatcggaaatttgtggcccaggggcttcccctataaatttatctttttgtcattagaaaatcttgtgtaaattatgggtaaattaccaatcggcttacggcatcgttgcagcatgacaaagacgtcaaaatgcccgtcatgtaaagccggcgcttcgtgttttcgcatctgtccccgctttttgtgaacgattgaccgcttccttagaaaaataaataaatttagtctccgattcaaaattccttcccatttttaattagtgtaatttttagacacttttgttgaaaggtgccaatattaatacttataacaaaagccaattttttaaacaaaatcgattgatttggacctttcttttctatttgacttttaaaatgtaggcaaagatagttcattattaattacttccttaccagcaatttggcagtcgacccattggctcgatgtgtaaaccggctcgaagcgtgggaaaccaatcgttcccaattttccgggcaccaattcaaaggggagcactgcgacgactgccaagtcaaatgctgcgccatttagtaaacggaaagcgggatggagcgcaaagcctagcacctttgaaaataactagattaagattaacgctttcaaaattttataattaagtttttcgcccctattatcggatttagacagagtaatggctaattaaatttaaaacaaaaaaccgaaaaatcatagatttgaatgtgaataaatgatttttcaaattaaatagctggctaagcagaaaggttaggggtacaatgaatcattcagcagtaaataagacaaatttttggggattttgccataattataattgggtaaaaatgtgttattgtaaaactgcaccttcttggaaacgccctcctccacactttgcccgtcctcgattcctgcataagcgattgatccgtcaccgtctttcgctgcttcatcccagcaatgagcacacgtgaggacaagagaagggttgaacagcactccgctgcatctgctcattaggccattcttaatggatacataaattaatagttaatccatattctgggagttttttccaataaatccatgaaagtttaagtttttagaaaaaggcataaaatgtcaaaaaaaaaacaaaaattgcaaattgtttgataaagtttaaacgggtttaatgttctggttttttttaaatttatgctgaatttttttttattgactcacttggtttttgatgagaaaatgaacaaagtacgtcgcgttgtcataagggccagtttccgaacgaacatgacgcgactcgttggcattgcgcatcgacgagattcccgaactttccgctgctgctgaagcgaccggaaattcagccttggactaaaacaagtgattaaaattgtttacaaatatttcattaatcatacaagttgttgcatttgtcagcagcgatcaatccggtgaagatgaccaaaattgggaagagcagaagaattttgtccatcttgcaatttttaaatgtggcaaaatgcgccaaagtcagaatcttgcaaaagttttaaaaatttaaaaaaatggaaattaaataatggaaaaatggcagtcatgggtccatttttgtacttttcgcaaaatggcctagcaccgtgtacggcgggaggggtgggctatgccgcacaaacaacgctcactcatcacccattgatcgatgggtcaaggtcatttcgcagcggagccaagccgtggtcatttcggcgcaccttattttatggcactatcgcacaaagggacggtcctctgaccagaagggggaagaggggggctcgagtgaaataagcaatgagagagcggcgagatggccaaaggagagagagagaggaggcaggagacggcattggagcggcagtgactgtgagtggtaaggcgaaagcgttcagaaatgctttactttattcatgtccagcaggcctttgcgctccgaacatttgcgccccggacatttgcgcctatgcacaaaatcggattccaacttgttttttcaagccctgatagccgaaacagaattgaaatgaaaaactcagtcttttagtttattaggagcagtaacatgtattgaaaaaacttcggctctacttcagtttatgcgtccaatcattttttatgtatcaaattatgtttttttgccaaaataaaggttttatgctttcgtgagtcaaaaagtttgccatactttttatgggcagccactgcctttttccattagtcggcattgagtcacgagacggccgccgccactttttctctccaattttcgacaataacacagacagccaccactttttcgacaaaaaattggaatgttgctattagctttattgacagaggaaaattagtcacccaatatttcagcaattggcttaaaaactgaaagagcaaattgacaattcattaaagcaagcaaaccgtccgataacatttaaaattattttgattttttgcccttcgtctttttctccgtttttcatcatatttggtgacatggcagactttaccatgaattcgagtttttggttgttttctaattttattagaaataaaataattttttttaaattatgttagcccagagctgcgatctcaaaattttgaaaatcttcatttcagccataaaaaatcctcatttgcaactaaaatacctcaaaaaatcctcatttggaatgaaaaatcctcatttttttaaacatcataaaattgcgaacaaatcagttaactgtcatattttcgtttgaaacaatcacggcgcctatcagcgccgccggacccattttttcttaaaaaattggcgtaaaaatcacaaaattggtgattttggtaaaaatttataacaatctcatttaaactagagtgcagcgggaccaggaccgggccgggaattcccggtcatccaaggtcccggtcccggttcccggattttgaaaagctcaggtcccggtcccggtagggcaaccgggaaccgggaaaaacaagcactggtaagaatggaggtctgagtgaaaaattagtgaagaaaattggagttaaaaggaaaaaatttaaaaaatatattaataccgtatatactctttttatatgccagtctccattaatctgccggtctccagttatatacccccttctgagaaggttgaaaaataatctaccagtctccatttatgtgccaggggggaaaatagaattttttaataatttatttggcacattttccaaaaaaaaattaaactcaattcaacagtaagaggggctaataaatgaacaattcgttgtcatctccgactccatccagccctgcttcatcatcagagtagggtcgctacttttagtgccggaaaatctcgaaatagttaactaaaatagtggcaaaaagtccgaaatagtgacgaatagtgacgtaattttcagccaaaaattaagccaaaataatttttattcactagttggagttgcaaataaggtacttttcctttgaactattcccttatcaaatactgaacatttttaatcaaaatttgtaaagaaaaaaaattgtggaaagaatttttaagaaaattttccaattcttactggtattttttaaaaaattttaacccgtttcttaggggtgtattttttggttttattgcatttttgttaaggaattttcctaaaaatgtcgaaatactgacaaaacgccaaaataatgaattttcactattttagtgacgaagcgccaaaatagtgatttctagtgaccgatagtgacatcagaattgaaaaatgtcaacgcagaaatacgttttttgagctcctttcttcaaaacaattgagtaaaaaaattagtaaatcactaaatgtagcgaccctaatcatcagacaagccaaaaaaaaactaaaaattttaaattaaaattaatataaaaaaattaaaaaaaggcttcttcgtgatcgtttcttcgtccatctttcaccattaaaaattccaatttttatgcataccggaagcaagaaaatgatagatttttgtcattttggagtcattttcagaagttctttaacataaatgcaataaaaatgtttttttttgacgcgatgacattttttggcgacatgttcaaaataaatttcaaaaaaattttccactaaataaatcatcgaaaaataatctcccagtctccattagtctaccaatctccaattatctacccccttctgaggaggttgaaaaataatataccatggcatataaaaagagcaaatacggtaggtaggcttcaggctctaaaagacccccaaaataggcactaaaaagtctcaactttaggagtgtaatgacaaaatttttcaaaaaagtaaaaaaattctacaaaatcagtattgagttaaataatgttttaaacacaaattcttgttaagaaataaataaataattttggaaatgaatttttgagaaaattttttatttctcatgggtgtattttttttaattttcggttgtcgattcttaggagtgtatttttgaaaaatttttagaccgatccttaggggtctatttttgctttttattgcatttttgttaacaaattttgggcaaaacaccaaaatagttcaaaataaatttttttaaatttttttttggctttttaggctctanaaataaaaacctagaaaa

SEQ ID NO: 1519 - DNA, 7684 bp, Heterodera glycines
ctgatcagaaaatgtgtaaaacattcaaatgattcggatttacattccaatattcggggctttcccccaaaactcaagagactccaaaatctcgagatttttccgaaaaattccggtaataaatttgtccttccattttctgtccccatttttgcttctctgtcccacccaccattattaccataatttgtgtctcccgttgttgttgttgttgtttgttggtggtggttcagtgccaattggtccggatactccgtgccctcgttgatcgcctcgtcgtgcggtttccccccgttgctgctgtgccctttcgcgcacttgccattgtgctggtgatggtggaggccattgcagttgtttttgttgcgcatattctggcaaaaaatgggcgataatttttagggttttaattatttgtaattttttaattaaaaaatattaaatttcattttagattttaaattttcttaatttaaattaaattctaccgaaaatgcttcaagccgtgtctgcacttgctcgtccaaagtgtccgccgaaagtgccgcacgagtggccattgtccagcagactgaacacttttttcaaaatcattttcgttttgaaaaattcgaaaatgaaatactaaaaaatttaatacataaattctaacaattaaaatttattttatttaaaaaagtgaaattttaaaacagaatggcaccaataaaaactgctcgagattcgcagtctcgaggtctaaaaatttctctggcttttttgggagtgggttcggtcgcgactctcgagaaactttcgtccatcgaaaacagatccatagcttaatagcattgaataatgagaaaatgcttaataatcactgctaattatctaatacactcattagaaagtaagaatttgtcggttcaaaagtcaagaattggtctcgagactttacaaccgaaaaagtctttaaaaattgaattttctcgactaataatgatgaaatttggtccttggtttcccagtggtgcatcataatttggtgctatttattattggaaaagccaaaaattgtttggcgcttttgctcatcagcggtggcggcggtgctccgtcgcccctcgggcgctatcacatttcaaaaattcccccggggcacacaaatttcggcgctgccgccccgcccccctaaaaaattcggccaataaaatttaaaagaggggcttaatatataaatatgtaataattcataataatcgaaataataaatgatttttggcacagctgacacccgtcagcggctggcagcagacaaattgctgccgcctcatctgtcacaaaatgtgcagcagaagcagcagtcaatcaaaagtcacaaaagaaaacaccgggcgaatgtttcgagggcaaaaattgtttaaaatggaaaaattattttaaaatgtttgaaaattatttttggaaagaataccaagaatttgctaatgccaaggaaagttcaaaatcaaagcatttaaaatatagacataatgttgtgtagtattcgaaaggaaaataataattttgaaattcttttggaaattattaaatttcaataataaagaatgattaaattaaattaattaaatttaaattaaaataaacaaaataatatagaaagaaaaagaaaatgcgggcattcgaattttataaatttttaaaaaagaacatttaaccttaaaatcagattttggggctgacaaaagaattagccaaaatagggtaaagaattaattaattttatataatttaaattccaaccaaaaaagttattttattgtttccacataccaaacgattttaaattgaatttaaaacaattaaccataaaattgaactaattataacatacgcggtgtgtcctgttcactgtcctgcagctgaatgggccgtacaacaaccaactgaacaacggcttcttgctggcgcaacagagcggcaacttgttgactgatggaaaataatgaatcattaattattaatttaaaaatgcaattttaaaattaattttaaatcggcgaattccaacaaaatgcccacctgttcagtccctgcgtggaaatgtgcccaatttgcagaatgcgatcgcccggacgaaggcgcatgtcctaaacggagtttggcttatgatcagcagctcgaattttaggccggacaaaatttgtcacaccattttagtttcagaatcagcaaattgtggcggttcaaatcatttgccaattagcaatgtttttggcatttttccgtttcccttcccttccttctctgtgatttttcgattttttaaatttttgaaaatccctaaagttttgattgatcggcgaacagaaaattccccggctttccccgaattttttaaattagtttttcgcatttttaaattgttttactcccccatccgctatgaatttattttaatgttaatgcgtttatttatttttttgactttgtccgccacactgccgcggatgatcgatttgaccacaacgccggtgctgtgccctccgacgatgccaaagccgagtccctccgcttcgttgggcaaatgcacaatttgcacttggacccaatcgccggttaactgtaaaaaattgaaaaagcattggcaaattgatttttattcattatcatacatatttaaaaaagtgataaataacttaaatttaaaaatttaattggactctgagttggatctgaggtccagcataattttctgtggaattctgtttatcatcatcgtccaagtggatttgaacttttattgccaaatccgaaggaaacggcaactctaccaactgaaccacccaaaaaacaaaatacgtatgagtgttattttatttatcaatataaaaaggcgcaaatttttattttcagtgggccttatttttatgtgcttttccttctttctttgttggctcttgaaatgaacttttaataatttaaccaatggaacttttatttttaaatatttttcatttttctctttggaagatttatttaaaaaattatttctcaatttaattttttaaaatttaactcaatatttttcagttttttcatttaaaaactctgattactactgatcaaaaatgccaaggtagcccattatcgctaattgccctattttctcgcctccacaatgcgttgccgttcccgttccttgcgtttccgtctccgttcaatccaccgctcgtcctgtgccgtgttgacaaccgcccgtgccagccgttcagctgccagccgattgtattcactccgatcattagtcgatgtctccgccgtcttggtcagttttcgtcttagcaacaagcgaatgaccgacaaaagcagcaaattgcgttgatggaattcactcgatggcatcagcagtggttgttctgcttgaacttgatgataatgatgatcagcatcatgttgttcagtttctgttgctttttcgtccgtgccgtcggctgacgtcacggattcatcgctttcatatgagtcgtgatgaaccgcttcgtcgcgatcatgatgcccttgctggccatcatcaactgcatagtcatcgtgttgtatgaccaaaacccggtcgggtactgctttaggtccctctgctggcatagcgatcacaccgccagcatatccatccgctgcggctttttcttcggatgacaatccgacgatcagttgctgcttttgctgctgtgccggcttgcgcaccgcgctgttgctgctgatgaacggcctcgccaccacgctgtgcagctgttgctgccactggttgatcagcggccaccagcggcggctgtcactagcgcaaccgcgacagaaacggcggctgggacaacaccaagtactgctgccgcagctgtcacagcagccgccaccggcggtgccatgccgcttgttcagcagattgaagcgcttgcgctccaccagcggtggcggtgcccaccgctcgcagctgccaaaccgttccatttgcggcggttccagccgtaagcatttggaggcggtcggtgccggaggcggcaactccagccgatcggggatggtcatgcggcgccatccaatcagcgcgctgccggtgcaaagcagcgcgcgggcggacgagcgccgcgaggacggcgtggtgttgcaaagtcgtcgacaccgctcctcgtcgactcgcggttccaccgcggagcggacactcgcggatttttggcacccctttctgctggtagtgacagaatgcgtatcagttggaagtgccaattttgactgctgctgttgatgttggccaatgtttttgctgctgctgttcaaattgtttggcgtgtcgacggaattggcccaccgcaccgatagacgccccgaactatgcgcggacgacaacggcgtatgcctgtgtgattgttgttgttgttgtcatcggtctcgagacaatatcttggggatgggccatggcctattggaccaatcaccaaaattctcgggccctagaatcccgtggaacaggatgggtgatcaggctcaaataaatccctaggccaatgccagaacttcaagttcgagatcaattctcgcctatccagtcgattcctaagttcgagattaagcttcaagaattagtctcgcaacaattaatattatcctagtcccggaagacccaaatcttgaaataaagtctcggcagtaaatcccagtctcgagaccaaaaaattttggccttttctcggtctcgagctcagtgtgggtgcccacgtgtgcatgcctgcttttggtgccgcttagcagaacatggtccgcaaacagtacagcgccttttttggcatattgtgccttcatgtgctcggccatccgttgctgcaactccgtcgcaaagttcagcatcactgcattcttcggcggcaccgcatcaaatgccgattttatacgactttgattcccattctcggccttttcctctgtcccatcatgttgtaatagccccgttttttggcattcgtcttgcctttctgttggattcgtgccaatttggcgctcatttgccatttgaattattgccaactttcttggcgccgtgttgtcctcacgccattttgccggctgattcaaccggtcagttttgtgccgtaatacgtcgtccatgccgactgttgttctttccgcattatgccgttctccgccgtcctgctgttgctgccagccaaacgcggaaaactgtgcgaagccgctgcgacgacgacgacgcgagagtcgcaagtcgcgtacgctgcgtcttagtgcgcgaggcgactcggtacggcgacgttgcgttgcggcgaagtcgacaccaacgcgttggcccgtacgaggcgcgaccggtgcggggtcgcgcaaaagccagattggcgtgccgccacggtctccgccaccgccgaacgggtcctcgctgaacgatgacgaatgggacgcggtttcggatgccttgcgcgacaggcgaagcggcacggcacgcagcaaccgtttggccgcttcccatggacggcggctggtgttgttggacggcgaaacggtgccaaacagtggcggcatttgtgaccgcgtgtgcggcatccatggtatggacgacgaaatgccgaaggggtgacacaaagtgccatccggtcgtatggtcgagaatggcatcaccccggcaaagcacttgttgttaccgccgttgctgtgcaatgccgtgccattgtattgatggtgatgataaccgttgttgctaattgaattgccgtttttatgtttggtccggttgtgccacggatttgtcacgaatttgttgttaagccaatcgatcaggcgcattttgcaaatcgaaaatcaaatttgaaaatggcaatttctggctgcgtcggcaaaagtgtaaaacttgttgattgaagtggcaccgccgcaggggcaaaccccaaaattaaaagtggcacttatgggagaaataatgtttagtaaaatggacaatgggagcagaaaagagaggggatattgtgagaaaatgcaaaattagtttaagggattcaattaaaaaataatcaatttaattttgacaaaaatatttttaaaatccaattaagaaaaaaagtcgaacattttttgaaattaaaattttctgtccaaaaccattaaatacgctgtttatttggtgtaaatttatttggctgatggcccacggcacaacgaacgatgttttggcctattgacttggccaagttgcccgaggcgatgacagcatcatcaacagcatcagcccttttgcctgcacagagcgactttgccaaagccgaacgccccaggggaatttggggatttgaggggaccgaccgccggggggggggggagcaaaagacgcaaatcgaaaaattagagacggagaaaattgtggaaatttggagggcttaaaatttgcaaattaccatcaaacagcagaattttggcattctgtacaacatttatacggaaaaaatgttaaaaaagctgcaagtattttgatttgagttgcaattggaaaatggaaactgtgaaatgtttagatttatctttggcattttgttgtctttttatctattgaaattttcaatttccattttggcattttttaatccttcgatggcatttttaaatttccgttttggcattttattaattcctccgatggcattttaaattcccatttttgcctcagtgttaattcttttttaatctttgctcttcaaaattaattattgttaaaactaatattttaagctttcccgaacttcctctttcatccaattctcttgacttatttctccaaatgttttttttaaatttgtgcatttaccgccataactttggcgtcccgtctgagcacgccgaagacgacgagtggcggcttctgctgctccgccgccgcacgttccaacgcgcgttccacgcgattccgcgcccgctccgccgctgcctgcgcggatgagcactaaaaaactgacaaaaataataaattttgaaatggcaccataatgccaaccctcgggtgattcatacagtatttttcaaaaaattaattaatatatatttggaaaataatttttttgctgattatggattttttaaatttaactttctttctttgtttttatttttattttttatttaaaaaggataattttttcttcgatggccccttaaatttttcgaccacgtgggttttccctggagaattttaaaaagaaattccgggtcaaactggaaacctagatccagatttttttaaagtcgagctctaatttatagtttacttatgccccaaaatcaattaagatttaacttaattataataataaaattctaaaaaaaaaaaaaaaattcgcttcgaaaaataatttgtgccaatgaaatcgacaggtcttattttaatgtaattataaaattgcttttttttcttcaccttttgtgactgatttttgtggttgcacgacggacggggcgaactttctgaaaaattaaaaaataaatttaaattttaaaatgctaaaatgctaaaataataattatgatattcaaaatcactcacttttcgatgagtttttcctctgctgctgctcgtcgtcagcgttgatcaaatcgctgatcagagaacggtccacttagaagcttcgtcagcgacgcgaagggcgccggaggagctgaa

SEQ ID NO: 1520 - DNA, 1630 bp, Heterodera glycines
  misc_feature (27)..(27): n is a, c, g, or t
  misc_feature (131)..(131): n is a, c, g, or t
aaattgaaaaaataatttaaaaacaanatcaaaaaaatatgcaatatggtttataattttaaagtgatcagagcagcagaagtaaaggtttaaaattaaaaaatgattataacaattggtaaagagaaganaattagaaaaattatttgtaaattaaaaaataaatttgaattttactgtaaatttaaacatgtggcatttataaaaatatactaaattacatataaaaaaaaattaaacatttgaaattttatttagcaatttcacctcaatttttgggaaaatttattcagaaaatgcaaatttccattttttcgagtggtttttcaattgaaactgtcacatttttaacataatatttttgttgaataatttttatgggagattctgaaattttcaattgcattaattgctaaagttatagcaacaaaaaacaaataaatgccgatgccgtgcatcggttcgattattgaaattccaagaatttgaactttaaaaattaattaacaaaaaggaaatttgtagcccaggggcgagcggcttttccttcccacgccatatttaaatattgctaaatgaataaagctcataaaattattgacaaaaataatttgggtggccggaggcagcttttcctttccgctgccaaatttaaattactaaattaaaactcataaaaataattaacaaaaaattaataaatttgggccagtgaggcgagcggctttccttcccttccaccatatttaaatattgctaaatgaataaaactcatataattaattaacagaacataaatttgggtgcccgggggggcttttccccgccttcgcttcgctttgtgttgtcccaccctccgccgtccgtccgcttcttcttctgctctgcttctcatccgcctcattttttcctcccgctgctcctcaaaaatgcttgacggcccgtggaaaatcaattatggcacttgcattggcttcccccccccggcgcttttcccactcattttgcccccgggggccttttctcggcttttctgtcccctgcagcaggggatagaaaagccaaaaaaaaaatgagtggcgtttattactctccgcttttttcgtccgctgttggacagagtccgccgccgtccccgcaaattgggcgctgtttttgtttcttttccccccttttttgttttagtttttttaccaatttttttcattcaaaatttttgttccgataattacaaaagggtgtaaaaaatttttaaatgtaaaataatttgtttggtggcattttcggtttatttataataaatattatatttaattttaaattgttgtgcctttttgtttgtgtaaagttttccctttattttatttgtaaaaatatctaaaattattttaaaaaactaatattatataggtttttattcagagaattggaaaaaattaatttatttaaatttttgtataaataattaattttgaactcaattcaatacattattattaacaaaaatattattcttcaaaaattaattaatgaacgaaaattgaaaataaaatttacaaattctgagaaattaaatattaaaataataattatgaattaaaatgtttacaaaataccgttttttgatgtc

SEQ ID NO: 1521 - DNA, 1785 bp, Heterodera glycines
aagtggttgctctttttgcagcatgtgtcgcctcatttttgggcatatcttttcaactagaccaaaaataacgaataataattattattagtattattgttagtaataatttatttaatgctaaaattatcataagaatatattaagattaattacaaataaaaagaatgttatcttcaatcaatggtaaaaaattaaaactaatttgagctattaaatttgaaatgggaaaattttcattaaattttagttttatttttaattagtcgaacaaattaagagctgaaataatttaattttttcaaaaacaaagaaacaaataccatttaaaaattgcgtttccaactttattgaaacaaaatcattttaatttttaaaatttcatttttttccgacaaattgtggccatgtgaattgagagaattgccaaaaatataattattttttttgtttttgataaattttgccgcttcattcatttcatgtcacagaattgaagctgctgtcagtcactcaaaagaacgaagagaaaaaagaaaagaatgctctgcaaaattgtcacttttgttaaacaatcaattgattcgtggccaaaggaaaattaaaaattaaaaattattaacgcaataattaattatataaatgaaacaaaaatttaaatttatttacttttgaaaatatttttatgaaatctttttaaaaaattaaaaatatgttaagcgatattcaccgacaaacaggtgaaattaaaatttaaaaataatctatccaaaaattataaaataaatttttgcaaaatttaaaaagtaaataaaagcaatttaaaaagatagagtttaatggaaataatataaaaaataaacaaaataaattaaatttgaagggctggcaaaaagttgacgatgaaaaaacaaattatgcaaatatcagaggcgcaagcataagcaaaacacacagaaaaagtggggcggcgttcaattggccctctaacgccctccccccacgaggggagagggtgttgtgccagaaaaagatgccgcaaaaagagatgaggaaaagccaaggaaaagccagaggcaaagggtgggcgtttcggtttgagacggatgccaccccgccgcccctccagcagtggcgggggagggggcggcgccggctgtcaacagcgccgccggacggaggggcgaagaagcggcgccgcggctgcgaggggaaataaagggcggctaagagaagcggcggatggcaaaaagcggggggagggagaagaagcaacagcagcagcagcagcaggcaaagcaaaggaggaagatgaacaaagcgatattggcaaaagagggaggagagacaaagggagggggagagagtagggcaaacacagagaaaaaggcaggaaaatagtgggggaatgggagagaaaagttggaaaagaagtgggaaagattgcaggtcaaccagaggaatgaatatttgaaaaacaactgtggaaaagattcttcaaaaaaaagaaaatcacaaatttaatcagtaaagggagagagaatgagagagatgctagagaaagaaatagcgaacaaatcggagagagaaggcagagaaattagggtaaaaaatggcataaataaataaacaaaattcaaataaaaattaataaataacgcatggtaatttaatgaatttagagagaaaaataaattaagtaaaatagattaaaaagaaattcaaataaatgaaaaaataattttaaaaaaaattggtaaatattatatttttttataattgtgt

SEQ ID NO: 1522 - DNA, 2672 bp, Heterodera glycines
  misc_feature (2598)..(2598): n is a, c, g, or t
  misc_feature (2636)..(2636): n is a, c, g, or t
ttaccgtatttgctctttttatatgccagtctccattaatctgccggtctccaattatataccccctttgaactaggttgaaaaataatctcccagtctccatttatgtgtcggggggggataaatagaattttttaataatttatttggccggcttcttcgtgatcgtttcgtccatctttaaccgtttcagttgccctaaactcgcgcaaaaaagcccagaaggctgtttctatgcctcaaaacataaaaaattacaaaaaaaaacttcattttgatcacgttaacaatttcgacattttgaccgacttgtcgacactttgtcccactactcccaaacattgttagacctgtcaaaacattgtttaacccatttaaaaacaaatatcaagctctacgcactcaattacccccaaaatcccccactcactgcgaaaagccgacttttttgaccaaatttttagacaaatgaccaactcaactttgggctagggactcaaattttttaaaagaaccgcctcaaaatgctctaaccaaaaaccacctcgcccattacccacggcaacttaaaagccgctacgggcgcaaaaaaaaagatgcaactctaaaaaaattcggaaaaattccctttttgaccagtttttcggacaaatgacctacttaactttgagctaggggtccaaaatttttttttaaatgtgactaggtgagctctacaataatatacaatagcgcctgagctaacatttcgctaaagcacacccgcccgagtctaactttttgagaccccttcctggccaggggctaaaggggggtcaccccttcaacttagtgctggcgcacaattttttttttaaagaccaaaacgattccatattttcttaacttttcattaaaaattccaattttttatgcataccggaagcaagaaaattacatatttttgccattttggggtcattttcagaagttctttaacaaaaaattcaatagaaaaaaaatttttttgacgagatgacattttttggcgacatgttcaacatattcaaaaaattttccactaaataaatcaaccgaaaaataatctcccagtctccattagtctgccagtctccaattatatacccccttctgagaaggttgaaaaataatataccatggtatataaaaagagcaaatacggtattaaacttttaatatccgtatgcgttttcttattcatatttatataaaactgatgaaaattttaatgaaaacttcaccattaaaaatcagtccaaaaaacagttaatttgtttaaaatcaaattattattaaaaattttaaatattcaaaaaaaaaaatttttttttaaatattttaaatttaaaatacaaattaattatgtaaatgatcaattaaagagttggatacgcgagaaagcctatgtcgttacccaatcggtacggtccaagcaggcatccaacgaaatgtggcgaaccgtgtgggagttgggctccaacacaatggtcatgctcacaaaggtggacgaaaaatttatttttaaattgaaattcttcacaccttaggcgctgccgtgggaaaattttagaatttttttcacgaattctctgaaaaattccaaatatggtaatagaaatttcaaaaatttaggcaaattcaaaagggtgtttgttaggtcgtttcgtaagaattgtcaacatgggcatttcgtaaaattgccaatttacagaccgttcgagaaaaacttgccacaaatttttttaaccaaataatttttacaattcgttgaaaatataaacttccagaaaagcgcattttctggaattgaaaaacaattataaaaagcattgttttctggtaattaattagaaagtgaaataacaaatgaaaatgtgcattcccagcaattaaattgcaattataaaacacaaaatgtttacgggctaaaaacccttaacccgtaaaaaccgtatcagcccgagaaagtacgggttatgggcaatggtcccgtaaaatctgtattcatgtccgaacgtatccgatctctattaaaaagtgtataatttgaaaaaaaaaatcagattttcgactttatgcgggtgatgtgtctccaatattggcctcagacacacttccaatttggcgaaatccatgttgaaacattggaaactcgcacttatgcacattttgtgagttttttttacaaataattttaaatatatttaattttggtatgaaatttacaatggttggctatttattttatttgaaatgccattctaaaaaggtaatccgaacattccgactgcgcaaaacgggtggtcccggcggtctgaacggaccggcggcaaatgccaccggcgacggcaccgccgactcagcagaagaggagcgtattgtcaagcatttccatttcacggaatgggaactggttggtgccgttggaattttgcgctttttggcactcatttaaagtgccactttcacacagaactctttcccctacatatcggcgtttgtcgaactgcgcaggcgcgtccggcatggatggaaaagtgagtgatgagtgagtggcagatgccaaaaatgtaactntttttcataaatctccagtacgaacccgaccctgcatnacgtcgtagaggctcatattttaaaaacttgctaca

SEQ ID NO: 1523 - DNA, 5218 bp, Heterodera glycines
ctgcgcgatagatatatcatgtcaatagacaacaaattcccacataggctggctatttgtgatcgctaattggcttagtcacgagaccgagagccactcgaacagcactgctaattgggggtctctgccagggacgtagctagggaggctgaaggggtccaaaaacagtaaaaagaaattcaacgaaaaatatttttttttaaagagttgatataataagtaaataattgtttaaacatagataattattaagattttttattaaaaattaaaaacaatgaaacgcatcttgttttgagttttgattaaatgaaataattacgagttactctaattaatcaaaaacctttctcctaatcagggatttctaaaaaagaacaatacacccttaaaaatcgaatttttttaattcagcccttctcacattctgatcactgctgatcatgaccgatcaacgctaatttaaggcattatgtaaaagtttttcttgtagaatttaagtgattttgaatttgaccgagttttggtccctttggtttcatggatcgatcgctttccttacttggatttgtgaataggtgatcaaatactgtagcgcgggacgcccgccctcacgacacgcggcattctgcgcaagtcgcgtgcgtatgcactgcgtgtcgcacagcagcgagcgacagcgttggctgacgcccagcaaactgtgctccaattgctggtagggaccgcattgcgcgaccccacactggcgtcgcagctgcggcgccgcgcttttgtagcagttcaagtgcgagatcagctgatttaacaaaataactggaggtgatgatatcagaaagaaaaaaagtgatcaaaaacaaattagagattgatcaacaaatcttctgacatgattggagaagggaatgaatgaccagcgtataagaaaagccatgagattgatcagagcatcaacaggaggttgatcaaaagatagtaaaaaagcaaggaaaaaagcaagaaagaattctgatcagtgatcagtataacgatcaaaaattgtgcaaaaattaatgatcattgtattctgatagctctcaattaatcttatattttacctctttgcgcttcgtcttgcacacaaagtcgcgcatgttgaactgcacttggtagccgcaccgaaaaaggaattacctatataattttaatcccattttgctctgatctaatttggcggaatgccaaaaaaagatatataataaatgtgggacattttttggtagaaacaccatatatttattgtatatagctaacccagcaaggcatgcatcatgttccgcgtccactcggcagaacatttgcaggtcgagcacatcgatcactgatgggacaccaatgctgccgaaggcggaatgtgcctgaggcacaagggtcattaattcgagagtgtcttaattgccatcattaattacagagtgttttaattgccatagtcccaaaatttgatgtaacttcctcctgaatcacaactgctggccgcttattgagtccagtgagaatgctaattgacctaattagccacgcgttttaattggacccctgctgctgccatttacatactaattaattaccttaaccatgtccagccccatgcgcaattgttcgtcacattgttgacgacagccatccaccggaaccatttctgcatccgccgatgtgccgtcgtcggtcattccactgcgcgatgggttccgatcgtttggctcatcctcttaaagcattggctcttttcaatctgttttctctcgctctctctttctcccctctctctctctctccccctcactgagtgattgacgcgaatcggctggcaaatgtcctgttcgcacttccagtgccatttgctgctcaagccggacaagatcaaatgcggcacgttgcccgtgccgtctgggccggccagcggttggcactaaccgttgatgctgatccgtgctgatcacttttcccgcaccaacaatctcagcagaaatgagcaccattactagtgatagtagaagaagcagtggcgtatcaaaaaactgtgaaggtgccaaattaaaaaatgtgccaaagacagcaaatgtttgtttgtctttgacgggcactaacgactacctcaaaaatctcagctttaatactgattagttgataaccccgattggaagatgagaaaaattctgaaaatgttgaccaatttcatcagaaattcttgttaaaattcctatttcccccctgcggctttaacggctcccggaaaatgggttagtgaaaattaccaaattaaactttttgtttaattagatgccaaaaaatttctctgatttgtgagttaaagttttcaaaaattatacttcattgtgtcaaaccaaaacattaaaaaattgatgaccccttacctcaacagctgtcccttctctaccgttaatggcaaccgatcgcggcactccgggcccccacaatagcatttttttgatatttttttgttgtttgtgctttaccaatttaaaaattcaaacaattgttttgttgctgctgctgttgggtgtcgtcgtcgtcggctggcagcaacaaaaataaattgtgacaatgttttgctttgcgcatggctttcggggcgatgacattgtcctcctcctccgcctcggtccgtctcgccgtgtccttggccctcgctcgaccctctctctttctctctctagcaaattgcttttccccctcctcctcctccttcccttttttccgcctcaggtttcctctcttttcttcttcctttttcctccttttctccttctccttctctttttcctcttttcctccttttcctcttactcttttcccgcactcttttcctcctccttctcttctgttttttctcttactattcctaatcctttattctacttttcctcttactcttttcccccactcttttcctcctcctctccttttttcttccttctcttcctcttttcctcctttccctcttactttttcctcttccgctttttctctgcttctttttttcctctctccgtctgtcggttccgttttcttcttgacttgacactaaatggagcactcactcactgactgatcagaacaaaaagggcgccagcgggcgttagcgtaataatgggttttacagggagcgaaaattgggacaatgaatggggctgttggctgggacgattttcgcagcatcaaaagtgtaaccagcagaagcccccccccccgccccgataataataataataataataattctaatggaggtgattaaatgctgataatgagtgtcgcgagaaagttttcgcgcaaaacgcgggaggcgacgacatttgcaggaaaacaaagcataaaacattaaggaaaggtgttgatggaaaaaaaaaagaattttataaactaaaaagatgaaaatttaaatttttaaaataatcgtttttatcagtaaataaatcaacggaacaataaatccattttaaaaaacaacgcaaccaaaagcccgttaattttttctcttcccattaattatattagtaaatatgcgcgtcattaagagtaattaatgaatatataaaggattaattagcacagatattttttgccacttgaatgattatttccagttctgatgataataccactgtgcaaattatcacgtgtttgatcagtcccattaatctttatcaaaagagagtgtaaaatcctaacagaaaaaccacttaggtttatttatattcgagtgcaattagcggaactaaaattacacacaatcaatcattaaaaaaagcaataaaatttgatttcatggttaattttgttttctgaatgaatgcgaatcatactttagctcaatttgcgcaaattatgcctctggcaaggcttttgttatgcgcaaaattttaattcggcaaaatttgattattataaaaataaatttttaattaaaattcattaattatagtttttgaaaaaaattatctttaggtttgtgaaacaggagtgatttcgcaaaaattaaaaattgcaggatattaaattttacatttttaaaacaaaaattttaaataaattatttaggtattttgagtggaggctaatagaagcagacggggaaatctttatgatttcgattatttcttatagtaatggtggaggtcgcagcggtgcctttctggcgctggatgccaatttggaactattgcagcgaacaggacagttggacgtgtacgagtacggcaggacgttggccaactcacggcaacatttgatcgacacggtggaccagtacatattcatctacgacggtgggcactgaatatgggctcagatcagttcaactgatccggaaagacgaattggttcctaaactcaattagtttgatcggattagtttctaaattcaatcagtccattatcatatttaatcacaaattttggtcgtcaaaaataagaccaaagaaaatcagcgatgagcttgatggaaattctatcgctaaaatcgaaatttaagaaataatattttttttccttttattatatttttattttaggtttaaaagaattttttaggtttctttctttttatttatttatttttttaagaatttaataaataaaagaaaatttaagtaaaatttatttactaagtttttttatttaaataaaacaaaaatttaaataaatcggtcagtccattatcatttaatcagaagagatcttggtcgccaaaaaaagaccaaagataatcagcgatgaatttgatggaaatttctatcgctaaatcgatcatgatgaagcctgttcaagaaatagtaaatcagaatggataccatctgctgagcttaatccaacagaaaagaccaattaaactgtttttttcagttttatgcgaggccgtcctctgcaacattcagcccattggcatgcatcagctgaagaaccgcagcggaatgtacaaagcgcgcaaagaccgcgagctgatggaggtgcaggacagccacgagaacaaggcgaacaccatgaaatattaaaaatatttttatgccaaattacgattcataaaaataaattaaaattccaagagacattagttttaaaacaaggctcatcgagacccaagatttagtgttagaccccgaaagcccgagagtcttctctagtcgagaaaccaggccttgactctcgacgaccg

SEQ ID NO: 1524 - DNA, 7010 bp, Heterodera glycines
aaatcgtagccatattactcactcctcattaacattcaatctctcaattcctaagcatttgaatctactaaattgcagaaaatccaaaaaattccatcaatttaaatttctcaaatttcctcatactcaacccactttcaaatcattcattctcatgttttcccattctcttcagctgttgctcatgttgaccgccccgctaagaatcggcgactgcgccggcggccatcggctcgaaaaccgtggcaaaaaccgtgacgtgatggtggtgccgccggaccattctcggccatatctgcagacattgcacggcgagtcaaaggtgagagaaacgccggcccggcgaattggcaaagtgccaaactttcgagtcataacccggcacatagttcagacaagtcaattttattggcaaatctggcacagtttataaattagtgtcttctgttggcgttattcactgcacgagagacaggaaatctcaaatttgcgtatcccgctgcgggaatgggactcaaattttttgcggacgggatcccgtgggattaatccagcaaatcacgcaatttgtaataaatgccgggttacggactgggatatcccgcaatttccgcgccgatgctctacggtgaacccatattcgtattttgatgcgcatatgcgaagagcagcgaattacgattaaaataaaatcgtggggttgtgaagaatcaaataatgtaaaagaaatggcaaaatttcttgatttgtggcaaaaagttgcatgaaaattgtgcagttgatttgtcaaattacaattcatcttttcgcttttcaaagtgcaaaaccccgtgccaaatttcggattaatgaaatttaaaatttgacttttatttcgaaatataaataaactaccaaatggcaatttaaaaattaaaaatcgggcaggcccttatttaaatttcaactttttgaggactacacgtacatcaacgcggtcgaagtggacggattcacacgaaaaagcgaggtgagtggcttaattgggccaaatttggcaaaattggcattttgattggcatttattattaatcaaaaattggattcattttatgtattagttcatcgtgacggaatggccaaaagtgccaactctggacagtttttggacactgatctttgaccataatgtgcacacggtgatcagcttaaccaatcagcccagcgacgtcaagcagttcccgcagtttgtgcacaacaaaggcaaacgcaactacggaccatttactgtagaggtacggtaaagaggaagacaattgaattattatattattctaataataattagtggcaaattaattccggttttttgaaattttcggaatactaaattccctcataaaaattttatgaaataaaaattatgaagtacccgaaaattgtaagatttcaaaaatttgtacgaaattccttattaaattttctgccatcccggattcccggcttaagtccataaaagcacaaaatcaaaatttattaaaattaatttgatttacattttttcatttaattaatataccctaatataaaattatttttacaggtagtaaattaccaacaatatccgggtctccaatcccacatggtgaagatctccaaacgggtaagttcacatgccaaaattttaacgaattcattttcttttaattaaatgttttttctttttctttccttctgtctaactttgatttttctccctgtcatttactctttttccctttctcttatcctttagcgttttcttttccctttctttccctctctctttcctttctctgactttctcttttatctttccatttttaatatactatttctcagaattgccctcgccctctgtctgtctcatgcctctcccatttcccatactatttctccatctctcgttgatctctttctctctgtctctctccgtctgctcacactattttcccgcttaactgatcaaaaaatgtttgcttgctgtaaagcccatggaagaagtgattgaacggcgcaaatggttgtggagccgccgtaaaaggggcgatcgcgcttccgtcgatggcgcaagcggctcgcaaagcaccggcggcggactccatcgccgggtccgtcgtcgcccgaccctgtccaacttcttggccgagtgcgagcgttaccggcgtcgccactcgtcgctagcgaccgcgacaggtggcttcggcggcgcctcctgcagtggaaccggcgcttccgccgggccgcctatcagcgacatcagcttccgcctgcagcagcgctattggggcaaaatccatcggcggacgcccacaccaaagacgtcgtccgcttcgtcctcctccgtttcctcctcgtcgtccggctcgttgtcatgttccggaagcggccggtccgcttcatcgtcgcgctcgtgctgctccaccccgcgcgacgggatgcgttcacgctctcgctccgtctcctcctcctccgcatgttcaagctgtacacgggtgagcagtcggcgtcaccggcggcggcgccgacatggtccgtcactgaagttactggtgccgacggaagacgaagcgccggacgcgaccgctgatcggctgatcactgcagccggacgccttggtcagcagcagtcgcagatcagaaccaaaactgaccagcaggaaatgcttgttgttgatgaggaggaaaatgaactgctcggcgtccgtcggaaaacatcgcgtccgttgccggccctccgcccgctgtccaccagcgcgttgccggacccgccgcgaacgccgctgacgccgaacgcgccgggcagtccatcagcgacggcacttagtgggaggaaaaacccaggcgacgatggacaagctgctggaggggtgggttaattaagaaaagtaattagctaatatgaagctaaaccgcgtttcaaatgacaacggactttttaaaattttatttttctatataaaaatcttctttcttaattttccaaattttagatattcatttaaattttaaaatttttagtctcctcatttaatacagtaatttgtgtttttaaatcttcaaaatttaaaatttcattgtaaatgaatttaaaattgtgcacatgacgatctctattttcaaaaattctaaaaaatttttaattattttttatttttgttccccggttagagcttcactttatttattgtttattttttaatttttatttttctaaaagtggaccaacccttgtttaggtccaaatgttgttgcgcggcggctccgacctgcgcacaaagcgcgacgcgcgcggccgacgcctgggcggtgagtgggacaagcgattggagcgacgcggtgacgcggttgttgcactgtttggcgaccgcggtgacaccgccgctacggctggtggtggttctggacgccgcgaacgtcttccactgccgagagacgacgacgacgcggtaacgatggcacgtgccgaaaccggcaccacaaccaccggctacaccagcaccaccaagcgacgcagcaacatcacgacaagcgcccggcgacggatgagtcgccgtcgcaagcgccgggagcagcggcgcgcggaacgcgccttctcacagccaaaccttggcacgcttgaacgcttcgagaaggtttcctccatccacccagccgcttcaccacgaagcggggcgcccgggcattttacacactcctcgagagtgtggtggtgttccaatcccgacattgccgtgccgccctcaggcattggtgttgttccctcccctgcccatactatatggcaagtggatacggtagtcatattttttatatccacaataatcctaaacttaacgatagaaagattaaatgttgatttagaaaatgtcaaagatggagaccaattttggtgctagcctatttgacaaatgagcgcttttaaacgaaatggcaatgaaattaattagcatggattttaactttggatgactctaatcggataagcaacacaatttgccttagggcggcatccgtcctttatagtataactaattaactaattaattagttagttaaattgttaatttggccctcggggcgcctcctctcccccagccacacttacaaattaggcacactttttgttgccttttctaatcacaaacaaagccgcttttgtctctgtgattacaaaacatgcacaccacttacagtaactcgtgtcaatttcgtcccaattttcgtttttccgttttttgcctgtggctggagttagaaccccttcaataggctcggcctagccgaccaattttttttgtttttttttttcaaaaataaattgtcccgaattcattgcatcagttcgcttcgctactttactaaccacatccccgaaaactgttgtggctgggagggaggtgcaaggctttcattccaattgtcgcattttgattggtcactcaaatcattatttttcttaattattgttaattattcctctcgctctctggccagttctcttcccaatcaatatttgtctcgctgtctgacttttccagcaaaatattttcacttcaaaacactgtcgaatggcgcgcattttcaaatgaaatgctcccttaacagcccactgatccagtgccgataaactctcagcccaacccggacaagggcgccaacaaaaaacttgtgagtcgactggcactgccacaaatggcattttccatacatcatttgctctcccagggttactgtagcaacccatggccaaccaccgtaggcgttcgtattacagtagtcccacccagccacatatttccgatttgcttactttcgcttttattaactgcaatgcttggcaatttgccttaaaagttgctgcttttttaattttctgtccttttgtccaaattgtcatttgtgtacatatggcatttcgttttaatccatcatgcgcgagatgtttaatgtaggcattacttgttaccgtttttggcattttaaatttgtgttgtgatgtaattgttgccttctttgttttttgcttccattcatcaaagtcatgtgtatatttcgtttgttttgtgtgccctttttgtgaattgtgccgtttctttttcaaaattctgttcagcgaggcaccgacgaaattcggcaacttttgagcgtcaagcgcaacgtgccgaaccgacgcgaccttgcggaacaaatgaacaaattggttggtttgtcgcgagtgcaaagcgtatgttcactctgacaaagtgccgaaactgaattggtcactgtaatatggccaatgagttgtgataagtcggcttaagtttcactgtacggctggtacggttggcttactgtagtgcaacactgtatatgtgattcaaaaaaatggctttcgctttataacttttttttgtcttcttttttgtgttttgttgtttatcagtacggtttttactgtaaatatgtggtaatttgtggcccggggattacggtaggcaacggaattgaaaaattaaaatttctgacattttttcggctcattcattccctaattttaaatttttcgtccccttctcccacaccaaattttttggggatttttaataaaacatcaaaatccacaagtctttagacatttatgatctccgaaattatggcctctggggcgagtcagcaacaattggaggcggaagtgcgcttgtgctgcataatccaagtcaaaatgtggccggtaggttaaaacagatttccacaaattttctatttcaataaaaattttgggaaagagagggtgccgaaagatgccgcagtggaaaattttattgaaaaaattttggtaaatttacggaataattttccctttaaaaataagtgagggatcttatagaaggggtatcaacttaaaaaagtttctaaaatttttttgaattcgattttcccttaaaaacagacaaattacagaaaattggctataaattcccaaaaacttgcctttttcgtgttttttggccgttttcattttaggcatttatttcgtttctgaattcacttttttacttaaaattttccgattaaatttgacagattgaaaacaaagttccgttgtccaccaccgcactgatcgaagtgctgaaaatgacgcggtcgtggcgaaaacgggcgcccgatcggcccgaacagcggccgaccattgtcatgtctcagtgagagaaaaataattaatgaaaactaaaaaataaggtataacacccacctatcggaatcttattgaaaattttaaattttttatgagatttccgagcacattttgtcaaaaaccatggcactgaatatgtcggatgccctttggcattcgttgcttagcccattcccataattaaacgagtggaatggaataatagcctttattccgaaggtggatccatacaaaatatgtgtaatatgtgtgaatagttggggcaaattgggggagagggggaattggaagagttcgggattagccaattcccctcccgaaagagtgaatagtacaatgtgctggagggcagcaaaagacttaaagtgggcggagcattaatgatcagctaatgagatattaggacatactgtacttagtaaagggtctacggtaaacacaaaacaatgagctacgtcagcattagcgaaaaatattgcatttttaactaaatcttgtaagaaaattgactaaattttcaaaaattttgtcctacttttgctttcatctttttattttaagtcagaaattttacagttattttagaatacaaatgttattttaattattattttttgttttttagcaacggcgtctcccgttgtggcattttcatcgctgccaatgtttgcattgatcaaatggaaatggatcacgaagttagtctagcaataagcctttaaaatcatattttgaaaatcaacatttcgccaaattctctttttttctctgtgcctttgctacaggtcgacgttttccacgccgtcaaact

SEQ ID NO: 1525 - DNA, 4515 bp, Heterodera glycines
ttccgatccaataaaatcgttttttaatttcgtgccacgttttttcgaatccaaaatggccctctgaatggaaaataagaaaaagtttttgtcttaaagaatgagggattattaatttaggtttctccatgttttctttgccttttacgaaataaatggctccatttatcaagttataatcagaaacaactcttttccatttcagaacatcacttggacactttccggtttttaaaatgtagaaaattttggccaattcctttacctttgtttgtgcctcaatcactgtttttaaggttattctcggattttcattcaaaattccatcatttttggcaatcaaattttcattaatattttttgcacttaaaatttttggctgaaattcaaattcatctgaattttcttccagttttggttcacaatctttttcatttcccggtatattatatcgagacaaaaaatccgccactttattcttttttcccgggcgataagttatctctaattcgaaactttggagagttacttgatatttctcaagtctcccttttaattccttagctttcatcatgccggtcaaggcactacaatccgtgattacttttgtaaccccagacccaactatatatggcgagaattccttaaccgcatacactaatgccaatgcttccctttcaattgaagggtaatttgtttcgtgccgatttaatgctcttgaaatgtaagcaacgggcccattctcctggaggagaactgctccaatggccttttttgaagcatcacactcaattgtgaatgtcctcccgaatcttggggactgtagcactggtactgttgtgagcatttgttttagagtttgaaaagcatgttcctgctctgggccccaattttcttctattttcccttcaaatttatcttgagtcaatgtctgtagtggtcgagcaatatgcgcaaaattgtgaataaagcgccgaaagtatgtcaatgcacccaacaaagactttaattctgttaggctttttggtgccttaaaattttgtaccacttcgacctgctttgggtcaattctaacacctttttcacttaacaaaaagccaaggtaccgtatttctgacattccccaatggcatttttccaattttaatttaagtccaactttttttagcaataaaagaaaattcttaatatccgttaaatgattttcttcagtttcgctgccaattattatatcgtccaaataaattaacatcgcagccgttagccgtcttctcaacgagttcatgactctttgaaaggtgtccggggccgctgttagaccaaaaggcatcgttataaattcaaaaatgcccaagtgtgaaatgaatgccgtcttttcaatgtcttcctcggcaaccggaatttgcataaatccttgctgtaaatccatgcacgtgtaaaatttctttgcccccatcagatctaacaactcttgaatgtttggcaagtgaaatactctcttttttgtcattttattcagtgctctgtagtcaatcgcaaaacgccacgactttttatcagccttagggaccatcactatagggctagcaaactcagattccgattcccttattatattctggtccagcatcattttgatttgcctttcgatttctttctgagtctccggtgggtaccgatatggccgacaatgaaatggtaacgaaccaggaattaggtcaattttatgcacaattggtccgttatatttgccaatttttccatcatcccctacaaaagcttctgaacactcatccacaattttctttaaatcattttgcgcattttcacttaattttgtaccctcaagattgattctttttgatggtggcctatttagtccgttttccggtaattttggtaaattttcgctccatcgtgtctcgggaggaatgtaatcttttgctgggatttcatctcctggtgatgcattaatttgaaccgattccaaatctgccaaatgtgactttccatataatttaaccgctgaatttcccgcatttaaaatttgtattgttacattcttactatttcctggtgaaaccaaagttcgtccaacaattattccgggatatttaagcttaattcctttcaccaaaaaattttgttccattggaaaacattcgtttacttttgccgaaagtatattttccgaccttggctctaaaacttccgtattttcaagtatcacagacggtggttttggcttttcagacccaattactgacacaatgtttgtccacacatcaccaagtctaactcttttctctcccagggaaattacaccttttaattccataagaagtggtaatccaataagcaaagggccgggacaatgttcgtccactgagacaagcaatacaacttcccattctccgacatttccagtcacattatcctcaattcgaagttttgccatagttttccccaaaatttctatgctcgaatcgtttgccgcagtcaaatttccttttccgtcattttgctccaaaattttaagtcctgcttttcttgctgttctttctctacagtaggatacactagcacatcaatcaaccaaggctgctgttaacaaatcattaagacggacactaatggatgggagtctcctcgggtcattcgtaatcgctgcaacccgtctcggaggaagataatccagaacataagcttcttcatcgattgaatccaattctggtgcggttggtaccgccaaaacccgagtacttcgtttttttgttcccatgattgctcttaacactcttgccaatactgacccagcacgaaccccggcaaatattatcagtctgtatttaattccaatgtaacccatcaatgccaaaagaattaataatggtatcgcaatcagtacatatgatatgcctttcaaataacttattgcttcttggttttctccggaattttctttactatttccaaccaatctccggatctaccaattatcacaccaagcgtttcatttgcctcacttttaaccaatttaataacttccgtaatgtttggtttttcaactaatcgtaatatcggtgtgggcaaattattcatttttgagcgatattcacgaattgtttcctcaattcgcacattgtctgattcaaaaagcgctccggcttttaaaattaacgggttttgtatatttcggtacttgggtcgaattttctcaatattttcacccattttttgtattattcccctttgagtctcattctgcattccctttacactgccattttccacacattccgactttttccccaaaatgctcaactcccttgtgccgggtttaacaaaaaatattgtgttttctgcaaaaactggcgtccattcgtaacactcattaccaatttttttatcccaaaatattttttcaggtgttagtggtgcgcaaaatccaacttccaaattatcaccttcccaatgcgcgaccaaatcatctctatcaaaaatccttctaaccccctcatttggatttatctgtaagattgccctagccaattgcatttgaaatttggtgctctcacatgcctgaatatatatctgatcatattgttgctttctggcttcatccagcctatacatcgcataattaacgcgggtgttcatgttcttattttcctgtcccgctttacccctttttttacttttctcaacttttttaagccattgcgcatcaggcgtggtcactgttgtccgttttctcctgtcattttctaacacttcaaattcaacgtactctccctcattactcccttcatcttcctcatttataaaattcatctccatttcctcaaggctctcattttcagaactattttctgtacgtatctcaatctcgctttcagtttcatattcagtctcaatgttctcacccatttctgacttaataacttcggtggcattccccaatcccgagaaaatatttgaattaattggtgagccaatcattaaacttgtatttgttttgtcagttggcaacactgttatttcactcgcattttgcgtgacttttgtagaaatcgtagtgacagaagtacttgttaccatgggctttaccgttgaagtggttatggtcgtggtaacaatttttgtgaattccgacacgaaatgagattttttgactccatttttgggtttttgtgtaattgttagattttttgttggtgtcgcagttgacaccaacggcctttcaattttgtgaattttaacaggtttagacacggtcaaattttttggaatattcgtcccaacttttgtgacagtaataggcttttttgtggtagtgctttcagaacgacttcccaaatttttaaactctcttccctttgcctgataaatttgctcattctgaggccttttcactgaaattgtctcaaaatgtccatcataattaacatttgaaggactggttgatgttacaaccctttgaacagtaattggcttagaagtggtgcttgtcgt

SEQ ID NO: 1526 - DNA, 4006 bp, Heterodera glycines
ttcagccgccttttggtattttggtatagagcaattcgtgatatttggtaacagaattggggtagtctgaactcgttcagaacaaatttgatattgtgcatttgacagactaaaagtaccaaacaaaatagacaaaaccatcgaaattgttaaaaatgtaaaagtcggagtcggagaacgtcttgatgaacttgactgtgtttgttcatctcccaccatatttattcggtatctctgtttttcattaccatttcctcggaaattaccacgattattctgaaaattgcccctgttaccgaatcctcttccccttggctcattattgttaaatctgttaggatttgaattatttccattccacattcgcttttgaccaagcgggataaaatttggatttcttggtacgaatccaccgttatatccacctctcgtactatttcggttttgctgccaatttcctctgattggcctacggtaatcattccctctgttgtaatttgaatttacaaattccctatttattccttcttcatttgttttactttttatggaaattgcattaatttgttcctttaactcggcaatttggtgtctaaattcatcacctttctcgtcattttcaagctcttccttcaactgaaggaccttttttgcttgagacatagcttctattaggcttttcggcttatccataaaaaataactttcgctttagggaagttggtaagccatttaaaaagtaatgaattgactcattctctctggcatccttggtatacgcggggtctggagaagactgttccacaagctctcttattttatttgcatactcagtcacggtttcttggcccatctttatttttgctaacactttctttgcccacatcggtccatccacctttttagtatggtccgccaatgcttccgttaattcccgccaggttttctttttatccgcgggtatattcataaaaatttcttttgcctccccctctaaaaacaagggtaacatgcgaacacagtcgctggggtgccagttggacgccgtagccaaaatgttaaattcttttaaaaatttgtgaaagtcgcccatggcgctatatttgggtattttgacgcccgacggcaaatttgttgatattttattagtcaatttgccttccaattcatccacttttatttttaagacttggtatttcagttccaaatcattaatgtccgtcattttttcttccctttggctttgaccttttttaatatctctttcctttgtccttttgtctctttctgaattgctcttaactttgtccttaaatcccctctgtaaataatcaggcacttcagaggatttcgtttttatcttttttctgccggccttcaaattcagctttatttttaatcactcttggtcttttcgcacaatttactcaatttgacagtactttaaatctttcactttattgccttcaatttacactccttcaaattactcctctcaattttattaattttcactcttttcaaattacaggcaattttttgtattttaaacgaatggccctttttttaaaacccttttttcaaaaactgaattcacctttttgtccgttcgagagactgcttcaatttggtccacttcgtagttgaacacgccgtccgtaattgccttcttcgaaaagcacgtccgcaccgcaaatgttccgctgtgatcactgaacagtaccgatctcgcccactttcgactgcgtgatgttccgttcgatcaaaaattgatgatttgacaacttcggtgttttggtttagtcgttttaaaattatttggcttaaatgggaaaatcccttttgataggaaaaactaaaagccgttggtaattgctcaagagaaaaaaaatgaataaaaaaaaagtgacgatgcgtccgatcgcgattgttttaagcaaaatgcctaggatttgccaaatgactcttttgttccatcaactgctgactctcgtaattgccaattaatttcttcccgatcatcttatttttggcaacatttgccaattctcattatctttatttttgttaaacaattggcctttgctttttcgcttctgttcctttaagttttcgttaattacttttggccgttaattatttatccaattgagctcaattttccatcggaatttctcgtgatttttcttttatttcaacattaaacatcaacatttttgtcattggtttatccaagcagccccttcggccaacaataggcgcctttatcgtttgccgtcagccgcttttcggcctttgctcgctacttctgcgatcggagcaattaaaagatgaacagatgtgttcggagaattaactatttattttttttttttgaatttgaaaagaagtcggggcggggtgtgaaggaaatggaaaatttaaataattgttcaaaaagagtgaatttgaatggacaagggatggggacattgattcgatggtaaacgccgttaatttccgcacttcctccggccagtcatttcgttccgtaatttaatttattttatttcttcttattgaaagcaaaatttgaattatggtcgaaactgcctgggaaacgaaggcaaattgtgccgtgccctgtgaattgcccaatgtttgttgggagcccgtgctttataccagtcccaacatttgccttcctcctggtgccaatccccacacttttgaaaactacatttcattgcatgccatttctttcctttggcttttccttgctgcttttattggcggattttgttttggcgttgttttgaccgtttcgtctggcatttacaaatgcctcacccgtcgccgttgcaaaaataccgtatatttccaccatatttcgttgactgattaattcttaggccgaaatttctcgtccaactaatcgttccactcgttgcactcgtgggttcgatccgttgcctgtgccattcacttctgctgtttaatgtaaaatcccttttcctaaaaatttgcccaatttcattctcattgattgtttctttagctgccgccgatcattcaacaatcacttttcggccaatttctcagcgggcctctcttttttctttttgttaaattgatccatacgccctttaatttctttaaaatttttgtctgtccattttcctttttgcttcaactccaatcgatcggacaattttcatttaaatgctttttaacattatttaaactttatttaattaatttattttattaaatttttccgtatatgtgcagctatttacaatcagtctcgccaagtctcgtcccctaaggcgggacctccatgaatatagatggggacaagggggtgcccaaaaggtctaagtgccaatgtctgactcttccaatgactaacagcacagtctttattctggtgtccaatgttcaggatacaatgggcaacccccaacccgattcggtctcggggacagagactgatgggcgggagccccgggcaagactgagagagagaagaggcggatgaacacttataaagagtctcgattagtgaaaagaaaggaccgccccccgggctgacattgacgggggaacaatgatcagaggataagagagagaaagagagaattaagaaattaagtatatcacacgcataaaattgaaaaattatatttttttcttgattaaaaaatttaggtttaaaaattttccttattcgaaaaaatataaaatatttaatattcatttaaatgacaagaaaattaattttttgattttaacaatcatttaaatgacaataaaatttgtttttgattaagttttacgtgttttgcttcctaaaaatcctttaaaaaatttttaaatgcctattttcatgccttttttagggattgccttttcatggctttttttcaatttttgctgtatattatagtgcctttttcgctatttttggtgcatttttagtcgtgttttacccatgacaaggcaataaagctaatttgtaacaatgg

SEQ ID NO: 1527 - DNA, 3249 bp, Heterodera glycines
  misc_feature (3227)..(3227): n is a, c, g, or t
  misc_feature (3243)..(3244): n is a, c, g, or t
aatttacagatttttcgagaaaaactcggcatcacttctcttaaatacaccctaaaaaaataatttgaatcatacgatagctcttggcttgctctataagcataaaaaatttcagaatatttcattaagttttcagaaagttatgtctattttttaacatttttggtcagaattttttgaaaactcaatgaaattttctgaaactttttaggctaatagagcaagcgaagagcaattgtatgatatcaagattatttaatgtggttatgtttaagaaaagttatgacggatttttctcgaaaaatctgtaaattggctttacgaaacgacctatgtagcaccaattcttttatttatattaattcaaaggtttttttgcccaaatgcttcgcttttcaagctaaataacggctttattctcgggtcctctcttttggtccccgttcattttgtccttttcttagaaatcgaggggagaatggccactcattttctgtttcaattttaagaaaatttaatggaccaaacattttgtttatgtatttatggtttttgaattttcactgtgttattaattacctaacgaattgtttgtatttatgaagagaaaagatatttcaatttagtaataattcaatgaattcgcgaataaaaggacaataaaacgctaattaacaaagaattcattagtaagtccatttttaaagggttaattaagcaaagaattcggctgtgatattttaggcaagaaaatgatcatttgatcggcaaaaaactaattcgaaaaaaaccaaacaatgacaaaaggaaatttctaagtaacgaatgaaacatgtggacacttctgggaatttaaataccatttttggcattttcaaacccaaaagggtgtaatttactagaaatttaaatttgaaagcacgcaatttgttcggtaaaaagagtggtcattaaaacggaaattctgctgctgaattgggccgatgtgtatgacgcccattatgaggaagaagccccaatttggcgtgctgctgacgtaaaagcataaaaaataatttttatgcattttcatcgctttgttaagtttgtcattatcagccatttttacatttgcgtgacaaaataaaatgataagcaacgataaaagatttagctcatcgcactttgcgtgccgtgccaaaagcgacggcggtggtgccaaattggcagggtagggcttcatgaactaagcattgagctgattctcccccccccccccccccccaatttgtcaattttaaatgccgcaatttttggttttctagctaaagaaataaactgaaggctaaaaaaaaatcatgaagtccgtattttaatcccttagatttctgagaatttttaaatcgcatataatcccgaaaaatataattgaaatatagttaatccttataaattatagaaaaaactgatttacataaatggtggaattgagtgttcgaatttaaattcaaaaaagccaggcttatcccatactcccaatttttttctggccccgcatcccacccattctcggtcaagccttttatttatttcctcattatatattttttttgcattattattggcattttgttaataacgacgtcctttgggaaaaacgggggtaaatgcgcaaacaaaactatgccaacaaacaaacaaacacaaaacaaacaattaaatttgtataaaaagccgctcaatgagtacacgcaaaatgacgcgctaacaaatggacaaacattggacaaaaaatgtttttcttttctgcaattgcacagcgcagtgcatgtgtatcaatgctggtgacaaactgacaaatgagcacacgcactcattcaattcattctcgaaaaaacaatcatcaccacagggaaaggtgcccgtgtcattctcgaggggcaaaagttcgccccgggcgattgggggggggggggaaatgacgaaaatgtgactgaaaaaaggaatggcagtggcaggaccggcaaaacgaaacaattttggggaaaattggaacagcaacagaagcaacggggggggggggtaatttgacccaaaaaactgtgtaaatttggtggggaaagggggggggggagccggcacgagggaatgtgcgggggccgatgggcggcggggggggacaccgtttacgcagcgcaccaatcactcattacgcattcattcgtcacatgatgatgacgaatgttgctgctggaaataattatgggaaagaaacattttggagtttgcttgttccttctcgcaagagaatgaagtgttgcatttcatcgttcttgaccgattttttttttgcagtgaacggcgaacgaacgaaatgccaatggaaaaaaacaatgcgggagatggcgggaatttaaaagtggaacaattaatgtgcacagcagggggcggacgaaaaagaatgcgaaatgctttgtttaagtttaataaacgggcgaaagttaaagtgaaaaattattaataaaaaaacatttttttattttaagaataccagaaaaactttgctgtcaaattgaaaaacgttaatttcattaccaaattctgtgttggtttaaatcaaaataatttttcaaattaaagaaacacaaaaaatgttccggattattttccaattatgcctgattttcctacagtcataaatatcggaaattggttggggtgccaattgatgaggagactgactacattcatcgaccactttttggctttttctaatgcctatcccgctgatgagaagagtaatttgttggagcttaatgaattgttctcacattcgaataatgaatgtttgtcacgttgcttctttcactacaatttagctgcttattaaggtgctgggacgttagtcaaaaaccatcaaaatgggcgttagtcaaaaaaccatcaaatggaaaatttttgacagaaaattattcataatttcgcataaaatggatcaaattttataatatagatatttttcgatagccctaagtgttttctattatcctgcaaaattagaaaaaaattctttaagtttaaaaaaagttatgacctgagaagctcaaaaacccaagtttttttgaacatttttagtcataactttcttgaatcttaacgaaactttttggaattttgtaggctaatagaaagcacttagtgctatttaatgatctcaagaattaaaaatgtagatgcttttgaacaanagttatatcaaaaaanntattt

SEQ ID NO: 1528 - DNA, 1356 bp, Heterodera glycines
agcttgttgtggcacaaaagcacagaaaatgccaaagttgggcgcatatgagccgacggtggaactaatggtgcataaaagtgcatttatccagcagataaaagtgcattgtgccaaatacaaaagcagaaacaaacagatttgttgttgaatttgtactgtacgtctaactgaccgatttctgtgtcaaaagtcattagcatcacatcagatgccggcgacaccctataaacatttcttaaaagtggccggcctccagcagcactcattagcggcatatcgcaccgtaccggcgcaaaaactgtgcctttttagcagaagcagcggcaaaagtgccaacgtttctgtttgttatgcatgcggtgttatgtaaaaacaaacttttttggctgttgttgtttttgtttattgctgctttgtgttgtggcgcacgctaattcctcctaatgcccccaatgtttttgccaccaccattaaattgtatgtccattatccgtcaattaggctattattattttgtttttattggtggctgctccaagcagcagcagaaccattaatgcgaaaagcgcctcaggggaaaattatttgcggaggagcacacttgctaacaaaagtgttttcgagtgcttatgacatgccaatggatgaatgggtgattaaaatattagtgattaaaaaaagacaaatgcgccagttaaaaaaacacatttaaaagaaaactcgcattgtacagtatacagggttccaaaataaaatttttcaaaaaactatcaaaaaaacacaaaaatcaaaaacgattatgcgcaaatgtttgtttatagaaaaaatcactttttaaaaccataaaaaaagataaaccctaagaaatggataccttgacacttaaataatgcttacacgtagacctctgctgctggttaaatgatttaatattatgaattcagaatgcttcaaattcattacttgggctgggatttttagtttttttttttacattttttcagcggcttggtttcgctaagaaatgcacgaaaaaaaattagcccgtaaattctcattttaatgccgctattcataactataataatcactattttggatttttttgccacgaaaataattacatcacaattaagtgaattttgtcactatttttattctcaacaaaatataataaaaacgaataataattaaaaaatttcttgctaaaaactcagaaattttgttttttttattaatatgtttatatggcaaaaattcaataatatttttttgaaaaagcgataaaaaaatcgctttaaaacatctgccattgtacgtatttataagacttgtccttatttggaggggttg

SEQ ID NO: 1529 - DNA, 6346 bp, Heterodera glycines
  misc_feature (5572)..(5573): n is a, c, g, or t
ttcatcgccggttcaaatctatcaaatgaaagtgtgctccttaaaagggcaatttggcaaactgtgacgacaaggtggtataattctcacagtataagcttgtgggaaaagctcttcgttctcggaattttttaagccaaaactttgaaaactttgagcgggattagcggaacacttatcccccaccccgccccgttatcaatcattttgccaagcaataaaaaaagcattcgctaattgctaatatctcccccccccccaggggacactaccctgcggcgtcacagcaccagcattatattggccatttgaccccgcactctttggcttaatcccttcccgttttaccgtaccgcctccatacgctggcgtgccgttgtgaccgaatggcagttaaaaatggcgcttatttgcttaccatttaagtgcaaaacatttcgcgggtttgggggcggggaaatgttcggctgctccacccgccacagcttaaaattgaatttatttcggaaagctaaaagcaaaatgagctcgtcagcattttgtgcgcgtgccaattcttgctgctgcagctgctgttgacgtatgtacccaattttgctttaaaaagtgatttttggcaaaaaaaaaatgggggagagccaacagacaaaaaaaactattaagaaacaaggcaagataagcccaaagcgaaactgaaaatatgtatgatatcattagcaattggtcgtattagagacaaggactttgtgatttcgggtccgggtccgggcttatgattgaccgggccgcctagtaaaaaggcccatttgaccgcgcggggggaattttgggcaccgggaagtttgggcaccaaattgagaaattagaaaaataaaaatattttaattgtctataaattgcaaccatctaattaaaagcatagtaaattttaatcaagttaggaatcgaaagtttttgaatgaataatccgctcaattagccattcttaatttgctactcattaccattcattctatatcaatataataaatatgtattgtggtgtatcataacaaggctcggtctgttcaaaacttagttttatgagtttaaactagggttcggaccccgcccccgcccccgggggcgggacaggtttttggggctcacccccgtccccgcccccgtgactctgacccccgcatcccccgcccccgcgaccttcgcccccgcgggggcacgggggtgaaaaacacacccctaagaatggcatattcgtggaattaaaggcaaaaatttatacaatttagaattttttaaccatcttttacaaatttttatgaaataaagtaaatttgcttatattttttaaaatatttgtggtttagtggttagtgcttcaacattaacaaactttttgctaagaaatgttctggttttggggtagtaccttattttcatctaaaaaagggaaatttctaaaaaatttggctaatttctaacaaaattcatatagacttaaaaaattttccgcttgcggcgccaatcggcaccaccggacctctcccctcgcacattcaccaagtttttttgaagcgttccaaattttttttttttttttttttgacacgtagttgtccaataagtttgagatcaaaatggattcaatttcccgccgcagaccctccgtcattacccccccccccccaattaactccaaaaaacagcgaattgtgcagcaattggacaatgccgcctcagctatcgaacaattccacatggaacatctcactgatgcgcctcaatgggcgtccgcaatgttggaactggtgaaccaaatggtcgggatgtgccgtgaactggtcaccatggtacgcgaacaggacggagaaagaaacccgaacatggtcttcgacgaggaacgacgactgcacagcgtcgtcatcgcgcagttgccagaaagcaacagccaaatgccaacgcagcgtgcaaccgacgacttggcaaatgtcaaagcattgatggaccattgtgacgtcgagtgcctgccgacgcaagtgtacagaatgggcaagaaacaatccaacggacgaccgaggttactcaaagtggaactcccgactaaattccataccaatttgttcttgcgcaacaaaaacaaaattaaaaattttaacaaattttccaaagttttgttgcgcccctccctgtctaaaagtgatctcattgaccgtgcccggctcatttcactttgtaaagctcaacgcgaaaatgacccctcctgtgattacattgtctatgcggggcatgtgcttgcccgtgacgacatttccgccttcaaatccgaccccaattttaaatgtatttgtcataacagctcataaaatcttgcggggaccacccatattgcaatctctaaaaaatttgataccgcaagattttttaaaagtcctcataaggataataattgtttacaaggtgctttagttaatataaggtctatttataacaaatgtgtacaagtagaaactgtttttgaatccttaaatttagactttatttgttttacagaaacctggggtaaaaatgaaaacccatttccttttcattctaattttctacaaaaccataccatttcttacactaacagattgaataagcgtggaggcggtatagcttttgtcgcaaaaaagaatatacaattttttgtaaagttttctgaaacaaaatttggctgtgaaatactaatattacaatttcaaaattacaattcgctgaatttaatccttgtctataggcctccttctattaatttaaaaaataccaaaaatctttttaaattcctggaaatttacatttcagaaaattgttgtttacttggggattttaaccttggaactaaagatttaactataaaaaataaaaaaccgtaccctttaagtaattttggtactttattctgtgattttttcaacaaatataatttgacatgctgcattaatgaacccactagggagcaagccttcctagatttaatcatttcaacaaaaactgaattaataaatgcggtagaagtaaaaggtggacttctagatacagatcatttaacaattctttttaatttttgtattttaaagaaaaaggcagtcaagaaacaaattattcttaggaattttactaaatctaatacttttctatttgatgcatatttatcctcatttctccctcaactactacaaaaattttatacagttgaggataaatatgctattttctttagttctgttcgaagaaaccttgaaattaatattcctgaaactattttatctattaagtccgccagaaacttttacccaccgcatttattggcttcaattagggaaaaagcacgtctatataagctaatgaaagaaaatagaggaaaatatgaacctttatataaaagtatctccttacatattaagactcaaataagaaatattcaatcccgtaaagaaaataaaatactatccggtgataagaatagattattttcgtatcttagaaaatactttaagccagtagaggatccaccagttattcaatataagacttcttttatttctgactcaatttctaaagcggaaatttttgcaaaaattttttctgaaaactttactgtaaataattattctcttgattttgatacttctttttcttctccaacaataaacgacgttgaatttaatattatttctgttggtaaagtacttagaaccttacctaacagaaataacacatcaccggacggtattacctttagactgttaaaaaattgttctctttcgtttactccttttgttactgaaattttcagactctcccttgatacaggaaagcttcccactatatggaaacaatcgattattatccccttgcataaacaaggggacaaaagtaaccctatgaactataggcctattgccttaacttgttctttatgcaaaattatggaaaaatttattgtttgggctatttccgattttcttttaaagaacaatttattctccgaacatcaatttggatttataaagggcagatcaaccacaacacaactaatttcaacccttgaaaattggtatgatggtatttataataataagaatatcgattgtgtctatatagattttaggaaagcatttgatgttatcccccataatttacttttatataaggttcatagaatcggtattaggggtaaaatcttaaactggttatctgactttctttcaaaccgtacctttagggttcgggttgataatactctctcttctgagtataaaatgagctctggcgttccccagggttctgttcttgggcctcttttgtttctgatatatattaatgtttacctgaattaattcctaaacaaatttctataaaattatatgcggatgatgtcaaattatattccgtacataaaacaaaaactgatagaattgctatgcaccgtgctttaaatattctctctgattggtctaagaaatgaaatattaaaatttccatcaataaaacttttattatttactttggaaagaataaccccagggaacaatataaaattaatgataatgcaatttgtgaagttgaaactatccgtgatttagggattcttattgacaataaattttctttttccgaacacataagcaaaatcactcgtaacgcctactaccgtatgcgtttacttttccgtgttattaaatcaaagaaaatagcaatttggaaaaatatttttgttagttatatccgtccacttcttgaatattcccctgaatcttggaatccgcaacttaaatcccatattatcaaaattgaaaaatttcagaaatattttactcgaattgctttcagaaaatgttgtctgccaaatattccctatgaccaacgactccgattttttaaattagctactcttgaaaaaagaagaaaaatttttgacctcctaactacttataaaattctacatggttttacacatttggacccaaattcactgtttaagagaactaacttaaatactcgaaacaagtcttttttccggttaaatgttaaattacaatttaaaaaatcttcgaaatcttttgttaacagaacagtcaaggcctggaatgcccttgataaaacattaatgtctagctccttaaacacctttaaaaaattattagaattgactcttgattctcaaagcaccaatgtataaagcaattattaacttttgaggcatctcattgactctgacttccattttatttttttttcattattgtttgttttaacctgtgatctcactcgatatttattcacttactctgagactattttactgtgatcagtcatcagagtaagtggtctccgcccttctgatggcaattttttctttatcgataaataaaatcaaagttttaccgtccatgggtggcgcctgtcgatcactaataaaattgggaattttttacggcctattttgggcaaaatctgtaagaaagctgcgcagaaaactcaaaatttgtcattatttttacacattggccatacttaatatttccccggnncggcgcctatcgacaccactgggatcgacattaatcctgtagaattgagtcaaaaggtgtgacatttagtcattttttggtcaaaatcagttaattaattgataaaatttttcaaaaaaaatttcagacggcgcctatctgcatagacggacccctttgttcctagttttcgaaaaaattgcgccgaaaaaaagcattttcgaaaagcaaaaaatagtcaaatttatcgaccattaacaggtttgatttccaatctctttttactaagaaatccgcaatcccgcgcgggatcccgcaaatttaaaatcgcaggattaatccggccggatccggtcctcgcaaaaatttttcgaattccaattctgcaacaggatccgcaaatttgaaatttccgggctctaacaaaaatgcaataaaaacgaaaaataactaaatttagcgattttcgagaaaaatttttaaagaaaaattatggtttttatagtaatggcggtgccgataggcgccgccggaatttttttttttcgaaaatttcagtgcaatttattaacagaagttgtacaaaaattactaatttttgaaaaaaattcaaaaaaaaattttccgaaagtttccgactttttattcaaaaacttcggaagtcggaattccgtgccatccccgctatatatgacccatgaaccgtaatatggaacttcgtcgttgattcaattggtttggaatacacatttttttttaaatttaaccgtttgttttaatttcgtttctttttt

SEQ ID NO: 1530 - DNA, 3691 bp, Heterodera glycines
tctgtcatttattaattgttcatagatcaccataacccctcttaccattttactcattaatcgtctgaatttgcagttgattttgtttactcattctttttaaatatatacttttttttgtcaggacatattctttcaaattctaatttaaactaattctatcaataaattatatgtaagaaaaatggcaaaacacacataaatttttgaacacgaattatgcttttcccattaaaattcgtttcattcaattcactttttatttatttacacaaattagcgcgttgactaattcctgcaaaataccttaacaattattcgtaactatgagcgattccgggcggtcatctattattcgaaaaagctcatcttccaagctcatccgacaatttgccgtactttttttttattaaaaatgtttcatgttaatcattcattcactgttaggagatgaacattcccaccaacggcgatgaatatttggaccgaggcgagtcggctaaaagggagaaacgattcgtattcgaatgtgcgtgggaagtggtgaacaaaggtggggagaaccgaacccggcatcgctactctttcgagagttcttaaattaagttggaggcatttacactgtcctgcggacgaaggcgccgattagcacagacgaactaggcgaccagtattacatgatggttggtggacagcaccaaatggaaggggaatcaaatcaacaaacattacacgaacccgaagggttcatggtccattaatatatgtttcgttcgatactctttttggaattttattcccgagttcgaacaaaaaataattaaaatttaagggtccctacgtggaggaaagagttcgcctggaagtggaggtgttggagccggagactgcaaatctcaagtacacgttggaccaaatgtatgactggggtttccgcgttgtgtacgggcggtggctgattgacggatatccgaaagtgttgctgtttgatgttgggtccgccgcttggaaattggatacatggaaacatgaggtgatagataacacgccaattatttccttgctttttcctctggtaacaactttatcactaatttgtgtaattttttgtttactattttgtccaaaaaatgaccattatattactttttgtgttaaattttaaaaaatagggaattttgagtccgacgttgcggacaggcgcctcgggaaaaaggaaaattttaaagaaaaaattagccaattattccttgctacatgtcaccttttcaaatggttcgtttaacgagaaatgaccattgttggtaatttaaacaaaaatattgctttttcacgtatcttttcctattttagttgtgggaaaagtgcagtatcggtgttccgttcctcgaccgcgaggccaatgattgcatcattttcggctttttagtggcaatatttctcaaatcgtttttggactcatccgaaaatttccaaccgaatgttgctgctcattttcacgaatggcaagctggcattgggctgattatgaccaggcaattaatcattcactatttattccatcaaattccaacattttgatgtttttcagaatttggaagttgaacatcgccactttattcaccacccacgccactcttctcggccgccatttgtgcgcctccggggccgacctttacaataatttggccatggttttattcaaagtgtctcttttaattccataaagtcgcattttgcagtttgacatcgatcgagaggctggtcgtctgcagatttaccaccgttactgcttggagagggccgctgtgaacatggcgcacgtgttcaccaccgtcagcgaaatcaccggcctcgaggcggaacatttgctgaagcgaaagccggacactctgacgcccaacggactcaatgtggtcaaattcgcggcgctgcacgaatttcagaatttgcacgctcaaaacaaagagaaaatccacgactttatcaggggacacttttacgggtgcttttttccatttttaattacgttttcatttgttgtgccttttaagtcacatgaacttcgacttggacaggacactttaccttttcaccgctggtcggtatgagttctgcaataaaggcggcgatttgttcatcgattcccttgccaagctgaattacatgctcaaagttggtcccccccccccaatccttttttattgtaatttattgtttccattgcatttacttttgcaccaaatgttaatggtttcagacctctgaggacaaacgagtgaaaggtgtgactgtaattgcctttatcatttacccggccaacgccaattcgttcaatgtcgactctttgcgaggccaggcggtgtgcaaacagctgaaagaaaccatttcgaaggtgaaggatagcattgcggcgcggatgttcgactcgtgtttacggtaagttgtgatgggctgcaaaataaattttttggaggaatttcccaaaaaagaatttttcttatttatttttattaatttttaaaaagactataatttttcctcaaatgttagaaaagcaaaactatagttttttttaaatattttgtgaactgcttccctttgtaatgtgtgtgtttaagacgtatttgttttcagcggtagaatcccggacatggaggaacttttgttgccggctgaacgtgtccaattgaaacggtgcattctctcgtcaaaggtgttgtttttgttattcttactatttcctaaattcccaattttccaaaattcaaattcaccattcaatgaaacacacttgtttttgtttaagcgtgacactttgcccccgatttgtacccataacatggtggacgatgccaatgaccaagtgttgaacgctttccgtcgttgccatctgttcaatgaagagagtgaccgagtaaaggtacccattcgaatatttcatgggaatcggaatttgttataagactttccaactttcgacaggtgatcttccatcccgagtttctgagttcggtctctccgctgatcggattggattacgaggactttgtacggggctgtcacctcggcgttttcccctcttattatgagccgtggggatacactcctggtaaatattttgctgtccggacaatcagtcgatttctacttgccatggccattttttattaaaatttattagcggaatgcactgttatggggattccgtcagtgaccaccaatttgtccggcttcggctcgtttatcgagaaacaagttcctgaccacgacaactacgggctgtacatcgtggatcggaagaaccgaagcccggacgaatcaattcagcaactttcctccattctttacagctattggttggctattttgattatttgtcacttttcaactgcaaaatgttctcttttagcgcattgtcgcgccgtcaacgagtgatcattcgaaatcgggcagaacgcgtcagcgaattgttggattggaaaacattgggcggagtgggtcaattcaaccatttacttttgcactgattgactttagttttgtttcttctttagctgtaccgcgaggcgcgtcggatggcactaaaacgtgtgtacccagactttgaaaaaaagaatgtcggaacatttatcaaaaatgcctcggccacaaaagccactagcaccccggcacacagtgacgaggagag

SEQ ID NO: 1531 - DNA, 10082 bp, Heterodera glycines
  misc_feature (5620)..(5620): n is a, c, g, or t
atttggggctaaaatttgaaaattcatatctagcctaagggttgaccaattttgagcaaataaagctttaaaaatagagaaaaatcaggagaattttatgggatttatttatgttttctaacatcaatatgaaaaaagttattccagaaattctggaaattttagatttttcagaaaaaaattcagaactcccttctgaaaagtcattctgtaaaagtaaaatactacaaaaatccgcaatttttttctctataaaataaattttattttacatttttatctcttttttgcgaattgttataaaaataaaagtgatttttggtttcgggaccataggggggtgaccaggatttttgggtggaaaaattttttcaccgaaaatattccaaaaacatgtctttaggggtattttatgacgctgatcacgaatacgtgatcagattttacttttgacatcgttcagacctcagaatccctgtgtgattggggattctgaggcatcatttttttgggggggggcgaagttcgaatccgcgcggtgtatattattttctatgtatttttgggttatttttaatgttttaattcatttaaaagagtgtttttttcttaataaaaataaaattttttaatttaaattaaattgtttttttgtgaaaaaatgttttaaattaaaataataatttatttacttttattaaagaactcctgtattttttaaattagaatttgtaaaattaatttcaatttaaataaatattcaatccttgtacatttcaaactttctttttaattaataaaaggaaatttattttattttttaaaatctattaattacattcaatatttaatcttactttttaataaacaatttccttaattatttaattttaaaaccatgattgtaccctttttaaccattattgtaccattccaacaattattttacctctccaacaattattgtacattttcaacagtggttgtacctcttctaatcactgttgtacctcatctaatcactgttgtacctcttctaatcactgttgtagctcttctaatcactattgtacctcttccaacaccttttccaacaaatcaccaaatttaaaaaacgggcgcgaagcgcccgtacaaccagaacaaaatttgaaaaacgggcgcgaagcgcccgtcgagcccaacaaaatttaaaaaacgggcgcgaataattttaaaaattttttaaaataatttaaacgtttttttgttaataataaaaaatttatttatgttttaaattaatttttttgtgttgaaataaaaaaaacaagaaaattcattagatttatttttaagcaaaattagatttaaaaaacacttgtacctctcctaatcactgctgtacctcttctaatcacaattgtacctcttctgatcaccattggacctcttctaatcactgttgtagctcttctaatcactgttgtacctttgagaccgttttttaatattattaaaaggttttttatttatttccatattttatatttttttcaattcttcgctttttgcatatatttttacattttcacatgaatgtcagactatgctctcagtttattgacacatttctcgtgtttgtgatggtgtgcgttattgattaatctgtttcttttttctctatgaaaacttttgatgggcaaaaaaggtactcaaattttcaaaattttccggcctcctgttcccaataatttttttggaaataaagcgtgccgaaaatattttttgtaatttttgtcattgaaataaaaacttttttaccaacaaaacctacaaattattatattttttggtaaattaggattctggaccaagggggattgacaggctttttgagttgaaaatttttttcaccaaaaatcttccaaaaaatgtcagttgcacatgttccaatcactgctttacctcttttgttcactgttatacctcttttaaaaattttccgaattctcgcctttgcacctaaataagttaggaaaaacctaaaccgatcatttccattcttttttattaaaattctccatatttttctctttcttttgttattttttccaggtttcttccttttttctgaccaactttttgattttttaaataaatttcgaattttttttgtcacaatttgttttattttttggagtggaaaataaaaaaatattttattcttgatttcgaattagccaatacatacctaaaacatttgatgggttaatattgatttttttaaaatttacaatactttattcaaattcaggcccacattatatggcaaccaatttttcagttttttgtcatttttaatgaaatattttgaatttgttgctctttttaaggcattgttgacattcaattcgatgacaatcagcagcaaatgccaaccgcaacaccagcaacatttggtggtgctgctggtggtgatcagaataagcaaagctgtgccaacggttcttccaacacttctccggcacggcatggacatcaaactcagatgacgacgacgagtcgaagcagtacaacgccaccttccacggcgccgtcgttgtgcccattgaatggcgtcggttgtgacggagaagcggcgcaacaaaaacaggacacaattcagccagccaattgtgttgctggtgcatcttcatcatcatcatcctcgtctttttcagttccgaatgaggtaaaaaaagaaaaaatggggccctaaattatggacgattttacttggttttgtgagcaattttttgcgtcttaatccggctcaaattgttttttttattacccaaatggttcaaacttcttaatgaaaaaaagcattaaagttttagcatttcgctcaaaaagcctcaaaattttgcaaatctttgtccaaatttgtaataaacggcctaaaaatggaaacatttggacttttttgtgtgccattttacggttgtaccccatttttcggacaaaaatcgctgcggacgacggaaagccaatgccaaccgatggaagaagccattgccgacatgccaatggatgatgatgagaaggaggatgaagacgatgatgacatcgatgtcgaaagcgtgttggttaaccagaaactgcaacaacaaccaaattgcatcaccaccacttatatgccgttaattgacaccgactcgtaatccattttttaaattttatttaaatttcgaatttgatccgcaaaaaaacccacgctttattagcgattatccgacattagcgccaattataacgggttaaaatacatgtttttttttgtttatcaattaaagtttatatttattcaagaaaaaataggcgatgtttatggaatttgggattgaaaaaaaacagaaaaattttgagtccaattttggacattgacgcaaataaatgtatctcctccctctttttttccacccttagatttcaaaaaaaaaaaatttcgcagaaaattacaattttttactatcatttattacatatttccaaaaatgaacagcaaatctttaataaaaaaagaaaaccaaaaatgggtttgattttggtttaaaaacacacatttaatttcccatttttttgccaggatttatttgttgcaaaatttgccttcgctgagccaagaaatgctttaccgcacgccggcattgccgttgaagacgcgctcaacgccgctctattcgctggtgctcgacttggttcggttttgctttatttaaaaaaaattgccaggacgaaacgctggtacactgcagtgtgcattttattggccaaaatctgtttttcaatgcgaaataaatgcaatttggcattttttttttttttggaattgaatagattttttttaagtcttttgtttgttcaaaaccctcaaaattagctctttttttcttaaaatttgctttgtttttttaggcccgcaatttttactcagtttaaaagccgaggacgacgacgacaaaaataacaacaatcgccaactgtcgcactgatgttttcggtttgcacatttttttcacggttaaatttaaccaaaaaccctgagaaatttcaattcattgggggtttcgattgaattaaaaaatcgctacattttttaaactttttttttgccaaatttcgtttgaattttttaaaaaatgccaagcaaggactacaaactttcaaaatgaaacccttaaaatgcttccaaattgttgtcaatatcatttttggccaaatcttttgtctataaatcagctaaaatgccttggtctttcacccgaggcacctaattttcaaagcatcacactggctaaaacaaattttatggccaagactaaaatttttcgtgttttccgcccaaatccgatttttttttgttcaattatgagccctccgatttcaatggtgaatttatttttagcattttattgcctcccccgaagctcgaaggagtgttggccgaattgaacggcacaatttgcgtgttggagcaattgttggagcagcgacagcgcatcctacaaaaattggtggcttttgccgggaaaaaattcttaagaaacttattgttagtaagaaattttcaagaaaaaatttttttgaaactttctgtgatttttttgatgaacactaccaaatttttttaaaaaattttttgaactttttttactaatatttttttaaataatttcttttgtgaaatttttaaagtaccaaaacttgaattttttttgcgttttttgcgcctaataattgaaaaattatggtccaatttttgttttttttgcatttgaaacccctaacgaatttttttttgcgttttttgcgccgaaaagaatttcatgcattttttataggccaaaaactcaaatttggcctaaatttttttttgtgccaaaattattttaaaagagctttaatggattttgtaaagtagcaaaaaatcaattaatggtttaatttttatttatttatttttgcttttaaccctaaggggtttgtttccgaataattgaaaaaatgctttaagttcttattggtttttttggttttaaaacctaaaggggttatggttcctgataattaaacaattggcctattttttggcctttttttgttttttaaagccccaagggcttatggtaccggataattaaaaaactgtctattttttgtcttttccctaggggttttggtaccctattattgaaaaattgatatactttttgggttttttttgcttttaaaccccaaggggttttggtacggaatatttgaaaaaatggtctaatttttatttttgctctaatttttgggtttttcttaatccagacgccgtttcttttgtgttggccaccacagcgcaggagttgttctcgcccgatgttgctacgatgatttcgtttgccatggttcagttcgcttttctccgcttcctggtcatgttttcgcttccgtcacttttggtgcactgatcggactcatttcggcgttggtaatgcaaaattttgccgttttccgactctaaaatggcatttttgtcgccaatcaatgccatttttattatttttaaaattttaaagaatttttggtgtttttgcttttaaaaccncaaggggttctggtaccgaatatttgaaaagatggtctattttggttttttaccaataaattgaaactttattatttttttttgtgaatcgaaaatatccaaataaatccattaaatgtgcatttgcaatcatcccttcattaactaatgtcaaattcttttcatttttttgttgtttgtaaaattttgacaaagtttctttttagtgaatttcaccggaaatgcccatttatttttaaaaattttttttaacgataaaaaaatcatttttgcctattttgagcgattttttttttagtgaatttcaccggaaatgcctatttattttttaaattcttttttaatgataaaaaaaacattttgcctactttgaacgaactttttcttagtgaatttctccgtaaagtgcccattgtttttttaaattcctttttaatgataaaaaatttatttttggctattatgaacgaactttttcttagtgaatttcaccggaaatgcccattgattttttaaattgttatttaatgataaaaaatttatttttgcctattatgaacgaagtttttttagtgaatttcaccggaaatgcccattgattttttaaattcctttttaatgataaaaaatttatttttggctattatgaacgaagtttttttagtgaatttcaccggaaatgcccattgattttttaaattcctttttaatgataaaaaatttatttttggctattatgaacgaagtttttttagtgaatttcaccggaaatgcccattgattttttaaattcctttttaatgataaaaaatttatttttggctattatgaacgaactttttttagtgaatttcaccggaaatgcccattgattttttaaattcctttttaatgataaaaaatttatttttggctattatgaacgaagtttttttagtgaatttcaccggaaatgcccattgattttttaaattcctttttaatgataaaaaatttatttttggttattatgaacgaagtttttttagtgaatttctctgtaaagggcccattgattttttaaattgttatttaatgataaaaaatttatttgtgcctattatgagcgaactttttttagttaatttcaccggaaatgcccatttatttttaaaattttttttaatgattaaaaaatcatttttgcctatcgcgtatttttattaaagtgccagattttttaaggtttttggtacctcattttttgatttttttttgcaatttaaaattttcgtgacttttttagcacatgcgcaacgaagttttgaatttggatggacattttcccctttttggcctttctcaactcgacctcaaattggcactgatttcgcccctttctatttgatttatgtttcagggttgcttttgccaaattaagccacttttctaagcgcaaatttacttatttactaaagttattctttcacaatttcagctgggtgtgccacgaagtttcgatggacgttttgccctgttttgaccatgctcaacttggcctcaaattggcattgatttcgccccgtttcgattcgctggtggacaaatatttcaatggcaaaagcggattgctgcgcaagtttttttttcacaaattaaccggtcaaatattttttatgctctaaattttttgattgcattcggcaattaaaaattgaaattttcaaaatttgtattttcaaacctatgaaaatcaattattgtgaatttttgaaatctcaacattgttgtggtgatgctgtttccatcccgctaattttttgtgagattaaaaaattctctcaggaaactgctgtatttggccgattaaaatttttaaaattcatcgatttgaccatgatttgaataaaataagaaaaaattttcagatgcacatatatattaaattatggcaaagtgtacactaagtaaatagttttagtcacccaaatctgaggttacttaggaaataagtttcgtacactttggcacgcataagctccacaatagtatttaagaagcctttactcttgattaatatttaagtaaacatttttgttttcaaatatttgaacaatcacttgtaaaggcttctgtcctcttattcattttgagattcacattttttatttgtttcaaaatcttatcggtctgctttgcgaccatgatgagatttttgcacgtgccggtctgcttagcgaccatggcaacatatcggtcagcttagcgaccatgatatgtagtgcaaacgccggtctgctttgcgaccatggcgaggctggtctgctttgcgaccatagccaaccgtgtcggtctgctttgcgaccatgacacagtgccggtctgcttcgcgaccatggcacccatatcggtctgctttgcgaccatgatatggaaagcaagcccagacttgctctcgcatagagatgcatgtggctgggccgctcaatggtggcgccatgaattccttatcgttactggccaacatccggtgcgaagctggtcccgcactttgtcaagaccagtggactggtgagaagtaacgtaggaaatctgagttcatcaaaataaatgtggactgccttttgaggattgtggttcaatggccagtcccttaaaggattgtagttcgcactatgctgatctttcccctactggggaaagattcggcaaaagatgcataatttttatctgcattcttaatgggatgtgtgagcgatcaatttctgcattcaatgacctttgtgcgaaattggacatgtttgattcgcagcggcatcactgtggcaaacaaggaagatgcaccttaatttttcacatttcaatgtttttgataaatatttgattaatgtggtttaatggttgttttcccaaatattttgccgcatgtacacatcattgcttcatttttgttttcagatgccttcaaaacaacacgctaaaagaaagaaggagcaagagcggtaccaaaggcagatggagcaatctgtcagcccaggtcgctcacccgtccctgacggaagtgcagatgagaatggggtggcatcacacccgggcatcacaacgcccaatattagtgctttgcaattaagcacaccggcttcttcctttggaagtaaaagaaagggaagacccccaaaagccggagcggtgtcaattatgacttcccaacacagtgtgtcatcttctgacactcaaattacatcggccccccaaaatattgattcatcgcctcgcaaaaaaagagagaaggtcgacgaagttgaccatcacatatctgctaatgaatcaattgcttcaacacctgtttccaggcaaaaaagccgtggagggcggccgaccaaaaagagaggcggcccaggcaggggtcaaacaaattattcaatgagcaatggctcctcaatgaaccacggctctgaagctgccacatcagtggtcgatttgccaactgtgcctgaaaagataaacttcagcacagtgcaaattaatttcgccacatctcgaaatatggcctgtaaaattcggagatgggctgatattggcctttacgaatgtgatgagagacgctcaggcccaagattcattgaaacgtgctggaatgatctgacacagtttctaaatgatggctttgttgtcgaatatttggcatacttggcaagcatatcacaacgaaaagtggtcgttgttgatccaatggtgtggcaaatgggcatagaccgagtcatgccttacaaaaatatgacatttgggtacgaccctaatgttccggcagaagttatacttttgccagtacatttccctggacattggactctcattgtccatgatgttcagtgcggtactcattttgccgattctttgcctacaccttatggcaggttggattggcaactgacggataaaattggaaagatcatatctgacattttgccgtcagcagtgttgaccgggattgttaatgccgtaaatctgacggtccaacacgatggaaatagctgcgggtactttgtgtgcctatatgctgaatcctggctcatgaacaatcgcacgtttgttctgcctgatttgtccataaattatgaaaagcggcgcctattgtggcacattaacgagctttatggcacagacaatgtgccataccatccgagggaaggggtaccaactccttgcccaattgtctgtcgacaggtgcagtcgacatccaagaccgctgagccaatggaaattgatgagcatgatgacataacgatcatcgaacctcagacgagtgggcaggcagttaatgccgtttccacccaagcccaagtggcaggtgaaaaccaagctgacacgcttggtttggtgtcggatttttgcgtcgtgcaagagccaattgcgcaggctgacgatgcaatcttcgtcaggccgaagacgcctccgaggcgatcatcgcgcataagcagac

SEQ ID NO: 1532 - DNA, 1206 bp, Heterodera glycines
gcgtccgggtttcagaattgactgaaatggataccagattcgtggtaagtgcccccgacaacgcaaggaacttgtttttatgacaataaaattttcactgacgcattttccactgacgcattttccactgacgcattttccgggcgccaatctaagcaaataattgtccaaatgatatcaaataaactctttttttccttcaaaaattccagtcattaattattattttttggttgaattttatttgttttttacacatttatttgtacagaaaacagcaggtgcagaagcattttcattgacagacactttcgttttcctgctataaagcttcatgtagattttttaataaaataaatatttaatttttttccttttcctttattagaaattttgccaaaattacataattataaattatttatcgtaaattaccaaaaatttatttaatgcttaacattatattttggtttatttttaatattgccaaaggcatacattttgtcaaatgtttttattattttaaaattaacaggactaaaattgactttttttaattcgaattttttttaaataaaatttgccaaaatattaaatcattcaaaaattattatttttccaaatgcttatacataatacattttgcaaaaaaaaacattttaaatgaaatcgactaaaatttcctaaagcttttttttgccaaatggctttacatcattcattttgctgatcccttttccacacccaatcattcactttccctccccccccccactttttcgtcatttcctcgcttcatcaatttcctcctcgtcgtcgtcgagcagccatttttggacacaacgattgcacttgctgatgctgacggggaccggggggatggccggggacggggaatgctaaaatgcgcttttccccgtccattattattcacatttgatcgtccccgtcccggcccatctccattacatacattcccccccccagctaaagatgctaaaatgcaaaaagcaagaccccccccccccgaagggcgggtgtctccatcatcaaattattttccaactgatcgcattatgtgattttatcgacgatgcgatcagcggcggactggggagaagcaaaagctaaagcagaagcatggggaaggtggtgtcgtgtggtgcttaatgcacagggcttgtcatcatgggttaaggggggggg

SEQ ID NO: 1533 - DNA, 3999 bp, Heterodera glycines
  misc_feature (3918)..(3918): n is a, c, g, or t
  misc_feature (3946)..(3946): n is a, c, g, or t
  misc_feature (3964)..(3964): n is a, c, g, or t
gtttttttttttgctattttatttctgtataatatgcatttataaatggatttataagtctggcaaattggtcggaattagataagtttaggtatatcagttttttttttgcacgacaacagttggataaatacgtaaatagcttattttattttgaatattaaagatgatcaaaaatatttgttttaattttctaatcacccaatcaacaatttttattcattccatattacgagaaattaatttgggcgcggaaggggtaattaattgagtaattatttaatgaattaattgtttccagccgtcctaaggcgactatttatagtgttcgccgttccattatttttattgcccttttaaaaaaaaattttagccaagaaaatcatcttttaaaatcaaaaataattcttaatgcatccaatcattattatttgaattaactcaaattcaattaatttttccaaaattagaaaagcctaattgaattttaatattttcattatttaacaaaaaattaaactatgaaaatataccatgaatgagcaaaatttataaatatgtatgaaatatactcatgaaaaaggattttctcttaaaatttttgatttcccggaatagaaaacccttattaattataatatttttattatttcaataaaaaatgcaaaaaataaaaaattataaaataaattttcattaattatctaattagaaagttcctcatttcattaaatcttttatcatttcaatcaaaaaaaaatgcaaggattgaaaaaaataataatttaattaccttaaattagaaaatctctccttcattcattttaatattttatccgctaaaaatcgaagattagataaaatttagaaattatttaaaataaaaatcccccttttaaaagatttattcccatggcaacacttttcccttaaaatgcgtcccccgtccgccgcttcgtccgttggccatttgtcggcccaaactgaccaccaccaccacccgtccaatcatcgacaacattgtccaccgttgcctgaacgttttgtggccggattgcgttgcgcttttcaactgcttgacatcaacgggagcggaaaagtgccatttgaacaggtggaatttgaaaaaaaaatttcccatttttcttacccatttttcaaaaaatttattttcgaattttttgcgcagttttcaccgaatttctgatttttatgtgccattttatggcagttttaaattttaaaaaaatggaatgttaaagaaagacgggctgatgaagaggagggggggggggcgtaaaatctaaaaaattacggattttttaagagttccagtaaaaaaaagggcgggacttgtcctggtcatgatgacttactctaatttacaaaatttaatatatttttcttaatttattccggcggcaaatactgcagtcaattagtagtgactttgttagttttggttttaattaggcatttttaaccaattttgtaaatttaattcaaatatttcacaaaattcttgtgaattagtccttaaacattttaattttcctatttttcccatttttttaaattatttttcaatttttatttttcgaatttttccatttgatttgtttacatatttttgcattttcataaaggtacacaatatgtatgacatttgtttgcccattatttcccattcggaaatggtcgcgctgacctttctcgtcggcttggctttatttgcccttttaatacttagtaaaagggaccattttggcatttcatcaaaacactgaattattcattttcggcctcttgggagttaattaaaattttgatttaaataaagcatttaaaccaaaagattttccataaatttttccatcaaaatttttaataaattttaaattatcttaaatgtttagtcaacaaaattttgcttgaaattaggtgtacttctcgtcattttaaattaatttaatgattcaaattttctttttaaataaaatgcacctttttcttgtcaaagctggtaaaaaaaataaaaaataaattagtaaatttattaatatatttgcctaattattccgaatttaaaaagaacgttatttaaacttaaggaagttttttttcgatttaataaatctttttttttatcaaattttgagcattagtctcaaatttttttttttttaatttaattatttttaaatttttattagatttgcaagaaatggccagtgcattttgccgaggcaccagtgccatcaaattttttggaatgtcttcgtcgtgtgaaccccagcgaagaaatggtcacttttgagcagttcatcaagggtgcccaattggcactcagagaaaggtgcgaaaaatattaattaattaaaattttttaaaattatttctatttaatttaactcagaaatttaattaattaaattattttaattaacactaattgttttcttagaatgaacacggcaggccgattaaagagagtccaaagtgaaggcaaattgtttggcagtgatttggaaaatggcaaaagcggagaaagcaacagagcaaaaagtaaattatttaattgcttaaaaatcaatttaaaattaaaattcataaaatctggctaataatgcttgtcttaattttattttaaattatatataaattatataccgtatttaatgaattagacccctcaggggctctagttttcaaccgcctttgcatgggcggctttatttcagagggggttctaattcatggaagggattctaattaagggcgcgggggggggggctctaattctgtaaatacggtactttgtttgataatttttaaaagattatttattttaaggaaaaaaaaatcatttttttattttcaatttttacgtttttacctttccgtatacaaattcatattttaattacggtttccgcttccccatttaatttatacaaaaattcatattttttcaacttataaatattacgattccacccaccccccgactcgctcccattatatttatatatttaaatgtcaaattttgaatttccatttatacaaaaggtcgtggtgccccgtcctcaacccctcctcctcctgctgctgctgctgctgctggcccacatccgttgcgcagcaatgggcatccgtccatgggtttaagtgggcgcaaattggacggacgcggtggcgctggcggtggtggcgccggtggcgatgcggccgcggccgcggcggctgatcaccgcatgcaccggctggtacgactgaagagggccagccggagccagccgcagctcaacgaattgtttgacggggcaggacagcaacgaaaaaatgatggtggacaacaccagcaccaccagcagcaacaacaaaacgcagaagcagcagcattacgaaggtggacgggggggggggaagaacattatatgaacattaataataattataataattgattcttattcaattaaataagtgggtgatcgatgcggtttgtcgccctagtctcgattgccgagaattttctcgtcccggattccggacccaaaactttttgaaaaatctagacattttttgttcctaatcccgaatcctggtaccaaaatattttggaagtctctaccaaggatatcggcatttttctcaccccgagtcccggatccgaaaatttgtggagtcacgacctggatcccgactttttcatgtcccacgacaaccctgctgggatgttggatcaagggtttagggggaggtcgatatcgattaaaatggatcggaaatttcatgatcatgctcctttgcttagcaaattaattaactaattaattaattaaatttttttttaaaaataagtattttttccagaacgaattgtcttcaagaaaatcagtttaattttcactttgncgataaaaatggttctgcttcgcccgantaagatggaaatgatgtngaaattgtttatcgatcaaaaaaggtaggtgaaaa

SEQ ID NO: 1534 - DNA, 2019 bp, Heterodera glycines
taataaagatttcaaagaaatataaaagaataaattcaaatttattaaaatctaaattttttacgaatattttctcagataatcacaaaatttttactaatattttttgccccttttttatcatttttaactaaactttaattacatgcagtgacgtcaacaattatgcaatcatcgccattgtcagccgtaaatggtcagaatggaattcataagcgacaaaattcggcaattcaatcaaatggcaccacaaataattatgccgacgaattacaaccccaagtggtccgttattcatttaaattttattttatttatttttaaatataataataataattgatataggcaaagcatgagcgattgctggatgaagagttcaatattgtcaaaatgggaacaaaaaaagcgcaggaactgatggattggtatgcgggtgagttaacatttattgaaatattaaatttattcgattaaacattaaataaatttttttaaattatatattataaaatagtttaaattaaataaattcatttaaatttaactatatttgaattctaatttaaatttaactatgttttaatattgaataaagacgaattaattaaaaataattaagtaaaaaaataaatttaaaataaataaatttacaaattttttattaatttaatttgaaatagaaaataaaataattttaaaattgttaaatcgctaatctaaaatttaaatttaaattacagatcgggcagagagtttggaaaagcgcaaaagaatgctgaacaaagggatggtggcattggtagccaattaaaaattttactttttatatattttataaaaattccaggattcggctatccacgagcagaagcttaattttcatagggctcaaattgcggaaatgaatcggcgcattacggcaaaatattatcattaaataaattaataacaatatttaaaatataaaatttcaaatatataaattcgatcagagctttgccattttaaatctttttttagagaaaaatatttttaaaattttcgtaattaaataaataaaaaatttataaatttatttaaataaacgcaaatgagataatttaggtttatatttatatttttttaaattttctttcaaaatctttctaaaaatcggttcaaattctaatttttttttggaatctatgaatcaaaaatttttcaaaaataacaaatgtacttttggaaatttcaaaaataaattaataaatgactaaataaaagtgccataaatttgtgccatttttattttgcatggattgtttagacttttttggcttcatctgaacgcggcggtttcccatcacacaataatattgtgaacaacaacaataacaacagttcttctgcaacaccacaaaatgcaccacaacaaatccgtagccaagtgcttccgccaccattcccagtcaattttgaataattaattaattagttttttaatttattcattatttatttagcctcagtcatgctattcatctgtgccaaactcctcctcaaattgctcatcctcctcaagctcatcggcggcatcttcagcactcgacagcagcaacttttgtaccgcatctgaagcggaatttttacgcgcacaaaaccagaaattgacgagggtaattaaggcctaattaataaatcttaattccacaaatttaaaatttcgccatcttccaatatcactaaatgtttctacacagtattagcttgagaaatttcaaaaagtcccatcctgactgatgaaatagatctgtgcatccttaaagcatgaaaaaagaagattttcttgttttctagctattttgctaggacttggcaaaaagaattattgagaatcttcgagcatgagaactacactgatatgttagagctacggaatcatgtaaaagttaattggttttgagcacaaaaggaaaaaatttttgcgccgaaataggagagacattttatgaacatttcctccccgacggcggtatt

SEQ ID NO: 1535 - DNA, 8191 bp, Heterodera glycines
aatttctttgctcggtatttcgaaacaaaatggaaaaaaatgatctaaaagactaattaaaatccatcgtgttattttctaagaatagctcaaggatgctcaatttcccagcgcacttggaggcgggggggaggctttaatggaggttgaaggacggttatattagatatggaaaactcacaaatttttggcatcaaattttattgtagagtgccaagattcacattttgcagggttgggttttcgggacaggaataaaaaaaagctaaaattcatagacgaatcattttttaactaagtaaacaaatcataatttattttaatagcctcttttttattttacagtgattatctgatgatgtggcatggtgtgccagtgccaaattcaaatggatttgcgccgttccatgcgccaccaaaggacacacttttgtgaacagagctctctactcctttttacaaaactttttcatagattggcgatatgttttaaaaaaaaataagaattttttatttttccatgctaatacatatgtcatatttgctacatgttataaaacgcaattaattcggcttcaaagttcgaaattttgatgacttcttaaaatttcaacatttgctttttaaatgtaattttaaaaatttttgggctggctaaagttttcaaaaaaaaaaaaacaaatccattttgtgggtatatgtttttttgaaataactgaattcaattctttttttttgttaattacataatttggcttcattaagtagccaataatgttttttttattaatatttctcaaccattaaaataaatttctaataatacatattctactcctccaaataagcataaatcacacctttgatacaaaaaataaaataaagaaagaatagaaaaaatattgtcaataattgaaaaaataaattggatgaatctcagtgtactgattttcttttatttcaaaatttgtcataatgactattacagtactcgattccacagtatattcagaacacagtagcactgccccatttttgctgatccccactccggacggcaggcactctactcatttttaaacctaaaaatttccatttaatttttaaaaattttttacaaaaatttttcttttgtaatgttttttttttgtatcatcgttttctttcttcatcgcttttacatttgtatttgtcacccaatcaaaaataaataaacaaattattttcttgaatattattcatcttttcggtgattcattttcttcttttttttgcttccattttcctcattccgtccctctttttaagccatcttcttcttccaccgatggtgaaacaaaaacaaaaaaataggcttctcctcccattcgccatcattcattttttgtgtataaaaataattttattatttttaattattttttagcaaaaatgttcaagtttttctttctgttcaccattttttgctgttttgtttttgccaacactgctggcccagctcaaaaagtatccaattatgtgcaagcattttaactagagatcggatgtgacttctggtactgaaaaaccagattttttttctttaactttggaattttcaatgaaaatttttgaaaaaattctcaaaaatatctctcctattaactgtaggctttttggcatgccgttgcccgctggcgttttcatttaaatgacaaattttgcgggtttttgagatgttttcgaaattttttcattttaaaattcttgagttagaaaaaaatcccaactcagtacctgctgaagtctcccgtccggtctctaattataaccatttaataattgttaattgatgttaatttcttttcaaggatgagcgtttctgtcacacgttgacgcgcaatgccaagtacacctgctacgagtgcaaagagccggagaatgagaaaatttgtaagtttattaattagtaactggaaatcatttaaaaataattattattcaatgttttttaatgccaattagtccgtgaaattgaaagtcataaaaaacgggaaaattatacctctaaattctcacatttttggaaataattacaattttttccatttgaaatatcgaaaaaaattaggtttttaatttaaattaccttccatatttttactttttagaaatttttcatgaagaaaatttccaccaccataagaactctgtcccaaagggtaataccgaatcgtactgtatatactgtacttgacttaataattttccacggattaattttggtctggcaaattataaccggcttaatttaataatcaaatgccaaattcataattaataactttcctatggaaaaactaacaaattaaggtggcgagttgcgcgtgaccttcgaaaacagtccatgaaaaaattgaaacctacacaaaaacgggaaaattatacctaaaatttctcaccatctggaaattgatttcagaattattttgcattttaagaattgacatttggctttcatccgttaccgcctttcttaattagtgttgccaaaaaaattttcgtgcccatcgccaccggcgcaattaataattaaaatgcccaaattaataattaataatttttctttgtaaaaaaaacaaaaattaaggcagcgagttgcgcatgaccttcgaaaacagttcgacgaagacggatcgcgatgggaagtcgggtttggatgctgtgcccgtggtcttgcaatgccgcgaccccaatcagctgcaaacggtgcaaaaaattgcccataactttgcttaaacccaactaaaattttaattttgatatttattcgatagacctaagagttcattattagcctacaaattcagttttaaaaaaagtttggccaaaagtacacatgcaatcaggttttcaaaaattttggccatatatattttttttgaaatttgacgaaatttttttaaattttattgcttagaaataaataattttgatcatcaaaatttcatttctgattaaaactttcttagaaccaacaaaataaagtgatcttatttccatagccctaaatgttttctatagcctgcaaagtttcaaaaaagttatggccaacatttttgaaaacttagttgcttgtgtactttttgccaaaactttgttcaaacttgactgaatttcttgaaattttgaaaatttaatagagaaatgttaggactatcgaatgatatcaataagtaaaattttagttgggtttaaacaaagttattgtattatttttttttgttgaaaaatttcatttagtttttttttagagtgcagcgggaccgggaaatttggacgagaccgggacttttttgtttgaaaaaccgggactttttggctgggaaaaccgggaaaaaagccgggaatttcccggtcccggtcaaaactggtcaaaaccgggaccttggtactcagttgtccgtgtccagagtagttacccccccagattttgggggtgacaattcagtcccgtcgtttcagtcccaggctagtcagtaccggagcaattaaatactattttacaaaaataaataataaaattgatttaaaaataatcaaaattaatttattaaaacccagaggaggtaaaataaaaaatcaaataaaattattaaaaacctgataaaaataaatagcctaatatttttaaaaattgttcacggcaaatgccctcaaaaattgaaataattgaagttgcgcttaacagcgctaaaaattctccacctgaatgaattaacatgaaaataaggtcatcaaccgcttcgcaaaaaattgcgcatgtccacattttgccccggtcatttgaaatttaccaaaaaatttgcctttccaaaaactctatcctaaaatggaattcgaggaattcgacccattcctaaatatgtttgttggccctgaaaaagaccttgagtacgatcctttatttgatctgtttctatcaaacggtgaaattaattaataaatgaataattaattctttatttaaaggcaaaaaaatcaattttgaccaaggattcttggactatttactaaataacgatgatgcggaacctgtggtaaaataaataaaattaaatgaaacattaaatttttaaaaaatacagtacatggatttggacaatgtgcctacggcacccccacaatttaccatacctcaatcacctaaacatgtaaaatgaataataatatttaaaataatttgaaacagcatttcgatttggataatgtgccgattactccactacaagtggacaacccacaacaaattccttcattccaggaggaacatgtaaaataaaaaaaattaaaaaaatcaaataaaagtttaaaatatgttaaacaataaaaatatataatttagttggctgatttgggaaatttattggctaaccctgccccacaattgacatcgcaggtttccccgatttttccacctcataatgaatatgaagtggaacaaatcattgaccaacgaaaaaagaaaggaaaagaagaatttttggtagtagtagtaataataataaaaataataatttaaaaaaataataataaataataataatattaataaaattaattaaaaaataattataataataaaattataataaaaataaatagtttaataataataataataataataaataattaaaaaataattataataataataataataataatttatttgaaggttctctggaagggattccttccagaggaatcgacgtgggaacctgtggagcacttagaaagtggtcatgctcttttggaggagttcaagaaaatgaaagtaaaaaaaaaaaaaaaaaaagtctacacacctaaaataaaaaaaaaattaagaaaaaaccaaaaaagcccgccaaggcgacaaaattggtaaaataataaaattaatttaaaccaaaaaaaataaaaaataattattaataaataaataaataaatttataaataaattacaggcaaatggccaacgaaagcccagccaaaaagttggacaaaaaataatataaaataaaaacaataaattaaaggccaacgaccaacgaaagcccagccaaaaagtgggataaaaataataataaattaaaaaccaataaattaaagacaaataaccaacgaaaatgcacccaaaaagacggataaataataattatttaaaaaataaataaatcaattacaggcaaaaggccaacgaaaatccaaccaaaaagtgggataaaaaataataataaagtaaataattataaataactttcaggaaaaaacaacaaaacgcaagggaaaaatggatggattggtaatgaaaattaattaaaaagaatagaaaaattatcaaccttaaaataaataaaaaattcaaggtcacagcgctgcgtgacctgcagggctcaatagccaaggttttgaatgcgatagatgaatgaaaaaaaagaccaattttgatttgaacttattcaaaactcgtgatcggatttaaattgcaaaaataaaattaaaaaatatataactgaaaaaataatttaaatatatatataagtagttaagataaaaattaacaaaaaaaagatgaagatgaatgattctgttgggtacatttaataacattcgttcttcacatacacacgctctattgcttctcgcgcaaatcccatcatcctacccttgtcgtgtccttttccgctgtcccttttcagctgtctctttccccagtgtccctctccaactgtccctttcccgttgtctctttccctagtgtccctctccaattgtccttttcccgttgtccctttcccgctgtctctttccccagtgtcactctcccactgtccctttcccggtgtccttttcccactgtccatttcgctctgtccgttccagctgtcactttccctctatcctttctcacattatcgtttctctatccttttgcgcactgtatcttttcccagtgcccttcctgttgtctatttcctctctaaccctttccgctctcccattttgtcctatctcttttacagtcatttattatacttttactctcctcatcatcgaatattattaatgttcgcaaaacaattaaaaaattgttattaaacaaataaaaaataaaaataaaattcaaaataaaattcaaaataaaaataaaattaattaaagagattaaaatcataataaaattaattaaagtaaattaaattaaaaataaattaatattaaagttaaattaaataaaaataaattataaaattaaataaattataactaaattcaatttgttcgactataaataggaaaaattttctcccattattcatttaaaatgttttttccaacaatcaaaaattgcgttgctgttgtagacaccaaaacaactctcgatattgaaaaaatttatttaatatcaccctccactaaatataatccacgtaaaattcatgctgtaattatgaaagtctataatccaaatgctaccgccataattttctcaactggaaaattcgtatgtacaggggcagctaatgagaaagaatgtacgcaagctgttgagcatgtcacggaacgaattaggcaatgtggctaccaagaggcactaatccataaatttgatgtgaaaaatttgattgcgactgctgatgtagggttccatataagattaggagaactttcagactttcttggtgtaaaatgctgttcatttacccccgaacttttccctggactcgcctacagaaacataaatcccaaaatgtccataattgtcttctcaagtggaaagctaaattttacaggaaacaactcgattgatgatatcaaaattgcatttaatcagttttatccgattttgtacaaatttatacattcaccacaaagggtatgagtcataataatttttgataaaatgtgcattatttgaactttcttgcgctgaagggacaactttagtaaaattttgaccaaaataaatatcagcttgatcattttcaatcattcgcacaagctcaagcggatagaatcgatcgtgcccattcttattcttctctattacacacggattgtttgcataacggagacaaattctatgccgtacataaaagtgctggtcaacggtcacattcttgaatcctttgtacgccatttgcttgcgagcattatccttcgtaattccgccataaataaattctttatgttctccaatttgatttttttataagttgtttgtagagttttatctttgagaaaaattttcaaccttttgaatttcatcaggatgatttagacgatcgcataaattacgtgcactgcaattcagaagagaagcaattattgtgtctaatcggtccatttttataaatgagttaatgaaaaattccttaaatactttttatcattttcttaacaaaatttacaacaaagaagtcgggatcatattgtatctatcattaacttttttaatagatttaaaaaagtacttttaaaattaacacttcctgaacacatacaatatacaaaataaatacaaaaatatccacaattctcactaataattgattgtataggagttttattaccttccacagtcttaaattgacttaaaaatttttcaatacatttgttaggtgtacgtccaaaactgtcaaagtagtacacggtcttataatctttgataaaaattgaaacccaatgcgttccttccttatttgatgggtcgttgttcgccactaatactgatgggaatttgttgatatttaggggtattttgttgcatgggaaacatcctaaataatgttcttttgttttttcgttcattgttagaatccgatttatcgtcgctgtgtccattttcttctctacatattcgcataattttacacaaatttctgattaaagaattaaaatagaaaaaaatgcctgtcattacaacagctatccataataaaactaataatacgcaataaacccatcttgacaatgactttgtctcttcaatattacaaagttgaaatttatcaataatttcatcaatcattgagaatagttgactttgattcattttatttaaatacgaatgatcaaaagaagcaattttataataaatgtctgtcattcctacattaggtgggcgttcagggtaaagaataggactattaaaacatgct

SEQ ID NO: 1536 - DNA, 1287 bp, Heterodera glycines
  misc_feature (25)..(25): n is a, c, g, or t
  misc_feature (55)..(55): n is a, c, g, or t
cgctgaaaaagtgtcgttcattttncggagttaaattttctcacataggcattgngtttgttatatggggaaaaaagactccttcaatttgccacgcaacatgtccaagtcctcctggagcagcttcagctgtgcttcgttggccgacaaagttcggctcaaacattcgttgcgccgttccaaatcagcctttaaaaaacaaaatggggatgatctgctagagagcattcccaccagcagggcgcaattacggattacgggccaggtaattacggaatttttagaccctctccccaacccgtaatacgggtttacgtaattgaaaacccaattacatcgatccctgaacttccaacaagcagtcagggttttttttttggttaattaatgaggccaccatctctctcaattatgagtctcgggaattttttcgagaatttcagtctcgagagtgtcattctttgtttaaattagccatggacaccttttgctcctccgcccccttggccctgagctcggcctcgcccagcatccgtgttcgatccgccaaactcagctcactgcgctccaacttcgccttcaacgcctgccattcatgcattgtgtagctagtctcggtgaaatcgcggggcctcggctgacttaaaatggcaaaaacatttttttaatttatttttttgcaactgggccctctccgacgcgatcagtgatcacggcatttttaaatcagcgagcgcaaaaaagaataccagtagagaccggacgggcccgggggcccgccgggcttttgccgggccgcccgggcccggtaatttttcaaaaaaaccggcccgggacgcccggtaaaacgggctttttttggacgggccgcccgggcccggccaattgtctaagcccgagcccgggcccggtcatttttaccgggctaaaatgggcttaaatttcgccagccaaactgccccaaatttgaaaatttaaataattattatggcgaaatgtcttagttcaaaattaaagataatcagaaacaaattccaattgattttcgtaaatacatgccaatctttttgtttttaaatcctttgaaatgtttttcagaaatgaatgcatcaatctggaaaataggtttatttgaaaaatcaaaggatgccaaaatcgcggagtgccgagaatgtaaaggaaatggaaagtccaaatatgaatttagcctctctgactccagcaccaaatcgctcaaaaacatctttttcacaattcatgcaaaattcggaatatgaaaaaaatttc

SEQ ID NO: 1537 - DNA, 2767 bp, Heterodera glycines
gcactgagcatctgcgtttctgtctgtttgtgaatagaatcaaaacaataaaattaccgtagtttgctacagtcatttggtccctccacttccaaccaattatactgtaaaacagataccctctacccaccctcatcaggtttagccgttgttccagttcgtttgatcgacgccactgttctcgccaccggtgtcgttcccgtcgcagttcgggcgcccaaaagttgcgcacagtgcccgccaaataattgaaccggtcgcatagggaagccaactcgcgccgaagtgcgcgtgggtccaaatcgacctgtggcgttttagcaatttgtaattaattagggtgggaccctctctaatatatgaccaatttacacaaaacggtattttgggcccccgaaattaaggatttccgtaattgaaaaaatctccgtaatggattagggattgccgtaattgaaatccacagttacatgcagcccggctggaaacccatataggtaaatgtccgcgaattttcgactttttcgacacaaccccgaaatgaacaccgacgcttggcattgcctcccccaaagtgccgaatacatttgatcaaaaaaaaaaccaaaaatgatcatattttgatcagcaaaaatgttaataggaatctttgattaggaccatatgctgaggtccatctattcaaaagtggcgagagaagaaaaacaatgaattacctgttgaagaatggcatgtgccgagacgggctggtagagatgagctgctgcttgaaaaccctttaaaataatttaaataaaaatataaataaatagtgcgctatttaaaaaaaacattactttttgaaaatattaaaaattaaagggcgggggccttttgggttttcaattttttgtcctaaaaattcggaagaacgtgcccctgtttttgggtgtaatcacatcaattttggccaattccgaatccactacccgaacaaatgattgaattttaaattttgatttttttgctcgggttcgggtttaggggttcgggattggattcgggatcagcgaccctgaaaaatagtccaaaaagataaaatagcacacacacacatcatcatcctcatcaatgcgcaaggctgattgtccgtcctccacatctccgattggtaccattccctcatttccccatggatgaatgccctgctgctgcggcactgtgccgctggacgacggcatccatagactgtgatgatgttgtgttgttggctggctaaagctgaatggcggatcaattttgccagaaactggtttacagtctcaacattttggtaaaaatcatgatcggcaatttaatttacaaaaataaataaattaataaaataataataataataataatgggatttgagtcctggtccaaaattgttcaacagagtgccaatcccgaacaccgggatcccaggatgtgcaataaatgattttagtatagggcctaacaaatttttgtgacaccaacaattgacgggaggcggtagaagacgaatcattgatgaacgccgccgtcttcgtcgtcgtcgttgttgcaattggtgccgttgttgctgctgttgttggttgtggcacatgagcatatccagaggcgccaaaataaggcgatggtccaccagcggcggggagcagtggttgaagaagcgatggtggtagtggtccattcaaatttggcatagttggaccattcaaattttgtggcataatgttgtgctgctgtagatgattatggtgacagtgggaggacggtagcgactcgctaaactgttgtactacggtggatggtgccggcggcgggaacatggaaggcgcggaggaacaggacgggttgtccgccaacagttgatgaacaccctccagcgaacgatgcttccttgaaatgggaggaaagtggtttttcaaaatttctggtggcaaaaattataagtttccgtaaaccattgcctaggtttactttcctagggtttggagcagggatggcattccgccgaggctccaaaaattttcggaagatggaaatcggaattccgtgccatccctggtttggaggaggcgtccattagaccggtctaggaattgtagaggaaaaggaagaattaaatctcactaattccgaactccaaatccgcacggatcaatgataattttggtattgagcgttaggatgtgcataaatttttgtataattcataaaacactaactaacaagtttgagttaatttatgatttatttttctgcaaacaaaaaataaaataattattaaatttaattaattaattaattattactatcattgacgcttttttagctttgattgggggttaagacaattagcggtgaacaaattgcgctttaatttactgctacacacttttaccttattagggactcattattttgttgttgttgttgttgactccatcgggaaatcccggcggaagaagccgaagttgttgtccaagcagcagcagcagcgggtgaggagaattggttttgttgatgggcggcggtggatgagtatggcaccgattgcaacaaatgggtttggtacggcacatttggcgtgaacatatccccagcaggggattgggggaagtgcggggaaacgggttgaggacgggaaatgttttttattgctattaaatattattttatgttatgtttattaattttcatatattgtatcaccatttaaatggcgaaaaatactaaattccccccaaaaatttatcgt

SEQ ID NO: 1538 - DNA, 2512 bp, Heterodera glycines
ccccccccccccactaaattagtcctccccaacccccccccccctaaaaaagccccctttgagggggggggggggctgaaaagaaagcctcagggattttaatttattcggcaaaaacaaacaaacattacggtccttaatgatgacttgttagtgagttgaattgagtacaaataagaaaatgattctttccggacataaacggggggttgagggggcggagggcaccggcattattcccttgggcaatggatatgtatgtgtggcagtgtatggggtgaaaatagaaagcaaatagtaatagaaataggcacacaaaacattgggggaggagaggagggctccaaccgaccccgagaggagagcggcggcggcaccggcacggcgggcggtgtctttttttttctttttactcattcatccccctttttggtcgtgctgtagaagaagccccccttccgtcccaccgccacgctcttcgtccaatccatttaacgtcactttcatttggccacataacaagaggcagacagacagatgaatggaatggaatggaatggaatggaaatgccattgatgaaagagtgggggagggggcacatttgtgaaggtacggacggcatcggcatcgatggacaaagagaggggggaggagggagagcacacacaaattttgacggaaaacgaaatgccctgaagcgcttttcatcccctccccttcccacatccattttcccaaccggcaaaaatggttaattgctggcggcagaaagcacacacaaaaaagaaattttttttaaaggatccatatgaatggaaacattggaaatttgggcactttggctgttgggggcccccgaaaaaattccaaaaaggggaatttttttcagggatttggaattgattaaaatagatgtcagattcgtgaatattgaccccgaaaacccccgtgacaaacaagttttcacgaattatgacaacaacaataatttgcaaaacaaaagggctcccttttttggaatttttttctggggtcccaacagcaaaagtgccgaaatttataaagaagattaaaactacaaataaactcttgaaaatctaaattttggtaagcctgcataaaataagggaattcatttaaaatttgatcattgaaacgaaagaatcgattgtttactgtaatctcactcatttccattcccattttcatttctccttagttcattctgctaaaatttggcttttttaattcgtcaatcaattcacgttcacttacaacaaaagtgtctatgtttttttccttttgtaattttcataacaatttccaaagatttgttaacccttaggttttttaatcgaaaatcagatgtatagcagcaatcttttgagtaatttttttaagaaaacattcgcttatgtcttttagaaacgagtacagttttggttgtgcttcgtttttggatcctaaagccatttaacacgcaaaaacttccttttctcaaaacagcgaattgtttaattccacgttgcatcaacaccaagataatacatataatttcaaacgttcattctttcttttttctttgttcctccaagtttcaaactgcacacaaaatttacctaaatttatttttagccaaagcatttcattgactttctgtttaaaaaaatgtcgcttcttgttttctctcgtctccgtactcttcctcgtcttgcgccgcttctgacgaacagtccttgtgcactcagcaccagtgccgttcgcaaagacattgacagtgccgcgaaatacgtcggagccggttaataacaaaaatgattttcgtacgaattttttgcattttttaggggctgcaactgtcggagtggccggttccggtgccggcattggcaacgtgttcggctcgttggtcatcggttatgcgcgcaatccgtccttgaagcagcagttgttccagtacgcgattctcggctttgcactgtctgaagccatgggactgttctgcctcaccatgggcttcttgatccttttcgctttctgaacattacgaagacgagcacagaggaatggataggaaatctttttttgttttttctcgcttccaataatagtacgtttttctatttttgtgttgtcagataaagttggactgattagaattgcccttttaaactcgatttattctatgtttgggtactgcactttatgagtccaaacaaccttcactttttttttcgaattaggtatctgtacattttggtatcatttggaagcacagagtctcagtttggactaatgaagtcgattggactcataaaatgcatgggtttatcgtgtcccccttattgcgagtttgttgaccgaccgtgaatccggtctccatttccacttcagacccaaacatcggaattcctattcctttttttttgcttaacatttgaggtaatccttcggaattggtgtcccgacggaaaaaaaaattttttcttacaaaatcacttttgctagggt

SEQ ID NO: 1539 - DNA, 3470 bp, Heterodera glycines
cttgaattcgtccggcttgtgcatgtacagggaagccgtttcgccgttcagcggatccgctgggttcggataggtcaacagttggggaaggaacgactcaaaaatgttggaaagatctaaacaatttcaataagttcatggacctggatttcatatttaacattgattgacatgtattttctgtaaattcatggaaaatgcaggcgtgccaaaccgactaggtacaggcctggttttttgaaaagtcgtttaaaaaattgtatgggtccaaaaaatgaaacttttttggaatttctaaataatggtaaagccaatgataatgacagaatttttaaatgctaaaattgcttgcatgaaatccatgttttccaatttctgattggccaaggacctggtttttcgtaaaaaaatgcagatttacaaaaaatacatgaacctataggcccaacgattttacctttttgggagggttttctgagtctttttacattcgtccatcccgaaaagaaagcaaaaatccacaacaaaaaaaaacagaccataaagtgctgtccaactttggttgatcacgtccagacaaactgtgccggatgcttcatcaatgttcggatgataaattctgttcatgaagccaatggaaggtgactaaacggattgtgtggaaaggcatttaaaaaatttctgaaaaataaattgttgtttttattattttttgcaccttgaagggatatttctccggcaaatcgacccttactcgccaaactccgccttcgtaagcagctaaaatttgttgaaatggattagcatataattgtacgaagatatagaaccactcacttccttttgggccataaaattttacctgaaaatttaaattacaaaaaaatacatacagaattcggcactttaatttgaatcattttaccctagaaaaatgcatatttatgaaaaaaattgaatttttgttcgaattcagacgcgggattggataaattcggttcaaattcgcgatcagtatcctcgaaaatcctcataaaacttatttttgagccgaaaataaaaaaaaaaattcattagggagcataattcatttaccatagccccctttttggatgcttttcgggggtccacaacagcaaatgcccaaaattcatcaactcatttaccaggaattcattcagtccaccggtgatgaccacctcatggttcgattcaatcctaaaatttgtgagagtcaatttatttgatggtaaaattcacaatttcagcacatccgtgtccattcttcgttttcctagaaaaaaaaaacaaattcaattatattatggaaaaaataattaataataataattgtaataatgtggcaattaccggcactgggagacgacatttgttgattaagccaatttggaaaaacagaaataattaaatataagtatgtattatatttgtatgaatgtgctgaattgtagatgaagcaatggcaatgtaataacaacagcaatagtaaataaagtaaacaaacaaacaaaatttggaatccgttaaaatccactcaaattgttttttttgcagcacgtgagacggttagactgtgcagagaaaagcttacaattagtagtactatctcgtcgtttatctttttctttataatgtttctctcatttcagcgtactatctcttcattttggatgtttgatgtattataaaaacagaattagcttaaattttttttttcgtattattttcacacgtctctaaaacatgaaaaacatcaaatactcaaatgctaacaatgaatgatatgtgagtggcagacgataaaaaagagagacacaaaagaaaaattgaacaattttttttgtatcaaattttatttcaaagttcattcattgtcagtgtttttttaaaaaagggacggtagagggagaaaggaatgaaaaaagggatggggacggacgaagaaggaagagcggaagtgaaaggaaccgactgctgcgtgatgagctgattaggtaacgaacgaaggggatggaggagagggagggaggggaagcgaatggaagtaaaagtacggaagaaaggatgatggatccaatagttcgaattcgggttcgtccccgacccttggggagagaaaagtcgggaggatcggcggggagaaaaattctcagacaaatatttgtcggctttggctggagaaattaaaaaaaaaattttttttttaaatgtcggggacaagacccacctcgaaattctcagacaaatatttgtcggctttggctggagaaattaaaaaaaaaattttttttttaaatgtcggggacaagacccacctcgaaattctcagacaaatatttgtcggctttggctggagaaattaaaaaaaaaattttttttttaaatgtcggggacaagacccacctcgaaattctcagacaaatatttgtcggctttggctggagaaattaaaaaaaaaattttttttttaaatgtcggggacaagacccacctcgtcgggtaggcaattttcaacgtgggcggagcaaccctaattcaaataaacacctttttttacttgaaagtgccaaaaccgctcgctatgggttgcagaaaaaccaagcgccatttcaaaacgaatgaaaatgccaaaaaaaaattttataacgcactttagctgtaaaaaaacacctttttggtagggtggcggcgattgccacaaatgtcgccagctgctgcactccccccgctttcggccatgtcgtcgtccatcggatggccataaaatcggcaccaccataccaccaaatccaatccttcgcccaccccccagggcacaataataataataatcagtgaccattttatgttcctcctctgcgctctctgttcagttcagtcagttttttcttggccatttcgttcactccggcagatgttttgcttactttttgctccttctttcttccttccacactatataagcatgtcatcaatggcttctcctcctcccctcgcgtcctttgcccctcaatggcacttttccgccgcttccctcctttttcatcatccatcaccgttttggtggcacttttatccgcgtccatcaccaccgcgcaattggtcactcgagagcaaatcagacaaagtttgtatggacaccgatataaaaaaaagggaacccccctcacccccccccccccctcgctcgctcgcaaaaagccccaaaatggggactcattcgaagtgaggggggccggtgtaaaagaggtgggagaggggcggggtcaccggcgacggtgaaggaaggaaagaggaaaaattttgaaattcaacaaattttcttattagaattcattaaaaattccgaaattttccccttgcagcgccgacccccccccctttttccctaaaaatttattggaaaaagccgcgccgcaaatgcttcatcagaacaattgcctcttttg

SEQ ID NO: 1540 - DNA, 3553 bp, Heterodera glycines
cggctcccggtaaactggacaccggaaaattggacaccgaaaattggacaccgaaaattggacaccgaaaattggacaccgaaaattggacaccgaaaattggacaccgaaaattggacaccgaaaattggacactagaatactggacaccaatggcaaattagacaccggaaaattggacagtattggataaaaaataaataagttaagaataaaaacaaaaattttaattgaaataaataatgttattatttattatttgtagcatcagctgcagaactcaccatacattcataacgaaaaaagtttttatttttatggagttcccatttttgcgcattttttggtacattgaacaatcatcacgcaattttgtacattttttggcatcttgatcaatcatcgtctaattttgtacacttttttgccacatttgatcaattattgtgcatattgagtgtttaaattcctgggtttatattttaaaagaggaatttagtgtccagttttccagtgtccaattttcctttggtgtccaaaattccgacagtgtccaattttcctttggtgtccaatttaccggtcccccaaaaaaccagcccacaagtgctgttggctgctcagtggtggccaaaagtgccaaagtcagtgctatgacaaattgcgagcgccgagcattgcgccagcagaaaagttcactttcacagtgagtgtaaaatcgcgaattgcattcgcagataaatggaattttatttgaggacgaatgtgcaccgttgactttgaaccggacggtgccaatcagtgaaatgaagtgaattttggcgggcataaatttcctctcataatcagtgaaattcattttctcaaaaaatcgctgtaaatttttttatatttttcttgaaattaaaaaaaaaaatttattttaaagattttcctgcaagttttttgcaaaaagtcgatgttttttctttttttgctgcctgacggaccgcgaggcggtggtgcacagctgtttctcagcgtgtctgcactggtgggacaacaattgggcaacgacagcggtggcacggcacggacgcacatttgacccgctgagagactgtgccgagtaagcgaacgggtgaacggcacatttaatagtgatttagccttgtggaattgaacaagcccgagaattgtttggtgccagcatatgttttactcaaattgggcctaatgaatgagacaagaaacaacggaacggaaaagctcaactaatgaatgaagcaaagcataaaagaccaacattgtttccattctattttccatgattatcataatgccaataaaataaataatccagaatcgagaaatgttttttaaatttgctccaaaatgtgcattggaaatattaaattccaatctctcattttttcaatttataaaatccagagactttaaaagccttcgggtaagacaagaaatggaccaaaatgcaagagacaacaaataaattttcctgtcaaatatttttcaaatcaaaagaagaaaacatatggtgataacgccacaaaatcatttagccaaaatctcataacatcactcactcatcgtcaattggtcaaaaaaaaaacaggcatccatccatcattttcttagactgcctgtagtgttggtcgcgcaccgtattacatgtaggagcgatatttgtggttgaaattgttgccgtattgttgcgaaaccgcagcggaatgttgctcactagtcgaatccggcaccgcacccccagcatatccctgcgcatcgccaccaccgcggcgctggttctgaacattggcctccggcggcgaagtctgtgcaggacgctgtgcagcttggaaacgattggcattggacatcatgtactgcgggtgctggtacggatgcggataagtgggcatctgcgaaatgtggaaaaatggggccaaagatttatctaatcgcatggagataacgacaattttactttaatttacctgaaaaagcgaatggatgttggccggctgcacatacgatggctgcgtcggtgcggtgggcataccaaagccgggaggcggtcccacatggcttggcggtccccccagcaaagttgcctgctccgattgggcaagtccgcgctgttgttgctgactttgctgcgtttgttgatagtgtccattgttggccgcttgattgactgaaaagaggcatattttgattattataatagtttagtaaggaaagcacttttttgaccctcacacacaaacaacaaaaagtcgaaagttcaaattttcaaaaaattcaaaattacaaatgaatgaccaccaccaccaaaccccattcccaccgttttgttgctgctgcccaaatttgttctccatgtacgattccaatgtggcacgatgatggtttggtgccaaagtcgtcggtggtccaattgactgaaaaataatgtaccataaaaaaccaaaaagtataaccaaccattgcgcccatctgcaagtccagctgcgaatacggcgtcccatactgttggatgaggaaacggtcaatctccgcatttggtccttgcagcgtttgcgcggtggccaccggcgaatacatgtacggcatgttgtagctggggaactgaggcactgcagtggctgaggtctggtggaagattgtctgagcttgctgttgcaaatgttgttgcatggccggcgttgcgcttaccatcgctgggtttgctgccggtgtgaaaagcgttttgttttgttgcggaggcaactgctgttgctgctggtggtgatgatgaacagccgcaacatgttgcgatgggtcaccagcagcctgctgttgctgctgctgatgagcagcggcagcagcaaagttgaccgcattgccaccgtggaccacaacagggccaccaccgccgggctggccacttgacggaggaaaattaaccgaggcagtgtcagagaacctaaattattagtgtataagtaactgcaacattttttctctgggccttgagggtttatgatcacaaatctgacacatctgatttgaccaatctaaccccaactcaaactcgcaatttcccattcttgtatatattttttaaaattcaagtttagggttaggaagaaaaaatggttattatttaaaacgaacgataacgcattgccagtgggcggtcgagctggtccaccattgttattgagccgttgctgatgcgcttcgaatatggcggtgagtgcactgacgctggaactcgtcgtcggaatgtttgccatcgaattgagcatggacccagccgaattcttagaaaaaatggctcaataattagctaatatatgataaatttaaaaaaaaacctcaattggctggccccatgtgctttcgttgtccttggcggaactgaagtgaaacccgaactgatagctcgtgctggtcggatgcggaagtgcctcgccagtgacgaactcaaccttttcttgcgcctggtccactaaaagaaaattttccgggggggaaaattacgtccattttattcgaatacgtgttaggg

SEQ ID NO: 1541 - DNA, 1282 bp, Heterodera glycines
  misc_feature (68)..(68): n is a, c, g, or t
aaatttgtatcaattcaaattacgtccatttattcgaatacgtgttaggattcggagtacttatgtanaagtacagtaatgaggttttttttatagcggagttagagggtttctgaaacatgggactttgtttgaactcggggtcctgtttatttaccattggtgtcagccattccagcagtgtcacaatggttatccattattccggccgtgtccaatttgcaactggtgtccagcattacagaggtgtccaaattgttggcagcttcaatgttgccagcggtgcccaacatgtcggtgttttccaatttttcggtggtatccaatttttccgggttgtccaatatttcggtgctttccaatttgccggttgatgcccaattttctgacgaccaattcgtcggctccgttgtccaattttctttcgtccaatccggctcccgactttcgtatgtgattgtctgctgctgctgttgttgttgctgatgttgtggaggtgaaggctgtggtgatgcctttttagccgcagcaacagcggcaaatgttttcggcttgtgaaccgcggcgggttcagccggctcaacagaaggcgtaaagttgtccagagcgggccacttcacaccaccatttgtcgatgtttccgccatcacaacagtagcagccgaagatggcataaacacacgaggcccatttttctacaagttttaattgtttggtattaatacccgtaattattgcataaaaacaaacccattcgtcgttttcgtgtcccgctgtttcgccataagattgctcaacagttgaagaaaagtcgccggtgtttgttcccgttcccacaactttgttggtggtctgcttgttcgctgcaacattgtcacgtcgatacgctcctccggcggtaaaagtgcggttttgccccttgaatccctgtccctgacgttcagtgcgaacacgcggcccagccgaacttaatattccctttttgtattaaacaggaagttttgtaaacaaatgaacattcgaatctgttttcagagtaatttaaatatgaaaagtcgaaaacatattttagcttttcgcgatttgtattaatggggtttaactctcccccccccccaaaaaaagtgtaagttatgtcgtacttctgctcattctgtcctttgcctttggtctgattgtgagtggtagtagtccgggcaaccgatggagttgacgatttcgtcttttgttttttgccttgctgactccccacacaccactaaaccaacttattgaaaccatt

SEQ ID NO: 1542 - DNA, 2347 bp, Heterodera glycines
  misc_feature (2337)..(2337): n is a, c, g, or t
ttttagacaaaaaatggaaaatcgaaaaatttgaattttcgactttttgttcgaattcgggtccaggattaagaattggtcgaaattgatgccggattcatgatcagcgaccctgaaaacccttagaaacatgttttcatgatttttgaaaccaaaatttttttttaaatgttcgaattcgggttagggattcggaattggccaaaaaggaggccgggttcatactcagcgtccaaaaacacccctataaccgtgtttttttgaatttacagaaaagtttcaaaaagaaaaaattttgggaccagtaaaacatttgattgcctaaaaaatgatgatatctattcattatacaccattttagaaccattaaacgtgtttttgctttatcccttaaatccaaatctagcaggagaaaatcttgcaactcctggacaataatttagaatacatacccagaaaaacccagattacaaaaaaaaaaacggattggacatgcgtccaggaaaaagccaggtccaactttactgaaaatgaaaccttgacaggtttctgctcagcaatgtcatcatgtgcaattgtagcgtcatgccctatctgggtgagttcagccagacgcaactgttcttttgttgccatgactggctgtttttgaagctccattggatgtttctgctgcagaattaagcttgttttgtgaaatttgtttgacagaaaaataacaattctgaaaatgttaaaagaaaaatttggtcctaacacgacttaattattgaatatggtaaaatgtaaaaccgattagacttcaaaatgaatctccgttatgcttcaaggtgtgtgagtttttgcataatacattttggcatcgattttttgtatacaatatgtaaatgcgggattttttgtatacaatatgtaaatatggagataagagacataaaccaaaaaatcgaagattaaaaccgaaggaaagaaagaaaactgcaaaagactgagataaggattggaagaaaacggccgttattgagaatgattaagaaaaaaaatcttttgtcattgtaaatttcgaccagaaaataggtatgtactgtctgtatacatacacaccaagatccgctccccatgtttcgagaaattgcttggtatcaataacagaccaaagggttcggaaattatttcgtttatcggaaatcaatataatcgtaatacatacgctacatatttttccggaaaattgaaccgccgttagtttaaactttgtgtttagttggttggggcccttaaacgataaaaattgatgaaacccgagtccgccattggcttaattcaaaatgattatttatcaattaaaaatttggctttccgtcactatagccacgcagaaacaaattggtgttggtgtgagctaatgagctgttggatttggttctatctgacttttgctgaacaaaaccctttgttttcaattaccggttcgggtacaaattactaaatttactttttaacaaattttcttgtttattcaaggaaattcagccaacttttgcatcaaaagtgatgagaaattttcttcttttactatgttttgctataattttgcaagttctttgtgacgaacatgaccatatttacaagtgaaagataatttatcctaattaaatttttcgatttttttaagtccaaatgctgaagttgtgctttggatgaatacggtgagcgcaattattgtgttgttgtctttaatggttatgattttttaaaggttggcccgtacaacaatcgtcaagaaacgtaggtcctaaaaatccagaggagggttttatgggtgggtcgctgatcacctaacattcattttgaccattttcgagtccctgacccccactcgaacaactcttgaaaaaataaacaaattcccaataactattggtcataattaatgtcctttgttttagatacagttatttctcgctgccattttgtcaagtaactttggacacaatcagtcattcaaactttttcaaaaaaaatttagggttacaaaaaaacaattgagcattaccatgagactttgggcgaagcactgctcggtgttgagttggaattttccggtttggacatacgcttcaccgttgatcagccaaaaacggttgaacaaaaaaaaacaaaatcgccaatgattagatgaattaatttatattccattattttctcaggagtattgcaacacgaagctgactcctaccgacatcgacgcactgatttttgcagttgaacacaattattgtccattcaaatccatggagagaaattctaacggaaaatcgttttgcttttttcctnatagacctgc

SEQ ID NO: 1543 - DNA, 927 bp, Heterodera glycines
tcggaagtcggaattttcaaaaaatacaaaatataacaaaaaaaatttttaaatatttaataggcaaattttaaaattctaaaccatgtaaaaggtgatttcaaatttttagtatatttctatatttaaaaaagtttttaatgattttcaaaataattttatgtaattttacattattttggaatttttttgggacaattacaccttttttttgcggcgcgctttatccaaagaaaatttggtgaacttgggggagggattcggcggtgccgataggcacgccgagaaaattttagtgatttttaatgtgatttgttaacagattttgtagaaaaaatgaccaaatttagagatttttagcaaattttcaaaaaaattaagggtttttaaggtgcggaggtgccgataggcgccgctgggaaaaaattgataatttcagtccaatttattaacagaaattgtacaagaattgctaattttttgaaaaaaaaacaaaaaaattccgactgtttatcaaaaatttcgcaagtcggaattccgagccctaaaattttcgaaagtcggaattccggccccaaaaatatcggaagtcggaattccgtgccatccctggcttccacctcagtatccccctctttcttataaatcaaacatcccgcaccgctgttcggcacaggcgcccgagggtggtcggtgccgaacatcgatgtaggacttcccaaatcacatcaatacccccctccccctcagctccacaccatccaccaattcctcctccctttcttccaaaacatgccttaaaggaagccaacatgtcacacacttgagacgctgtctcaaacgggttctccgaaatttgtgccgcaatttttccgcaaattcctctggcacaaggccagtgacctgggtgtttaaaactgataaaca

SEQ ID NO: 1544 - DNA, 2214 bp, Heterodera glycines
taaattttctcctataagcatctgggagagagaggacggtgaaaagtgaagagaaagaggaacagaaagagagaaggtttataaagaggaaaagaaagatgctttttggcccatttttctgttttttggcccactttttctttttttggcccacttttcttttttcagcttttttggcacttttcttttttctgttttttggcccacttttcttttttcagctttttttggcacacttttcttttttcagctttttttggcccactttacttttttctgtttttttggcccactttttcttttttcagctttttttggcccatttttcttttttcagctttttttggcccatttttctgttttttggcccactttttcttttttcagcttttttggcccatttttcttttttcagcttttttttggcccatttttcttttttcagctttttttggcccatttttctgtttttttggcccactttttcttttttcagctttttttggcccatttttcttttttctgttttttggccctcttttattttgaaagagaaaagaaagaggaacggaacggaacggacaggaataaaaaggaacgaaagaaaaaagagaaaaggttagaggaagtgagagacagggaaagagtaagagattttaagtggccctattaaaagtttgagtataaagaaaaaattattgaattcccggccattataaaatccaatgcccttttataaaaaattttttggcgaggagcgccctctagtgagtgttaaatatcgaaaatttggaagttcaagggtctgacctaggtcataaactttaaaaatcaggggtcaattacggtatataaaaccatagcacttaactgaataatcgctgccgtgctctagttcttatttaataggactgaaaaaaacttttgaaggcttatataattttcaaacaatacttttttaatccttttaagaaatgctcggcagctatttccttaaattttatttgtattatttacatttttctacacaacatgaatatactaaggttaatacctcgacctggattaggccctggaatttccaatatttttttctttaagaatttcagtcgagaaacccaccagatttgtgccagccaaatccgtagttttgggaaagtctggaaatttcgccatcctcggcttgtccttttctcgatcacttgtagaaaatgaaaaaataatttgtaaatctaaaatattgtaattaacaaaaaaaatcatttatttttttcgaaaattcgcaaaattaagactttttcaatgaaaatatggtcaaaattcttaatttttcccggcggcgcctatcggtagcgcggccccaccaaaagttttttggaaaagcgccgcaaaaaaatcgagcgatttttcatgctcagatttcacaaaatgcttatttctaacaataaattgaaaatacacataacattttgaacattttaaacttgttttgaaaaaatttgtaaaaatgttaaatgcaataactaagcaaaaaggtcgcaatattgggacgacgaatagaaaatgttgtattaaaatggcgattttttagctattatctttagagatcggtattttgaaaaaagcctggacctggaccagacaaaaatccaggaaaatccaggtccaggaaaaatccaggctcttcgagacctggattttttgaaactcatcctaaaaatcaaaaaaaggttgaaaaaattaattaattgcttagaaacacctaaaaatatctacttaataataataatgtatttttaaattaatttaatctttttttgaaaattaaaaaaaacatcggtcacttgaaataataaattctaaaattttgtccaggaaaatccaggtttttcgtgttttgcctggacctggacctggatttttttttcacattggacctggacctggatttcctggacaaaaatccaggaaaatccagtgccatgaaaaatccaagatgccgaaaaatgacctggacctggacctggatccaacaaaaatccaagcctggatccaggaccaagccgagatcaaatctaaagcatactgtatcactgactcattttctattgtaccgctcagatatgttacagaaatgataggtgacttgtttacaagtatttttatgattattttctcatttatattgaaatcgtagcgagcttttttggataa

SEQ ID NO: 1545 - DNA, 9040 bp, Heterodera glycines
  misc_feature (1986)..(1986): n is a, c, g, or t
cagggaaaacagcagatacggcgttcatttcggctttcttaaatcgcaaatgactaaaagaaaactagattttcacataaatttatgtgttagttttcaccttttctcggtgcgaccggtgaaattcggtttcgtagaaagttcagcacttcctcgtagtagcgtcgatgtttcccgggcagaagaccccagactccaatgcacattcggtggttgacagacgcgcccacaacaaagcactgctcccacatgtttggtgcagccttgaatgtcccgtccaaatgccaagttgcactgtttttgctcaaaatgtccaaagtctaaaaaatttaaatttaaattctgttttcgcccctgatgattacccgttcactcccaaaaacaagcacaacgtccttttctccaattctgaccgtgcgactgtcgtagagcactatgtcctcgccatccttcagccgtaatttgtccggaattgtgaatgcctcctcttttcgtttctccaagtttgaagtttacgatggcgtgttcttcaaaatccgttgaaaagccgacaattcagtgccagaaaatttggcaaaaaattttcaaaaaaacccctaaaaatacaatataaattgaagtggttagattctgtctgatgttattgttatactcttatgctaaatcaatccaaaattaaaataatgacctaaatatgtttagaatcaccttttaacatttaaaaaattatttttggaggggtacatttaaaaaaagttttttttttaattttttcactagaaatttctaaaaattttcaaaaattctcaaaatatgtataaaaaaataaaaaatttgccaaaattttggatttttttttgaggatttccaaaaattttccgtaaaaaacccgcaaattatgtaaaaaaaatcaaaatatgtaagaaaaagtccaaaatatgtaccaaatatgtataaaaccccgaaatatgtaaaaatatgtaaataaaagtcccgatttttgtttgcaaacataaaaaagaaagtgtttttcctactatttagagcatggagaagccaggaaaaaaatatgtacatatttacataaaattgacatccctaataatgaacaaaaacaaatacaaaattttcgattccattgaacacaatcgtttcaaaaaaaattctcaatttccttatccacctaattttcacccagacccctttcttaccagtgcttatttcgacccgaaacccgacccaaaatcatcgggtcgggtttcgggcgagaaaaaggccgggtttcgggtaacccggaacaaccctggtatgaataaaatgcatctggggaagggtgaggccccgatggtgtcaacagataacaacgacgaaaaggggtttttccaacaaaaaaattttagaatttgaattaattttaaagaaaaaaaaaactaagaatttggtggtgggcggtgccaaaaggtgtgcgttcagtgaaaaaaaaaccgcaataaaaattatgaagaattatgtgtaatttgtaagaaaatggcaaacatttcagaaattcctcttttcccccttttttcatgtatgatttattttttaaatttacttttgctgcccgacttttcagcgtttcttcgatggccgccaatttgacgagtgcatttccaattttccagtcaaatttgttccgctcaatggcaacggcctcctgcaaaatgaaaagtgatgtaaaaagagcagataaatattaaaaaaaattctatttttctataatggaaaattattttttaattttactaaattttgttaccaaattttatctattttcaaatgaagacgcctaacagcatcgcccgatccaatatttccatgttttttttccaaaacttggccccaaaatggccaaagttggtgaaaatggctaaaaatttcctattttttcattcggttctgaaatttttttctaaatacatggcagtaccgtatttaggggggggngggggggggtacaccggtgggggtcgactgggcgccgccaactgggcgacgccgactgggcgacgccaactgggcgccagatcaactgggcgacgccgactgggcgccaatcaactgggcgccagtccccgtttccctccctaccagagaagggattccgagaccacaaaaatttttgaaaattggagttccgaagcccaaaattttttcgaaacggaattacgtgctatccctaccccctaccatatatgtgataaatagggattttttaggcaaatgcataaaattttgcgtaatagttatgattgtaggcccccttttaagaaattttttttgttgttccaaaagttttctgggtcgctgacaatgaatcctgtatccatttcgaaccctcggacccaaatctaacaatttttgttcgaatttgggtccgggttcgtaatttgtcgaaatgggtgtcggattcgtgataagcgacccaaaaccccttgaaatcatgctttcatgacttttaaaaataaaaacaaaaaaaatttctttgaaaatacacccttcagaattgaaagtaaaaattctcaaaaattttattgcctcttcgaaaatttttgtgtctatttaaacctattttgcgatttttgtgcctaaagaaagggaatttgaaagtgggtcttggcgcccagtcggcggcgcccagttgatctgggtcgcccagtcggcgtcgcccagtcggcgtcgcccagttggcgtcgcccagtcggcggcgcccagtcgacccggtccgacgtcgggggcccaaccctaatttaaacgaaagaaaaaaaattaatttatttttttcaaaactctcaacaactcctccctcttttgattttttttttttggaaaatttttggtcataatgtagtttgcccccgcccccttttttgaaaaaaaaaatttcaaaaaattttttgccataaaaacattaacaaatgtgtatttttattgctccctatttttgtcatttttaaacaaaaaaacagacaacttaattaccgtaccgtaccgtatcaatggtttcatttttacagtttctcaattgttcaattttgttcaacagtttcatgatcactgcacagtcttttccatagatgtcgcatcttgttgatttgctctctaaaatttttttgtcattttaaatttttgtaatatgcgcataaaatatgcattaaaaatcccccaaatataccctaaaaatccaaaaaattcacaaatatgccttaaaaattacccaaaatggcttctaaccctcaaaaaaaaatgccaaatttggtgtaaaaatacagaattgagtttaaaaaacaccaaaacaattgctgctaaggagctttttttgacaattgaaaaaatttttgattttctaaatttaatatgcaaaatcatacaatttataaccctagtaattagaatacatgtaattttatttttgtaaatttttaaaatttcctttacatatggatattttttataatttttgaaaaatttggctcagtttcgagccacggtttacaataaataagaagtggtgatactctttggcccccaatccttttgccggattttgttcaatttcttagcctttttttagtcattttcgtatggcttctgggcactgatcagtttgttgaagttaggcgttggaatctggaagaacgctttcatccgatcagcaacaggcggcaccaaatgaatcattttggcaaaattttctgctttgatgtcattgagaacggtgccaatgccaatggcctaaattttaattaattaattattaaaacaaattattctttaaaaaataaaattcatcatttaaaaaataattggcaaatgccattggctaatttaatttaattatttaaacaagaaaataattgacaaatgaattgtccattttttaaattaattattttcaaaaagaattggcaaattgctataattctaaattaattattaaaaatgacgttttattttcacattttcattcagtgctccgctgatcactttcccattttcttgttctcgtattgcgctttgctgttgatcggtgccaaattcgagaaagaaaatgggaataattttctttgttttcataatttgttcaacggaaattgggaaattgcgcgtcattttgatgcttaattaacccaattaattaattaatgacatcatttaatctctctcatcattaattgacatacaatttgtctgtggtggaaaggttcaagaatgtttcaaagacaagcttctgttccatttcatcccgatggatgcaaatttgtacagcaaatccggcagcattcgattcattaagatggtcttggcataatttggcgatggcattgttgcttggcaccactggattcatgcttttatagcatgcgttcagttccgcatgcctaaaaaacaatttgtgagaatttggcaaacaattttaccattttgcaaattttttatggtgccgttttgtgtacaaaactttttttataagaaaatttaatgaaaaatggaaattattgaaaaaattttgtatagtgcctaaaaaacctagactcttatgcatatgcttaagctttaagtttaggcctaagcttagacttgcttaggcctaggcccttggttaggtctatgcctatgcaagtctattaggcctaagctttaggctaggcttaggcttacttgaagctaagcttaggctaagcttaggctttatttttgaaaacatgaattgccattattatctcaatttggcaccaaatttttgtgccagaatttcaatcactttgcgcattttgttgtcggcactgacatgcaagcattgaaaaaatctttgtgtgcattttccaaataatgcggcggtaattttccgatctcgtactctttttcatagtcattgcacgcaattcggtagggcctagcggtgatgttcacaatgaatttggccacctccacggggaaaacaattttcgaacaattagtgccaaaatgggacacaaattcggaaaatggttgaaacgaaaatgtttgttcttcggtggttgtcgggattgaagttgttgttgttgttttgccatgggatttggttgtgccaacaaacggtgcctttgtaaggcactaaaaatcaaaattaattaaattgagaattttaaatataaaaaaattggactttctctttgcacaatttgttggtgccgccgttttctgcgcaaaattttgtgccaaattcgaatgccaaaacaaatggcataaaatcgtccaaaaatgcggcagaagaaagcgcttcttgaagttcgtttccgagtggttcagcatctgtaaaataataattattattaaaatattattattaatttggttttacttttggtcaaattaatttccaaatatttttccgtttttttcgtttgatcggtgccgaaaatgtcgtcgaatccatggcttaattaattaaattcataatttaaaatattttatctctcccaatttgcctcgattcgtagctgatcactccgtcttggtgcttggaaatgatcagaccgtgccattggtcttcggcaatctcttcggcacattccacaaatttcaatttgccaattattcctttgcccaccccaaaacgttttccgatttttctgtttttggccatttcgctttggtagcagatgaggagcctaaaaatggtttaaaaatagttaatttaaaataaattattgaaatattttactttgtgcagccattttccaccaaaattgtcccatttttgccattgcacaatttccaaatgccaacgtcggacgacaaagggctgaaaattgaaaattttgaaaaattagaaaaattcaggccaaatatccaggctttgattaggcctgaatcaaggcttagactcgattattttgaaatgcttttaaaatttaaaatatttattggtttgagattacttttgaaattaccgtatcggaggagctgagcaattaatgaccaagcaaagaaagacggtcaatagagaaaaagagttcatttgctagttaattaatattaattatatttaatttatttactattaaaaaatatttttattttattttacaaataaaatatgtattcccaaatgatcaaatgaatgaaatgaatggatgaaaatggtgggatggaattggttggtgcagtaaattccgtcgttggacaaatcactgaattttctgtgtcgacgtgtaaaaaagtaaaaaaaaaaatgggggaaaagccaccagcagaagaaaaagcggacaaacgaccacacattttgcagcagagattgtggacaccgataaatgacaaaagtaatttattcatttatttattttttataaattggccaaatcatcacaaaatcatccgacaaattttccaccccatttttcatcggacaatttggcgtgaaatatgaatgaatgaataatgcataattaattagtatacaataaattggaattctgtattttttaattgttatggaaaaaaattataaagcatagaaaaagtggttgtctttttttcattggcgcaatttgttgttgattttgtttcggtccactaatgaagttcaaaagcgccgttttcgattcggattttttactttttgttgattggcgccgccgccggcttattttaaatttttaaatttcctataaattttgaaattttgaaaaaaaattaaaattgcctaagaaatttttattttagttaatactctataaatgaataaaccaaatatatccgaaggtgtaaagcagggataacagataaaatcagcaagaataaatgataaagtattatatatgatgatggtgacaattaatttgctaggcttctgctcacagggttgctgggcgcaattacggatttccttaattgataaaatcgccgcaattactactgatttccaatagaaaattcacgtatacagtcctgcttctcagtaaaaccattgtgatctgagcatctggacttccagcagtgaagctcgagagccgcgggctcgattcgagaaaagtcgggttttttgagtttcgggtctcttggtctagtctcggtctcgtggttaagtctcgatctcgagtttcgggaaatttttggtctcgagcatcacgagctaccagaaactatcccatactcccttccagttttatggatctttatgctttggctttaaagcgttttatccgtccgcttcttgcttaatccttacaaatccatcttttttttccatttttgtacgtttatccgtcccctgtcaaatcttaactttgtgtgcactgtgaccactaacatgggcgtcactgaccattaacctctcccatctcagcatttttttcagatttattgtccaaaaataggtcattattgtcacacattaactcgtgttgagtgcgatgagtcattccacaaaaaatcaattaaaataataataataaattattatttttattattgttattgtacatatgtatatgtagaacaaaatgcaacgaaggatcaatgaatgtcagcagactcggaagaaaaaagtcactttccgcgaaacagttgaggaaataaatggcacaacaacggaaattggtaggaaatgaacaataattaaaatttaataacaattttatttaatttattttttcttgaaaactaagcttagatttttacgaaataaaatgacaaaatatttgccaaaatatgcaataaaatattatgcttttttggacaataaatttttagaaaaacatgaaagagatggcacaaaatgccatcaaaaagaaagacccaattaggcctaaaagaaatttaattctaaaaaatctcaaaatatgtaccaaaaagtttgaatttgtagaaaaatatgtaaaagaattttcacaacacctaactatattattattaaaattataaattgatttaaatgtacattaaaaaaagaattcactttaaatttgccctcatttgtcagggcagggagcgcggctctttcgcgtttacacaaatttatttcatttaatcttttaaatgcttttttgacttttttttttatctgtgggttttttaattaatgctgctaataataatttaattcttaatttcaatagtaattagcgcgtcttaattgctttttttttgcaaagaataattttaatttaattcagtgcacatggaaacgtcgagccatggtaatcgacgacaatcttctgacatcagcaccagcattagggagctgcaacaattacacgaaattgttttgtccatccaaaatttggcggcaccaaattcacggcgacggcattactcatctgctgatgatggtgagcatggagaagcatcggttgccattcaccaactgcaacaggccactcagcaacttcaacaagttggatgagcgaattaataaaagaaatttaaaaaataataattaaatttaaattatagcaaatgcgcgaaagtgatgcaaaatttgaatatttgtgccgagagattaggcgaaaagttgagaaattgaaattgcttcacattggcaccgcacttcaacttgaacatgtgaaaatttaaaaatttctgagcaaaattaaaattggcaaaaaaaagaaaaattatttttactatttattattgttggtttatccccggcagattttgggtcgaattgctcaattagaacggatgaaagccttcaggttatcaacgccttctgctgaatgcatccgaaatgcaaataatggtaccagcagcagatggaacattcctcaaaaatcggggggagagtgaattctcgaaaatcggaggggggggggggaattctcgaaaatcggaggggggggggggaaattattgaaaatcggaggagggggaaaagaattctcgaaaatcggaggggggggggaaattattgaaaatcggaggagggggaaaagaattctcgaaaatcggagggggggggggaattctcgaaaatcggaggggggggggaattctccaaaatcggagggggggg

SEQ ID NO: 1546 - DNA, 3663 bp, Heterodera glycines
agaaaattgtgggaaggtgggaatgggaattctcgcaaatcggattatggagggggaggaattcaagaaattcggaaaatttttgactctcgtcagcactaaattatacccaaatataaattgacagtcaaatcattgatctaattatattaagcattgacaacgccatttacagacatgagaaagaatggcaattatcaaaatgtgtgtagaaatgcttttcattttactccatcaccgatcacttgtgatcagcgagtgcagcaaaaagatggggtacaaaaataatacaataattattttatattattttaaacattagcattttttgaaatgatttttaaaaaattattcattagcattttaaatgatttaaattgtaaatcccaaaaaataatccgttttctagctgacaatttgctataattaaaaaataataattaatttcagttgtttgctatacatttgaaaaattgttgggacaaatacgcctgtcacattggcctcaaaatccttggcactcaatttttgaaggttcaaaaaacagatcaaagcggtaaaaaactttttagttccatatacaaaaaacattttgaagggttaagagatttttttatttaatttaaaatttaaaaaaatgtaatttttttaaattaaatttttcttgtccagtggttaaaaactgagattcctgaccaagaaatttcatgattccagggatggacaattttttgtttatgaaaaagtcaccaaattatgaacaaaaatactttgaatgtaaccaaaattaaaaaagtacagtataccattatcattattatacagtgggttggagttctgtgttcgcaacatgctgtgttccggcagaaagtgccggcattttttacttcgaagtgcgcatttttcacgtgctcaggtaaggaggcaggcactaaaaatccaggacaaatcttggcttgtcacggcatggacccatgcttgtgtaccaagatttttgaaacatattttaaaaagcaaataaattatttgaaaaaataaattaaatggttaggaaaaattctctaaatttttaattgacaaaactaattctacggtagtggaactaccgtaggccttgtgctgggggtgggaatttgaaattttgaacaaattcaatataaattattattgtcctaaaaggtccaactttttaaatatgatatttgtattaaattaaaataataatataacctacaaaagtctacggtattgatctaccgtaggcgtagagcactgctgcttctggagttggaatttgaaattttgaacaaattcaatacgaaatccaatgtacatttcgggcaaattgaacattgacaagcatgctattgtaattttaaaatttgaagttgcttcaccatcggactggccaccaagcaaatgccattggcgccacaatttgccctgccggcacacaacgcttcttccgctgctgcatctgctcccggtggcaccacccatttgtttggtggcaatgaccattttttgttaatgatttccatgagcagcattaagccaacacagcaaggatcaacaacaacgaacacaacaactacaggatttgcatgtggggatattgttggatttggcattgaattggcaaatcgacggatttttgtcacgaagaatgggcgccgtttgggtgaataagttctttattgcactttttaggcgcccaatcggtgctaaatgactttactcaaaaacccataaaaatgggcgttactcaaaaaaccatcaaatggaaaaattttgacagaaaattaattcataacttcgcccaaaaagaacagaattttaaaatttgggtattcgatagaatcaaatccctcgatagcatgcaaaatttcaaaaaaattcattaagtttcaaaaaagttatgacctgagaaactcaaaaactaagtttttttttttttgaacatttttggtcgtaacttgttgaaaccttaatgagattttttgaaatttcgcatgataattagaaaacaaattgtgctatcgaatgcaatcaagaataaaaatttggttgcttttgagcaaagttatatcaaaaaggtattttcatttgttggtttttgagtaatgacccggcaccatccaatcagtgacgggtcggggtcactttggcgcgggccattttgtttggcgcgggccattttggcgccgcggactttaaagtgtcataatttttttcttacccaatcaaataaaataatcttgataccatcaaataggtctaaatgttctttattagcctgcaaaatattagaaaaaatgaattctgtttgacaaaagatatagcgtgcggcgccaaaatggccagaaaaagtcagttttttgagggtttttggccataacttttttgtgtatcaattaatttttttgaaattttgcaggctattagggactatcaagcgatttaaaatcatatcaagcttatttaatttaaatgagaaataaaaatgttatagcgtttggcgccaaagtggccggttcccatcagtgaccatccccagttctcagtttcctaggccatgtgaattttttgattcttggccaatgcctacattcctggtattatattgaaaggttgaagtctatagaacattttttgtataactaaatttttaattaaaaacttgaatatactcgaataatgttgaatttcaatttttatcattatagtttttttttcttaatctcttttcttgtatttataaattcctgaggctttaagcttccgattgataccaaagaatgtaaacattgaccaaattagaaaaagctatgaccaaataaactaaagatgatcgatcattaattgaacgcctaaagtggaacagtgccaaaaaattattaaacatattttaattatattaaaaaacattttaagttattgccgatttgttcttttctgctgcccaaccgctctttccgtttgtctctttgagagattttggtgccacaattgaagccaattttgggccaaacttcaaatttaatccttaaaaagcgtaagaaaaaaacacacattttgttcattttatgcgcctttccgtggttttatttatttatttttttttattaaagtatgcattaaaataaaccatttatttttcaaaatatggcctttgttgtatgtatagtataacaacctgtaatatttttttgttattactttacattctatcattcttctacataaaaaaccaggacgaatcggaaagatcaggaccaatcaaaagaccagcaaaagaataatttttattttatttgaaaaatcaggccgagatcaggacaaatcaaaataacagaagaagaataatatttaataatcatgattgaatctgaaaaaccaggacaacggaagaataatttttattttatttgaacaaaatcaggacgagtgtcataaggtttggcatttattcacgtggacatataatgacaaataattgactaatggaccgcataaatatggcattgaacaagcagaagccatcattttccaattaaaaaatattttcaatttggccattcgttttttaattaaatgtatacgcgttttatttttacattaaaaatacaaaattaaaatttttgtttaatttaactctttttt

SEQ ID NO: 1547 - DNA, 1538 bp, Heterodera glycines
agcgcagagaaattttattggccgaccggttcgagtatagctttgaagctttgagccgaattgcagatggttagtctgatgtattttattggcattttacattgcattttacgctccaatagagcattttggcgtccatgatcaccctctatttctatgactagggatgcaatttatagtttttttagaacctaaaaactaacgattttggcggttttagttactgtaaatcgcatccatacttatggcataactaagtttacttttgattggacacctcaaaatgcatttggccagtaaaatgcagtagcgccgcgttttgatcataggcattgaaatttatcgctgcagatccggaattgggtgcttatggacgagtggacgcatggattcgaaatcgaattcaaaacaatggattacaggggaggtctgcaagtttcccacaggaaatgtggaatatgagtgaaaggtgaaagtggaaatagaattttaagaaacaaaaatttagagttgagcaaaatttaatgaggacaaataacagcatcgaggggtggcatcgctctttcaatagccaattccgcttccttcatccgccattaagttattttgtcaaaaaaatgaaagaagaagacagacactggaatttgattaagcaagattacaacaataacccacaaaatggaatgcgtggcaggggaatggcaaggaaaaacatttacgtacagcaggaccaagcaattcgcgccattttcttggatcgtcataacagaccttttttggcctatctacgtgcaatcgcttatcgaatgccggaaccaaattgatttgattgagatatttttaggaaataatccgttctaatgacttgaaaatattttttaaaatagaaatttactgtaggattggattgtccactgtcggattgtccacttctgtcggattgtcctcactgtcggattgtccaactgtcggattgtccacttctgtcggattgtcctcactgtcggattgtccaactgtcggattgtccacttctgtcggattgtcctcactgtcggattgtccaactgtcggattgtccactgtcgaattgtccactgtcggattgtccactgtcggattgtccactgtcgaattgtccactgtcggattgtccgggagccgtttctgatggtgttcagctgcaattttctttttcctcttcagtttctgctcctttttctcctccctttttctctcttttccccccattttctcttccttctcctcccccttcgctgtttcctttttgctgttgttgatttcgtgtcacgacatttgcggccaccagccaaaaacgacaattgcggtccgtcttttgcggcccgacatttgcgcctcggacatttgcggcccatttcttaagggccattttcggacatttgcgtcccgacatttgttgccaaaatcaaaataggtctctcatcgaaaatcctttttttctcttcaaatttatgccgaaatttactcaatcgagtaattctttctcgaaatgggct

SEQ ID NO: 1548 - DNA, 4482 bp, Heterodera glycines
tttctcttccacatttctctctctctcttccgtctctctcctcttcaaaattctcgcgtttgcggagatggtggtgtctgatggtgttcagctgcaattttctttttcctcttcttcagttgctgttcctttttctcctccattttactctctttctcttccgtctctcctccttccaatgttcttgcttctgctgatgttgttgtttctgatggtgttcagctgcaattttctttttcctcttcttcagttgctgttcctttttctcctccattttactctctttctcttccgtctctcctccttccaatgttcttgcttctgctgatgttgttgtttctgatggtgttcagctgcaattttctttttcctcttcttcagttgctgctcctttttctcctccctttttctctcttttccccccattttctcttccttctcctcccccttcgctgtttcctttttgctgttgttgatttcgtgtcacgacatttgcggccaccagccaaaaacgacaattgcggtccgtcttttgcgcctcggacatttgcggcccatttcttaagggccattttcggacatttgcgtcccgacatttgctgccaaaatcaaaataggtctctcatcgaaaatcctttttttctcttcaaatttatgccgaaatttactcaatcgagtaattctttctcgaaattgggcttgttcaaaaccccatcagagcttaaaagttttttattaaaagtaattatttggaactttttcgccactatttttgccactatttagttaattattttgggattttttgccactaaaaatccgatccctacttctaacatgcatttttttgagactttttttgactttttttacactttttcggatttttatgacttttttgagtttttgcgacttttgttcgtgatttttttgacttattgaggcaaagtttgagttttacagaagaaaatgccgaaaaataaaattttcggtcgataaaaaggcaatgaaacctggatgaattttttcttaattattggaagattagaagtaatcattaagcagaagctaagcgatgaatcatctcaccaaaaagctatgatttataagacttaaaaattcaagaaaatcctaattttttgtaaactataaatcaactttttggtgagatgattaatcgcttagcttctgcttaatgatagcttctaaacacgttgagctttcgttgaaacaaattttgaagaaactaaatgacgaacaaaaaaattatggccattcccatttgaaattgtacgaactgccttgacaccgaaaatcccggtcccgtggcactctacttaaaatagtgaaaatttactattttggcgttttgtcaatattttttttactatttcgacattttttggaaaattttgcaacacaaatgcaataaaagcgaaaaatacacttttaagaatcgaacaaaaattgagccaaaaatttattatttactaattgcagttgcaaatgagtaggactgagatttttaaggccaaaaatgccatgaaaatgaatttctgggaaaatttttaatttcttaggagtgtattttttttaatttttgggacgatttttaggagggtaatttttctgaaattttttaagtagattcttaggggtgtattttttggttttattgcatttttgttgagaaattttccaaaaaatgtcgaaatagtgaaaaaaatagtgacaaaacgcacgccaaaataatgaattttcactattttagtgacgaagctccaatggtgacatgaagtttgggatgaaatttgggcaccagagtaagggatttcaaaaaaataatacaaaataaatatgtaaaatgctaaataaatcgttaaaatctagtaaattttatgaacccttgtgcttaaaaatttatgttttcttaaaaaacggtaaataaataaaataaataggggagcaaaatagaatttagtgctaatttggattttggtgatgaatggttttggcatctttcatttgtgcttttatatgccatggtttctctgcccatctctgctgttcccattttgtttctcttctctaattgccattaatctgtccatttgattttccttgggttaatttgagtggcttaatgccctcctctgccagtgaatgggaacggacggcattttctttgctcgcacaacggcactttgggaaaagcaacctaatcctcaaccaaaaaatgaaaagcaaaaatgaatggatctgatttatgcttttctgaggccgaaagtgatcatttaaaagtgaatttttgtaaaaattaagcatatgtctaaataaaaaaaccggagaaactaattagcaactccttaaaataagaatcaactaaagcttataaaatcttttgagaaattatttttccatattataaaattggtaattttacatacaataaagaaggttgacgcaaattccgagtgaaaaatgcaaaaaaaaaatttgttcgaattcgggtccgggtttcgaaataggtcgaaatggatgtcatattcgtgttcatcgcccccgaaaacccccaagagcacctgaaaatcgctcaaaatctcttttttacctcttttttatgggaccagtgaaaccgatgattacccaacaacagcagcaaaaccaagaagttcaagcagtacaacaacaacagcaaattttgatgggaaacgagatgaagatggacaacagcaaaaatggagaaacaagggaagaggagggaaatagcattggggaaggaggagagacggaagagaaagagaggaaaaggaaaaattcggcggaaggaagaggagaaagaggaaagaatgaagcagaaaagagaaaggaacagcagcaaattgacactttttaaaatattgccggtgctaattgctaacggacgtcgtaaatcccccgtcaaaatcccgaaaattaatgtcacaattttcaagcagagagaaattcatacattcgtagatagcaagccatttttatgcatccgattgatttaccaattgagaggtttttgatcataaaatgcatttgatcactgatttaattatgatcagtcggtcattcttctcaattaattcaattcttcttcttctgcggctgatcattgtttttttgttgttttgtccgtcactcatttcgcccttttgtgatgctttgtcccgtttcttctgctggtggaggagacaatggccttaattaagcgcaattcgaattatttaaacaaaattaaatgtcttttctaattgctcacccaatgctattagtgccaccaagaaaaatgatcacattgtcccaattattgtcccaatttccgtctttccaatgaaccgctgccgtctccccaaatttgcatcgtttcattatccaaccgatgccccattcatttttcactttggccaatgtcagcttttcctttgtccattcgttcaccaatgcaaatggcaccatttgcattggcgacacatgaacagaaaaatgaatttcgtaattgacggaagaaatggcattggcacgaagaaaatgctaaacaatttgattggaaaaacaaaaatcacaaaaatgttgggccacacctccttgaagttgttgacccaatcgaagtcctcttgtgcgttcaaatttctgcgaaaacgcaatcgcttgggttgtccatcttttctcggagagtgcaaccatttggacaatgcttggccagcagaagttgttgaatttggcccatcaaaatcatcaccaaacgcagcgggcgacaaatcataggaattgattgaagtcaattggttgagatcagtgagaattgtcggcgaaatttgacgacgcaaattgtccaaatgatcaccatcgttaaagcccaagtggcgaatgttttcagaaaaaattggccaaatttcacgggccaaaatgtcccaaatccgctggccatccgtggtatgtgataatggaatccacaaatgtaaattggtgcctcttttgtcgaaaatttggtgatttgaacgaagaaaagcgatgacggagtgatcgatgtaactgtgaaaatggaaggaatgcttttattgtcatagctctctgatttttaattactaaatccgaaggcgcttaaaacggattttgctgggcaacggacggtccggcaatggaaattccataaatttgttatatttgtcatccatttgtacaaacagcttcggttctggtcctttgtccttgctaattgcgattggtctccaaattgtcaattcgcttttgccattgaaatgtttgtccaccaacgcattgaaacgtggcgaaagaagtgccaatttgaggccgagttgaggacggtcaaaactggggaaaatgtccatccaaacgtcgttgcaaatccaactgaaatggaaaattacaaatattttcttaaaaatattgaacaaaaaaaaaaatttggggaaaaatttttgtgaaattttt

SEQ ID NO: 1549 - DNA, 2638 bp, Heterodera glycines
tgatccttcccctttcctttgtgaccgaataattttgatacagtatcccccaatttcctaccgtttccgtcttgcccaaacaaatcagcagaacttgcgattgatggttccgctgtgttagctcgattcagctcagcaattctggcaatcagaacactcatttcctccgatgtgctcagatttggaataattgctggaaataaaataattttacaccaattttttgaaaaaaatgtgaattaataaaataagaaaattaatttgtaactttttacccttttccttttccctatggtgaacagtcaaatatttggcatctgtaaatttaaattcattaattttatcgaatatttaaataaatatttccataaaataattttattaattcctttatttattatttttaccatttttctccttttcctgttcaattttggccaatttttccttcaatgccttctgttctccaatcagttcctgctgctgctttaacttttgttcaagtgtcttcttaagacaaatagggaaaacagaaaataaaatatttttatagcaaaactcacagtttcgagttccaatttggccatttccaattccatttccattctggcaaacttttcacgaaattcctgaatttaaattagcaaaatctcttttgggttgcacataatactaaaaatatttttcccaattgtttctgtctgtttttttgtttgtttttctttcgcccaccttaagctgttgctgatcagtgatcgattcactgttttttccatcaaataattgtccatcattgtccaaattaattgcatcgccattcacttctaaaaatttgggttttatatttttcttattttcctccattttctcatctttttttacctccatttgctgctgcttgtgtgaaagcatctccataatttattgaattggtcaaaaatgacatttttgtttgataaaacaagcttatattttatctttttataagaaatatgtttatgttgaataaataataaaaaataaaagagagaaataaaaataaactagcgcgctgtcactaatcattttatcaatctgttttttttcttttgcagtaaattttacatttttctaaacttttctcttgcttaatacgtcactaggggggttggggtgatttccctaccgccacttccctaccgccatgtccctaccgccaattccctaccagccatttccctaccggccacttccctaccagccatttccctaccgccatttccctactaaggcatttgggccatttccctaccaaagtatgaatattaataaacagtacgattaaaacaagcaagaaaattaaataacattttatctgtttcaaatcacggtctcatttcataatttcgagaaattccgatcaaaaaggtaatgataaatagatgattaaagcgctgctcaagtggaaaaacattggggtctccattgttgagtggtaaataattttgaaccatcgtgagaattcggcggtctgcttcgcgatatttctttgccttttgcggtgggtcttgtccagttgaacacttcgcgaagtcatcatccgataacttttgatccattcgcagaaggtcaatgaaatgccaaatcgatggatgtgaacaggcaaatgcgcattgcaggcgtctgtttgcggcttctgaatggttattcgttcggtcatcgccttgcagtgttcgagtgtaaacactccaaatgtttgggtcaaatcgcgggcgtgttctgcttccatcatgcttaagacgacccgtgtagttcatgatgaacctaataaaatacatgtcagattcgtgattagcgacctttaaaactccggataaaaaattatcatggttttttatcttaaaaaaattttgcaaaacaaaagggtccccccttttgtttcataaagacccacttttaatatagcgccaaatttttggtagggaaatggcccaaatgccttagtagggaaatggcggtagggaaatggctggtagggaattggcggtagggaaatgaccccaacccctaaattttggttactttttagtcgaaatctgtgcaatttatgtcaaaagaaatagtatcgaggcgatcaacaaataaaggaagtggagccaaagaaatcattcttaaaaaatatttttttgtgagatttttggacctaattcaaagcaaacccccgcccccgtccccgcgggggcgggttcgaatctgagcagaatgattatttttaggtgatggttttctgattaattttggcttgttttaatctattttagaagttaaaatgaattttttaattaatttccgatattttgttcgaattcgggtccgtggttctaaataagccaaaataaatgccatattcgtgataaacgacccaaaaaacctcgagaagtctgaataattttctttaatttttgtttgaaaaatcaattacttaacgaaaaatcctagataaaatcaatgatttttcaaaagccacgggaccgggattttcggtgtcaaggcagttcgtacaatttcaaatgggaatggccataatttttttgttcgtcatttagtttcttcaaaatttgtttcaacgaaagctcaacgtgtttagaagctatcatta

SEQ ID NO: 1550 - DNA, 7458 bp, Heterodera glycines
  misc_feature (241)..(241): n is a, c, g, or t
aaagaaaaccaaagaagaagtaaagaaggatatggaagatgaggaaatgacagcaattgcgtcgatccaccgtaaataataaagtatttaaaagcatgtgattatttgatttagcccttaaacattcatcatgattggaaaccaattttacacagataaagaattaaagctaaaaatgccccttcggtatgcttatttctggtccatcggggagtggaaaaagcagctttctagtcaagtntatgctcgagtcctcagaacttattggtcctaagcccgcttccattctttacgcattcggtgaaatgtccagcattgtgcctaccctccaaaaatgtggtattagtgtgtattcgggagtccctccggaagagttaattaaacgcttacctaaaccactgcttctaatccttgacgaccttttgctatcgattgatgaggcctatttaagtgcattattcacaaaaaaatcgcaccatcagaactttgccgttgtttttgtcacccaaaatttgtttgaaagacggattaaagttgcaagacaaaacgctcaatatttggtactaatgcgggcccccaactcagcacttgctgttaggaatattggagttcaactctttcccgggaaactggattattttctctcggcataccgtattgcgaccaataaaccctatggataccttctgatcgatatgcatgctgcctcaaaccctttgctgaggcttcgaagcgggatatttaaggaggacgaagaagatggagaaaaggtcattttcattccaaaaaatggtgtcttgtgaaattggaaatattgttcataaaaatattgattttattcgttcattggcaaaaacaaaatcgtgcaaaaacaaacaacgaattttaaaacgcgcaacagcagatcaattgctaacacttgttgaaatttgtttgaacattctttgttcgcgtttcaagatgacgacacgtcaaagaaagcgtttgttaccgtatgcaagctttgtccggactcttgctcgtagaaggaccgagaaaggagcacgcaagcttttagttcaaaccggtagcggacttggaggagtgttcgcggcgttgctcactccaattttgattgatttggcgcgcaccgctataaattcaggcttaaaatctgacaattaatcatttatcatggcgtcaaaatttattctcgtccccgatgaaatttatcatggtttaacaaacaatgattcggggaatatcaatttgggctttgcgcaacgtactttggagagaacaaaaagaaggagggaaaatgtgacggcgaagaatgttcattataaccaggaattggcacgttatctccacctgcgagatgaacagcaaaatcttccaacaaagttgagattacaagagggttaaaagcactgatcaaaagaggagatgaaagtgatgaagaacaagtttttgattttggggcagatggagtccaacgccccgcttcacaaagtcgcagacgccttcgacgccatcgccattacaatgatgatgaggaaatgccattaatgccgccttctccaccgcttcaagttgaaaatagggggcaaaaacggaaagcaaatgaattttatttctcatgggaggagggcgcaaagagacaatcgcgccacgaagatgcaccggttccttcttcatctaaaattgctaatagacaaggaagaagaaaactgcctccagtttcatggcgaagagaagaagaacaaattcccgctgacattcagcaggaagaaccatttcagccagccccacaaccgtccattcctatacatccacaacttaacagaaaacggaaggcacagcatgctttgaatgatgttcgagaatcaaaaaagagtcttattggcttggaagagttaagacctccttcgcttcaacaagaggcatccctacgtttcaaacagaaaaggacaagcaaatcccgagtaaccctaccacagcattcgaattcattggccttggcaaaactgcgtaatcctccgagggacttactggccgaggcagcctctgccccattaccggacgatgatacccatgattttgatctctcacaaaaccccggggtcgctgctcaggtcgagcctctcccacctggacctccgttgcctagtaaagccaaaaagcggaaaagcaacaaagcggaaaaagagaacgaaagaaaaagaatcaaaattggctctcgaaagagggacttactggcagaggcagcctctgcccctttgccggacgactttgaactctcacaacaacccgggacctcggatcaagtcgagcctctcccacctggacccccgttgcttagcagaaccaaaaagcggaaaaccaacaaagctgaagaagaatataccgaaagaaaaagaagcagaattggttcttgaaagagattatcttcaccaagtgttaccaaaaatctgccaaaaaggcaaaagaactcgggtagcgatgcactctccgaagagcagcgtcgtcagtttgcagaggatcaacatcttttcagcattccaaattcgcaacttaccaatgagcaaaagagaagacggcttcagttcgtatttaatagaaagcccgccaagtacggtgttcagggtgacaccattttgaacagcgcaggaaacccaataaccgacagcagtgtcgcccaagcattagactatattatcgaacgcagagagggacgaattccgcagtttagacagcctccaggaacaaaattgatccgcgatcggatcaaccaagaccttattttgcgaacatggacggctccaccagtaccaccaagaggacccaaacggaaattgatacaaacagaccaagcgccagaattaaagcaaaaatcacaaaaactcagaggaatgagacaggcgagagtcagggagcaagaaggattgatgcttccgtttccaacgaggggagtcaagcggaagtcgacggtcctgccaacagtagaaacggaaatcccaaccaaaagccagcgtctcaggccacaaaaatggaaaaatcaatagaaaatgtgttagaacgcctctacaatgacccaaaatcccctgctgcgttcgccggtgtcgacagactgtggctggaagccaaaaaagaattaggaaataaaattcgtaaaaatgatgtaaaacattacttggagggacatcgcacctacactttgatgcgcccaaggcgcgtaaattttctgcgcgctcgaacgactgcagccggttttatgaccgactgtcaggtggatttggctgattttcaagcactttcccgacacaacttcggcaatcgttatttaatggtggtaatcgatgtcctttctaaacggatttacgtaacacctcttcgtaccaagaaatccgatgacatggtagaaggctttaaacgagtgttttcaactatgccaatgaaaccacacagaattttctccgacaagggtacagaattcagaaatcaacagctgaaaaagctttttgatgaagaagtcgagaaatatgagagcgcacattctgagaagaaagcagcattagccgagcgcgcaatacgacaaatcaaaaatcgtgtatatcgctactttgcccaaacaaaaacccttaattgggtggacgtaattgaccaaattgttgatggcattaataaatcaccgagccgagtgcatgggatgcgaccgattgatgtgaactttaaaaattcacaacaaatatgggaaaagatgttcggagaagatcagcatagggccctttttggaaagcacagaaaaagggccaaatttgtgcccggccagacggtgagaatgagcatagcaaaaggacaattcgagaaaggttatataccaaactacggtgattaaattttggaaattgatgccgtaaaaggccatatgaagccaatgcgctacaagatacgtgatgcaaagggagagaagtttaaagggtttttctaccccgaagaattggctcccgtacgcagagatgcggatacaacatacagaatagaacgagtttttcggaaacggaaaatgccagacggaacaatggaagtgcttgtgaaatttgtaggatacccagagagagaatggattcatgagacacaacttgtataaatacttgtaaattagcattgacttcacattttaatttgtataaatgtctaacactttttttgtccatttgcccagtaatagcccagactatgctgataatgccccaaataaatttcgagtccgtctcccgaaaccaatttatttcaatggctcttgggtttgcggactacacagcataaattatgcatattcttggccctccacaattggaaccttggatgatcaatggattaacatccattttactgatggcctagaaaatgaaaagcttagagttgttagagtgcctgtcccaaaagcttccaacacaaccattgaacatttgagagaatttattacagcaactctaaagaatcacgcggagtctctcgaatctattataaaagataatacaccaataagaagaaaaagaggtgcagttgagcctacaactcctcctagtgcacgtattgtaccaaagtcacctccaaatgtcactaaaaaggtcatagtaccaacatctccgccacgtgttggacaagaacatcaagaaaatacagaagaaatctctgattcattaaccaatgtgacgaagccaccagaaaaacagccaaaaattgaaaaacaacccgaagtcgtaaagccaaaaaatgaacaaataaatcaaacagaaaatatttcgcaccaaaatgcacctagtccaaaacctccaccacctgcttcaattccgactacgaaaaaacatgaagaattaaaaagcaccattgaccccactccttcagtttcaaaacctccacctccattgccagtttctaatccggttaatcagaataaaaacgtgtcgatcaatcaaagtgtttcacaaaaaataactattccgaatgagaatggcattctcgtcgtcgatgacggcatatgtttgctcttctccgttcgcgtctcgacctactctttattatgctgataagaaaaaagggaccatctcaaaaaaaatattcaaattatagaaagctaaaaaaggatcaacggtccggtatataaatgggaacaagcaaatttattctcattttgatcagattttcaaaaaaaatgagtatcaacctccacgacaaaaagtcgctcatggacaacattttgccggtggttgagataaatcaaactaccaatggcattacggttagcagtgagcgaattgcgataccacgaacgattcagttcgacattcttggcaaatgccgagaatgtaagtcaaccgaatgtgagacggaatggtgcatttccaaggaaggcgttaccatttggtgcacacgcttcaaaataagcccacgttttgtgccatttgatgtgatctacgattttatttagctggactcggaaatcgaacacgttccgaaattccaatgagtgaaaaataagtctcgcttcgtcattgaagacgtaccggctgaccccgagggacttttaattggaatttttcaacactgtatggacgaagcaattggtgacagccgcttgaaaggagttcaaccaacacatctcggctgtatcatttccagccagttactgacatccgatatttggattccaattcgtcaaatgacacccgacaccataaacaccatacttaatcgctttaacgacgtagcgcagagcaaaaaacacaggacggggtgacgctttggggagatgcatttaccgttattgtgacaacggttaaccgaaatggacaaccagagaaaatgaagctaaaagggggagccgcgcggaagttggctccagtccaccaccgaattcatgaacaatgtcttataaaggttttcacttttttcttaatttaaaaaatcattttttagattaaaaatttcggacgggacaattactgcttattctatgcaatgcaagcgacgatggttcgggcagttggtgccatgacgcggcaacaattttacggatatctcaatggaattgatggaatgcgagggaagctgagaacagaaacaacagaattgatggaagccgttcaagcacctcttgggcagcccaattacgacgcagaaatttatgttccacggattgtcgattggtggaacgacgagaagtttgcagggcagtggaagtttaaagctttcatctttggagcaacggggcattacaagccgcttttcaaatacgggccagaggaatacatcgttccaataattctctactttgacgatggacacttcaatggggtgcagaaaagcggaaatctttttggcaagccctattgtctgagctgtgaaaagacttacgaccgaccgaaacgccacattgctagttgcaaatcgcgctgcattaaatggttaatttcttgtaattttttattaccttttattttagctcacaaataggaccacaattcccatgcaaaccaattgttggagttcggcaaaagtgcaaggattgcaataaaatgttcttcaataatgcttgctaccagtatcatctttcttccaactttgtcaaatgagcaaagagtgcaaatactgtggcgtagtatgggacatgcgtaaaaattgcgataatgggagagaggtttcttttaaaaatttaataaattttaatattggaatagggtcacaatgaccgccaccctcttgttgcattcgttaaatggcttctctacaaacttccaaagcaatacgaaacaattgcctattcccatttcggcggacgtttcgacatggtcttggtctttcgggaacttttcatggagggactgaacccctcaatgatcagaaagggaaaccgtctgttcgagatgaaggtataattgtccatgcgtttttatttaataattttcccatctcaggtgaaaagcagaaagaacttaaacccgaatgtgacatttcgtgattcttggaatttgattccgggaccgctcgcctcaatggggcccatgttcggcttggacgtgcaggacaagcccttctttccacacatggccaacaaacctgacaattatggatgccaaatttttccgtcgaaagcagattacctggccgacggaatgaacccagagaaacggaaacaatttgatcaatggtaccagcaaaacaaaaatattccgtttctgctggatgagtcattggcaaggtgaatatgaataaatcaatgttgataaaataataaaaaattaagctattgcaaaaacgatgtcgacattttaatggctggactcatcgcatttcgaggagaatttttggagatgacaaaacgaccggcaggcatcgatggaaaagccgacagagcagcgtacaaaacaccgcacaacggcattgaccctgtccgacattgcgtcacaattgcgt

SEQ ID NO: 1551 - DNA, 5014 bp, Heterodera glycines
tgaaaaacacccgaagtcgtaaagccaaaaaatgaaccctctaacaaacagaaaatagttcgcaccaaaatgcacctagcctaaaacctccaccacctgcttcaattccgactacgaaaaaatacgaagaattaaaaagcaccattgaccccactccttcagtttcaaaacctccacctccattgccagtttctaatccggttaatcagaataaaaacatgtcgatcaatcaaagtgtttcacaaaaaataactattcctcctccatcagtttcaagttcatcaataaatgtgactaaaaagcaggaagaattaaaaaacagcaacggtccaacagtttcaaagcctccgcctcaattggcagtgtctaaccaaactacagcagcatccgttcagcaaatatctcctgctcaaacaaattatactaaaccatcatcattgatcactgaggagaaactgaaggaaattggcccgccgccaaaacaaagaactgaaaaaagtacgatagagccggtctcaccgccacagcaacatcctccagctgtacccacacaatccaatgttacagtgaaaaaggccacttctcctcctcgagttattgccaccgacattattggaccaccaccaaaacagagaaatgaaaaaagcttaaatactaaacatgtgcaagcacagcttgtcaacgaaataatcccagatactactaaaaagacaacaataacaacaacaactaccaccacaattaccgagccaccgaaagaaacaattggtgatttgtttgggcaaattaaagaaccaacagagaaaaacaatgcagagcagttgcttgctgtcttgtttggaaacgatgaatggaaaaaagttaacttgagaattcttaggcaaatcattgaaggagttgagttacagtatcatcccaattttgaacgatttaaagcggtttttacacatccgagaattgaatttatctcattttcgcctcagctcggctatgtgttgggttttgaaaattcgcaacatgtaagaaataatgaaatagccaaatacggaagtgatctccgtggtggattcgcaagctttgccgtttacgcaaaaggtctaaccgagaatatgattgttggaaattcattgagctcactcctccgtgttgtctctgtgtcgggggcggtaccaggcgaatacacggaaaaaatttacgattcaccgctctatgcacgtgttctaccaaaagaagtatcagaaattgaaattgagttacgagctatgacagacggacgactggtaccattttcctatggtacagtgctggtcgtactgatatttaagaaggtgataaatttttgaaatcactcattattgtttttattatcacactcaattgataaaatggtacatactctttatgacacttcggtttcgggctatgatgcattttttgtgcaaaatggttgtggagtcggggatgactcctcctaccaagtttttcgaggagcgccaccgtttcagcgcggatggggcccaacacagacgggtgcggggataggtgatatttttcgtggtctctggcgctttttcctgccactaattcgcagagctggagattctgtcacagacgaaacaattcagactggaaaacgctttataaatagggtaatcgatgaaaaacccggtttgaagggaacgatagagacgttggcaactgagagtaaacgtggagcggataatgttttagagaagggcggatttcggcgtcaatttggcacaggagggcgaagaaagcgtataaaagctaacaattcctccattctatcacatcaaacgataattggaaaaacaataacaaaaccgttaattcaaagcaaaaagaggcttcgatcagacgcgttcgggctttattaaaaaatgacctttcacaaaattgacgcgagtagcatcgattcgattaccaatgccgttgattttttcagtatacccccgacaaatgttaccgtatcatcgtcaaaggttttcgagattttgccgagtaatccactcaccgacactccttatcattttaaaatacactcgagccaaaactacattgacctgtcaaagtgttaccttttgaccgaatttcgaatgcgaaaattgacacccccaaatggtgaatggggacatttggatgcttctgatcaggttgtaccgatacaattgatcgggcacaccttcatgcgggacctgaaaattgcaataaacggtcgtgaaattttcaattctaattcactgatggcatataaaacttatctttctcatgaactttcgcaatcacttgaagctaaagtttcgcatttaactgctgctggatacgaccgtgaagatgctagtaatctacaaaacgcaaattccgaagggttcaaaagtagaagacaacggtatttgggaggtcgaacagcacaatacattgcaaaaatcgatgccgatcttttcaatgtaccccaatatttgattaatcattgtgaaattgacataacgatacaaccccatgacgacaactttttgttaattgacaccttagacccccctggtcaaccatatagccttgagcttgttggattgaaactctactgtaaaaaagtcagtcttatggatggtttggctcttgagttggcgaaaaaattggaaatgaaaccagcacggtatgctgtacgaaagacaatgatgaaagcattgttcataagcccaggacgctatgaatttaatgcaaacttgttcatggaccaagttccacgccgcgtaacaatgggacttgtcgcaaattcagattatgtggggaacatcaaaaggagcccattcaactttcagcactttaatgtacgggagttaagtgttgtggccaatggtcgctcctatccccaggcaccgtatgacattgactatgaaaattggaaatttgttcgtccctacaatgacacgcaggaggcgcttggttttgccaactctacatatggaaatggaattgattacttttcttttttgcacactcactgtatttatgtgtttaatatgacaaacagcggcgacgatcatggcggtttatttgatctaatcaaaaaagtctgtacagcagtgaacattaaattcaaaaaaccagtacccgatggtggaataacacttattgtgatgggtgaagcggactctatttactttttggataaaaaccgaacgattgcaaccgatacaaccatttgataaaaatgtaccaaattttacttgcttccatattttttcaaccaattgtttcattgattgttgaagaaggaataaaaacagaggaaattcctgaatataatgggtggaaaagacttttgggatttaaaaattcttcagaatttcgaaacacaacaacaacaacaacaaaagggatagttacttcgattgtgttaaggaattcttcaacaactcgaaaaacaacaaaaaagactactataaaaacaaaagtaacaactaaaagctcacagacaacccatgcattgaaacattatcaaccccaagaaagcatcaattttccttttataccactttgtaaagaactacccaaagagtcaaatgtgtatgcacatattttttgttgggcaatgattatcctttttggcttgtccgtcatcagcctaattatctaccaatttcgatcaattctttggctcaaactaaccctgacgcaacagcgcaatagggcaaatggacaacaatcaaatcaccaaaattttaacgtcatcaaaaataacgagccccaagtttcttggatgcttcctatgcgatcaattacccaaccctaattcaataaaatttcccgcatcattgattgttaatttggaccctcatcattttccgggctctcattggattgcaatatttgtctatggattagatcagaagaccatttactttgatagtctgtctttgcccattaatgaattggtaattaaatcctttcttaatgcttttcctggaacccattttaaccaaagaccctatcaatcagtttcatcaaattcatgtggacatttttgtatttgttttgtttattttttatcaagcggactaacttttactcaattcctctctaaattgaattcttcgcataatccagaaatgtttgttcaaaattttattcgcaatttcccgataaaatagaaaaaaattcgttttatttgttttatgactcttttttttttttggttccgtcccaaaaaggattgaccataggaaaggaaaggcaaacattgagtgccgctcagtgccagggaccaatgactgtcgatggggtccctttccttccgaataaatctcggcgagtgttatttgccaaaaaaaaaaggtaaaaggagcgagtgacctttcccttcaacagcataggcgaatgctgattggctgaaggacaaattcaccctttttccttcagcagaatgaaaataggatgatgatgattggttgaatgaccaatatgaccattcctcttagattaatcgttggaaaatagattagtaaatacaatacacaagcaaataaaaatggttttaaaggtttaaaaataaagaaaaagactaaatattattcataatttggaaaatatttttttttaattaaagaaaaatgtcaaaatctcctccttcgaaacgagctcgccgttttttcatcgaagaattgcttcgggaaccctacaacgagctttccccaccacaaaagtcggcaaaggattacgtcagaaagctcgactcggagatcgaacacgttccgaaattccaatgggtgaaaaataagtctcgcttcgtcattgaagacgtaccggctgaccccgagggacttttaattggaatttttcaacactgtatggacgaagcaattggtgacagccgcttgaaaggagttcaaccaacacatctcggctgtatcatttccagccagttactgacatccgatatttggattccaattcgtcaaatgacacccgacaccataaacaccatacttaatcg

SEQ ID NO: 1552 - DNA, 9495 bp, Heterodera glycines
  misc_feature (9474)..(9474): n is a, c, g, or t
ttaattgctcatcaggtcgaaacttgggcaattattttagttcattaaaatttcatcctttgcttatgaggagggaattaagtcaaataaaaagggttcgccaaaatataaaacttttctcgagtcaaaagactgatttgtgagcaaacgctgcaaaagtatttattattagcttatccgcaaatggcgactaaccatttttaataattacaatagacaattaaattaaatcatttggtgacaaagttcaattttgaacccgcaggaaattaaataaatttaaaattgaatttaaaaaaatcattgtcatattggcaccgaaaagaaaaactatggtgccatattaggtaagtgaagttgatcatcttccattgttcttttttttcattttgcccctaaactcttccaaatggcattaaatattaatggaagtttaaatttgcgtttatccatccgcttccattttctatgctttcagacaaatttcacatcttccaattcggctgcatcggcagcgtcagttcgcgctgtgacgattttgtgagaaattccgtcggttctcggtacaaagagttcaacagcgccccgtacacatgtgaatgcttttttgggggacccggtgccaatatgtccaacaaaaatgtccatcttccggtgactcatcctcggcccgaatccgacgcgggcacaacagcagcaggtcgaatttagggaaatgcaaattgtataagttgtcatttgctctccttaaccccccggctttatctcctctaaactcgaagacgagcaacagcaggccccagatgccgcagcattaaatcagcaattaattttaataattgccattaattattattattattaatttctttccatatttcagtgactcatcctcggcccgaatccgacgcgggcacaacagcagcaggtcgaattagtgaaatgtaaattgaaaaaggaatcatatgtcggcatttcattacctataaaaaaatgtaattaatcttttttattattttctttttagattcaattaaaatttttgtcgaattaactggcataaatgcggaaagtgccgctgttcgtcggcaccattttgatttgaatattctgcagttgttgttgttgatcagctgttgtttttttagaatgatgtgaggaggaaggaattatttgtgtgatttaattccaaaggaattgaaaatatattaattaataaatattatttataagatcattcaccgaaaaaaattcgcatcaaaaaaagttgaagtaccaaagaagccttttggataaaagtgagtcaaatccgatagaagagccaatgatttaggatttaaaaggtacaaaatcatttttgatgataaaaatgcaaaaattatagcaatgagacgtccagtaaaattcagtcctctttcgacaactcaacagtgttaagcacaatttggacaaatcgcaccgatttttctggaaagaaataataaatgataaaaagcaaataattattaaagttctaaagattttactcataatagatttgtttaattatcaccctttctacctttaaaaatcattattttcaaaatgaaaataaaaattaattatttttgttgtttttccctcattagccttcccctctcccgcccccttttgctaaacgaccgtttatccgctcaaaaatgggcaatgtccgctgcgggaagatgaacacgtagtaaagcatcagtccgacgcccaacatggccacagtgtaagcgatgctcaacgggtgggcccatgccgaaatgagcagcagagagacgaacatgcacaggcacagcaccggcagcacaagcggcgtgcgcagcgagtcctcccgcaaaggaaagtcgccccggcagagtcgcatgtacagcagggcaaccatggtgcaactcttctgcaaccacagcgaataggacctgagtgaatgtgttacaactgctcgggaatccgggccgaggccaaagccgggaatttcgggttatttgtgcctgtcccgagtcttgacgcaaattctcggaccatgaaccccgaatttttcaggattaagcagatataaagggaatgagtaccataaggaaaagtaccggcttatgggagcgtatttcacccatcggatatattatgaaatattatgttaaaaaaaaccaaattgttttataataaagcatgcaaaaaaaatatgcgtgtgacaggattcgaacctgcgcgggaaaatccctttatgacctagagcacaacgccttaaccactcggccacacacgcgatgtttgccaaccaatttgtatcatgaaaaggatgcaacaggacaaatgaccaaaggtcaactcaataattaaccagccgagggaggggcagttatatcgaaacgagccaaccgggcattagagactattgggatttcgaaataaactggaccggggtgacgatggaaaagtgaatggtattaacggaaataaaaccccgtcttccgggactcccgctttttgtaaaatatattagtaaatcacataaataccaaaatataataccgatgaattccatttgaatttttcaaatgttgactccaaaatccttccgttaatttttaaaatacatagcataattaccagaattaatgaattttgaatgctttttgattttgaaagtgggggtattttaaagccccaatgaggtgtttcagagttccggatcaaattgaacttaactcgcgaaaagtaataccgtacccttaattgaggaattctaagttttttagtttgaaaggtttaggaaattgtaaattggaaaaactgaggttgaaaaataattttaattcaatgttggttttgtacgaatcccttacagtagaaattctgtaggaaaaaaaacaaaaagtggaataaaataaaacaaaaaatgcatgtgacaggattcgaacctgcgcgggaaattccctttgcggcgtaaatcgcaacgccttaaccactcgaccacacatgcggcgaatgtcaaaaggcactaatcaattttaatgtaatttcaaatttataatttccaaagtcactgatcacaaatatagcttgtgatatgagctgatcatacttttgattctattatcagattacggcatcatctgtccaaactgatttatattcgtgatcagtgattgtgaaaagccaaattataatattggaacaaatacaaaaattaattttgccgattcgcatgcgaatccaactcaactcacatatagccgatcagattctccaagtcgcagatgaatgacagaacgattaaagcaaacagcttaaaattattatttaatttacattcatatttaaaatgatcaaaataaaaatgcacttcgtagagaatggccacccgcggactcatcgaattggcatggaccgtactcaacgcggagggcataatggcatttttggcaccggcaaacaaataactgaaaaacggacaatttttgtcatttttcataatttgaaaattttgaccgtgacgaggcgaagatggaactgttgaggttgccaagcagcaaaatggcgaccaaaaaaggcacgacacgggagaaattgccaagtgttttttcggcaaaaagctaaagacataaaataaaataatttaatttaaaagtaaaaaattggaaaatttgacgaaccgcggccaccgcttgtgagtgacggaattcgtcagctgacataaccgagaaataagcaatgttgaccaacacgtagacgaaggcggagatggcaatgccgcacagagcgccgatgggcaaaacgcggcgcggattttcaatttcttcggtggcaaaattcaaaacgtcccaaccttttggaataaaattaaataataaaaaaatctaattggaattttagtgaatcttagttttgcctggatatccaatattttattggcttttacctgctgtaatatttaaaattaaatattttattacaattttgtggtaaaatttggttaaatttaaaatcaaacctcattcttaaaatataaatattctaaagaatgggggatttaatttaacttttttattttaagttaaaaaattatcataagatgctgtcgaatctatgatttatcagaattttatgaagcttggtgtttttaataatcacgctcgagtctcttccacgtcataaaaattcatttatttttactccattttttaattaccgttttcaaaagaaaatgtttttgaagttttttgacacaataaaaccccctattcttcaaattaggtttgctccccgacccctcgggggggggggggggggcaaaatgtcgggggccggaaaccatcgaggggcacatgttgggggtcgggtcggggaataggtcccaaaaaggtctcgggttggggggttcggggtcggggagcaaccctacttctaattgcctaattattcgttaatttgtttctttattattatctacataaattataaaataaattgaaattaagcataatgtgatcagcagttcgaaaagttagttaatgatagaatttattttcatgcccaccattgtaagcgaaaagactggcaaacaatgccagcacaatttcgcacgcttctgtctttgtccccgcaaaagtgtcgcggaaattctccgttctgccgcgaaagatgatctgttctgtgtggaaaggggggaaaactgtttaaagactaaacaagcaattaataaaatgatttttatgagcaaatgcggacaaatggcagaaaaggaaaaacgaagggaaggaaaggcaaataattggaattatttggtaaattaaatttcaaatttaattttgtgagaattttggttgctccaaagaatgaatttcctcggccttttcacttgcttatatctcacctgataaagtcccgtcaaaataatcagcgcaattaccagcagtttaagcaccgttaaaatcacttggaaacgggcggcgattttttgctgaattaatgcgaacaaaaaatatttgcccatttaaaaacaaaaaatgccaccaaagagaagagattgatgaagcagatcagccaaatggccagataaccgatcagtcgcttcagcacaaaagccattgtttcactttgttccaacgatggccaaaagggcctcagcccgtcgaagaaatactcaccaaaagtcagtgtttggatggccattattgcgggaaatgtcagcgaagtggagacccacagaaaagcggcggcgatgggatgcctttaaagggattatgccaacaattagcatattttaattaggcactttagaattatgccaacaattagcatatttgaattaagcactttcggattatgccaaacaattagcatattttaattaggcattctggaattatgccaaacaattagcatatttgaattaagcactttcggattatgccaaacaattagcatattttaatttggcactttcggattatgccaaacaattagcatattttaattaggcactttggaattatgccaaacaattagcatattttaattaggcactttgggattatgccaaacaattagcatattttaatttggcactttggaattatgccaaacaattagcatatttcaattaagcactttcggattatgacaaacaattagcatattttaatttggcactttggaattatgccaaacaattagcatattttaatttggcactttcggattatgacaaacaattagcatattttaattaggcactttggaattatgccaaacaattagcatattttaattaggcactttgggattatgccaaacaattagcatattttaatttggcactttggaattatgccaaacaattagcatattttaattaggcactttggaattatgccaaacaattagcatattttaatttggcactttggaattatgccaaacaattagcatattttaatttggcactttgggattatgccaaacaattagcatattttaatttggcactttgcccccgataaactcgccattttgcgtgacttaggtaggcaaagtcacagcccgacttgcgaatggaagtgccttcaaattttaaatttgttgttttatggccatttgaatccccgttgaacttgcccaactccacgtaaaccaacgcgccgcaactggccaccacagcgccagccacccaaacgcagagggacatgccgatggagccggtgtgcagcagaatggaagtgggcgagatgaaaatgccggagccgactatgtcgccggcacagtaagcaattgcctacggtaaaaggggtcatttaacatatgaaaagccttcccatgttaagtcaatcgactaacagacttcaaaaacgccaattttgttattgttgcccaatttgttggagaaagaagcggacgatgaatggtcagaaagaagcatttggaattgtaagcaaaaatgaattaattacctaattaaaattggaatttaatttaaatgaatcggaaaggattttcttttgtctttcgctgcgtcggggcccaattttcgctgctttctttcactgtttgcactctgctaatttatttttattctcaagcagtcagaccaacttttgggtaacttttgtcgtcgattggaccaaagtttcttcgctttcgtttgtttcatttttcagtcatcgcccgaaaatgacaaaaaaaaattggaggaaaagcaaacaaaaagcacaaaatgttatcaccaattggttaattatcatcaatcagcacaaacaatgaaagaagaagaagaagaagaagttgttcaattgtattttgaggcaaagcaatcgaaaaaaagaaaaattcaatggccaaagaacacagtgaaaaggcaacacaatttgagaaaagatcaaacaaatacaacgacacactcattaagcaattaattaattatgtcattaaaatttaacaaaaatcttttccttttgagattaaaaatgaaaaaataaatacatttaacaattttatttctatagaaaatgttgcaaattgtcgctagtctttttcataatgtccttatcagcttatcactttacaatatgaaaaaagtgagcaaaaaatcgcatgtgacaggattcgaacctgcgcgggtcaaaccctttgcgtcttaagcgcaacgccttaaccactcggccacacatgcagtggacaacggacccaaattatcattttctgtgtgaaagggcataaataaataatcaatgattggtatttgaccaccgaatgtcacgccaaaataagcacaaaataatcaaaaaataaaacaatttattaaaaaaatcaccgaaatagtaaaaatatcaagcacaattattctgagatcagaacaaataaacatattttcaattgatgcgtccttttcacagttgagttgcgcgactgatctgaaccggatggatgccgcggcttcgcagcaactgaacgaaaaggcgcacattttatacgaaatataattaatttaaaatcccattaaaaaatttccaagaattacttagataattattatgacatgccattgttcgaatgcaatttgttttttatttaatcccggagaaacagtacacttctggcacttccaccgtacctcttcgaaactttcgtcagctttgtcaaatgactgtgccgtcgtggcggccttttcgcctttctcggcaaattccacgtgatgttgttgtcctacagcacgtgcggcaccgcttccctcgcctgagcctttcagcgacgaacgcgttggcgctgcgcgagtgacgtcaccagcagaagtgacgacggcgccgccttcgctacgaagtgccgggacatttacgagtagatgcgaaagcggtggggagccattgccgacgatgacatttttctaatgaaaaagcaaaggagcttgtaagagcaagaaattagcatttttgagaccaaaattctgtaaaaaagattctttattcgttttctgcgagtaaatcaatagttctcataatttcatatcacttttatttaaacaaataataattttaacctgaccctctcttaatgaagatgaaatttattatcattgacgaattttaatttgcttcaatttaatgtttcaaatacttatagattctacgacacattaaatatcgtttcctgtaatttttcgctataaaaattactaaaaaatattgtgagaatgtaagtttttggaatgtttgcttaaaaccagagctcccaagtgtccttatttgtaagatttgtccttattttggcacgacctccttgttttgtgcttattcatggatttgaaaataaaaattcaaaaagtgaatatttttgaattacatattgttttttttgaagcgagtatttgaatgatttctatttaaattttttcatttcttgagttaatgcccaaaatttcaatgaaaatctgttaaaaaactgtcaatatttctatttttcctccggcagcgcctatcggcaccgccgggccccctaaaacttatttattcataaacaaataagctcaaaatctcaaaaattggtcatttttgacaaattctgttaacaaatacgaagtaaattttcaaaaaattttctcggcggcgcctatcggcaccgccggacccacccttcctgtcccaaaaagttttctggaaaacgcgcgccgcgaaaaaaaacattttttgatttttttcattttgaataaaactttccaaaaagttggtttttgactccaaatgatgattttttatcggccaatgctgattttgaaaattctcaattggcagctccggtttttacgctaataaaatattgttttaagtcaatttttcatgtttttattgcgtttacttcacgctactattagttttagaaaaatcttatttttggagtccgaatcttacttttagcctcatctgtccttattttgaaaaaaaaaaacttgggagctctgcttaaaactcataaaattgtaagaatggaagaaaaagggaagcgcgtaaaatcgaaaagtacatatcaaacattaaaacaagagcaaaacttttactcttttaaaaacgaataattttttcgggacaaaaaggttcagctaaatataaataaaattaaataattttcatgccttaattttaataagcaaaattaattaattaattaatgcatcgcatgtgcccaccaattgttcagttgtttgtgctccgccatcagctgctgttggagtgccgccagctgtgcgcgacacagtttgtgccaaagtgcgcacagtgccggccaacaattgggtgactttttcaccgctgtgccgtcgctcggtctgcggcggtgagtcggaaccagcggccatcatttcttccggctcctccagcaacatgttgtgaatggtggacggaaagggcaccacccagtccgcgaaatatccttaataccccttaaaaggaaagaaacgggcgngaagcgcccgtataagcccaa

SEQ ID NO: 1553 - DNA, 1804 bp, Heterodera glycines
agactggatccgctccctccccctctcgactcggacaatcggtcacctgcccgttgcaccgctgcggcgttgtccgtccgtacccgccgtgggtgccgcccatcacggaaaaggtgcgcgtgaagcgtgcaaatcctccggtgccgtggtgacgttgccgcgcctgttgatgatgattactgcggacaattgtggacaattcagtctgcgcaaaggcgtccctgcgcgggcaaagcccgctggtcggcgtgccggccacgctgttgtggttggccacgtgcaacgaggcggtccgcgttgggcaactaagcgtaaaactgaagggtttctgtgtaacaaattttcaacgcctttaagtttttcaataattaaattttaagttttccccaattttcccattgttttgtccactgacccaagtgacagcgattgtgtgctgttgcgcgccttcgatgatgagaactgtttgctgtcgttgagcgcctgcgaattgccgaaatggcaacggatcaatttggtggtggtgtaggaggagcgcacattcttctcgggccgaagcaaaatgatgaagactttggggaagaacagcagacaaagcgcaattgaagcggacagagaaaaagtgaaactggcggtcaatgcctttggagagggaaaaagtgacgaagatggagggggaactaattgggtgagtaatgaggtcgataactaattaattgtgaattagcatttcatttattatacaaagcatagatcagtgaattgagtgaggccgtcaaaattgaacaggcgggtttgaaaatagtgggatacagtacgataggaattttgtctgtgcccattcttgcttctcaccttgtttacggcgttcacatacagtacaacgaacgcgccccaagtaaccaaggtacagtaccttaaattggcaaaatggcaattaaatcaaagatttaagaaataagcaaatgaatgtcaacaaaaaaataaacttgcattgtgaatccgatgaatttggcctcgttgaaattctccggcaaattgcgcgttttgaaggcgtacaaagtgcagaagagaatcagaatgaaattccacacgaaaggggcgagaaatgcacgcgtggaaatggaacagatcagaaacatgcgacgctaatgaaaaatgaagcattaatttaaaaatttattaaattaaagtttaatgggataattaccggcatcaaattggggtcgaaccccgcctgaggcatctcctccatcacactgacagcaacaattgcgcactgaacacccaccaaggaccacgtgattactacctgtatattttaattttgcataattaaacagttattaattttcctcgacaaaaaatagcatataaaattggagattcaaacaacaagagaaaaagaaaaaaatacgcaccccatctaatatatcttttatcctttttataaacagctaaaaggatcaccattctaactataccgaaatacttgggttgaacagtgtgtcgacgcaatttttggaatgtcaaaccggaaggttgaacgaaaagatttggtaattttgtcgaaaatggtacagcacaagtatttaaaacccccggtgatcggagtgttcgtcgatctctttgccccccccccccatcgttgctccacctgactgaaagtgctgaggaagcgcggctttttggtcaaaatgcgctttttgctgcccgccaaaatgcgcgcaattcgattgggttttgtaaacagcgcggaataaatggcggagaaagcgatgggcggcaaaagtcgcgtgaaaaa

SEQ ID NO: 1554 - DNA, 2534 bp, Heterodera glycines
  misc_feature (2472)..(2472): n is a, c, g, or t
  misc_feature (2490)..(2490): n is a, c, g, or t
  misc_feature (2499)..(2499): n is a, c, g, or t
tttttaatattttcttattgtatcatttttatatctccctatatttttttgtaatttcatcaaattaatttttaagtaatttatttatttcttattttttttagcaatttttatccaattaatttttaataattattttccatttaatttttaaataggtaatttaattgtttaaattgaatcgtttttaataattttttcagcaattttcatctctctgcggctttattcaatgtgttcccactgagccatattgtgcccgaccagttcaagctgttggccaatgctgtcctcattgcggtgcttctcatattatttttaatcaaattttgaaaaaaaaaattcatgaaattgttcggtccgtaaatttcagggcctcggttttttttctaaaatttttggtttttcaggtgccatgcttcgatttcgcaaaagtgcattgaatttcactaaggcctttgccattgtggaccaattcattcgcgctcaaatggcattgccacgcggcgctggcgtgtcctttgttcgccttgaccgggacgactttcacccgctgtaccaggtgtactgtaaaaattcaaaaatgcatgcattactgtagccaaaaaataaagcaaacagtacagtagtcgattgattgcacattaatcgctttttgccatttaaacatgaacagatttccgtgttgtcaaaccatccggcaaactttgacgagtccgagtactgctccattatgtggtccgtatttcgcaaaatccagcaacggacaatcaatggtcagaaaggcatacatttgtataatttttaattataatatcatccatttctgattatattactataacttccatttttagggtcttgataaatcgctaattatttcttaattagacattagacaccaatgaatttagttttgatcaatttatatcattcatttctttttaattttatatgatataataaatagaccttttaccatcaccggaaaccgaaaaaatgaatatttttttttgccgaacctaatcagttttcaggattttctgtctatttaattacaggcctattacgcaatttccttaaatttcttctcaattacccatatgggtggagataaaaaataaatcatggatataatcctataaatccctttgcagatcatctgccaattgagtaccagccaacggacagtgccgaattcttcgatatccgtccaaaatgttcaattcagctcggcattttgcactggaaaaccgtgttcaaagcaattggcttcattgtattggttggcattgtgctcggcttaatgacctattcatattatcggcatagtccaaggtaaagcaaaagcttttgatctgtaaaaagcaaagtgatcgaatcgggcgaaatcatttggccatttgaaaattctgccaatatttgatcactctttaatttttctgatcattaaatcaactgatcggtcgatccttttgccaacagatcaattgattttcgtgtcgataattgatcactctttaatttttcggatcattaaatttaagctttcgtctttttgttcacgatttactgtcaagagagcaccatgcaatacaagtcagttggcgaaggacacatgaacatgttgaagtgatcagagaagaaatcgtaagtcgtctaattttgacactttcaaaaataaacgaattttggcagaggttgcctaaaatttatatgaaattaatcataaagaattcatattcaaaagaaatgggttgttttaggatttatggttaaatttttggcaaatattggaaaaaaactttaaaaatttgaaataagataaaggcatacattcataattggcagagctttatacgagttagatgaattttgccaaagttggtcttaaaatttatatgaaaataaagaaattaaatgtcttaaaatagatattattatagcatttacgattaaaatagaatttggcaagtattggaaaagccttgaaaaatttgtaattcgtgatcgatcaaacagttttgtgatgccatctttggcatttttttttgttttgtttaggaagaacaaaaagttgatggaaatggtggcggcggtggtgcttcatttttggctgagtttgcaaaccgagcattctcatggaagatggaaaggaaggataatgatgatgataatgatgatgaagccaaagaagaagccgccgatgtcaactcacagaaagaagcattagctgctgatgaaaaagggcaacaggaaaaatagaaattttatgatttgttaaaattattaaattacagtaaaaatatttatgaatattttgttagagctttaaacggatgaggctttatgcatgaaaaattaaagaaaaatttggaactgcaacagtgattatgtacatacatcttttgcgaatttttcttcccaaaaaaattgaaaaaattttaagcaaacataaagcatgttaattanactccgaaaatttcctanatttttcanaaaatccacaaatttttaatgaaatctgctaaaat

SEQ ID NO: 1555 - DNA, 760 bp, Heterodera glycines
aaaaaaaaaaaaggtcgtcgcccgggggggaagtgccccaccccccaagccaaaatcctgggaccgtccctgttaattacattcattttcaacgaaatatgagagaaagacacacatcagcatcatttgtcggctttttttttaaacaaaaaatttcattaacaacaatttttgtgcaacattcattagcgcaaaatgaaaaagttcacatcggaaaataatttgttatataaataattgattaaatgtaattttggaagcgaaaattataaaattcattttattttatttttgagtagtagtacaatatcattttggtacttttccgtttgggggccacacattcaaattaaaaaaaaaaaatttgacaatcaacaacaatgttgtttcatgccaagctcccgttcacaaaaaaggatggacgtattttcatgggcccaccaaagaaagggaagttgtgtgccgagcccgaaaaataaatgtaattcttcccaagttttgggttcctcgaaaaaggattttccctgacccgggatgtgattttccccaatttcccattccattttaattgcccaattccctttaaattattctccgctctttatatttccatatccttttctttgacttctccattatccaattggtctgatcgatttatttacttaaaatggaaaatggttgtgaattgaaatgtggaattggtggaggcgaaatatgataaaatgtgaattaataagagataaaacgatccgagttc

SEQ ID NO: 1556 - DNA, 5180 bp, Heterodera glycines
  misc_feature (4850)..(4850): n is a, c, g, or t
cggaaaagtacctatcattttataaatttttaaataattacaccatctcaagcagttttaccgttttgagaggagctgaaaaaatatttttttgtactcgttaatcaatgcataagataatgctaattaatttttatgatatatttgttcaattttaattcatattatttaatgcatttcatacaaaaagcaagaaactcttttatttatttttttaaaacaatgttccctttaattaaatttatttataatatttaaagcttttaatttaaataaaaaagcattaatacatagtaataaaattccttcatgtatttagcatattaaaaaaaatgcccagaatttattacttcttgccctgtaatttactttgttgaaaacgccggcaaaaataaaaaattagttgtttttttttttttgcttttgaaatttttgtttttggccaaagtcggaagaatacaaagcgttagtgaaactcccgataatcgatggttaagaattttaaagaaatgctcaacgacaactaaaacatcaacaaagtggctactttgttagagcggttggaaccaagggcgtaaaatattaattttttggcgaaaaattttgtaaaatacaccccataattcggaatttcaaaaaaaccaaaaatacaccccctaaaaatcgacttaaaaaagaaagatacatccctaaaaatcgacttaaaaaagaaagatacacccctaaaaatcgaaattttccacttacgaatgaattccataacgtagcggaattgcgtgtttttggagcaacgggcaaggtgccgttaagtcgaccccattctattacccatttgcaaattacacggacacctgtgtggttgttcattattattattattattattattattattattattattattattattattattattattattattattattattattattattattattattattattattattcaggatccatgtttcgcgcttgtgaactgtatattgtttatttctttctttgatagatttacgtagtaataaaagaaatcataaactattgagtattcggaaaaaaaacagttttcacgcctaaaatcaattaatttcattattaaaagagtaaaaatcttttaaaatttatttacaatattttttctttaaaaataatttttaagcggaatttgaaattctttaatattttcgtctttaaattcaattatttttccctatttagcatcaaaaaataagggaaatataaaaagaaaataataattctgtacatattgtcgttcctattttcgtttgatttgcctaaggaaaaaattctcaaaatttgataagcaaaatgataatttaagaaatgaatataattcttacaaaaataatttttcctataaatttttattgtaattcggctaattggttttggattttctttaatttcttcgtcttaaaattcaattatttttctcctttcacaaaataaaaatttaaattattaaaaagataaataaagagaaaattattgtatagaaaattaattctgtgttgtctttcctatttttgcttgatttagccaacgaaaattttttcaaataataatttaaggggttgaatatgtttttctgaataaattatagcaattaactgttgaaggaaagaatgatgaattcggaaggtataaaaattggtgccaaattaacattagccatacatttttttgattcatgaatttataaaataaatttcaaataaacagctttagaaatgtttaaaattttcgttttattcaacgcttttttgctgatcaaattcgcaataactgatgaggaacgagaaattcctcccggtggagaggttgaacaggatgtaaatagcgagatgattaaggtaaaggaaacaagtaattaaaagcgaattctcgagagtctcagcttcaaatcgagaaaaaaatggctcaaaatcgcaaactttggttattttttagacaaaattatttcggttgaaccccccccccccccgtccccttctgtaatggtcttttgaaccctggtctcgaattcgtctctaatttcgggctcgcgcatcgctagtgattaattgaaataatttggcaaaattccttaattaattatttttgtttaattaagacgctcgcctctcgtgcgatggacaaaatgaatcaagagtccaacaatacgctcatgtttatccctgtgaaggtgctcagtgccacatcacaacccgtagctggagtaagatatgaactgcgcattttggtcggaaagtcaaaatgcttgaaaaaggtaagtgcaaaatggggagaaattggcacaaaaatgggcaagtcggcactgtaatttttttttttgggggggggggggggaaatttctggactgacagtttaaatcggatttgtatcgagattactttttgttttccaaaagtcgtattgctcattattgggagggataaatgtgaaatttaaaaaacaaattttataaaagtaaagttaaatacaattttgatttaaaatgtagtttttaaagcagccaaaggcgaagaagtgcataaaatatgaaaaagaaactgaccgggcagcacgaaaggcatggacataattaaataaattaatacttaattacatgctaattagactaattgtatattcttcaggtctataaagtggaggtgtaccaacgagcttgggaaaactttgaggagattacattcgaacaagaaaaaattgcaaatatgacaggatgtttgggataaagttgattatcaattaccaaattggacatgttaaagtgccaccatgttgaataaaaatgttcaagttcaattcaatttacttaaatatgcgagggagagggttttgttttttccttttttaagaatttaaaaaataaaagtatttttaaaaccaaaaaacatttaaaaaaaaccacggttaaggtctcaaaaatggaaagtcaagaatttttttaaattttgttttttattttttgggtaattcaatttcgttttcatgtatggtcgagtttccttttcttaaaaaaaagtttaggccgaataaaaaaaactggggccgagaccgtgactttaaagcttgcatcgagctcagacaggattttgtaaagcagaaaaacgttggaaaattttctgatcataaaattatccattaaataacatttgttttaattgttaaattcccggctttttcccggttttcccagccaaaaagtcccggcttttcaacccaaaaaggtcccggtcccgggtttgcccaaatttcccggtcccgctgcactctagtttaaacagttatgacacaattttttttgcctgagccaatcaccaaaatctcaatatctgacagcctcagatcagtttcaaacatttgaatttgtcaccacaattttaaaaatggaaatttcaaaataattcttcgaagatgaagaatttttcctttaaatttttattgaaaatagactaaaatggttttgaattttcatctttaaattcaattatttttcccctttcaaaaaattaaatttaaattattcaaaaaagagaaaattattaaatatgaaaattaattctgtgttgtcattcctattttcgtttgattggccaataaattttttttaagataaacaaaatgataatttaacgaattgaatgtgcatgcttttttgaataaattatagcaattatctgctgaaggaaagaatgatgaattcgaaaggtataaataaaaattggtgccaaattaggcttagccattcattttttctaacaatttataaattattttccattcattctttttccaataatttataaattatattaaacaaaaatgctttagaaatgtttaaaattttcattttgttaaacgcttttttgctgatcaaattcgcaataactgatgaggaacaagaagttcacggtccaccggatgtacattatgcggatagcgagaagattgaggtaaaaaaaaagtaattaaacgcgatgctcgagaatctcagttttgagtcgagaaattcggaatctttaaaaaagcggtccgagtcgttgatttagatggccgagtcccttcgcaaaaattttggttgacccccccccctcgctttttccatgtataatctttggagctttgatctagttgtctcgtatctaatctcacgctcatctctcgagtctcgagagcttttcggtctcgagcataattagtaattaaaaataatttgacaaaattccttaattaattattttgtttaattaaggaactcgcctctcgtgccgtggaccaaatcaatcaagagaccaacaatacgttcctgtttttcccggtgaaggtgctttgtgccaaatcatctagagtagctggaataaattttgaactgcgagttttggtcggacaatcaaattgtgcgaaaaatgtaagtgcaaaacggggagaaattggcacaaaatggtgaggtcggcatatgttttacaagggggaagggctgtaatttttgggaaaatcgggagcacagaagtggaataagccgagatcaacagaccctggactgacatgttgaaaatcgggtttgtatcggagatttgcttttttaactcggatcgggaattattgggattagattctcaaaaaaaatttaaaattaccatttaaagcaaagttaaattacaataatggtagtttttaaagcagccaaaggcaaagcacacaaactgtacaacggaaactgacctgacagcacgaaaggcgcggactaattaattatttaattacatgctaattagcctaattatctattcttcaggtatatgaangtgagtgtgttgcagcaatcttcgaagaatttggagttgattaaattcaaacaagaaaaagtgggaaatgcgacagaatgttagggacaaagcgaccctaattaccaaattagccatttaaagcaaccatgtatttaataaaatttcatgttggcatccaacttccttaaaaataaaatatgcgaaggagcgggaagtcgggcatcgtttcttcaatgggtgttttggctttgccttatttaattacagcttgttttcggcatgccgattttccaattccgtctcttttgggctcggatcctaattgcgggatttgccgaaattttttag

SEQ ID NO: 1557 - DNA, 4532 bp, Heterodera glycines
ttaaatttatacaaaaatatattttatatttttatggtattttaattcgataatatgcatgatgatggagttttctgtctaaaaaaaagttggagctcagtccgcttcattggcccaagaaaacggcacttttgttcgctgcactttgagggtgtcccgggttttcgagcctccatccatccagtaatcccaaacacacacagccctttcgggtggtgccgggaatagcctgtgcgcaatttttacccggcgcacccatccgcagaattccactatttgttccccacaggaaattcggtacctccacgggtgtttattgggtttttgttgtttggtttgtggggaccctcggcaagtgcaactggccgcgatttgggcctccgcccgctccccatttcatcgctttgcctgcccacggagcgatggcctatcactgaccaaaactgagcccacgagtgtgtcctccaggcacatttcttttatatgaagaagacaatatattaaatgattattggatgggttcacatttcttttatatgaagaagacaatatattaaatgattattggatgggttttaatggagaagagagatttatagaagaattatgcattctctttttttgctctgacttcttttcctgtatctctcatgtttgtgcactcactgtctatgcacacatcgcattaaacgacaattcctttgattatttagggttaagtgattcaatttaagaaagaaagaaggacaaaaattctgatctgttaaaagtaaataaaaatttacctacctattatttttatgatgattttgcgtgattttttctttatttattcgaacaaaagtcgaaattcaaattttgtggacgttgttcaaaaattagtactactctacataccagcagtttgggtcctggttttatgtcaacatttttctctccttaatttacaaaatttgctcaaaatcgcaaaatttggtcatttttcggacaaaatctgttaacaaatcgcattgaaaattataaattttttcccggcggcgcctatcggcaccgccggccccacttgcgcccaaaagttttttgggaaaagcgccgcaaaaaaatcaacttcgtttttcatgttcagaatcccaaaaaatgcttatttctaacaaaaaaatgctcaaattgatcatggacgatcaaaaataccacaattgaacattttaaacgtgttttgaataaatttgtgaaaatgaggtttttttttgcatgccaaatgaggcttttgaaaattttcatctgcgagtcagttttttgaggttttttggccataacttttttgtgtgtcaattaaattttttgaaattttgcaggctattagggactatcaagcgctttaaaatgatatcaagcttatttaatttgaatgagaaataaaaatgttatagcgtttggcgccaaaatggctggcgccaaagtggccggttcccaaaaagaatacttcttactgtcttatgcgatgcaactctgggtacttccgtgttttgctacccccccccccccccctcgaaaaatttttaaaaaaatcatatcttggagttttcaaggtcactctgactatgaaaatggtgtttgtttttcgggcctatctatgacatctagtcatcgatttaataaaaatatctatgattttttgaaattaaatatccaactctgctagctttaaagctattaagatagtaaaacaatagccattttcccgttctagcaaaaaaatgtattcaccccccccccccctatttccattaacaattagactgaattaagctttatcaatcaaatttctcattttaaatttcgtactaaataatgtcatcgtcctcgaagcaggagaatccgattgaacggatgaagcatttgttgagctcgggcgaggacgcggacattcactttttggtgggggacggagacaaaaaagaggcgcgatttttttaaatgaaaatttcttttttttcaacgtcctattttattcagattctatcagctcacaaactgattttgaagcatgcttccgatgtttttgaggcaatgtttcgtttcgactcacagaaagaaaaaacagaaaatggtgaaaaaaaattttttgatttaattttttttttttgaatttagcctctgccgtcagtcccgtggaagtgccagatgttgagccagcagcattcaaaatcatgctcagcttcatttactcggaagatttgagtgaattgaacggagacaacgcaatggcagtgctttacacaggtgaaaattggcagcaaaaatttttttgaaaaaaaaattcctaggaggctggtaaattttttcggggaaaatgaatagcgccattcgaaacaatccgtttttttcttccaactcatttataaaagcgatgaatgtttactgaaatacctcatgtcaggcccattggcgtcattttagttaccattaattcgaaaaaacaatttttcgttccagccctatggaattagtaaaaaaaaaaaaaaaattttttttttaatcttttcgggagggagggaacgatgcgggggactgatccaggggtggggatagtgtaaccctttgacacccccccccccccccccactttcctgcgccggtctccatttttaaaattttgatatttttgaaaaaattttcgactcaaattttaggaaaatttcgatttcaaccaataagatgtttagattatttccgattgttttttagcaaaaaagtacgtcattgatcggttggtcagtccagctgtggaaattccaattgcacagctgcgcagtgttttcgaggcctttgctctgactcgtctttatgacttggaggtgacgacaacaaaaaaaaaaattttttttaacttcaaaaattaacacatttttagcatttttctcatcaatgtttgcgttacatttgtcaaaatgcagccaaattgttcaaatccgagggatttttacaaattgatcagaatttgctgtgtgaattattcgaccgtgatcagttgatgatcagcagcgaatttgaaatttggaaagctgtaatttgagaattggaatttgttgttaccaaattaattgctatttgtttgttttttctgaaggcaatccgttgggccgacgaaaagtgccgtcaaaatggcatcgaatgttccgctgagaatcgtcgcgcggcgcttggcccggcactgtttaatattcgctttcctctcatctcaccagctgtatttgcgaagcaaattggtagaaaaccaaatggggggggggcagctcgtttcctccttccgagaaatgttttaaagaaaattttaaacaaaaatttttaaagaaaaaaaaattgtcaaacattttttataagaaaatttcttttaaaaaaattcgaaaaattttaaggtgtatcacttagattttttttaatttccaaaaatggctaaagtttttagaaaagttttttcttgaaattttattctaaaaaaattcttggccgggggggggaggagaactgacccatccaaacgtcatttatcgagcatttatttccctttttgcagttccttccggcattctgtccaatgatgagtttgtcggcgtttatcaattcaatttttatccaaaaatttttcgtggtgtgcccggggggctttacccgttgaaatttcctaaactcggatttctgattggaacacagccaaaggaaacagcagcagaggcacattggcgatggaaattgagaaattttctgaatttgcacgagaggaagtgggaaatgaacggaacagtgaaatggaactgtcaataaatggactctcgtggaaaatatcggcaaaaattggaattgatgaagaaagcaatgagaaatggctgcaattttacctttcgtgcaaaggtgggcataaatttaagaatttgaccaagggcatagccaggggcatacctgtgcagggacgcgggttccgaaggggacgggacaaaaaaaaaatttcaaacaaaaatttttaagaaaaaaattttagaaaatttttttgtaagtaagttaaaaaattgaaaatttttaagcgatttttttttgaaaatttatgataaattacgaagttttttcaaaaaaaaaaaaaattttcaatgattttttatgaaattttcttatataaaattttttaagatttttttcttgaaaattttctttttaaatttttgcggcgatattttgtctcggtgatattttggggtgtacccgttccgaagtggtcttacgatcgaatttgacctaatttttttttataaacgaaagggaaaaaatcgaggttagtcgatcgtagaaaaaactggaatttttagtatccggccaaatttcaggatttttctgcctccttctcttacaatcgacgaattgtcctcataagttaaaatttggaatttttaaatgaaattagttaaaaaccaagtcaatttttcgaattccatatgagaaatttttataagaatttgcttttattttcatatgtacga

SEQ ID NO: 1558 - DNA, 796 bp, Heterodera glycines
  misc_feature (59)..(59): n is a, c, g, or t
  misc_feature (112)..(112): n is a, c, g, or t
aaaaaattagctttttttttattcaaaaatgaaatacaaaaaagtgaataatatgtctncaatattcatcatttcaatcaatcactcatcatccgtcaaataaaatatttanctaattatgcttgtttaaaatgtgatggtccgtctgaattaagaattaaagggcgaccaaatgccaacggaaggaacggcattttgttggccaacagtggcggcggcggcattaatcggcgattggcaattccgagtgagcacaccgttacactcgttgatcacgctgaccattgtttcaagcaccgtttgcaccgatggaccaccaaatccgtgcgtcagctgaaacaatttggggaaaatggtggaaatttaaagactaaaaaattttgacagagaaaaaccgagttttaatgaatttttgtgaaaatgccaaaagaaagaaaatttagcgcttaaattaatgaaaaaatagtcaaaaatcatgtttttcgggcgcaattttgaaaaagttcgggatctggattggcattatgccgcgatttgattacgggagattcaaatcctcccgattatgttggaattccgattgggcaaaaataaaattaaactttttgttattttttcgaatttggcccaccaggctgaaatgggccaatcccgcttgaacttctgggttcatgttcaggtcagcatcaaactgttcagtcggctcaagttttggctgctccgttacggtggcggggctttggtcggctttatggacgtccaaaatccgattgagaaatttgctaaatggggaaaa

SEQ ID NO: 1559 - DNA, 1365 bp, Heterodera glycines
acgcccaaattaaccaaatcatcgattgatatgcccaccataatttaatcaccacaatcatttcaatcgttttacttataaacaaaaaacgaaatgaaatgagaaagttaatttaaaataataaaaaaaatactttaacatttttagttgatcgaaaagcaaataacaaggcatataggtagatgagaagatgaccaatgatgctttgaaaaaacaacattgttgacaaacaaattaatatgaccagaatcaatatccacaaaaatagatgattgttatatgtacctatttatgttgagttcaaacatcaaataacaaagccatttaattgtttaaattatttggaatagattaaaatttaattaattcagggcttttactcatttcaccgcatttatgtacattttttttgaggcgtgcttttttcaaaaagctttttggcaatagggggtccggcggtgtcaagaaaaagaaattccggcgcggcgaaaattgttttcaaatgagtcccaatttcaaggacatccctgccattcaaggactaatgattttattattggcaaattttgacgcaccaaaatgtcccgtgccaatgtgaccttggttctacaattactacaaagtagataattaaatatatgctcctgattagaccagagtgctaacaatagagcgaccccatgatcggctgatggacatacattggtttaagagaagaaacggccctctgattaagtgagctttcgcaatgatatgagaaagcatataagcaacaatgggaagaaagaaaagcacgggaagtggacggatggtggagagagagggttaatgattttgaaatagcaactaaatcaaatttgtcacgtgttaaaaaactgattgcttacatatgtactagaaggaacggaaaagagaatttattcttgtctacttgattttgtcgaataaattgcagtttaaaggaatttgtacatgtaaaaaaccaaaaaccgaggtaattataagggggggggggaggagggaaaccgaaatgaatcattagagagagagagagagagtagaggcattgcattgacaataaaagatacacaaacattccgcaatgatcgaaaaccaactacaaaaaggcacaaagtaaagtaactataaacaaaagaatcaaagaccatcatagtcattgtacctcttccttttctgtacctcatcttttctctgttctggactgaatcccgaccccaccattccaaggtgtttctgatactaaatgccgagtctccaaattacaaatcctcgaagtgcgggtccccaaaagtcgggtagccgtcagagaattgtgtctaacgaaactcaaatgatatcaagaat

SEQ ID NO: 1560 - DNA, 4635 bp, Heterodera glycines
tgacccaagacaaggtgtggtcgacaagaagggagtgtgcatgacttgtgccggaactgtgaatgattgtccgggtcattttgctcgtttggagttggctaagcctgtgtttcacattggttttttctccaaaatcctcaaggttgcttttaaaattctctttgcaatttgatttattttaattgcattttcttcagattcttcgctgtgtctgtttctcctgcagccgtttgcttgttgacaaagatgacccacacattaaggaaattttaaagaaaacctcgcacaattttcgttctcgacttggtcttgtgtatgaacaatgtaaaaagaaaggaatttgcgaaggtgcggaagaattgccaccgaacccggacgaatttgaggaaggggagaaagagcaaaaggcggggggctgtgggcgttatcagccttcatatcgaaggaaagagatcgaaattcatgccgaatggaaaaaacacgtcaatgatgacacgcaggagaggaaaatcattttgacggcggagcgcatccttgagatatttaaagcgatttccgacgaggattgtctcgttctgggcaagttttcaagttatctgagcaaaattctaatcagcaaagtttttagggcttaatcccaaattttcgcgaccggattggatgatttgccaggttctgcctgtccctcctctgacagttcgtccatcagttacgactttcggttcaataaccagtcaagatgacctgacttataaattatccgacattgtgaaggtgaacaaccaactcaaaaggtaacacttccgtaaattgatgcgtttcttcaattcgaacattggtttagaaatgaggctaatggagcagctgcccatgtaattgcagaggacattaaacttctccaatatcatgtcgccacactcgtcgacaataatgtcccgggtgttacacaagtaatttactcgacttctcctcacattcttctaagaacaaatttaggcactgcaaaaaagtggccgtcctttaaaatcaattaaaagcagacttaaagggaaggaggggcgaattcgtggaaatttgatggggaaacgagttgatttttctgcgcgaacagtcataacgccagacccgaaccttccaattgacactatcggagtgccaaggacaatcgcacaaaatctaacttttcctgaaattgtcaccggactcaatatcgaaaggcataattcttattgttagcacttaaactaactgtgacttcagattgcaaactctcgtggcaaggggcgaccgagaatatccgggagcgaaatatatcatccgcgataatggagaccggattgatttgcgttttcatccgcgatccgctgatttgcatttgcagcctggctacaaggttgaacgacatatgaccgatggggacataatcgtgttcaacagacagccaactctacacaaaatgtcaatgatgggacatcgtgttaaggcatgactgttttatttgcaattgttattttggattattacgatagatcttaccttggtcgacttttcgtatgaatttgtccgtcacaaccccttacaatgctgattttgacggagatgaaatgaatttgcaccttccgcaatcactggagacacgggcagaaataaacgaaattgcgatggtttttattaatttaaagcaccaaatataacccttaccttttctctaaaaaggcatctcgacagttaattacgccacaggccaacaagccagtgatgggaattgtgcaggacacattgaccgcagttcgaatgatgactaaacgcgacgtttttattgattacgctcgtctcatggatttgttgatgcatttgccaaattgggatggaaaaattccgcagccagcgataatcaaacccaagccactttggaccggaaaacaagtgtttacaaagataattccaggttttgtcaaatgaaacttttcctccattctttgttttgttctaactaaggcagtgtcaatgttatccgaacacattcgacccatccggacgacgaagacagcggaccatacaaatggatttcccctggcgacaccaaagtgctcattgagaacagcgaacttctctctgggataatttgttccaaaactgttggcagaggttccggaaaccttcttcacattgtcgcattagaattgggtcatcaaattgctgccgagttatatgccaacatacaaactgttataaacgcatggcttctcgccgagggacacaccattggaattggtttccaattttactttacaataattttgttcaactctcaggtgacacaattgctgatacttccacctacagagatatccaggagaccataagaaaggccaaacaggatgtcattgatgttatcgagaaagctcacaacgatgatctcgagccgactcccgggaacacacttcgacagactttcgaaaaccatgtcaaccgaattctcaatgatgctcgagatagaaccggagcttcggcacaaaaatctttgtcggatgcgaataattttaaggcgatggtcgttgcgggatcaaaaggatccaaaatcaacatttcccaggtcgctcaatacaaaagtgttttttattgttaatttaatcattcaaggtgattgcctgtgtcggtcagcaaaatgttgaaggaaaacgaattccatttggatttcggcacagaacccttcctcattttattaaagatgattacggacctggtaactctaaacagtactttcgttaggttttgccatttatttacagaatcgaaagggttcgtcgaaaactcttacctcgccggactaacaccggctgagttctttttccatgcaatgggaggtcgtgaaggactgatcgacacagctgtcaaaactgcggaaacgggctacatccaaagacgtttaatcaaggcaatggaaagcgtgatggtcaattacgatggcactgttcggaattcgtctgggtatacagttttcctttattttttaataaaggaaatgctacaaatagggctgttattcaattacgttacggcgaagatggactggatggcatgtgggtggaagaccaaaccgttccaacgcacaagccgaacaacaatttattcgaaaacgagttcaaattggacctcaccgacgaacgacaactgcggaaattatacacagaaaacattgtcaaagaaattactgtaagtaactacaaaaaatcatttcacttatatgactaaatccaagaattctgccgatgctcttcactcggttgagtcggaatggcgaaagttggaggaggacaggaacattttacgttcaatatttcctagaccaagcacgaaagtctatttgccttgcaatttgaacagattaatcaaaaatgcgcaaaaaatctttcatgtttccatgaataaaccagttgatttggtgagttccccaatatttttggcatgtccttttctttatcttccacagagtcctgtccgagtaatcgaaggggtcaccgaattaaccaaaaaactggtcatcgtgtctggagaggattctattagcattcaagcccaacataatgccacactgttgatgaacattttattgcgttcaacactttgtgcaaaacaaatggccaaataccataaattgaatcttgaggcatttgaatggcttcttggcgagatcgaaactcgctttgaccaggcgatttggtgctggtattccatatttatgttttatcgtttaaggctattgcacaaccaggcgaaatggttggcgcattagcggcacaaagtttgggggaaccggccactcagatgacactgaacacttttcactatgccggtgtttctgcaaagaatgttaccctcggtgttccccggctcaaagaaataataaacgtgtcgaaaaagccgaaaacgccttcgttgactgtttttctgaaggtttttgcaaatcggttttacactcatttaattgattggaattttatagggaatagctgccaaagacgcggaaaaggcgaaagatgtgttgtgcaaattggaacacacgacgatgaggaaagtgacttctaacacagcaatttactacgacccggacccacgcaacacatgcattgaagaggaccaggaatgggtcaacattttctacgaaatgccagactttgacccaaccaacgccagtccttggcttcttcgccttgagctagacagaaaaagaatgacggacaagaagctgagcatggaggcaattgcggagaaaataaaccattcgttcaaagacgatttgcaagttatttacaccgatgacaatgcggacaaactcgtgttccatctccggctgagcactcaatcttccgataaagaaggagaggtttgaaatatagtcaattatagtgtgatatattaaaaaaggagtattaggaacaacttgacaagatggaagacgacggcattttgagggcactcgaacagaatattttgagcgatttgacacttcagggcattgagtccattgctaaagtgtatatggtatatgcgaaaacattagaaatcgacttaatcgttaactgattaagcacaaaccaaccaccgatgacaagaaacgaatacatattacag

SEQ ID NO: 1561 - DNA, 1553 bp, Heterodera glycines
cagagagaagccgtcgttgtgtaattgcgtgcagagggaacaacgcatggatgggctcaattgtcaggtatttgcaatggaaatacacaactgataggttgggtgtcagaagcggcggaagagactgaagaggacggcgaaggaatggccgtggcacagcgaatgggcgcttcgaccgttctttctgcgagaggacctaagccacaacactcaaaacacttgctgttcaaacatttgcgagacgtcacagtgggacatcaccaggtagtgccgtcgtattgcacttgttcccgccgccctgttgcaatcagtatcatttactctttttcagggacaaatatccgccgtcaaattccatccaatcaaacctgttttggtgacggccaatgtttctggcaacatttcgttgttcgaagtgagtttaaaacagggcacgtgggcaaaataaagtatacggtgcaataatcttggcccctcatttccactattctatttttaggtgtgtaaagacaatacaaatttgaatctgaagagcaaagactcctttctccaaagcgtgcatttcccacgttttcgtcttgaaaatttcgacttttttgatgatggcaattctattttggcaagttctgcgaatcaggtgatggatgaattaatgacgtgctctgaattttgctttttttatttagaatcatctttacacttatggtatggcagtcacccttccgcttttttttctttttcagatcttttaactggcaaagtggcattggtccgtcaaccgataggtccgttgttgaactcaccgttggaaacattttaattccgtgccttttttagtacttgactcccttcggatgcgaatggcccgtctctccggcgatggttcgcttatcggaatgttggccaattcttccgacattttcgttttcgacttcaaagtttttaaattaaatttctataatttaaaactcattagcattaaaatcgcagtcagcaaattttccaaaatgacttctataaaaccgaataagattagactgcacatttaaatttcagacgatggaacatttgcacacttttcgtggtggcgagaacgtcgtcgacttttgttttgctccatttaatagacagattttgtattccctggcaggtgccattttgttttatttctttactttttcgtcattcgttcagtcggtggtgctgtgaacactttcgacttggccaggtgcactggccaggacacattcttcgaccagggctgtgtccgtgccacgtgtctttcgtgcagtccttcgggccaattcatcgcctgcgggtgcgtccgcttggaaactcgggacatttttgtgttaaattaaaccccatttacttttagttctaacacgggaattgtcaatgtttacgacctgacaaaactctctccgagtttggccaagtcgaatgcaccaagaccagtacggatgttcgaccagctgaccactttggtgtcattcgttcgctttaacaacgactcgcaaatgttgggatttggtactgcagtgccggtattt

SEQ ID NO: 1562 - DNA, 3440 bp, Heterodera glycines
  misc_feature (3428)..(3429): n is a, c, g, or t
ggggagtcgacccgactcctgggggaggggggggggttgaaatttgccaagtccctgctttggctccttgctcaggtaaatccacaactttttttgctcttcaaacctttcttgatgcgaatgagccccgggggcatatgtcttggtatcttttatggtatagaaaattcgatcacacaaatacgaaaagtatgaatttcatgtgaaacaaaatgacgtaagaattgtttacagtgggtcgctcccccatttgtccattctcacacaagtcctctcttctttttgtattcttccaatgtgagtgtccgcgagctgctcgtcttctgttgtgttcgtggtgcctgtgagtcggtaattggcggcgctctcaacgaaccgccgacgacggctaaatgtttaaagtcatatccaaaagaaacaacgattaagctcaccgggcatttttatgtcaatatttatgtcgattccatgtgcgttgaataaatcgtgagttgagggaagttgcacttttttgtttggagaggactccgacgaagacgacaacgaacccaacgaagaaaccatcgtgtccataacggataactcggcattggctagagccaaaggtattgtaaagaaggaaaagggatatcccaacactaccgccacttccttcgccggcggttttggacttcacggatcccgagaccactttcatccgcgccgacttccgtgtgaatgggtcgtcgtccttctcctgctcttcccgcaccattccggcaccaaggaatgtttgtttcatatggtccctattccgctggttgatggcactgatggcacttaagttcttcgttctttggtgttcctcaaaaataaccatttgtgtattaacacgggaattccttccaatcacaattttcttggccttctcttccaattcgttgacttgctgctgcaagtcgcgcaccctcgcgacatcgccgctttgttctgcttgctcctaaaacaattttttgtttttattatttctttgatttgtatcattttttaacgaaatgcccatcaatgacctaaatagtgaaaagatatcaatcttcccactaatcgtcggctgacaaacattccaatgcaaaatggataaaggggatgaaggagatgagggggggggggcacttctcacataccatcacatttcttcttctgttaacaatgcatacggcaaaacaaagtcaaattaaataggagcaggaaaacagttaggcaaacaaaagcatttgaaaaagtcgagaggaaagggaggggggggagcggtaagttcactcgccacccgccccccagcaatggcgcgttgttagtcaaccgcagcatttctttcccattccaatgtgaatatagcgcggcgatctctcaaaagtacccactgcaaaatccacacactaatcgatggatggtccacgcaattcaaccaaacacagaaatattgcacattttcaccggatattttgccaaagaaaataaccgcagcaacgagattaaaatcctccagccaactgaccacaaattttgttatagatcagtcctttcactaaaaatacgttaacaaactgttggcatttcacagtatcacccatttttcgcattttgttaaataggcaataacaatttcccgtttttatagggaaacaagttaacgagcgctacacaaatccaaaggcaatcccgcctcagtcatcatcaatcattttaaagcatcgacagacaaattataaaccaaaaaatgctaaattcgggggatgaggaaatcgaaagcacgaaagaagaaaaaccgaaaatcgtagtgaaacagtcaaatgggtgggttcgtttgaaaattgaacaaacattcggtcgcaacattaagacaagaattaccgcatcatcaaactcctcagacgaaaataaaacactcagaaaaacatccccaaactaaatgctttggcagaatgaacgccaaagtgaaatttattcccgagtcacgaaaggggcagctcaacacacaatatctggccactctcccaggacttctcaaaatcgtggaattggttgacgaaatggccctaaatgtattcttgtcccatttttcagattctgggcttcgtcgcgtttattcttgcaatttgtgccagacgctcaacaaactccgcctgggtagaacacatcacttttgagacgacaattgttgtctccgttttgatcattctctacgtggtttttccacatttgacttttgctgacgaacgcacgcgcgaaggactcattgtcgtggtacgctccgaatgtgttagtgttctaatagaacacaaatttggcaggaaatgttcttttatggaataaacacactcttctttttcattggggttggtcagctaaaacctattttattaacattttgtattcagatttggctaatggttcatttgagtgcgagttttacggctgaaggacgaggagcggccattttgggatcggttggttgagcaaaaacatttgagcaaattctgattttccagattttatgcttggcactctgtgttatttatgcgggagaagcctatataaaattcaaagtgtggacaaatcccgcgggaaaagtgcaacaatcaaaaagccaagcgcagggacacaaccaagtgccaccagcaccgacgcattacgaagagaaaacaatccgacgaaatgaaatggaggaaagggcagtcgtatgaaaggcaacggacgaactttctttcctcttcactcactaaccaatattattattaaactcacaaaacaatttgtaataataaaaaaccgcaaaaacattggcccaccttcattctgagcaattccgatttttgaaaggcgaaattggtcggttgtcttttgaagcgctgcttttctttgatcagcaaattgatctccgcctcattgtatttgtagttgagtgcgtccacaatttccttccttttccggtcaacaaagtcgacggttagcatgggcgtgttctgtttttataaatattatccagaaaaacccagagacttataagctagaatgatgcaaaaaaatatttgggaatttttttaatctataagcaattttgctaacaacaaaaaccagcaatgttgaaaatttttgggggtgcaaaaagaactagcgcaatgttattataaacaaaaatagtggaacggtcgaaattcaccgaagaccgcattttgttgaaccaaaacagaaactcgctttccataataagactgttggagacgaactccaaccgatagactcgcattggctcgccatcgctcacctaaaaaaacgaaaatggcataataaaggctaaagttggtttatttttgggtgaattgtgttcacttgccattaccttgaggcgaaagactttgtttgtacggatgtcccactgttcggctcgnnacttcggactc

SEQ ID NO: 1563 - DNA, 3705 bp, Heterodera glycines
atttggtcatccgattaataactcttgttttaacttagggccgtaggctcattaacaatttaagccatggatatatttgttttttgtgatcaattctctaccatagaccatacgatcggttacatgcgtaaccttatgctcaagacaaacatagatgaaagaaaaaaaatttaaaaatttttttttaaatgttcgaatccgggttcggggttcagaatcggtcaaaaataaggtcggattcgtgctcagcacagtaaaatagccctagaaaaatttttcaattatttttaaagaaaaaaaaaacgggaccagtaaactccatgattgcccaatatctgctcgttcggcgcaccaaccttcctctgcttcggatgccgagtccttctcgtcgctttcatcgtctccgtttgattcgtcggacatttttcgttttcgctttttttgccttgcggcaacttctccgtctgcctttttcccagcagccatttcgagtttcttttttattttctctctgaaaagcattggcgatgatttatatttttaaaaattgtttcttaaaacttgtgtggaattattccccctttcccaacctcgtcttcatgatttcacgctgctcgagtcgcttgtaaatttcaatttctcgctccttttcagtcattttgtcgaatttttctcgctcttcgtcatccatgagcaggtcataatcctcatcctgttaatggtttaaatatatgattattattaattgaaaagaatcaccttctgattcgggtcgaattcttcttctgatgaagaaactttttgccttttatttgtcttcatctttttggcttaaaagaagaaagaagatgcaatcgttaggcaattgttaagcgaataaaaattgaaaaacacgcaaacggtaaaaaacatgtaacagtcagtgagtgaaatttggggtcgaaaaccaaaacattcgcgatttacaatttatcctatcaaaaatgtatcaattatttttcgcctcccattatcgattttaacaattttggggaggaaataagcaaataatatatttaagtggaatcgggctcaaaaaatcagatttttatgaattttttgcggcacttttcccctaaaaaaacttttgggaaatgggcgagggagtgggtccggcgttgccgataggcagcgtcggggaaaattttgaaaatttgagtgcaatttgttaacagattttgcctaaagaattgttttgtctaattttacgattctggacgatttttttaagaaaatcaaggatttagggtccggcagtgccgataggcgcagccgaaatttttttttgaaattttagatagtttttaaacagattttgcctaaaaattcagagtgagcacaaatgggaaaaagtcctttaagatctgtttctcttcgcaagctaaaataattatatcttttcaaaaaataaagatttttaaccttttatttcttgtattagcaaataaatgttgagggaaactgagcccatttccatcaaaattgtcgaggcggtaatgtacgggtgggctttaatgtaggtgcctatacgtgataaagccactgtcaaacgagctaaagccgaaactgccctttgtttccgatgtctctgtttgttcgaactatgagtatttggtagcaacagaattataattgtcaaaaaaagaaattttttcattttctagaaaatatattcataattcgtaaagcaatgacaaaaacgggagaagagaattgtgccagccgtcgcgtcagctaattgaacattgtttttgagaagccgccgaacgaacgaacgagagcggggggggggaagggaattatttgtgccagcctacaaattcgtttttgcttgttccacttaggacaggcaattaatcgtagattgaagaccgggaaacttagccactattacacaacaaataatgaatacaaaatcttggttcggagtttggctgcgctctcttttctggaggaaattcgagttgtgccagctttttacttgcttcgacaacgagcgactaaagcagacgtaatttttctaattttgtggcttagaattaaattttttaatttttttttgttttattgaaatccccaaatgtcgggtccctaaatgtcgggttgccaaatgtccgtggttttcttaagtgtcttttgctcaaatgtcgttcggtctccaaatgtcgggtccccaaatgtcgggatccccaaaagtcgggtccccaaatgtcgggatccccaaatgtcgggatccctaagtgtcggatccccaaatgtcgggatccccaaatgtcaggatccctaagtgtcggatccccaaaagtcgggtccccaagttgcaaatccccaaaagtcgggtagcccaaaattgggccgctgtgtatatgatccccctaattttgcgtcaattaaatttgttatacaatatgccacataatttcaaaattaagagtttgtttaagaaatcagaactaaatttggtcactaccctcaaattagaacatttctgtgaaatcacaacaaatcacataggcattgactaagtaaaaaaaaaatatggcctaggaaacaaaggaagtcactgattggacgcgtaaactttgaatggacaactggaatagagcagtttcttttttgtcgaacagtacgaatcggcaaattggagcagtacgaatgcttaaggatgtctgtacgttatttgcgtgcagatggtgatcagtttcttagttgctaaagacaatcaaacctcgtgtgacaaaatctctcttgagaaacttaaaacttgatgaaagtctagtaaaaaaacttaaacgctttaccaattttattaatgttttgctcttattttctttattttgttctcttcatccattcattgtccttcttccttttgcattcgcttagttaccattatcccgtctttcccccccccccccccattcatcgttcatcctttagccatccctttcattgtctttgttcgtttacatgaacattgagacgaagaaaagcaataggcgtgtgaagaatcgacgaaagcgctatggaaatggaaaacaatcgttttaccagctgacaacaataaacgaagagtcactggccgacgagaagtggcggagagagaggaagcggtcagttggttggataggagaaccgaacagtgagtgctgtggacagcgcacgccctaacaatgattggtctttcggcttaccgcgacagcatcagttgttatggagcaccatcaccactgtcaaaccgatagcagcagagatcaactgttagcacttatcctcgtagcaatgattgcatctcattcctttaaattaaactaaaaaagaaaacaacaaagttttggctgtttggaatttgaaaaacgtcgtgggtggtaagtggcctttcctttccgcagtgcttactttacataaacactttctccttacacccaccgctctgtccgttatttttcatttcccaaccgcaattatttcactccgcactttctctccatcacttctttcctttggttcgtagatagaatcgtcattttaaatcgattaaataaattcctccatgggaaggataatgttggggaatggaatgcgatgtttcttccagtagactaatcggtgctgcacacttatcgtcgcccaggatcttgttgtaatcgttgttgaccatttgca

SEQ ID NO: 1564 - DNA, 1023 bp, Heterodera glycines
atccccgctcaaccggggcacacccccctccccccccgggctgagaccctaattttgattttccaatataaattcaattagtcaaaaagaaatattttgattttatatagcatttttaaaaaagaaaccatacattaaaagagggggggggggtggggggtcggttcccccactcagctatgtacatctacgacctttttttgcttttcagactgcgataaataggtttgactttgttcttgggtttagactgtaacccatcaataacccatcaagggcgttcgaacaaacctaatttgtccgggtttgtccgttttaaaggattaaaaatgcctcattttcttcatttttttacattttaatcggttcaaaaactggtttagcttgttgcgcatacttttttttttgattttcaattggtttcagcaccaaagaaaatctataaatatgcttttgtgagtttttgctctgggccttcaaatacatattttcccagaccgtttttttgcggcgtgcttttcccaaataaatttttttttttttttttggtgagcagggtgtccggcggtgccaataggcacctacagggaacattttttaattttaatgtactgtattttgtttaaaaaaatttgttttcgcgatgaggagtctgacccgctcccgcaaaaataccgctgcattaaaaaaaagcaggagcggagctctcgcaaaatcccacgagagtcggctctcaaacgcttaacaaaacataaattttgataaaatctatgaacctatgtttatagaggtggaaaattatttgaattgttatgggtgctgcaacatttgcgcccctacatttgcgccgcgattgttaacaaaaaaatttattcataaaattgccttttccaaaggctaacgggagattaactcatcccgatttcgttggtactcttcttcatctttgattcgactaataaacttttaattgtttttctgttttggtattttatggtaaaataacgttgcccaaggtggatt

SEQ ID NO: 1565 - DNA, 2594 bp, Heterodera glycines
tgaataagttccttccgggaactttgaaatccagtgaccatttaacacagcgtttgatttggctgctttaggcatttaaatatataaagaaattttctaaatgcttaagaaacgtaaagtagtcaatttttagggtgcattttcagattttcttgtattttttttgcgatttttctcaaaaatgccaaaatatgtgcaaaatatgtgccaaaaccccgaaatatgtgccatatgtttttatgtgccaaaatgccaaaatatgtgtttttatgtttttataactcgctctaaatcaaaaattgttcggagaaaatgctatttttgggcttctctcgccataactaagccgcaaaaaaatatgttaaaacataaaaatcccagccctagtcatatattatcagggacagaatcatgcattccaagtttctggcacaaataaagcagatcgtcgatttacatttccatcaacactatgagatatgtactgtaaaaaacaccagaacaatttaaaaacataatctacgatgtaaagtaatcaaagattggttgcgcttgtataggtgcattatttctgagaatttaataaccctctttcaatgaaaagtgaaaattcaaaggcggaccttggcattttgatgctttatgcggtcaaaggagaaggaaaacaagaattgtttgcttgtgcatgatgattttttgataaaatcactccgttagcccttgggaaaggtaatttcatgaataaattttttattcacaattgggcgcaaatgtaggggcgcaaatgttcggggcgcaattgtaggggcgcaaatgttcggggcgcaaatgtccagtcaccttgttatgtagaaatatggttgcaattattcatttgctttttccattcgattgattgaacttatgtaagatgaaatgtacaatatataaataataactctttatcgaatgttttcctgtttatgtttctgttaaatcattttctctttctccgtttgtttgttgtcccccattttcgttttccccgtaacgtaaaatgagaacccgcttttacggggattcccttttttgcccccacccccttgccctccccgtccggtgtcatcgccccgtggacaatcgctgtttcacattcatagaataatattatgcactatctaacttttgaatgactcttaaacactgtttacctctttttatccgaatcacataaaaaaggatccgttcataaatcaatattccctttacaattatgcttaagcattaagcccctcacacacaaaaaatttatgattcacaaaagtatattttcattttaattgcttcgtcataccgccaaaaatggaagccattgttttatatttttattgatctctttctttttatgtattgtaaaatgaacttgtgacttgtgaaccttgttttggatcaatttagaattgcgcgcgctcccattaaacatgctaaattccactttaatgcttcagactaactcttctctccttgacggcaaaaatagagagatcaaagaggtgttttttgacattggtccacaatttaacatttctttaatcttccagcttaaatcacagcttaatcgatcaaaagagacgaataaaatgatgggtcaaaacataatagtgaggagtttcatcttgtctctttttactcagtgaaaatgacccactttcagcatttgcaacagcaagtccatctgttgacacaaaaattagaagacgaagagaaacgagcaaacattttggccaaaacttatggagacacccagaagaaattagcccgttcggaagttagacttcgccacgttcagcggactgttcaggaattggaagcggtccaaatgcaatttcgaattgccgtcccttcctttttgtaatgatagattttcaggataattttgagcttaacaacgaattggaaagatggcgcaacatgaagcagtcgtcggtgacattggacgatggccttgaagtgtgggataatgacgaagagaacaagacggaggacgaagaagaaatgagagagttggaggagcagggcaaaggcaagacggagcaggaggacgaacacatggaattgcttcaacgtgaaattgacaaccttttggtagcaattggaaatgcatctctattttcgcaaattcaaatgaaccatttcctcaagacggactcgggcactttctcttcgcgcagttgcgataccaacggtgtcaactactgcgatcaaaacaacggcaccactgtcgaggaaagtggatcggcgataggccctttcgacatctttggcggcttttctccttttatcaaagcgtcactgtcgcgcagccaaagcgaatcgaagccgacgaattcttttggcagtctcgctattaaacctccgactttggcaaacactcattgtcagttcaactacaacaagtgagtttaacagttaataatttcgttttattcacaatgagtagattaacattctcaaaatgtagctcttgcttatttttgccatttaatagcattttggcaacacttggcaatggcattgattatcatcgtcagaacagtggaacagatgaagggact

SEQ ID NO: 1566 - DNA, 4986 bp, Heterodera glycines
ggattgtcaaaacagcccggccgggttcatattttcagaaccaacggtactcgggccggcctctaaaatcagtcaaaccgaatttttcctaaaatcgccttgccggtccatgctatatacaaatgtgcatcttctgtgcaaaccatttaatctttgattgtaacaggggtatccaatgaaaatgcgatgaaaaagcattccctcccccttttgctaaaggaatacctccctccctctcctattgagatgaactcaccaaaaaatgtatcatgctagaatcaaatttattgcattttgtttaaacaataatctgttttttgcaggcaacttcgcatgataatgccacaaccttcggtggtgtccaaaaagaattcaccgacttcacagaatgatgtaaaacttaacatttaagcagtgtgtttggcaacccaaaatttgatttgcttgcagaaacgaatggataaattggaaaatggtgagacgaacacatcatcattgtgtggggatgaagaggagaaacctgcaaagaattaccttcacaagacccaaatttgtcttttttggaaggcatatgtaagtggaaaaagtcggactaaatgtcgtaacggcgtcaactgcaactttgcgcatggggagaaggagctgaagaaattggaccccttctactttaagactgaactttgcgaggtcggtggtcaaacgttcggctaaaatattttttccattttccagttttggaatttggacgaaccgtgcccttacggcgacgggtgcaatttcgcacatggaccagatgagttgcgtcagatgggagtcaaaggtccctttccattgcgcttttccaaatttgatttattcgacccgtcaaatttccaaaaggtccgaagtctgttgctaaagcgccgtctttctacaataatcgtcaacgtctgcgtaagacgcgcaccaaaactcagactattcagccactcgcgagctatgggaaaccggtagaacagaaagtcacaattattaatggacattgataaattattaatatgcgacctaatgaggcgacgttcgtttgtattttgtatacatgtgtatgcttttgttcgttatttacttgactgtatttcgtattaactctaatgacgtaacgatcaaaatctgtcatcattcatcacaagcagtttggttcagtaaacctttgccatataaatattgatatctgagtttctgatgtattttgattgaatttatttattggggtactgtggagtacagtttattaatggaatagtcttaaaatgggggttttgtaccataaatacgtttatttcttggccattgtcctgttggcatcaaacatcgtcgtccatccgttttttgtttcgttcttcgtgcccatccgtccttcgcctcaagcaatcattcattcgaagatcgatccccccccccccccccgttgcttcggaatgttttcatctgccgccatcccttcccatcaggcaaatgaacatttgttgctgcttggaaattggaagagctgtaactttggcagagagcaagcaatcattttgcagaaaagaagagccaatccgcgattgttagcccaaacattggcacgcataagccgaacattcaaatagaaaacaaattaaatgccctttttggagtgccgcctttcaaatcggtgtgcccaaaacaatcaattgccccgtcggtctcttggaattcattgtgcgggcaaaggcgacgtttgcttcttccttcacctttcctctgttgccccgagaatgaatgtgcaaaggatgaatcaatgtcagcgctatgaagcccccccccccgaggcttataacccccgggggaaagggtgggagaaggagtgaatgaattgggtggggggggagagcaagcaaaacgttctttttgaggggggggggcagaataatgcgaaaatgaaaaaaggagacggacggatgtttggcttagtgatcggagggaataaataaaaccaattcacggcttcgcttcgctttgattgggctgagccgtgccctcatccgccgccgccctttggccgcccaatgtttggcggaaaaaacattgccttttcacgtccttttacatattgttgaaatgttttttattttaaggtgaatcgaatgaaaacctttttatcaatttgcttcgcttccatcctaaaaaatgcttttcctgtaaaaatttacaaaatcagtacaaacgatcaatagtcaattataagtaattattattattctttgcccactcatcagacgaccgaattattccttatcgaacaaaagtcaacaacactcaccacaagaaatacttgttgtgctttcgggaagaataattaggtaattaattcacaaattataacaaatgattatgagtgattaaatttgaattgattttttaattaattgaatttaaattctaatttaaataatgaaattatgtgacttaaagaaagttccataaattataatctgttgcagaggtcgtttcttctttcactttgcacttttacttccgtccgatgcattgggtcacatcaaattaagcgtggcatttcgcgtcacttaacaaccgacacacagtaattcattgctaacaacgacaacataatacggtactttttctgtaaggtgactaatagtgcaattgccgtccaattaagcaaattaatccactgaaaaatgggcaacaatcatgccaatgccgcggtgatgacaatgtcaagcggaggggacagtcggcacggctcctcccggggacggggcggcggccaataccatttgagccatccatcgacccatcatttggtggtacacacaaacggtgggcaaagagtgaaggaatgaacagaaatgacaaaaatattaaaataaatcattaaaataaataatattacttaattactaatgccttttttattttgaaaagtgtgtttttgaatttattatttaatataaataaaaatgcaaaagaattggaaaacaaataaaatccaatttttattcgcatttattatacaattttaaaagcttcttttgttttgaatttgcgcgactgtcctccctccgttttttcactttttccattttcttttgccactttgagtgccctccggcatttttttccgcaaaattcaaaatggtctttttcctttttcacttagctcgccttttctcaccacattttgcccttttcgactgcttatcgcagccgcagttggcaaaatgacacaaaatcgataaaaagtcgacttggccaaaccgcagcttcttatcattttcagatttgttaaaggctttccttttctttcgtttcttttttaataattaagatggcttataaaaagttagacagacaatttattgaaaaaatcctatttttcgaaaatgctttttgcatttcctgggtcattatcgaatgtgaatgactgacattatttaattttcatttgccataatttccatttattaactgataattaaatttggctgatttgataaggtaaaatcaattaaagtgatcattttatttggttttccatttcattctaaaggtttctcactttatttggtcataatcattagggaccggatttatatggacaaaaaaatccaaaaagcagaaattagtaaatgtttgcaaaaaattattttttacacgaattttgctgatgaaaaattttttgcacaatttttggtagtttctccaaaatttttcgattttagggcgtattttccaaaaatttaccatctttaggggtgtatttttcgaattttttgtcaaaatgacgaaatatggatgtaaaatatggaaatatggacaaaaatatgaaatatggaaaaatatggaagtaaaaaagcatcctagaagcatcaaaccaggctaaaaatactatttacgtggtttttaggccgaaatgagtgtgcaaaaaaaaaatatggaaatccatacaaatccggtccctaataatcataagtaagcgcattttgccatttcttaatttgcacaaattaaaagatttaattccctaccaaattcattcgttttttgttttttctttatttaatatgggtcgattcttttcttcattcgcaatttcaaagtaattttgccttctccataagtcatcagtccagtcccactttctttctcttttctcttcgctttcgtctcaaagtgccgccgacccaatcaaatttaacggactttaagtaaaaaggaagtaatttgaattggcactggcaaagaaggcagaggaatgagtgtcttcacagattcccccgtcgtttgggttttttcgctctttcagcggacaattcgttgagttcataaagcattaaaaaattttgggattataattttcatttcattatttttatttttcatttaaatttcaaattttgggtgtcttccctttgcacatcattaagcattgttttttcatcggcaactttagtccatcaaagggatagccttcaaagtctcccgcccctcccaccacttcacaattaaggcccgctttcgtaaatttcaataacaaatttgacagctctcggctccttccatgccgtcgtctctgcttccggttcgcctttccacagacaaattgaaagagagaaaaaggagagtgagagagagagagtgagagatgagagagagaggagagagagagagatggcgagagagagtgagaagagacgaagagaaaaagcgcccatcgtacagaaaatggcatttgcccaccggctgtcactttctttcccatttgtgccagctattatgccgaccattgtttgtgtatgatctctgcgtcatccccgcctctctgcttcccattatctttctctttttcgagttgtctggtaagcaacaattggctgtctctgcttcttcccaacgctctctctttccttccgctttttctcctcaaaatgccaatgcaatccttgtccccccccccgt

SEQ ID NO: 1567 - DNA, 2669 bp, Heterodera glycines
  misc_feature (111)..(111): n is a, c, g, or t
  misc_feature (2621)..(2621): n is a, c, g, or t
ttcccatcaaaatcacttcgtttcattcattatcattatcattatcattggcattgccactgtctttgttaataatttctgccaaaaattgggtctaattcgtttttaatntaatttgtaaataatatttaaatatcatcaaaaacagaactttttctttgtttcttttccttttctctcctccatatataaaatatgcaaattcagtttaagtgcttattcaaattatttttccatttttgtccatttttatttccctaaaatcccaatttagaaacactgtttttatacatataacattaatattttctccatatttttttattgttattaatttttaatcaaaatatatcaattaaaattaagtttatttaaaaaaactttacattgatttttagagcttttttcaaatcctcaaccatttaatgaatggtctctctcggtcacttgctcttatttgttaggcctttcttccctttcccattttttatccttttgcttctcctctcccttggcttttcctccattccttccgtttttgcttccattttctgattcattaatcctgcggtgccgatagaggaagctaggaaaattataaaaatcttaggtaaaatcccgaaatatggcaaacccataaaactgcaaaaaatttattcgctaatccaaaatatggcaacttctattacctttttcatatgtatgctaaccaccgttcccccggcttttgctccgtcccctatttttgctttccccgcctttttccctgattattcatccgtttgctctaacaaaaattggtggggaaaggcaatttgcttctcaattttaaccctttgcatggaatggcaacaaaaacgaaggacaaaccaacagaaaattgcactcattttattgtcatttcaatttcaaattaaaattgccttttttggctgtcgcgtcacttaaaaaatattagaaaatccaataaaatttaaaatttcccgtacaacaatgaatcgatctacaatgatttgcatatttaagcagcaatttattctgttccaccatttcatttcccggccttcgctttctctcctcacgccgttacgtaacgaaacgaagcgaaagcctaatccctccctccctccctccctccctccgctgtgtccttcttccaatcctcgaaatgttttgttttgggcttagccgtgcatcgccctttaggctgtttgggttaattttgaattttcactttttgacattccgtttgaatttctctttggtttcgaaacccaaaataattttctaatttttggctttcaattgaatttcgcttcgaattctctcccctccccaactcgccctttttcccatcatattaatttttgtattgccaaatgaattttggtggcgcagctgtgctaaaaagcgcataattttattgcccccttttttctcccacaaatatttttgatggtttctcggccattttccgccttcactttcgcatgaaaatgaattcaatgcgcatttaataataataatttgttattaatcgatcaattcgctgctaagagtcatttcatttgaatcattcttttcttttcttttcttttctttcttttttatgcgtgcttaatattttttaatgacactttttgtgatttatccgttaattactttcaaacattaattaattaatttaattttttaaaattcttcactgaaacttttcagcgaattgatcaatcgtaaatttgcgcgtgaattgggagggtaaattataattcgatagattgatatgaatgaatgcaaagaaagcccatcccccgcaatggtccaatcagtgatcagacagacgattggccttgaaaaaagtttcttttgtcgtccgaatgatcatttatttttattattattattattaaatttttatactttttgcttaaatcagttattaatcacacttaactaataaatttgttttggctccattaccacacacaaaactcacattgaaaaatatgtttttagacaactcaaaagcgcaaaagcattacacgtgctatttattccttcgtttctcctttttatttttatttatcttttctttcttttcttttttctctttcttcgcttctcttttattttttcttctcttttcttttctcttcttttctactttttagtcttaaagacccattcctaattctatttaaacgtttcccaaaatttcccccgcgtgtcggaccaaccgctaaatccccgtcatagcttatgacttttggattcagctatataaatttttttattttgaaagcttaacattttggtaaataactcatcattaaaaatgtgcgaatattattattttgatgagaactcggagaaatatttaatattttatggaaaaacatttttattgctcccttttaatcatttttaaagaattgactttgattaaagtttatttgcaattcggatagaagcaattttctgctaaagttaaactgtgaaaagcttgtggatagtaatgaaagtgcattttccgatcgaatttgaacaaaaatatgtcaacttcccatttaaattggttatatttttcaaaaattagcattacatttatgcaagaaatttanacaatttgctgacatattttaaatcttttaccccccccccccattttt

SEQ ID NO: 1568 - DNA, 1067 bp, Heterodera glycines
gatcagaagcagcgaattggcccggcatttgacaacgaaaaagtgagcggaaaaagcaccagcagaagaagaagaagaagaagcagaattcacattcacagcaaattgatcagcggacagatttttacgtcttttgggactgattgagcacaaaattcactgatcagagaaagagacaggtggagagagagaagcgatagagaaagaaagaaagagggaggcaaatttgtgcacttttgccgcaactttcgacttcatcggctgcattttgatcactgctaaaccaattcatccaacaaatttgagtaagtgagggcgaaataaaataaatttttatttatttaaacaaaatcccacgaggcatccgatcctttgatgagaaaatgaaaaagcttcaacttgtttttgacatttaacaaaagatcagccgaaatattctttgattttccgctgggaaatcctcgcctttctcaaattccaaaattaaaaaccaaaaataatttttcaataaaaataattcagttcttctcacacttctccaggcgcacaatgctcaaattcttgaagaacaaaaacagcgacgatcagccgagtggcggggggagcagcgcggggggcaaggaaaagtcatcggctggcaattgtgagttatattcacttttttatttttttattttattggtgtaatagtgattttacagcgcggagcaataaaaatataatttaattgtgatgcattgttttgattaaaaacaaatttaattcgcagaggcgaaacatatgtaatttatgcatatcataatgtcgtttgaatattaatatatcaatttgttcaagttttgtttaattaattttttcaacaattaattaatcaattattttgcgatttttgccatttctcttaatttgtttttcacaacgctatctttaacttttgttttccctttttataaattttttaatttttttttctgtgggatagttgtgagaaaaaataattttgtttatgcacagacaattgataggaaaattcaatttgtaacggttcggatggagatggggggggg

SEQ ID NO: 1569 - DNA, 3461 bp, Heterodera glycines
  misc_feature (160)..(160): n is a, c, g, or t
  misc_feature (189)..(189): n is a, c, g, or t
aaattcattagtcagtcatttcattgtcttctcttttttgcaataataaaattgtgccactttttcgaatttccttttgatgtatcaaaatgcaataaaactacttttgttttttggcattcattctccgatcaattcgtttcgttctttgggcttttcngtcttttcggttttgtccccccccccccncaatggaaaaagcatcgcatttcgtcgcttttcaagcggagaatgtgtcgaaaataagtgataatcgactcgacacaactgcgatacaatggcaataacataaaatgaaaccgccaaaatccataaaattcatttaacgaatataaaaaaatgcacaaataaaacaaataaaacattttaattattgtttagggaagtcattgtttatgatgtgaattctttctaatcaacttgtattcatcaaacacttcttatcactcattttccctattatcatacttttccttttcaccttttccttttccttttcttttccttttccttttcactttttctttttttccttttcttttccttttccttttccttttcactttttctttttttccttttcttttccttttccttttcactttttcctttttttcttttccccctcttttcccttttcaccctttttcccttttcctcccttttcttttcttttttcttttcccttttttctattcggccaattccgctgatttcgtccgcttttctctgctgctgatgttggccacttccatttttatgcgcaatacgcggcagagaaaggaacgcgaagcgaacgaagcgtcggtgaaaatgcgaaattttcactccgaattcctcacggacgactaccgaaaatacagtatgcagaaagtgataccaaatgtacagttacagtatgagaggcgcgtgattttgcggttaatttggaataattaaaaaagacaattttattcagtttttcctttttaattttgaaatgcgttttcatgaggagaagagtttcaattttcttttgaagttttatctgaaagaattccaataatttcgtggaatttcttcggcgaaagacattccttctcaccaccgcaatatccttgtgctattttcccctcattttctttgtctttccattccatttaattatttattttatcagtttttgctgaacaaaaaaaaattgaaagacgcaattttcgataaaaatcggactgaaggggccgaaacggtgacgaatttgtagcagagtccggattcagtcggaatttaggggggggggggggtaattatgtaattatttgagtttaccattactctaaaacagtctgatcagtctcttcagaggaggaatttctgaactgtttatccttttttggtttaattttattccattcccttttaaaatgagttcctttataaatttttcttcctaattttgctgctttttggcttttccccctttacctcccctcattttatctgcgagtgaatgggtgccttttatttgtttgatcattttgtttaacaacttttcgtcagttgggccattcaatcggtgaatgcttttgtctgctgatcctttgattgatggatggtttttcgtcttttggtgatgaagcctttcgccctttaattttaacattttttaaaacaaattgccctttccctttcattcatttgatgagttttaattatgcttttacctatgtctttttttctgccgtaattcatttttcttaattttttctctgtctttgttctcttctctttctctctcccttccgtttttttggttagcaaacagaaaaagccgctttttgactgaactgatcgatgctcgaatgcccccccccccaccactttaacccttcttccgtccgtccgtccgtccgtccgtccgtccgtttctttcgtttatattgtgtctatcccaacctctttttttttgtactttccaaattccattcccaccatttttctttctttttaaaatcagttcgcttcattcaaaagtttaaaatcccacggtctctccggttttttcgagaaaatcccgagcaaatgccacttttttttggtgttttaaagagctttttttgctgcccattttgttctccctctgtggggaaattcgtcaacgacgcaaatttaagagagaaaaaggacgaccaatttttattggacgggaaaaacgaaacgaaaaggaaacgaaactgtgcggcggcggcggcggcggcgccctccgccgtttgcctctcgaaaatgatactgaatgactgctgctgataataataatgataataatacgaatgaatgaatgtgtgcattttgtgttgtgttgaggcaaatcaatttattattatggttaaaaaaaggaaaagagagagaaaaaagagaaaagagaaggaaaaaatcatttcgaccaaaaataaatgggaattattggacaataataaataaaaaaagaacaacattttatttgtttaatttgtatacaataaaatgacaaaatatacatcattattttatacaaaatgtgcattgactgagaaaaaaaggggggggggggacggaattgccgggggccgggggggggcagtgtttattctgtcccctttattctgtcccgctccctccctccgccgttggctccgctccattcgctcgtcccattccccccccccccccccactcttcagctgattgtgctgcgaatgcttatgattatgatttgatgttgttagtgattaccgttgatttgagtttgtctatgtcaactaaaaaaaagaaagaaattattaaaaaacccattttacgatttgatgacgcattttgatacataaaactattacttaaatcattataattatcctgaagcctccccattttctgcccttttttattgattgttgggattgcctaagcgatcatcgacggatcgtttccaaagatgtcaatcgatgcaaattttgtccttaacattcactctccgacgacgacaacaaataaacgggaaaaagccggcggtagcaacagcagcagaagcgcatcggatggcacaaattcgcttaattcggccgctttcactgtcattaggaccccaacgcctgcggagcagcaacgccatcaacaaaaagacgaaaagcagcatcaacaacagcgagactctcgcgactcagcgaagaacggagacgacgacggcggaacattcatggagagaagcgaatcggacaattcgaccgcttctgttgttgtcgaacactttcctcatcagcaacaaaatgccaaaagccgtcagcagccgccaaacattggggaggggtcaaaggtgaaaaagcatttttaaagccaaaagtaaaaagtcgaggctttccccgtccattagcctttgttttattagagcatattctttgattgctcctttaattctccgggactcaattgtccgttcagccgatgga

SEQ ID NO: 1570 - DNA, 1132 bp, Heterodera glycines
  misc_feature (817)..(817): n is a, c, g, or t
  misc_feature (1121)..(1121): n is a, c, g, or t
  misc_feature (1123)..(1123): n is a, c, g, or t
tgcggcacctcaacttgcggatcaggcaaaagtcaaattgatcatgactaagctgggcgaggcggctttcagccagtacagcaagtcgtgtctgccgaaggaagtcatcgatttcgacttcatccaaacgcaggagcgacttaatattgctttcagccggccataatccatttggattgatcgctacgaatgcttgagggcctcaaaaagtgatgctgaaaactttcgccctttcatcaaccgacataagcggctcttacgtgacttttagtttgacaaactgaacgaagaacaattttcgtgcctcatgcttttgacggcacttaagtcaccaaaggacgccgaattgagaaagcgcattctatcgaagcttgcagcggatggcgggcgacctggtggcatatgatggagttgccgaagacctccaaatgtaccaatcgaccatcgctgaagcaaagatcattgaacaacaccgatgggatcgcgaaatttgatggcggtcaaacagaagctgcgcccatcaacccaatgcagaaagggagccaaattcaaagccaaactcaaggggtttgctggcgttgtggcaagttgcaccattctccaagctactgtccgaacatcaaagcgtttgccgaaaatgcaacaaagctggacatttggaggcacaatgcgagaagcacgatgagtggctcaaccgtaaccaaaacgccaaatttcaagggaaaaaagcttgtactcttcggatcggaggtgtaatggtgaacattgcgaaccttccaacgaagcttatcgaacttaccgtggaaatgaatggacngaaagtggtatttgtgcttgattccggcgcggaggtcacagtgattaatgaagagacgcactatctgatcggaaagcctcgattgcgccgatgtgaagaacaagcagcataccacgactgaaattgtagatgacggacttgggcattgccaaaaggtgaaggcacattcgtcgctgaagcctaatgcaactccgatttactgccgaccacgtcccgtcccattcaacacgaaatctgttgttgaagcagaattggagcgacttcaatcgatgaatgtcatccgtccggttcaacacacaaattngngctgcaccc

SEQ ID NO: 1571 - DNA, 7311 bp, Heterodera glycines
aaaatgatgcagcaattaaacgaatggtaacggtattcgatcagagtgatgaaccgaccgaccaaaagtatttagaccatattaacatgctttctatttgttagttatttaatttattgctgtgagctttcttgtttggtgtgtctatggaagggccgaaacacttagtttttttaatttgtaatacggaagggatcgtactgacgaggcccatccttctaattttttcagcaattctcgtccgcaattgtacggtccgcaattgtcgtccgcaactatacggtccgcaattgtcgtaacaccatgcccatcccttctttgacccctctgtcttttgcataaatggcctccccttccctcctcagttgttcttctccattcatttcatttatttgttccttatatttgcaatcgatatctctgaccccgttcgcccttgtccttttctcttttgaataaatattgttttattccctttggactttggggcgtaacagatatcaacccgaaaattcaaccaactcaggaatcaagaaccaaactgggaaattccaaaatcgagaatcgagactataaaaaaacctagagaaattcgaaaagagacagaaattagagaagttaaacagagactccaaaaatcttaatcctgagaaattcgatatttttctataattttcctggttcaagaataacccgaagtaaataaaattttattcattttttaaaattttaaataatattataattttaaaaaatatttccatataattgatgaatttaaaattatatgaatttagtgaatagataattaaattcaataatttaatcaagcactgagtttttttttaagtcgacctagcaccgaaaaaaagcactttcaaattttttttaggaaaatcgagggcaatttttatataataaaaacctattttttaatccatttttaatttccaccttaacaagctacttttggcattttgcaatacgaaattttataatttttgcatatttaagatttttttgaaaaatatagcaaaaattgccaaaatcgacaatttaataaaaaatataccattgaaatctatgtatcgcctgcattaatgaaacaatttaaaatttctaaatatcatacagtgccccaaaaaagtcttgcctcaaagaggcaaaaattgggaatattaaattttctatcccacgcataaaacaaattctctttaattgacttttttctatagctcgtttgatgctctatcagatgctgattatttaacacaaaatgagtgagttattggcatcagagtcaaagatgctcaaaaatgcaaaaaaattcttgcctcaaacctcaaaaaccatcttaaagttggtttaaaaatctgaaataattcatgtttgcttatcttttggtgttgaacaaaaattaggaaaattttattggaaattttaatagtctcattgaaaagagcacaaaattctctaccgaattatctttagaagggaggggctacgacttgttcacaaaaagttatacttagttgaaaaattggagaactcaaaaatgatcagtttttgatcatttaggaatttttttcgaaaattacccaaattttcagtgtgttttagggtgttcagatcaccatgaaggagtgatcggatcaagtattttgaggtttgaggcaagactttttccactcatttttgggcatctttgaaccaatttttgcctctttgaggcaagacttttttggggcattgtaactagtgctgcgatttttaggcagaaaaaattcgcaaaataagcattaaataggcacaaaaaaaggcaaattaatttttttaaattaacgcttttaggtagaaaacacataaaaattaatcaatacttactttggttatatttaaatttaaatgaaattaataaagattttaaataaaatcaaaataggtctttggaatttacaaagtgctcttatttttattcataaatctttttagaaactcagagcgcgcatcgaaaattttccaaaataagcaattttgaaaattagttaaaaataagattccggggtcataaaaaggtggtgtaacgctttattaaaaataactcactaatatgttttttttgatagaaactaactaacaattatatggagttgttaaaatctgatatagatgttgaccaattattaatttccatgaaaaacaaacctaccgtattttctctttttatccccccgtctccatttatcccccgtggggataaatggagtttttatttatcacgccattttttcaaaaaaacaatagtaaaaaatgctaacaaaaaatgccaaaatagtggcactgacgaaaagcccgaaataatgaagaatagtgacataatttacagccaaaaattagcaaaaaaatttttattcacgggttgatgttgcaaatgtggttacacttcttcataaaattttcttagaaaataatgatttgaaatcctaaaatttgtcaaaataatttgagggatgaatttttgagaaaattttccaattttaaggatgtttttttacatttaggtcaatcttaggggttgtttttttggaatttttttaggtcgagcatttttgttgagaaattttccaaaaaatgtcgtaatagtgaaaaaatggcgcccccacaaagtgtccaagccacgaaatgtccaaaagagtaaaaatccaggcaatgttcaaaatttttcaatatttataaacacaaaatgagtctaatttaggatttctagggttttcggggtcgttgaatatgaatataccctttatattaccccttgcctaaccttaggcccatctgaataataaaaaactcaaattcgagacttggacatttcgtgggctggacattttgtgggccagcggaaaaaataggtgacaaaatgccaaaatagtggcaaaaaactattttagtggccaacttcgaaatagttttttagtggcaactcaaaaatagtgattcctagtgatggcgctagacgaaaattttttgaaaaagaatatgctttttgtgcatttctcattaaaataaagctgcagaaaaaaatttaagtttttcccgccacttcacatttttggctcacttccatccatttttatcccataattttataaaacaattccaaaggcctagattgaattttattatatataaacaaatttacatgttaacaaaaatgttttaatgagattaaatattttatgaggggtttggatgaaattgttaacaggtttagacaaaaataagccctttttgtgaaccattttttaaaaatgaaaatttttgtcaggctgtgattacaggcaaccccagaaatattttgaaaattttatacgaattattgttaaaagattttttaataaaaaaaagacaatttataaatttttggttagaaatatttttttttttttatatataaagtcttagaaaataagcacacaaatgcgacatctgtagcagtggtgtagttttttttttgtttgctttttcgatctttctcaagtgatcaattctaaatttctcggtaaaaacatttatcgtacaccgctagggaggctaataattagacttgcaaaaaaaatgcaccaaaaatcgcgaaaatggcactttaataggcaccaaaaaattgaaaaaaaggcatgaaaaagcacgaaaatcccgaaaaggtatgaaaaaaggcatttaaaaattttttgtattttcacgatttcattacatttttaatgtaatttttcggaaaaaacgccaaaaaggcattaaaacggcaaaatgccaaagaaggaatttaaggcacgaaaatcccgaaaagggcaaaaaaaggcataataaaagtcaacgtagaagcctcaaaccaagtggaaaatttgtgtttttatgcttatatatcgaaattagtgcataggaaaaaaaggcatatgcctcaaaatgcgagctctactaataatacgaattattatgttaaatgcttaggcatagacggcctaatgcaatgcaccaaaataaatttgtaatttttgcactagagtccggtaaaaaaaaatttccgggaacggggaacgggaaacgggaatcgataaagagcgggacgggaaacgggaacgggattcccggctttttcccgttcccgtaaaaatcccgtcaattttaacgggaatcccgccgggaaacgggaaaaaatttttttaatgaaaaattttgattttttaaaaattttttactttaattatttttcaagtgaaaatattataatttaaacggtttaaaaaatttctctgtgtaaatgattgagtattttttaaaattaaatggacaaaaataacaaaaaatttaataaaatagaattttcggaattgatttgttcaaaatccttcgttaattttccaccaatccaaagggtccaattcctgcccaatcaaatcgcccgaacaatattttttgaattcttcgtcaaatgtcgattcggtttgcactttaaattttgtatgtgtaataagaaaaatcctttaaaaataccaaaagatttgcttgttgaggccatttctgattttttatatatgtacaataattttcattaaaattgtctattatttttaaaattccaaaatattcgtagagaatttttctatgttttcaacttatttacaaaatctttttttggttaaaatctcttctttttgtgagcgccttttacaaaatcctttgtggtacagggaggggtcaagcggtgccgataggcgccgccggggaaaattttgaaatttttagtgaaatttgttaacaaattttgtccaaaaaatgattaatttgtgggcttatggctatttaaaaaatattttttaaagttagacaaactttcttattaattaaatttcaaataaaataatttaaagaaaatatgaaaaataacctatcctaatggggaattgaactcaggagacaaataatgaaagaccagaagtattaaccattaggctacataaatatgtacgctaatgaattaaaatgaatttatatttatttttttcacaaaaaatctctcttttaccaccaatttccttcaaattttttcactcagacccccattcttaccagtgtacttttattcccgtttttgagaaaaaatttacgggaacgggaacgggaaaacgaaaaagaacggggcgggattcccgaacgggattcccgtcatttttcccgttcccgtaaaattcccgtcaggcaaaaaagacgggaaacgggaatgggattcccgaatttttggatattcaaggtcaattaatttagaattgattgttttttcttcctgcaattcaactgcattttcattataaacggtaagtgtgagcacttcggctgtgaatttaaaagataatcattaaattgtttttaaataaaatttatttaaattattgtaaaactaaaaactataagcatccccgaattaactatttgtttcattggtttttactagggttgctccccgacccctcgcgggcgacatgtcgggggtcggggcggggaggagctcaattgtcggtggtcggggatcctgatcggggaatgatcaaattttattttaaccaaaaaaacaattttttctttttcaatactcgtaaatcttcctttttttcactttaatcatctgatttcgttagcgccaagagtgagtccaagctggcgcctttaaaccagggcttccctttgttcttatttataagaatgttctgattttggggtagcgaagaaaattattctgatttcttaaatatacttataattttgaaattttatggcataacgtcactattttatcaagaaattataaattctgacgcagaatttttttgatctttgatcctgaatgtacttaaatttacaattttgcattttcctctccaaaattttaaaattgatgatgggagactaaaaatataaaatttgatacattttgatcgaataaattgaaaatcttatttttcggacttggtgttcatggtggaagccctggtttaaaatacatggaaagggggagggagtttaaccgaaatttttgcgaatccgtctcaacatcgaatttgaccaccattttttgcggcgctctttttcaaaaaaaaaacttttggggaacagaagggggggatgggcggcggtgctgttaggagccgcgagggaaatttttttttgaaaatttataatttgttaacagatttttcctaaaaaataccaatttgcaattttgggacaattttttccaaaaaaatttgggttttggggggccggcggtgtcgataggcgccgccgaaaagtttttcggaatttttaattaattaatattaagaaaattgttcaaaatttcataaattttcaacctttccccccttcgttttattgaattaactttttaaattttcaaggaccggttcaagctgttggatctgatcagtttgaacttttgctgcttggtagggaacaaaagtccgaaattggcaaaccatatttaccatgttaaaagaaagaaactaattacgggcagaaaatatcgatgttttgtaccgtaatgattgtagtctgacttttcattcgggcttaatactggtgattgttcatgtctgtttggttttttgctaaggtgccaaaattgaaaactgagttcttgtacaacaatgaagaaaaggttctgctggtgaaaaaccgtttaaaaatataagttgtgcttattctataggcaaaatggaatttcggaatccagttttaatttttggacgaagaatttttcttagcctgtctattgaatttgtcgaacatacgtcggcttgtccattacaataatgctgttatctggagaaattgcatctttaatcaccttggcttacaaaattgtcgaaattccgaattgtcaaatacgagttatttcggtgttcaatagcgatgaaaattttgttcaacaccgattgtgcccgtggcaatgtcgttttaatttgcgttatttacggcggcaacttcgaaagggcgtatattagaatcggcaaggtcagaaatgaaaagcagattttcttctcttggtgatgttgatgtctgccttttcgcattttagttgactaatgcgccaaagtcaaaaacattctgagatggagcacaagacagctgaaagcactgcaacaaatcaatgcttatgtatttcgtgacaaaaacaaattctttaagcctatattgtctcttgaaaatttagctcatgtggattttggtaggaaatgtgttcataacgaacatacgcag

SEQ ID NO: 1572 - DNA, 3947 bp, Heterodera glycines
cttttctgtttcctttcccccctgaaatttacaaataaaaagtcatttctagcgtagtttgtggcgctgatcacgaatatgacctttattttacaaaattccgaaccccgaacccgaaatcgaacaaaaattcgaaattcaaaatttcaatgtaaacaaatttttaagggttttctaagtcgctgaatacggatatggaatccattttctacaaaaggcatctcgtacaatattaagcctaagctgaagcctaggcccaagcttaagcctaagcctaggcctaagcaagcctaagcctaagcctaagctgaagcctaggcctaagctgaagcctaagcctaggcctaagcaagctgaagcctaagcctaagctgaagcctaggctgaagcctaagctgaagcctaggcctaagctgaagcctaagcctaggcctaagcaagctgaagcctaagcctaagctgaagcctaggctgaagcctaagctgaagcctaggcctaagctgaagcctaagcctaggcctaaacaagctgaagcctaggcccaagctgaagcctaggcctaggcctaagcaagcctaagcctaagcctaagctgaagcctaagcctaagctgaagcctaggctgaagcctaagctgaagcctaggcctaagctgaagcctaagcctaggcctaagcaagctgaagcctaagcctaagctgaagcctaggctgaagcctaagctgaagcctaggcctaagctgaagcctaagcctaggcctaagcaagctgaagcctaagcttaagcctaatcctaatgtgcgccgctcgcttcgctcagttcgccccactatttgtcctcctttctccgtgtgttggccattgcgaacgctccgcggcctttaaaaaataatattaaatgccaaatgtggtcaaaattaacataaatgtggaagggaaggccccaatcgtcacttttattttgcttccaattttacctttatttcctaaacccaaaatggattattacaattatgaccgattaatggccgaatgtcccaatgaagttgcgacagttaaatttctccaaacaaaaggcctactacataaagaacgccattgcgattgtggttcgcaaatgcgcgagagtacacgcacacaacgggacactgtaattcccgtgtggcggtgtacttcaaaattctgcaagcaactaagggcttaagaccggctacttggttcgacagctccaccctttcgttccgctcaattcttaaatttatttattggtggtcgactgagcaaacgtctgttaatttttgtcgccatgaaattggaatggcacacgaagcagtagttgactggtaattagctatttgtaagtgccggaggcattttataatggctcaggtccatgtacatgcgcgaggcatgcgctgactccctgttaaagaacaatgggcgtgtgggaggcgtaggcttaactgtggaagtggatgaagcgcttttttctaagcgcaaaaacaacattggcagggttctccccgaacaatgggtgtttggggggggggggtatgcagagagaccaaagaggtttttatggtggcagtccctaatcgaactgccgaaactctgatgaccgtcatacgtgagcgaattgtggagggcagtaccataatgagtgactgctggcgcgcatacaacatggtcggtgcggatggcacttaccgccacctcaccgtaaaccacagctgtaatttcatcgatacttactgtatcgtaagggcattggaatctaggcgcccacacgcagaacatcgaaagaacttggcgctccgctaaggcgcggaataaaaagcattctggcacgcatcgacagatgctcgacagctatctgtgcgagtttttgtggcgggcaaatgtgaagagaaatgaagctgacccatttaaggagattttgagcacaatttgtgcatacatgccaccaaattagcccaaattttatgcgtatttttttggcagtttggccaatattttgttgattttatgcttgttgaaaaaaaactccattttatcgagttcgggttatttaattggataaaatagatgccatatccgtattcagcgacttagaaaacccctaaaaatatgttaacattgaaattttgaatttcgaatttttgttcgatttcgggttcggggttcggaattttgtaaaataaaggtcatattcgtgatcagcgccacaaactaccctagaaatgactttttatttgtaaatttcagggggggtcacaaaacagaaaagaaccaagaaaattgttattaaaggcaaaaattctaaaaaaaaaatcatacctatattatataaaagtgacaccaatagctgtgaaaatggcctagtggctaatcttctttattttctattacttttccttggaaatattatgaattttttttttgttataatcataggttttctatcgacaaataacatgtaatttatcattttttaaagaaaatccggtaacaaattgagcctagtaatcccaaaaattaaaggcattttgataaaataaaactggtacccgacccggtacccggcttttcaatacccggtaatacccgggcccggttttgcccaaatacccggtgcccgtccagccctagtttatagttggttggccgaggacacctgttgaagatatgaggttcaaagtcaatgtttctgtggtcgagaatccactgtcatgggcctacactaagggggcggaaagggtctaaaatgtcggggattcggggtcctaatcccccgtatctgggtcacaagcccttaactctcggcttctcattaaatctcgagtaaaaaaaaagaagattggatttgtcctaaaattcgcttaaattttctcaaaacaaaaaaaagcgttaccattctcgaatatcaactcgcgacgaatttaagctgggcaaaatgtgtacgggggcggaatttttgaggaataaaaaaggtcatccccgcgggggtggactcgtaaagaagtgccgaaacaaaaacgggaatggcaaaaaataaaccccgtttaatgggtggagaagcaaatgggataaaagcacgcacatgggaggcttcttcttctcctgctgctggtgttttgctgcttcttcatgatgttcatccaaccccgggtccggcataaacagttgacatctacatttatgggagggggcggcaaaagcggaagtgttatccggcacgaaatttgataatgttaaaatgtattgggcgcaagcaagtgcatttttatccccccgggggcggggggagggcaaatgtggggggacaaggaggacggatttgggaacatagaaaacgcgcggaccgggaagagatttgtttttttctgtgactgatcaaaagcagatttcacccattattttatccggggggagtgattgcaaccgagaaatttgaccaacgatttggcacggcttgggacaaagtgagggggatatactgtaatcagcagcagatgctgttgcactttgttggccacatttggtccgccttgtcgttgatgacttcacacatgtttttttttgtaccgtaccataccgccgcggcattaaacatcgttggcacgattatttttattatttttttgttttgccacgcaaaagcattttggcaacaaaaatggcgaaattttgcggtgccaaagtgccaatgccatcgcgcgcggaacggcacggaacggcggccacacccaatttgccaagcccgaaaaggacggacggatagagcattttgtgtgctgctccattgcagattatgatgttatttgccgggtcgtttcacccaattagcgggacgaagttaatgctggcacattaaaaatgaacacaaattgtgtgatgacgaaacgggggcatcacaacaacacaatgtgcgtacgtactctgtgcg

SEQ ID NO: 1573 - DNA, 1876 bp, Heterodera glycines
tttttcgagctctatcgattggtgggatttttggaaaaatttcggtttttttccggaaatagaaaaaatttatggcctaagcgggacatttgagtcccgggcctataactcgtcagggatcggttttagccaaaaattgccttagaacatttttgtagagcattttaagctctatcgaatggtgtgccatttgtcggaaaattttcaaaaattttcgagctaggccccctagaaattttcaaaaaatttttttagggcgagaagtggggtgaaaaatatttttttggggtaaaataaggtgctgagcacgaatatgatgtttgttttttgtttgggaaattttggaattttttaaatttttttgaaaatcggtcactttttttgccctcgggattttgggttaaagtttgaaaattcataactcagtttagatcaggtctattttaatgtatagaggcttaaaaaatggagtaaaaatcggagaaatttttgccctttatttggtatttctatcaagaatataaaaaaagttattccagaaattctggaaattttcgaattttcagaaaaaaattcactactcggttctgaaaagatattttgtaaaataaaaatagcccaaaaatccgcaattttttgctgtatttgataaattttatttcatgtttttatcattttttagtaaaaagttataaaaataaaagtgatttttgaattcgggaccaaaggggggtgcacatggttttcgagtggggacattttttcgcccaaaaacttccagaaatatgtctttagaggttatttaggacgctgatcacgaatctgaaatcagatttcgtttacttcttcgggaaagcctcagaatccctgcgtatagtgatgaatcctatgatggacaccatccccataccgtttgctagagggattgccaccatccccataccgtttgctagagggatggccaccatccccataccgtttgctagagggatggccaaacaatccacataatactgtttaggtggatggtaccataaccaatcccatccccatagacactcttatggggatggatcacatccccttaaacactcttatggggatggtggtcgtccccttaaacactcttatggggatggatcccatccctttaaacactcttatggggatggctcccatccctttaaacactcttatggggatggctcccatccccttaaacactcttatggggatggtcccatccccttagacactcttatggggatggatcccatccccttaaacactcttatagggatggtcccatccccttaaacactcttatggggatggtcccatccccttagacactcttatggggaatgctttaaatacactaatatccaatctgctgttcttcctcttcttcttcttccacttcattcacttcctcctccgcttggccttcatttgcttctgccaatgccagatcgacatgtccttcccttgcgtttccgttgttgttgttttggctttcattaaattccattttatttattaacacctttaaaaataatcatgggactaattaattcacatagtcgaaatgatgttgactttatctgcatttttaaggggcataattttttaggctcgaaatttgacaggttttcaatgcgcattatttgctaacggtttgccgagagttttctttttagtttgcttgggaatccattttgtcgggccgagctgtccagcggaaagttttatctgatcatggttgtccggggctgcattcacaggtctgtatttatccggggcgtttggcagcttatttggccgtggtgtactttctggctttctctggcgcatttagtcgggcgatattttgtta

SEQ ID NO: 1574 - DNA, 1592 bp, Heterodera glycines
ggcgcgctgtcaaaatcccgatgcgtcgaaatcccgactaagccaaaatgagtcataatcccgacgtgtctaaatcccgacgcgtcataatcccgacgcgttgaaatctcgatgcgtcgaaatcccgactaagctaaaaagagtcataataccaataaatttaaaaataagcgaaaaatcgaacctaaatcttcggtaatgaaattttaaaataaaaaagcaaaagaagttttgtgctttatttaattgtgcaaataacaacaaaaataaaacattaaagtaaataaattctaattgaaatctgcggttgaattttccatgttttcatcaattttcctgcatatccctcgacttgaagaccaagcgccgtcatgactagggcctgtaattatatggacataaaatcgcaaaatatggccataaaatatggacaacaaatcgcgaaatatggacataaaatagcaaaaatctcaaaatatggacataaaatggaaaaaatatggatataaatttttcaaaattaggggtataatttctcaaaatttcttcaaattcgctaaatgcaaagtaaaactttcaagaattgctaaatatattattaaaaattatttttgaagaaaaaaacacgatacattaatcaatattttcgacaaaattttgataaaaaatgcctttttcgaaaaattttccgatttgaggtcaaaatcccaatttagttgatgggggccgttctaatagaggttttttggaaaaatgccaaaatatggacataaaatatggacttaaatgccaaaatatggaaatatggacataaatcgccaaatatggaaaaatatggatatagaaaccaatccaagaagcttcaaccgagctaaaaacatgtttttcgtgcgtttcaggcttcccacagtccaggaaaaaaatatggatttccatataatacaggccctagtcatgacaaattcaaatggcataattggcattgacggcgcatgaacagtaaaatgaattggtagatgacggaagaaatggtggcacgggtaaattcttaaaagcaatggaaattaaaaaatcaatcggcaatttttccccaaatcggaaaataaaatgcgaaacgcgaaagcccatccctggtggccacctcctttaaaatgttgacccaaccaaagtccgcttgttcgttaaaatctttgcaacgcaattgcttcggcaccccatctttcctcggaatgtgcaaccatttggacaaaacttggccagccgttgcatttggcccatcaaaatcaccaaacgcatagggcaacagaccaaatgaatcgattgaactcaactgattgagatcagtagaattgtcggtgaaatgagacaaagtccactcttgtagtagttttgttcacggtgttcagaatttgcttcgttttcactgttgttgttgcacataaacccgcgtttacgcgacttttgaataatttctattttctttcggttcattaagcttgctaaatattggaaattagaaaattatatcctttctcgatttaattcaccggaaataatgttatttatttattttttaaatttgtcgggattat

SEQ ID NO: 1575 - DNA, 4744 bp, Heterodera glycines
taaaaattcacccaaaattagacaaatttacgtctgcttaagccagagttaattccattgcaagataaaacaaaataatattttaaaaattaactctatttccggactcaccgcgaggaggtaggtagcagaattttgagcccatactaaccacaacacaatagacaaatcacaatacatttttatgtatggtacaccctttccaatttttaattttcgaaaaaagattttcaaaaattttaagttagttgtatctgttataagtttaaaaaaattcaaatttcgcttttccatcattaaattaaatgttcccaaagtgttagcccctttcatattcgtctgctgctgatgaagactgttgggctttcaaatcggagtgccgtcggtcggacacgtcgtcttccccagcgtcggcggcacctcaaaaagtggaactgctgaacatcgacgagtacagcaggaaggagcagacgatgtgcaattgtttttatttgtctctaaagctaaagggcctgtggccagaaaaattttcaaggggtgggcgacccgaatttttttgcctggcaaaactttttttcaaaaataggcctcgctgtggaaaaaatgcatttcagtctatttgtcaatcattcatgagcacaaattttctttttttattggaaagaggaaattagtagtgctgttcgagactctcggtctcgagtctcgactcgagaaaagtctcgggtttttttttaaatggttttaatagccctttaatatgctgcttgattgaattacatttcgatttcatgtattaaaacatttaggaacaaaaatgtgaaatcaaatttttaggctttgattgaatccgggttcagtgttcaaaattgatctcagaatgaaaattttaattattttttggcggtcaggattcggcaggtgtaatacctgttgctttcaaatttacgtttaacataaaaggaaggtttaacagaagagattagtcgttattatacggtctggttaatcgtttaattccattttctgtgttatccgattaatgggcgacacattctaaaacggccttcatggtcggttttctatttatatcgtcttgaatttttggtgcaatttttggaatttcgaaactattttttcaaatagcgaagctcaattccctacgaatataacttcatcacggaaaattgacatttgagaccattaaagccataaatacacgatgatagctcgtttcaacggatgataattctaaatccaagaaaacggtggctctaatttcagttattatgtgcctaaatttgccttcgctatttaaactcgaaattccgaaaattgcaccaaaaattcaagtaagatataaatagaaaaccgaccatgaaggccctttaggatgtttcgcccattaatcgaataacgcagaaaatggcattaaacaattaacctgaccagcagacagattctaaaatgaccttcatggtcgcttttctatttgtattgtacttgaatttttggtgcaattttcgggatttcgaagccattttttcaaatagcgaaagcaaatttagacacataatagatcaaaaccgtgcctgaggtctctgggaattattattattacccgttgaaacgagctatcatcttatatttatgcccttaatgctctcgaatgtctattttccgtaatgaagttatcttcatagggcgtcggcgaaatatctgttgctttcaaatttacgtttaacataaaaggaaggtttatcagagtgcgtttgtcgttatgttgctggtctggttaatcgtttaatgccattttctgtgttttccgattaatgggcgacacattctaaaacggccttcatggtcggttttttcgtcagggacttaattttcacgttaaatgttctatatacatacttacctattttctttaatgcattttaaactcaaatagtgataattctttcattcaatatatatggtgcttaaatattaaagtaactttttactatcaaacgaattcgtcagtggacaattttccaggaaaattaaaaataatcctgtagctcagatgttggattcgggccgacatatatgcagtcgagaacgaattaccatacgtaacaagcgattacacattttaaaacaaagtatccactgacgaaaatattcactgtcgaattggaacactgacgaaaaaaatggaaaacagtgaaataaataaaaaatagtttacagacgaaaataatcactgcaaattcacaggcgattaaaatatagtgtaaatattgccacatggaaaatcctactcagaactcattgcttttagtaaatccctgaattcctttgccttattaatttgcaccgctaccactggaagattattccagttttttactattctattgaaaaaattattttgagttttggctgtgtggcgctttactcgtaaaagtaaaggccttctgggcctttctgagaaaaggaagcttttaccagcatcgagcctagttaaccctttaattattttaaaagctgttgttaaatcattgatttttctttttttttaatttgtgtaattcagtgatttttaagccacattttctaaatgcttttctcgtgaaaaacttttgaacgcgttcaattttatctatatctttttttaagttagggttccaaacttctgtggcatattctaattgaggtcgtacaaaagttttataggctgctgttagtctttatttccctgctttttaacactctcaaaatttggaaagttctaagatatgcatttcgtacaattttgcatatatgttccgaaaaatttgtattgtacttgaatttttggtgtaattttcggaatttcgaagccattttttcaaatagcgaaagcaaatttagacacataatagatcaaaaccgtgcctgaggtctctgggaattattattattacccgttgaaacgagctatcatcttatatttatgcccttaatgctctcgaatgtctattttccgtaatgaagttatcttcatagggcgtcggcgaaatatctgttgctttcaaatttacgtttaacataaaaggaaggtttatcagagtgcgtttgtcgttatgttgctggtctggttaatcgtttaatgccattttctgtgttttccgattaatgggcgacacattctaaaacggccttcatggtcggttttctattaatatcgtcttgaatttttggtgcaattttcgggatttcgaagccattttttcaaatagcgaagctcaattccctacgaatataacttcatcgcggaaaattgacatttgagaccaataaagccataaatacacgatgatagctcgtttcaacggatgataattctaaatccaagaaaacggtggctctaatttcagttattatgtgcctaaatttgccttcgctatttaaactcgaaattccgaaaattgcaccaaaaattcaagtaagatataaatagaaaaccgaccatgaaggccctttaggatgtttcgcccattaatcgaataacgcagaaaatggcattaaacaattaacctgaccagcagacagattctaaaatgaccttcatggtcgcttttctatttgtattgtacttgaatttttggtgcaattttcgggatttcgaagccattttttcaaatagcgaaagcaaatttagacacataataggtcaaaaccgtgcctgaggtctctgggaattattattattacccgttgaaacgagctatcatcttatatttatgggcttaatgctttcgaatagagaccggcgcaggacaggatcctgcgcaggattttgcaggatcccagtccgcaatcctacatattttggaaaatacaggatttacaggatttgcaggattaatcctgccggatcctgtcctgtaaaaattttgaattccaatcctgtaacaggacccgcaaatttgatttttatgcaggattcaacaggatcctgcattgattttttgaaaattttatgataaacgatggttcaaattagggttgaaccctgaccccgagctccgagatttttgtgcctgttcccgaccccatccccgacggtccctggcccccgacattttgctctgctccccgacacttagccggggaatcggggaccctgagtgttgttaaaatttaaaaagttaattaaaccaaaatatgtaaaacaccgagccctcccggtggttctcaatccccgacttttccaaccccgatccgtcggggtttcaatccttgttcaaattacataatataaagctccctaaaacggattttgttgggcagcggactgtcgggcagcgcaaatttcaaaaatcctccgtcactcatatatacatggagaatagtgtcttcagactccgtgtcttttcgaatttcgacatctctccaaactgtcaattcgcttttggcatcgaaatgcgcgtccaccaaaacatcgaaacggtcggaaagcattgccaatttgaggccgagttcacaacgatcaaaaaagtgcagaatgtccatgcaaacatcggtacaaatccagctgaaatgcgtaaaaatataatcaaaccagcaaggctctcagatgtgacggatcagaccgttttcgttcgaacatatgtttttggctataactttttttatttgtcaaccaaatccaacactgttggtatcattcgagagcccttcagatgctctattatcctgcaaaatccaaaaa

SEQ ID NO: 1576 - DNA, 8007 bp, Heterodera glycines
aaagcatcgattggggcttaaagatgataaattaatatttatatttttaatttcttattttttacttttataaatgaaaactatattttaataaatttgtttttctcatcacttttttccgttttttgtttttgatgaactttgcttctgatgcttaatcatttcgctgattttttctaaattgttttaatattagcatggactgaaactgggtcattaaaaaaaatataaatttaaatcgattcaataaaaaatacagctaaagcaatgtttggtaatttctaccgtattttgtcaattctttttccctttgcttttcctctccaattttggccactttctcctgtagtacattaagctctgccaccaatccacagtgctttatcttttctcgaagttccttctaaatatttttgtcataaaaatttgttttttttcactcaaaatcatatttatttacataataggtgcaaaaataggtgttaaaaatgaaaaatccagtgtctttatgcacaaaattcccaatttcgcccgcacaattgcaacttgccaagaaaataaatacaataataaattttggaaatgatttttaaaaaaaactttttttttcatttcttaggggtatatttgaaaattttgggacgattcttaggagtgtatttttcgtttttattcactttttctatgaaattcctggaaaaatgccaaaatgtgcttatctgggcactagaaaggactaatatcgaaacaacaagccatatgacaatccgaccaatctccacccctgtttttaaataattttaaaatcactatcttaagttcgccaacagttttaaattttgaacaactttttgccaattgaaacgcacattttgttgttccaatttgctgatcttgtttaagtgtcttgactccttcaactcattttccattttgacaaatttttcacgaaattcctatgattaaaattgaaaaatttaaattgaaaaatgaattttcgacgaccttcagctgttgccgaccagttaatggtaattcctcatttcccccactggttacatcggtttccaaactgtcaataaatgcagtgccatcaacttctgaaactgtaaaataaaatttataatgcaaattgccattggaaatattattaatataatttgggatttaaaattataaaaaaaaaaattgtcaaaaatatctctcataataacattaatgcttgttaaatttgattaatactcgatatttttaaagaaaataagtcctttttaaaaagcccggaagaataagaataatactggccacaaacagactttgttgacatttttgttttttttaattataagaattggcctacggtcccgaggcgagacgaaaaattttctaattttgttataatttcttaatagatttgcataaaaatccaatattatgaatttaagccaaaattaataatgaaactatgcatgcccttaatatgcatgaaaatatattttaaaaaaataattaagctagttttgttgtatcgtttttggataaaactccgactttacaatgacttaaaatgagtaaataacaaatttttaatttttcaaaaatggagttgatagaaaggtataaaatttctctttaaaacttaatttcagttcttttttttattctttccccaatatttcgtcgtccaatttggccttatcttttcgctccgctttcttttgatttttttttatacatttctttcattaaaaggtcaaaatgcacatattaactgctttccgggccgggatcgagaatctgaccgaatcggattgaattccggttccctgattcccagtcccataagtttagggattggtgagacaaatacgaaatcctactgacaaaatgccaaattttgagataattcatcaaatatttaagtaaaataattttatgaaaatactgaggaaaagaaaaaggaaaaaatcaataaagctgatcaaaagtgatattttcttccttcaaagagtgaccaaatcaaatctgaagttggggccaaagttggcctcaattttatcaccagcgccattcaaactcaaagtgacgaaagggaaaaagaaacaatcagcacaggaggatgtagccatcaactcagaattatctaaataaaaaagcacgggaaatttgaaggaaatgaaaattattttgggttttttgggaaagaagggatagacggtgccgacaagccaggctccaagtttttcttcctattgggttgatgaaaaagttctgaccctctgaaaaaacaaattatgcaaaaaaatgatatttaattctaaagagattgaaaaagggaggcaggcaattgggggatgaatcagcggacggttggccatcttttggccatttgcattcgttgtatagtcattacttttgcaaaatcgaacgattttcaaaaaatggaaaaaattcgcctaaatgttgcgttcttaacgcaacaaaaaattgagcaacttcgatgggcggttcttcctcatccaccatacagcccagacatcagcccgtgtgaccactatctgtttcgatctatggagcacttcttgagagggaaataatttgctgatcaaaacgaggtcgaaaatgcattggatgacttttttgtatcgaaaaatgatcagttttataaaaaggggattgaaatgttgcccgaacgatgggagaggatcattgatcaaaatggtgagtacatcattgattgaacatttgttttttgtgaaataaaaaattgtttaatgttgaagtgcttaaagggtcagaactttttcatcaacccaatagaaagaagctagaaggaaattaggcgtgaccttaaaatcaaatgggttttaaattttataaaatcaaagggggactcttttgtaaattaaaatgcagtaattactaattaggcaccccatggcgtcggggaactgcgggaattgcggactgggaccccagttaatcccgcgtgggatctcttcccacgccgttatcttgtaccaaaaaatccttggcatgatgattaaaaaaacttttttttttttattaccaacccaattgtcgtccattcttcgtgaaaatgatccttcgactcgacaaattaacgccaattccgacagtatctccgacaccgtaagaatatccatcacttccttcctttcgttttccgttaatccacagctcgccattcttttcataagcatatgtgcccgtgctatatcgaattgtttcatcttttgatgtttgctgctgccttagggcaaatccgaagaaggcccaactgaaaaatcaataaatctaattttaaaaatataattttaatgtatttatcactttatatatttaaaaatctatacattctctcaccctttcaaatgtttgagcgaaatttcatagtaaaaaatacgagaggaattgttgttcaacaaaatcgaatacattgcgaagatggaacgaaacacttttaaaataaaactattaattttatattaaataattaaaaaattaccccaagcatttcccgtgcaatggaccgtcaaacttttgccatctttgattttgatatcattttgataagagttttcttcccaacaattttgacggaaattcgaatgcaccttaaaacagattttttttaaaaatttatatgcttaattgtcagaaatgttatgaatctgttacatttttttaattgtctccagcggcgcctatttatatgttaattaactgttcttatacacaccgtttcaattttggcctcccagttccaagaagatttgcatgtgtggctcagtggtttttgtaagatagtaaagggacaaagggtgttggttcgagtccgttgtgcaacatgaatatttttatttatttttgtgcaaaaaattaaaaaatgaccatttttgggaattatttttggaggtttttaccaaccaaattgtacaatcttgacatcattcgaaagcccttgatggggagaagctttttctaagcaaatgctaagcaattggattgattaggaaaaagatatgagggttcgaaattttgtttctcgaataactttttagttaaccctttttttgcttttaaaaacccttacattttgttcgtaatttttttctctatcgacatgcaaaatttggtgtaaattgtatgagtagaaaaaaagttatatgtggcgaagtaaattcagtttttctctattaacagagataaagaaatagtacgccaaaaagagatgtttttttctctgcactctctatttattggttcatgtctcgttttttgaaacggtgtgtatactgttaaaattttgagattgaaaccctgtgtaatggctgatcgaaaatagctgtgggagctcaaagtgctgtgggagcaaaaagcaacaggggccaaaatgaaggaaagatgtccccataacaacagtcatcccctccagtggtgggtggatgtggtctaatggctaagacaacggatccacgtaaggggccccgagcggcggttcaaatccggccttccaccccaatttttcgcctaagtaatacactgccttaaaagaattataattataaaacttattttattcagtaacaagaaattttgtataataatagggttcgaatccaaatatgcactaaaaatcattcaaacatgctctaaaaagcctaaaaatgcccaaattgtgaaaatttcagaattaactataaaaacattaaaaaatggctatggaacgctttttcagataattgcaaaaaatgttggtttttatttttttatatgcatttccgaatttttatattttatataataaatttaaattaaaaaaattttttttataaaaagttcaaaatttttcaattttaaagaaaactttcattaaatcaaaaaattttaatgtagaaatgctattttgagtccctttcttcaaagcatatgcgcagaaaaatgtgcaaaatcataaaattataacctaataataaacaaatttataccggaaataaattcttgggttttttaattttctttttaaattctatctgaaatcaaattatcgccacgttcgacctgtggctgtagatgttccttgcccttcaccaagtcccccttccgtgtgaaatgtccctgcgtccgtgcacatccgccgctggtcccaacactttcccaacaacattcattcgtcttgttctgctgcagttcattcatttgcttttccaatgcattgaatttctccaaaagttcattatgatccttttgcatctcattgaataattcgacagaaactaaaaatttgtaatttttttgttttgttgcatattgtatttacagtattcctttaccgtatttgctcgtctcgtcctcctgttgccgctggagtgatttcagttgaccttccaattcatcgattctgtccaaaagtgtcttttggtccttccgttgaccaactgtttaaagaaagcaaaaatattttctttgaatatttgaaaaataagacgttttaggttcaaaaaaatttattgttcataattcgggctgtcaaaaatatgtacaaaaaatggtcaaaaacataaatatgtaaaaaaaaatcccgaaatatgtatcaaataagtaaataaaattttttaaatggttatttaagaaaaagtgctaaaaagtataaaattatctaccaaatatgttaaaatcccgaaagaatacaggaaaaaaatatatttaatataattgacagtcagtcctattcataatgtacgtaaaagcaggagaattttcgctctttgagcccatttcatactattttggcattttgtgtctattaggcgtgaaatttccaaattataatgccaaaattgcaattgaactgcttatgatcacaaattcccttccaatccaagcgcccggcagacccaatcttgcaggtgcctcccgacgctgaccacacgtccgtttttcctgctcgtccatctgttcaccatcgatcacaaacacaccgcattggacttgggcggttgcttcggggtgccgtttgcggtaaccggagcgccaacgacggaggagcactttggggtcggtgttcgaaaaaattccgagcgctttaattaagcaaattattatgctaattgtacacatcaaatgatgcacaaaacccttaattgcttcccgacaatcagcgaatgtttgctcagtgagttcaatttccacttgcgcggtggtgtcggacgatgctgccttttccctaccgacccaatcggaaagaatttggaaaaaagctgaagtcgactcgaacatccaagtgtcttgtgcttaagaaaaaattttttatcgagcaacgggacttttgagcaatttccttcctactgtaaattttttggcaaattaatttcctactgtatattctttttccatatttcccctttgtcgccggctttttctcaacttcaccgattcgtccaaaaattgcctcgaaagcatcgattggggcttaaagatgataaattaatatttatatttttaattttctattttttaacttttataaatgaaaactatattttaataaatttgtttttctcatcacttttttccgtttttgtttttgatgaactttgcttctgatgcttaatcatttcgctgattttttctaaattgttttaatattagcatggactgaaactgggtcattaaaaaaatttaaatcgattcaataaaaaatacagctaaagcaatgtttggtaatttctaccgtattttgtcaattctttttccctttgcttttcctctccaattttggccactttctcatgtagtacattaagctctgccaccaatccacagtgctttatcttttctcgaagttccttctaaatatttttgtcataaaaatttgttttttttttcactcaaaatcatatttatttacataataggtgcgaaaataagtgtcaaaaaaaatgaaaaatccagtgtctttatgcacaaaattcccaatttcgcccgcacaattgaaacttgccaagaaaataaataataaattttggaaatgatttttaaaaaagcttttttttcatttcagtatatttgaaaatattgggacgatttttaggagtgtatttttcgttattcactttttctatgaaattcctggaaaaatgccaaaatgtgcttatctggtcactagaaatgactaatatcgaaacaacatgtagccatatgacaatccgaccaatctcctccacccctgtttttaaataattttaaaattgctgtatccgcagcattcaaaatttcatattttgtacataatgtaaattgccctactttccccgacccaataccgtcataaacttgtccctctgttcgtcccatcccaagccaatcctatccctctcatttccaatgttatcgtgccatttcttccttttcccctctgttgaatatgccatccatttctcttattccctttgtgttatgccttcccaaataaccaattgcactgacccacccaaaatgctctgaggttgttgttgacctaaacatattcccggtttttaacacataattatttgtcaatgcttttccttataataaattcctctctcttaaaatgatgatttgaaatgtatttaagccttaaacccggggacacaacaaaaatcactatcttaagttcgccaacagttttaaattttgaacaactttttggcaattgaaactcacattttgttgttccaatttgctgatcttgtttaagtgtcttgactccttcaactcattttccattttgacaaatttttcacgaaattcctatgattaaaattgaaaaatttaaattgaaaaatgaattttcaacgaccttcagctgttgccgaccagttaatggtaattcctcatttcccccactggttacatcggtttccaaactgtcaataaatgcagtgccatcaacttctgcaaatgtaaaataaaatttataatgcaaattgccattggaaa

SEQ ID NO: 1577 - DNA, 13236 bp, Heterodera glycines
  misc_feature (8216)..(8216): n is a, c, g, or t
  misc_feature (8240)..(8240): n is a, c, g, or t
atcactgggactcaaccgtacgggggccttcggccccactcaccaaatttttgcgccaaaggtactcactcggcctcgtacggggcctgcggccccaacccttcccccctctccccttacaccaatttctgcgacaaaggtactcactcggccgcttcgcggcctcgtacggcggccttcggccccctcaccaatttctgcgacaaaggtactcactcggccgcttcgcggcctcgtacggcggccttcggccccctcaccaaatttttgcgtcaaaggtactcactcggccgcttcgcggcctcgtacggcggccttcggccccctcaccaaatttttgcgccaaaggtactcaccggccgcttcgcggccaagtaactggagtcttcggctccattccagtcaccagaattcaatctcaccaattcttcgaaacccaataaccggaaatgaatgataaaaccgaacattttcctcgtcttttcttatttcttgtggcatttccttatggcacaacattcttggaatttcatcagctcttcttgtttattggcattttcttaaggcacaacattaacattttcattgtctcttctattttcttgtggcattttttatgccacaacatttcttatcacagcatcttttcttgtttgttgacatttgcttatggcacaacattcttagcattttcgtcgtcttttcttgtttcttgtggcatttccctattgcacaacattcttggcattttcatcatctcttcttgttcttatcttttcctcgtcttttcttatttcttgtggcatttccttatggcacaacattcttggcattttcatcatctcttcttgttcttatcttttcctcgtcttttcttatttcttgtggcatttccctagtgtctcacacgaaagtcgcagaacaaaccactaatgttttttcaaaagcatgacacacattagtgtctcacactaaagtcacagaacaaaccaaagatatgcatttctatttcattaaaagttcaaataacattaagcataaacataattatttcacgtaaagaacacaaaaacaaaataaacaaacaacaaccactaaatcaaactcaaacaatatactgataaattttttcgtttacaaaaaacaaatttatataacaaataacttaataaactatgaacatacataaaaaagcaaataaataggtacaattttaagaatgtttattgcaaaacaaattgaaaaatcaaaaccaaacattttcatttttcaaatgcttttttaacgcaaaacaaaacaaaaacatttatatttttcaaatgcatttttaacgcaaaacaaatacaaaacgccatacaagtagttactccccccctttttggcccttaattttcagccccgccatttcagtcccagtggaaagggacatttcagtaccagatttaaaccttaaaaaacacctataataaatatatccaatcccagaagaggtaaataagtgaaaaaacatctgaaggataaaacccaaggctaaatcctattagagaaggaaagggaggcagaggataggcgtcagctgtcatgccttataaggaagggaagggacgcatgccacctgagcgcccgcgtgtgtgccatttaaacgctcgcgtatgccatttgagccccagagttattttttacagtgcaaccatttgagccccagagttatttttacagtgcagccatttgagtcccagagttattttttaagtttagccatttcactcccagtgcccacgggacacttcagtcccgagacccaaagcctattgagtagccaaagtctacggagggtcattaacattccttttaagtgcattttgaccaacgcagggccgacggagggtcattaatcattcttttgagtgcatttttgccgaagcctaagcctacggagggtcattaatcattcctttgagtgcatttctaactaatgcctccgaaagtgtcataaatatccccttaggaaatgtggagtctgttgtactaaaagccaactgagcgccattaaccattcttttgtgaacatgtctgtccaatcgaagctagtggtcattaattatcccttgggaattctttttgtgcatttctgaccgagtcaaaaccaatggaatggtcattaataaccccttggacgcattttgactgtataatgcccacggaagtgtcggtaatataccactggaaatagaggtcaagctgtgagtcaatgattaattgtgacagttgtgcctatgcaaaacccaacatcagatattctgtgcttgagacagctgctcaattgccggttgactttcagctgtgagtcaatgattaaataaagaatttaaaattaaaaatgaattataataaagttaaagttaaaatataactaaattcaatttattttagtataaatacctaaaaattttctcccattattcatttaaaatgttttttccaacgattaaaaattgcgttgctgttgtagacctcaaaataccccttgatattgaaaaaatttatttaatagcgccatccacaaaatataatccacgtaaaattcatgctgtaattatgaaagtgtataatccaaatgctaccgccataattttctcaactggaaaattcgtatgtacaggagcagctaatgagaaagaatgtaggcaagctgcggagcaagtcaccgaacgaataaggcaatgtgggtactacgaggcacgaatccacgaatttgcggtgaagaatttgattgcgacagcagacgttggttttcatatacgcttaggacctctgtccgactttctaggcgccaaatattgttccttcactcctgaactattccccggtctcgtgtacagaaaccaaaaccctaaaatatcgatcatagtgttctctagtggaaagcttaatctaacaggctctagatcaaaagaagaaattgattttgtatttaatcaattttatcaaattatctgcaatttcaaatattcaccataagcgataagaatcataataattgtcattatattttgaattattttcgtcaagtaaaggtattgactttgggaaattttgccctaaataaattatatcattgtccttcactttcacaagttcaagtgggtagaaacgttcattgccattcttgtgtttttcgatcacgcaaggattgcttgaatagcgaagacaaatgcggtgccgtacataaaaatgctggtcgacggtcacattcttgaaaccattgtaagccatttgcttacgggcactttctcttgtaattccaccgtactcaaaatctttgtattcatctagttgatttttgtatgttgtctgtagagtttttcctttgaggtatttttcaactttttgaatctcatccgggtgatttaagcagtcgcacaagttacgtgcgggacagttcagaagagaagcaattactgtgtctaatcgatccatttttataaatgagttaatgataaattcctttaaatactttttatcagtttcttaacaaaattcacgacaaacaaatctggattatcttctcctatcaacttttttgtcattttttcaaaattactctcataatttcttcctcctaatgagcacatacaatgaacaaaataaatgcaatagtagccgcaattctcactaaagactgactgaatagctggcttattcgagatcacgctttcataattccgtaaaaactggctgatacatctgttcggtttcctaccaaaactatcaaaatagtagacggtcttgtcatcaacgatgaacattgctatccaatgcgttccctctttattggatgggtcattgttcgccaccaatgctgaagggtacttgttgattttatttgggagtttgtcgcaagggaagcatcccaagtagtgttctctggtctttgtgtttcccgctagaatccgatttatcgtcgttgtgtccattttcgtctctacatatatgcataagcttacataaatttctaattaatgaattaaaatagaggaaaattcctgtcataacaatagctatccacaacaaaaccaaaagcatacagtatacccatctcgataatgacctcgtttcttcaacattacaaagttgaaacttttcaacaatttcatcaatcattgagaataattcagattgattaattttattcaagtaggaatggtcaaaggaggctattttataataaatgtcagtcatttcggtgtccctggatcgttcagggtagagaatagggctattataactcgaagaaaaatttatcaaaaataaagtatatagaataaacattttaaaaaattataaaatataaataataaatcactttaaatacattaaatggttgtatcggtcattactgttcgatttttatccaatatcaaaatagagtccatttcactcatggctattagggtgatcccacccgatgggacaggtgatctaaattgaatgcacacggtagtcgtcccttctgtaataagatcaataccctcgttgtcctccatgctattagtcatattaaacgcaaaaattgtccacccctttctatacttctcaagagaaattccgttactatctgttgaactggccatacctaacgcctcattcatttcgtggaatgccctggtatataaatttttgttaaaattaagctcaaaaggcgcagcgggccattgtttcccgtttgccatcaatgtgacggatcgaatatcaaatggtttaaaattaaatgggcttttcttttggttgcctacgtatgcagcgttctccaccattccgagaatgacccgtttaggcaattgacccgtaaatagcgttccattgtattcagttcgattctcgcttataaatgtggatttgatcaaagtttttctatgggcatattttgcttctttgttttcaagttttttctgtatgtctaatgcaagaccatcaacaacttcaagagttttaacatataacttacaagcggtaatttctattctatatttatcgtctgacgctgccattatcataaactcattgtcattaggggtaagttgtatatcaatctcaacgccattcaccatatatttgtcctgattaaaaatatctgcatccaattttgtaataaattgtgcagtttgactttgtgaaaacaattttcttctcagttcaaaaccctgctgagtaatatccgtgccgtcctgattctcactgtccacataatacccgctcgcctgtaggtctgactcctttacgtttttggaataagaaagttcggcatccaaatatgctttataagcataaagtgagttagagtcataaatctcacgtccctgcacagtgatttttaaattctttatccaagtcgcaccaatcatattaattgttgccgcttgctcattcactttcaaattaacatatttattggtgtcagaatccagctttttaattgacatttcggttaagatgtaacatttgttcaaatcaaagaaactagcggtagggtgaattttaaaatgaaaaggaatgtccgttaaaggattgagcggtaaatattcccgcactgaagaactactcactgacacattagttggtggaagggtaaatattgacaaagctgaagttatagaatttaccgattccttgtcaattttcttgaagaccattttaaaataattttccaaatacgtctgatctttttctcttctttattactgtctttggtatagtttttccaataattcttttccttttaatactcttttttcttcccgttccgaattgacgcccaaccccacctttttcgagtacattatccattcccttctttacttcattaattattgcttgtttgtttggtgtttcagctttctctattgtatccaatacacgtgttccagtgtctaatgcctctctacctaataatgtaccagccgattttaattttggtaaaagtgctctccataaaaacctcaacacatctcctactcctccacctcgctgtcttccatatcctcgttggtatggaggtatcccgcgaaaataattaaaggcttctcccgagccaatctgctctactacaacaaaatcatcaaaactaactgagtttggatcaaatatttgatgcaccatatttattcaattattaatatatactatatgtgaaaatgaatatttaaatactaaaatacaatagattttttaaatgctaatacaagtaatgttgtaccccattggaatggaataagccttccctccctagtcctaatttcaatttcaatctcagtaatttcctttactaccaccttaatgtacattggtgtgttataaatcttctcaatcacgtctccccccccccccgttgccgccgagcctctctcgcaaaaggcacggacccctccccaccattccgtcgtccgtcggcgcggaccccctctttccactgccgcggacccctcccccatcattttgcagtccgtcggcgtggaccccctctcgccatcgccgcggacctcctcttcaacggcgtgaacttcctcttaccaccacagttttgctgcgcaagtctcgggatgggggaggggcggggcgtcgggaaatactgctcaaaattgtgctagaggcgaaattctttcgccgttcagcttaagggggtgtgagttgacggctcgtaaaatttgaagtcaatcggtcaagggtgcgcgagttttagtccccccccccatcatccatttccattctcctccgcagttctgcattttaaaattttttatcatcataataaaaaaaaataagaaaaataacatacgaaaatgataactgattggtcctcccttttcattgatggttctcggcatattggcgcaaaatttctgcctcacgttcggcgcgttgaagaagcgcggcttcgatggtaggtgctcgacggtgtccaaaaagaaaacgaatctgaaaaaatgtgatgaaattttaaaaaatgataaattgaaaaacaagcttacgattgtcgggtcttcacgccaccagttcaagagcaaatcctcctccgcgtcttcaatttgtgcgcgcaactcggcgtcttcatctggttgttgatgcggcagttgaacagtttgaacattgtcgggttgttgaaagggacggtcagaacattcatttggagacattttttgtaaaatgaatgatgaaaagaatgagtagttttgagaatgcaccgccagcatgagtcattatcgattttgtcatactgaagagagagttcagtgtctgttttctctaatcttgcatcattttgttgcgaaaaatattggtggttgtcgaggtatatttttcatctcttccattactgtctcggcctcgctgggcgagaggtgcccgtgacttttaagccacctaattaaaacgaaccaaaaaagcaaaaacacaggaaatgcaagaagataatgagaaaaaagcagtacatgcaaaagagtttcattaggctcttctggggaattcaaaatttgtatggccggtttcgttgtgttggtgttattcattttaacattatgtaataatatttttatttatttataatttacccaagctttgagtcggtcacaatgtgccggttataatcaaccataatcatttggtcgaattcacccaagacaatcatctctacaccaccatgcggaattggtgaattgaatgttgctcgtacgtttgtcgtaccacttctcaacagctcaaatccacagctgtcgtcaagcgtggaagtcaatggaatgacaaaaaaggtccacccttttttgaactgggccattgaaatgtcaaatgaacgttccgagttagccattccgagtgcctcatacatgtcaacaaaggcgctgacaaagtgatcatttgaaaaaataagtttataaggaacagctgggtaaactacgccaccagcatgtaccgaaatctcacgcaaatcaaacggctcaaacatgaatggactcagtttgtagtcaccatgaaatgctgaatttccaactaacgcgattgtcacgcgtcgaggaatggtcgcgctgaagacattatactcaaattcgtatcgaccgacactgatgaatgacgacttgatttcggtcttgcgtactgcgtatgtggcgggttgtttttcaagtgttttgtagaggctttgtgaacagcaaatccaaattatntaagagataaagctcctggtttcncagatcaaagtcgaggcaagagaggaattgcgcattttttccacccttaaaaattttacaacgctctttgaacccatcgtctgttgaatcatcttgatttacggtgtgataataccctgttgaaccaagaaaatttttcttggcatttattggaaaacttaactcattggtgatatatgccttaaatgggtataaatttccgctatcgtatacttccgtgttaccaaccgtaacttttagttgctggacaaatgtttgaccaatcccttgaatggcagagacactagtatctgcatcatctatcgcaacccatttatcgtttgctcccggtttttcaatggacagttcgagataaagatagatccgagacaaatctgtccacaaattgtcactgtacagacgaaacaggtacggtgattcttgtgtgattgttgctagcggaagcacttgacgaaagaaagaacgcacaacagacacattggtcggtggaactgagaaaatgtttaggccactgttaattgctaggggactgctgtcgctgattttttgtgggcaagtcatttttagtaagttcctaatgagtcaacacgcagacgtttatttttggtctttacaaccattggtggcccaaaggaggattgaagtttatttatatttttcgccttatttttccaattttgggagccgagtcttttttataacgtttaaaatcaaaaccttggcccttttgagtgtttatgttgttggctgctttttcaagaagattctttagtcccgccttactctcactaacgagcgactctttgaggtcttttccctccagcacattggtgagtactcgatttccgctttgcattccttgacgtccaattgcggagccaatttgctttccaatcggcagcaagtatctcataaggcttcggaacactgcgccaactcccgctccacgctgatagggtaatcccctgtaaatgttgtatccaccaaattgaacacacgaggacgagaacgcggaccaatccacttgaagaggatcaaaatcaacatgcatttttaaaaaattcattttggtgttcttttcattatttatattctttgaaaattatgccttttacaaaattgtttacgagcgtatccggttgctgctttccaaagtgcaaaaatctgacaattttttcaaaggtcattccaacacatcgacagtacaaaaagaaaatgacatgacgcccacacgcacttgagttggcagactgaagggggatagagctatattgaatttgtttgtagcgtgacaaatgattcacaataagaacactgggtggtggccacatccctaatgagtcataatactccaaacgcaaaggagaagcgcaataaatgcatacccaatgagagccacgcgaggtgctggggtcaagattcaccaccatacaatgtggaaatttgacaattgctccggctggtatttggtctgccgcaaaacaaccaatatagtagtggcgagtcacgttgtttcttgccaatgttttgtcaatttccaacgtgttcatttttttaaaaataggacatttttctaaaatgtaaagttaatgtacaagttccgtattggaatggcatcaaacttccgctatttgtacggatttcaatcagaatttcagaaacttcctttaataaaattttgtgatattgtatggcaaaaaattgttcttcaatcacttggtcggggtctccgcgtatggttacaatgcgcaacacgggggccgtgacgtcaccaatcatcattggttcaatgaggtctggcgtgtaaacgtggaaggatgacactccaccgctcatgtccggcatgaattgtgcctcgatttcgggctgcataaactccgtgttgttgaagccgagaatgtaggcaagttgaggcgagatttcaacctttttaacgtaccgcggatcggtgttcaggacaaaacgatttctatggacgtcatagttaaattggcagacaagacgtatctcacgatacgcctgaatccatgcttccgttcccatttcctttgtggattcaagggatcgcacgttcctcttcagtcaaatttttgattttggcgttcaattttgtcatacccaattcatcaagaatgctcaaatttttgtcacataattttgaaaagtacgcatccaatttttgctggtaagaatcggtatcgtcagctaacgttctcaacggtatatttctcgtttcagtacgcttttcgcgtgccagaaggccttgcgccacgctgttcagttcaaccaatgttccagtatctgtcaacatggcctgtaagagcagctcttcgtcacggacgccccgtttttctttagtctttcgcttaatgtattcttctctggcccagcggcgagccttgtttatcgtcagcatgaaagaattctgtgttgatcgtaccttttttgccaacggatcatttccctctccaaggagtctgtataaatttttgctaagctcatgggggttggtgacatttgatgtcggaacttcgatacgtaccgtattgcctgtctgccactcaatctgtacaaattgttgctccacggtgcctatggaaggccaagagtggggataaacaatcaccgccagacccacctcccattccgaattgaattgtagtttgcgcggtaaacgcactcggaaagtatttgtcctatttccttcaatattggtgttggatggaataacaacataaaaagaatttgaaggcattttttgttaaaatttattaaatagtgcttttttatatatctttctcggtaattgaatttgcaggaatccaactattgaagcgagcgctataccctttccatttcacaaatgcataatccaccccgttctgtttctttttcttcaaaatcttttcaatttcatacatattttgctgcttgtcttctagtgatttgcataaatcatttgcgtaaaaccaaccactaattatttcattatggtcatcacgcaaccgataaacaactggcgaacgctctgtgtgtacttctaccaccgtgaatagttcattggtgaagcgtgggaggtagcccttttggaacacgtgcttgtacttttcaatgcgcacgcgatctcccacacggtatcttggctggcgtcgtacaacattttcagctgcattatgtaatttttgtctcaacgcttctgcgtttttaaagttcacgtctgctgggcgcattccaatgctcgaatttggcgagtggttaattgcacgaacaatgtcttgcacaacatcaatccacttgtacgtgttacactccgtaaagtagcgataaagccgctctttgatgctacgattcgcacgttcggccattccggcatgaaattggggtgaagtaaacatacaaaagtgttcaacgtctttagctcggaagaaatgctgtactgcgcgggcagtgaattcctttccctgatctgtcaacaccttccacggaatatattttgatcttttgaaaatacgaccaaatgctattattatgttagtgctcgtcttagtctttacgggctcaacaaacacctgtcgactaagggtatcaatacagactaacaagtacttgtagccacggttttgtttagcaagtcggtcaaaaatagccaaatcggcctgccattcagtgtgtaagcctggtgccaatgttggcaatcgacggtagcgccgcttggcctgacgatgcagtgtgtatgtacgttgggtggctaaataattttggacatcggttcgattaatttttggttgagttttctgcgcctctctcagcagcggttcaacgctcgtgaatgcgacaggcgaacttagttccttgtacaaaaactcaagcaaacgaagctttttcaaatccataaagatggattaaatttcagtgtggtgtttttataaatgcctttgccggattggccttcgggaaagagcttttattcacaagccgtgccgttgcactgacaaattttgccaccgaatgttctttttgtccacacttcgctgtctctgaaaattccttgcgattcgttcggaccaatggacggccaatggcccttttcattggtcgcaaaattggggtgactaaataaaaagaaattgaaaagtcattcgttcgtttgtaagaactagagttgagcgggaccgggaaatttgacaaaaaccgggacttaccgggaccagaaaagtcgggaccgggaccaagtttttcgaccgggaccgcgaaaaaacccgggaccaaccgggacttttcccaggtgaaaattttttttgaaaaaattgaaaatttaagtgcactttgttacgaaaatttccaatattcaaaaatgtacccataaaattttgtatttacgttttgggggacgagttcgaggaaaatttttaaaaattttgtttcaggggggttcttggaattttctgagtcccaaaattctgtatttttttaaataaattaacaatcttttaaattttttgcttttagatctctgtttttttggcaatgttttttcaaaaaacttttttggaacattgggagggggcggagtccggcggtgccgataggcgtcgccggaaaaattttgaaattttgagcgagatttgttaacagaatttgtcaaaaaatgacaaaatatttggttaatttatgggtttttaggctattaaaaatgaaaaaaataataatttaaattaaaatattttttattaattaaattcaattaaaataatggtaaagaaaatataaaaaaattttctgttccatcagggaattgaaccgaaggacaaataatgaaagtaaaaaggtttagccacttgactatgatatgaacacatgctataaatgaaaataaataatttaaaattagtttatcaaaaatttctgatccctcatcaattcccttctcttttctcacccagacccccattcttaccagtgcttatttagtcccgccgggaccgggactggcaaa

SEQ ID NO: 1578 - DNA, 3521 bp, Heterodera glycines
  misc_feature (3302)..(3302): n is a, c, g, or t
  misc_feature (3311)..(3311): n is a, c, g, or t
  misc_feature (3313)..(3313): n is a, c, g, or t
  misc_feature (3333)..(3333): n is a, c, g, or t
  misc_feature (3353)..(3353): n is a, c, g, or t
  misc_feature (3376)..(3376): n is a, c, g, or t
  misc_feature (3379)..(3379): n is a, c, g, or t
  misc_feature (3386)..(3386): n is a, c, g, or t
  misc_feature (3405)..(3405): n is a, c, g, or t
  misc_feature (3409)..(3409): n is a, c, g, or t
  misc_feature (3413)..(3413): n is a, c, g, or t
  misc_feature (3443)..(3443): n is a, c, g, or t
  misc_feature (3452)..(3453): n is a, c, g, or t
  misc_feature (3458)..(3459): n is a, c, g, or t
  misc_feature (3468)..(3469): n is a, c, g, or t
acgtggcgaaaagtgccaatgttgttggcacgcctttagcgcttgaagcaacatttgtcaaaaaacaaaaacaggcctcaaacgacaatgccaccacaataagcccaaagagtaaaaaggagaaaatgaagttgtggcagcgaaaagtagttgtgaaagccgttcggatcgaccgacggaccaaggcaaatgtttgggttgtcaaaatgtacgggttcccaacaacgattcgggctggcacaaggcattttgcagacggccttgggttcccaaacaatttcaagcattttttttagactcaagaaataaaataagagaaaagtttaataaaatggaaaaaaaggaacacaaattggaaagatgagaaatggatttggacgattaagtgaaatgaatttgaagaaaaaacattcaattgacaaatttccgtcggcttattcaatttcgcacctgcaaaattgtccttttctctcagttcagtgtactatttcgcactttttgtgttgacaattgcacaattttattcaccgttcactctcccacccccacccccctcttcccatctctcagcaccaaattttcgaccaatttcttggaagtgaaaggaaagagtggggacaattggccgaacttcggcctatgaacattgcttcaacaggcgccgttgtgatgatcattaggggccgattggaaacaattagcgggatcagaaaggggattaaagaatgtgactaacaaatgtttaatgggaaaaatttgccaatcacgagaattgggccaaaaatgaatcggctggccagccttaaagtgatcaacataacaattaatcaggaatgtgttgcgaaaatcgccaaaatcgcgaaaaagcccaatcctctaaacagagtaattaattagtaaaagacgggcgaagtaaagtcataaggcaaataatgaaacatttgtgctcaggcgaaaataaaagctcatttgggatcccgctaatcctaggccatttgatttccactctcgagactctcgacttaagaaaatattaaataattttcactgattaaatattaactctgtacaatttagtattaaattttcacaattttagcaaaaagcaatcacatatttctctaaccctaatcctataaaataaaataacatcattcattgcacgttactgactgagcggacacagctgaacggagagagtcgaaaagtcgttccaaaaaggcaccattggcccaaaaagcctcattacatcaaagagccgttaataattaattaaattaatccgaaatgaataatttttactacagtcgttaagaaccactaattggactaaattttaagtcggagaagattggcacgacatttccaacgcctggaaacactggaaaagagggagattttcaaattggacgcaaacaaagaattgactggaaaagaagcaaattggtggagattggcacgacatttcggacacgcggacacattgcgaacagaggacgaaatttatcggacaaaaacaaggaattgactgaataagaagagaaggtgactttttgttatcttggaaaacatttttgaaagggctaaggtggtagaagtttcctcattttccattcatttgttgcgagtacggtattaaaattgggtacttttgaaaagtgccattgcttaaaaagcgagtatctgagatttgtttaaatcgtcagattaatatcaaattggctggcaaaagtgaaaaaggttaccaaattcctggcaaaaggaacagaattaacacattggttcaaatattaccatttattgtttggcgaatctgaaaattaaagtggcaactgtgaaataaccaagcagtcaatactgtaaatacagaagaaaatcaaacaacgacaaaaaagagaaaacgtttgaaatttgaaggtacggtattaaatactgtattgtaaaaggagacgaaaataccgcatgaatgtatttacaatagtttgactgttaaaaaataactaattctgaataatcgtacccaaactgtcatccaattcagttgagacacctgaatatttgaagaaacggttcaaaaataaggcacaaagtaatacagaaagattaaaaaggaaggaaaagagaaacgaaaagagagagactcaagaacctcaagaatacgtaataaatatggatcctaataaagatttggaaaaaaaatacgacgccttaaaggttaaattaactgagttggaggacaaaatgactaacaaaatctcaactaacctaccgcacggggtgcgtatgcccaaatttgatgctacgggagattttcaccaattcttaaaagaatttaatctaatcgcgacagcgtcgggatggcatccgacggactgtgtccgaatgctcccactctttttagaaggggaagcccgggaacttttcatgaatattccatcggataaaaagaaaacgtggcgagaaatgactgaagcactagctgatcaaacaaaaaaaattgatggtccaatgtatgcaaaaaaagtgcttgccagaattaagatgggacacgaaagtgtcacggaatttgccaataaggtcagagaacttgttgaacaagcctcgccaagtccgcattataccaaagaggcaagagagtgtgaaacagttcattattttgtaaatggtttacccacagggttaaaaagaaaacttttctttttggataaaccaaatacgttaatggaggcaattgctcaggcaaaaaaaataattcaggtaaaggaggagctcgaaagtgatgaaaaaggagatgaattaaaaagacaaattacagaactgagccaaagggtaaatgcaatttctgtaattaataattcaaataacgacggtaacggtcgtgaatttgtcaactccacatggagaagaaatgacatgaataataatgatgtcaaaaatttttataatagaggacggggaaacaatttcagaggaagtcagagggcaaggccttccggtggatttatgaacagaaatccaaattttataccacttggccaaaaccggtattggcgtgggaattctgaaaattatcagcgatttggtgcaaatcgcccccaaagaggaaatttcacgaatttcagagggaattcgagaggcgcgggatctggaaggcaaaactacaaaatcaatgcagtaaataacgagggaaccgaagatacgagacaatgccgaaggtctccgactccgtctcttacatttctaaccgtgtgtaccattttctctttactatttacaaacacattagctcaataccaactttnttcttacananttcctaccacccctatttanttaccaaacataactcaatntactataacaacccaacaaaaancanctgaaancaaaatcacattatttttncctntcanaattccaaaagaattccaaagctataaatnttaccaaannaattnncaaaaatanntgctcctaggagagttttcttttcttttttaaagaggtgaaaagtgacgaaa

SEQ ID NO: 1579 - DNA, 3175 bp, Heterodera glycines
gaattaaaatcattacttggggcactcacctattttcggcgttttattaaaaatttcgcgcacattgctcgtccgcttcaaacattaactcaggataaatttgagggtaaaattgaagaaaattggggaaaagaacagaacgaagcgttggaaaagctaaaacaaatgttaacttctgcccctgttttacaatcaccaagatttggcagattatttataattgagtgtgatgcctcgaagaaggcaatcggagcagtactgttacaggaaaagggaccagtggcttttatttcacgagctctgaacagacatgagactaactatccgtccattgagagagaaacgttagctcttgtttatgcagtgaaagaattttcaccatacatagtcggctcagggattacaaaagtgataacggactgtagcgcgcttacctccatgattaaagccaatgaattaaagggaaggctagagaaatatcaaataagcctacaaagctttgacttagaaataatttaccgtccgggaaacaaaaataaagcggcagattttttatcccgctacaatatcccaaaaattgatataattgaggagtcggacaataatcctaaagagtcaaaagaagaaaaggtgaaaatacttagtgcacagagtttggaaaattcaagtgaaaaaagtggaaaagaaattttttgtgaaaaaggacaaataactttggaagaaattattaaagcacagaggcaagtaaaagaaggggcacaaatattttacattttaaagacagggaaaatcccagaaaaaacatcaaaatggtcacaaataaatcatgattactgtcttataaatggagccatttactataagaaaggaaaatcaaacgcagaaagaccaaaattattaattccttatttatacaggaaagaaatttttcatttaattcatgatgagggacattttgggttcgacaaaacttggccagaaatcaaaaatcgattttattgggttggaatgaaggatgacgtaaatatgttaattgatagttgtgtggggtgccaaaaaagaaaagttcaaccaggccaagctaaggcatcaccaggtgtacccataatacctacagattatcctttccagagggttcactgtgatataatgggaccgctgaaaaaaacggagaagggaaatgtgtacgtattccttgcaattgacagcttttcgaaatgggtaatggctgtaggaataccggaccaaaaagcagaaacggtttctgaatcatttgtggaaatggtaattcaccaacatggggtacccgaaacagttgtgactgaccaaggcagacagtttatgtcacaaatttttgagaatctgtcaaagtgtacggatttatacataatacatcaacgccctatcaccaacagtcaaacggagcagcagagggtgcgatcagaattttagcaaacattatttcccaaatcattaacgaagaagggaataattgggatcaaattttgtcaaaatcagtgtttgcatacaatgtttcgatccattcatctacaaaaaatacaccattttttgttaattttttacgaaacccgcgtctgccaactgatcagttacttaagctaccaaaaacagatgagttaacatcagatatttcggtttataccagaaaacatggtgaaaaagcagcaaaagcgtgggagtttgttagagatgaaattttaaaagcacaacaaaggactaaagaggaaaatgatttgtgtaggaaagcgaaagaaagagaatttgaggtcggggacttagtacttctaaaaaaggaagtattgaaacataaattcgataaaaaatggagtggtcctttccgatgtgttggaattgaaaaggataagatgaatgtactcttacaatccttagaaggaaaagggaaattaagaaaagtacaccaagaaaaggtaaaaattttctatggacccgcagttttaccattgagaccttgtgatgaacccctttgctgggaaaagtatgttaatgacccaaatttggaacaagaagaagcagaagatgaaagtgagactagcgaaatagaatatgatgaattgaaagtggaagaaaaaaataaagaagagaaggaaggtggaaatccgacaaaaacggggaaacaaatgtcaaagtacggctttgaaagcagtgatgaggaaactcattcaaaaattattgctttcatacgagaaaaccaaaattttgaagaagatgaggaaaatgagggtccaggaattttaatgggcgatagaaatcccgaaatcgaagccataccgacctttactgagcttgaaattttgctcgagggctcatttacgagagtatacacagggtggataaatcccgtaacaatcgcattaatttcaagtatacccgaaaatttagtcagagaaaattgggaaatttacataaatgaacatggctcaagatttgtattgggttggatttttggtgaaagttttgaaatttatattattaatgaatttgatgaaataatgctaggaatcgatgcgcaaatgttattaggtgaaagatggaggctaaaaaacgaagaactaaccgaatcatactgggaaatttatgttgacgaaagtggggaagaagttgaaataccgagaatcccggaaattctgatttctgaaaaagaccatgtggaaaatgaggaaaacggaataatcagaataagcataaatttggttaaaaatgaaattgagagagatttatacgactttacactaaatacaaatccaaaagaatttatagaaatggaaaagaaaaaaattcaggataattcgaccatggattctcttacaggtatggaatcgacgtccaatttatttgattcactcacaaccgacgaggaggaatcattgaaacgactcaaaagaagtctaatggctcaattggaaagagtcaataaaacgctgaccaattcggaacaaatgagcgaaaagcctgaagaaatggccgacaaaggaatgccagatgaagggataaaaggtcatgcggtggaggataaaatgggcgaaaaggccaaaagaagtggccgaagttacaaagccatttgaagagacggaagcgaaaaacgaaagctcattacctgtcaaaaaagcagaaggaaaggtcataccagaggatt

SEQ ID NO: 1580 - DNA, 6760 bp, Heterodera glycines
  misc_feature (4428)..(4428): n is a, c, g, or t
agttgaaataccgagaatcccggaaattctgatttctgaaaaagaccatgtggaaaatgaggaaaacggaatagtcagaataagcataaattcggtaaaaaatgaaattgagagagatttatatgactttacattaaatacaaatccaaaagaatttatagaaatggaaaaggaaaaaattcaggataattcgaccatggactctcttacaggtatggaatcgacgtccaatttatttgattcactcacaaccgacgaggaggaatcattgaaacgacttaaaagaagtctaatggctcaattggaaagagtcaataaaacgctgaccaattcggaacaaatgagcgaaaagcctgaagaaatggccgacaaaggaatgccagatgaagggataaaaggtcatgcggtggaggataaaatgggcgaaaggccaaaagaagtgccgaagttacaaagccatttgaagagacggaagcgaaaaacgaaagctcattacctgtcaaaaaagcagaaggaaaggtcataccagaggattgcatttcgttggatctcgaggaggaagagagaattctcgaatttccaaagactttcgagaccggagcattgggattttacgaatcatgcgtcaacaaaagcaaatcaaagtcggaatacgaagcaaccttaaaaaaagtggagaaaaagccaacgaatccatggaaaattgcttatcacgaaataaaggcggctgagacaaacattttgtcaaaaaaggatgaagcaattccgcccgaaggaaaaaagaagaatccttttgcagagagtacactggataaaaaggaatgtgaaaacaatagtcgaaaaagattcgctgttggagacccatggcttgcacctcccaattcaatttggcgtgaaatgaagacgaacgagccgaaggaagtgcaaaatgtgatggcaatgcttctgagcatacggaacaaagcattggacgtccacgatgaagcacagaatgcttggaacgaattaatgaaaatgaaaggaaaaggggagaagaaagaggaggaaggcatggattccggacttccagggttttcaactgctgattggcaatccgatcatgaccgttggcgtggacaaaatcgttggcgcggcgaaagaggagcaagacgttggggacaaccatggcgagggcgtgaatggaaccaaccaaatcaaggagcgggcccatcgacatcagcggcatcacaagaaggacaatggaatttctcaaagatggcgggatatggatagaaaattggattttgagttggaattggttgcattttagattttttttttgggccaaaatacaacaaaaacaaacaaaaaaacaataaaaaattaaaaaatgcaacaaaaaattttttcttataattacttttttttctctctctctctctctcttgtaatattttttgtattttcgggacgaaaatatgtcgggcccgggatgagatacgataacttactcatttaacacatttaattgttctccctaatctatcattaacaaatgtccctggggcgaaacggggcggtcccttcaattgttatcctccccccgtcgttctcctctgatcacttttcggatttggccaatccaactttgcgagagggaccccctcagacgtctctctgttcccgaggacgttctgggctggggcccccagttgtacccctttattattacccaataaaggactattgttgacggtataccatttgtactggggatgcgactgggaaaagggccccccgctacactacgaatgttacatgtatggataaaatgggaaaattcccaaaagtgccaccggggacagcgttaggggatgattaagtaagcagggcagataagggataatttgttgggaaatggggctaccgggaactaaaagttggggggcgaggaagccagggaccattttgtcgaccggacggcatgccggggcaaggaaattgggatattaagcaagggataaatttcgggggatcgccattttgaagattgaaatttggtacacttagtcaacggacaattataggggaatgagaaagttgcacaacggggatcagcatgtcggaaaacagaaattagcaacatcgaagtcggggaacgtgccggggataaggatttcggcatatcgggaaataaaaatgtctagggataattctgtccgggaatcatgatgtcggatacaggggctcaacatgtcggaaaacatcaggtttggccccattcaaatccctgcacatgccaaaacggcgccaatgtccacgccgttcatcccaccgcaatcatcagcggagtcagccgcttttccgtgccgttcggcgcgtattgcatgtacagcaagctgctcagctgttcaccgtccagcacattgagcagtgagcgcaagttggccgcttcacgatcgtagacaaagtcgaaaacttgctggtaattagtgcaaaatgctgcacattttgcttttgctgatcagccgagcgatcggtctgccgattgggagggatttgaacagagatttcctcccatctgtccttatttctaagagttggcccttatttttgcctatttttcacacttttttttgatttttattaattttgtcattctgcttaaaattggtgcataattacatattattaaaatttgtcaatttataatttttcctgaaatgttctactaaaaaatagtagaaaatttcacaaaatgtcgaaaccgcggaataacaacttccaaaaaacagaatgctttttttctctccaaaatcctaaaaaaaaaattttgcctaatttttctgctaatttttaaattatattaaaattttatggaaaaaattataaattgtttttgattttttaagaaaaaattctgttttaattgaaaaaaggtcggttattaaaggatatgggtggccaaatgcccaaggcgggagggagggtagtactgtcaattaccataacattgtcgaaaaaccgtaatagtgcaacgcacaaaaataaggacagccaacaaccgccattggtgtagcaaaattttgccatcgatggggcagatgaaacgacgcttgttgttgactaattttttaaaaatggatcaaaaaaatttttcactgctggacgaggtgtggctaaagcaggggtagtaataaaaaaaataaaaaagaagtatttcgaaattaattttgtcttttttattcaaattggataaggggttggaacagtctgaaaagaatgtcatatttgtgatagctcggaaacccccggaattttgcatgtcctatggctctcaattgtaccatatttggatctttttcataattttatgaaaatttaggacatatttaaaaaagaaagggtttttcctactatttagagcatggagaacccaggaaaaaagtgtttttccgttttggcctaaattttaattttaaaaattcaacaaaaggaaggtagaatgcaaaaactacgtgccaaaattatatcgttggcataaatgccacaatttgagctgatttccttaaatggatttatgccaatgggaaacaattcagcacgccctttgtcgtttttaaaaaaattcaaatctaggcaccaaaacggaaaagtacccgaaatttcgaccaaactagtgaaattttttaaatttaaatttgccattttgattgaatgtacgactttcatctttgacctcttttattatacacaagtgtagtacaaacaaacaaaaaatgctaagaaaatgaaagacaaattgcaattatatgacattttaagacataagtacaataataagaataaatgtataagtaattaattaaaaagataggcatataatggaggaccacttttttgaggaaagtgaaaaatataattaaaaaatcaaaataaaatccatgtccatcaaaaatgtcaattttttttaattacatttttttttgattaatagacatggatttccggtataataaatgttcaaaaaatgtgcaaaattttgaggattaaatcttccgaatcatggcgcatcatctcttctgtcctcctcctttctctgtagtgaattttcaaaaattttaaattttcactccccctttttctttcaaattcttttttgtatttactcattcatcatcatcatcatgcttctgcttttgtgtggcgttcagtgctcctcagcaaatggctgagtcggaacggttccaatcgactgaaaggcattcaaatttaacagcaaataaatattttaaaaattaacacacaattttaaaagtttaataagtatttaggaaaaaaaagcgttagtaatgaactcttctttaagaaataatccgcggctaaacgacggggaacatagtgagagtgatccaaaaaaccaagctttcgttgctctaattttaaacncctctccacaaaataagaggctttagtttttttttgaccccatctccccccttaaagttagcctcgacttgagaaacttctcaatttttaagtcttgagttggaatttaaacatttttttttgcctcgggtctcggaaaatttttccacattatttttatttctgaaattttctatttatttgttatttgtatgagttggccagtgatccgattcgtaattttccgatcattcatctcacagtatcggaattgaattttttttttaaataaacgacgttgtttttccctcacctttgccccctccgttttgcttcatcattttgattttcgccaattttctgcttttgatggcagttgtccgctgctgatgatagcaacattttggagcaaccaccgccgctgatcaccacacagtcccaatcattgtttggatcatcgccaccaccaacacaattttgttgctgttgctggtcgctcatttgcttaaaatttggaaaaatcgggatcaaactttgaaaagcggaatgggtaagcatactgtatacttactgtattcccccccccccctctaccaatcccacatattacagtagctcgtccaaaaaaatgtcgtaacagtgatgaattttctttctgcttgctttgttgaatggactactcaaacaaacaaaaagtagcacgagaaccaggacaagacggaattggggattccaattagggccaatccgtaattggttcctaattagagaggtctttgaaaagccgcagccgttattattcaagtccagaattttttggaaaaatgttgatacattaaattcaatgataactgttcctcctactctatttatctacctgaatcctctgaacggccatccggtaacagttcacctccaaccaccgtggcggcagcgaggcgagaaaggccggcatcagcacctgtgaagggcgcaaaattttgaaaaattcaattaatttccccaaagaaaaccgaaaattctgaaaatgagggctgatggtccttaccaggccgtggaagagtccccagatggcaaccagtgagatggttttgacgaacacgagcgggatgtaattctgaagcaaatttccgcttttcgagatttatcgaaacaagcaacctctgattttgggaacaaagcaattttcgtttttgtgggattttgtgccaaattcaatcactacgtaatgtaccctatttgtttaagatgccagaaattggaaattagaaattcgtatggcctagcgttgcacgagaaatgcttttttcgagagtcgagataaatttgcgaaacagggaccgttgaaatcgaataacaatcactcgagagactcccaaactggccgagatttggatctcgaatatgtataatgtaagctcatcaatcagtcaagcaatcacttgcaggaagacaagcggcagcacgcagatcaccgtgctgagccccgcctgactcattggccacgcgatggagcgtaacgcgtgctgcaacttgtcgcgcggtgttcgcaacggcacgagcacaacgcgaccgtcgcgcgtttcgcgtcggtgggacagctgaaacaaggaggaataaaatgtgaaaagaggaaaatttgaaacttctgacactaagactctcgaatgcgatttatgtttttaaataaattttaaaaaatagcattttgctgctcacttggaaagagtaagccgtatgtgccgtaaaatcgacgctcatcccaatggacatcagaacggcgcaaagtgttaccttttcaagaagtaagatagaaaagatgcttgattacgttaaatagattagacgatttagattgtgcgtagtactgtattccaatgcatactgtatcattccagttttcactgtctgcgctctaccgcgaaacagaacacaaattgatacaatatgaattgaccagcagacattgaaaattggtttaataaccggtaaaaggactatgtagagttcgtgctgtactgtacctaccgggtccaaatgcaaatgccaccaggacagaaagccaatgacaccgatggaaattgagccgatggcacacgaagcggtgatcacggacagtgggttttggatgaaaatggcacacaccaatgccatgcaggcaagcgtcaagaaggtggtctgacaaaatgggataaatttgggagtgaggcgtatatcatattaatgacaaaatttggctttatataacatcaaattaagtcggataaaagaacatataccgaatcagaggagcgatatctgcggattttgtcgataaatattattattaaattaattacgctttcaaggattt

SEQ ID NO: 1581 - DNA, 2034 bp, Heterodera glycines
atgaaaaacacttttgaggacaaaatgtcacaagacaaagtgtcaccatttgatgatacgaatgaaaatgttaatggttacaaaatgtctacaaaaaatcgggaggatcaattgtcagaggaaaaaaagtcgacaacaaattttacgatacagtgtcgttcgctgtatcagagaaaatgccaaaaaatgatgccaagggaaattgccaaactgacaaagtatcaccatatgaaaagaatgatgataatgatgacaaagcgctgacaaaaaatttggaaggaaaagaaaaggttgacaaaacacaaaataaggaaaaggaaaacaaaattaatgaagaagaaaaaacaaagcataaagattctggtaataatgatgaaggaattgttacagaaaaagaagccgctgttacaaatgccaaaaccaaaaaagcctatagaattgcaggtattttaaatgaaagaatatttataataattaaaaataaacggttacttttattagaaaatatataaaaatatttaaattaaaaaacttatcaatatattaagaaataagtaaaaacaattaaatgaaaaaaaagttgaatcatatttcaaataaaatttcttattttgactttaatctttttcttggaaaagaggggaaaatgttgttattaaacttaaaatttttaaattgaaatttagcaaaatgattttcttagtgtatttcgaaagaagaataaaaatatcaattttatattaaaaaaaataaataatttttcaaaatttatgaccttttagatatcaaagaggatgtttttcttctgggccattttcaaaatattctttcaaattcgaaagagtttagcattgagatgccgcgaaatttgctcgagttaggcatttattcaaatgaaatttggcaccgaattttggcagagagacattttgacaaaattggcatcaaattttggcattcaaaaataaattttgaagagaaatgggcagaaattgaaaataataaaataaataaagaaaatgaacaattattgaaaatggaactgtaccaaatgttgagcaatttttccccagattttgacgaaaattttgaaaaaaattatgtgaataaaaattggcaaaaaatcggtgaaaaattgcacagaaattggttggccaggacccttttgtccaatggtgaaatgtcgaatgacgggccaggacgttttcgtaccgccgttttcgtaccgccattttcgtaccgccgttttcgtaccgctgttttcgtaccggagacgttttcgtaccgccgttttcgtaccggagacgttttcgtaccgccgttttcgtaccgctgttttcgtaccggagacgttttcgtaccgccgttttcgtacgagtgagtatcgaaaaaattgcattcaaataatttgttaattttttttaattacttttaatgttttgacagttaagcttttattaactacaaaatgaaccagcagcaagtaattaaaacaaaacgaaataatgataaattggtgcatgatggtgcactttatgtgttccacaaattcagtaacgatggacttaagaaatttggcggtgtgagtttcatagcccggcagaccaatgcaagggtatgcaatatattattttgaattttgaaaatcttttaaaattcaggacgcttgcacacggatttaaatacgttgtgcagaagttggtcggagttcattcgtgcgacatgaacgctgcgcatgtggaatgtcagcgtcttgtaactggtgacgtgctgctgtgacgtgcgaagcacctgcgaccattcgtgctcaagtgcttcaaaacacatgcacacctgtgctggcctcttttccgagcaaagatgccacaaaaaaggtgggttactatcaaaaacaattttgtaaataattttgttttctttttattcacgtcatcaaacgtttgcgccgtgatgaaaatgcaccgcgagtccaacctcaaattggagcagctgaagattccgaatacctatcgtgtttataagcgccctgagatt

SEQ ID NO: 1582 - DNA, 2522 bp, Heterodera glycines
  misc_feature (2478)..(2478): n is a, c, g, or t
caattttgcgattcattgcaagatcagatgtgagcagaaggcgcttgatgctgatatgccacgttgcatgaatgggagaagccgcaccccaaaagaaaaggaagtatcccgatgccgattcacggattcttcgtctcgtccaacgttataacgatgtcaatattgtcccccaaaatgatcacaattatgccaatcccaatgtgaatcccgaaaacattaacaattttctcgccggaatttcccgaaactatgagatgcgaccctagtttgtcccattttgttattgctaaatttatgcattttttacattaaatttatgaatgggaaatacgaaaatgtcccccgtacgaaaacggcggtacgaaaacgtcccccgtacgaaaacggcggtacgaaaacgtcccccgtacgaaaacggcggtacgaaaatggcggtacgaaaacgtccctgaccggtcaaatgaatgggacaaattaggcaaagattcgcaaacccaagcgattacggtaattttcgctgcagaaaatggaaataggaaaatgaaagaaggcaaacgcaaaagtctgcttaaatacatagagaaatggggtaaaacctagtgatgctcgagaccaaaaatttcccgagactcgagactcgagaccgagacccaaaaccccgagaccgagaccaaaaaaacccgagacccgagacttttttaaaaatttttttttacacacttaaaaatcgaaaaaaatcaatcttttgagttttctcaaaaatttttgtttttttccttatttaagctaccatacatttttccttttcatatgattgacttttttacaccattttttgtggtgctctttttcaaaaaaatgtttcgggaacaggggtccggcggtgccgataggcgccgccgggaaaattttttaaaattttactgcaatttgttaacggattttgtccaaaaaatgaccaaattttgcgtctttgagctacttttttaaaataaaagtaagagttttgggtgccggcggtgccgttaggcgccgccggagaaaattttgaaatttttagtgcactttgttaatagatttagtccaaaaatgacatttttacgattttaattgttaaaattgtgtttgaactcccatcgaaaaaaacattaattttgaaaaatgagaagaaaaaataatacttggaggggaactgatccaacgcaaaaataaggaacaaaaccaagaacacaacccgctggaccacgcatatattaacaaacttgaacaaaaaagaacctaaaatttataaaaatagaagtttaccaaaggccaacaatcaatcattaggggtgtaaaaaagtctcggtctcgagtctcgaaaatcgagaccgagacttgaaaacccgagactcgagaccgagaccaaaaaaacccgagacttttctcgagtcgagactcgagaccgagactctcgagcatcactacgatccgattagtcacttcataagcgcctgactcattaataaacaacaataaatttttcatcttgtttatttttaaaatttttttatcttgactttagaaggaatcacttacctactttaatacctaatcaaacttaagacaattctatttacctaaataatcttaaaaaatttttttttttttattgatgctaaatccatttataatagcaaaaaaattcactcactgtcgtaatgtccactgtccaattgtccgttttctgtccaaatgtccgggagccttattttttagatcactgtgccctcccaatggctaatgtccgtttcgccggtgatcaatcgcatgcttagcgttgaaatgttggagaaacagctgcgatcgatctcttttgaagagttgggcgtggacatggagcagttcatggaatttcttgacaatatttcagttggagctttcagcaagaaaatccttccaaatcgtaaaatttttaatttaaaatccttttaagaattgactttgccatgaatttcagtacacgaaaatatttttagccaaaaatgttttattgctgctccaattggccgacttcttccaggtggacgcgttgaagtcccgctgtgaaagccatctgatcaattgtgtggaaattccgctgatcgaccgtttccttttgattgatcgatatcagttggaccatttgaaggcatgtgtgatttcaatttggaatttttaaaaaaggacctacaccgatttttttttaattgaaaataataatttaaaatatattttaataccaaattttccccatttagaattactttttgaatttgcgtgacttttacaaggctaatcgtgctaaaatgttgcctgctctgaacaaggattttttggatgaattgaccaaccgaatttgtggatgaattaaacggaaagaagaatcatgaaacttgccaaattaattaagtcaaattgattcggcttacccaggggcgtatctagaaacatttttcngggggggggggggggacccgacctgaagaccttttttttttttt

SEQ ID NO: 1583 - DNA, 2324 bp, Heterodera glycines
  misc_feature (102)..(102): n is a, c, g, or t
actcgagaccgagactcttcgagcatcactagtaaaacccaggcacaactacagattggtaatgagaaaaaaaagattattaattattgtagaaaaaatatntaatattgaatttaaatataaataattaaaatttttagactttgtatctccgatttattctcaagaaatatattatatgttttaaacacgatcctaagctaaaaattattagttgggtcaggcggtgtcgtgccaacagcaggggaaaatttgaaattttttacgcgatttattacactgcgagataaaataagaaaaactcatatatttaagttatttattccgagtcaatgaaaaaataagaaaattttaaaattttatttagaattttatatataataaatatatttgctttaaattaaataaatactcaaacaaaaaatcgcattaaatataactgatcaaattcatattcaaatcaattttaaaaatttttacaaaatcggtttttaatgtctgaacaaaaaccagctgaatggcgagcacagattgaataccttcaacaaattaattgcgataataacgtagacttgacttatcgtgtaagaaaataaattatatttatatgttaaattacgtttaaactaatttattaaattttgagaaataaataaaatcagagaaggtaattatattttattttgtttcaattaaattaagtattcaaaattatggtcaattggacattggtcagatgattatgcttaataagcaattgataattattttgaattaattaggattataaattatttctaattttttaatcaatttttaaaaaattcaatttgagctggaacaaattttgacaacaaatggtcatggtttacttgacacaaacaagacacaagaaattaatgaaaatttcaacaaaattcggacggtcattaaagaatgggtgaatttttaaaattaaaaattcattgaaaaattttaaatttagttaaaaggccaaagcgatttgttgttaagcggatcaatgatgttggatgcttttacgatgggttctgatgttgacaccatttgtgtgtcgccagaacatattcaagctgaccaattcttcggcaaagtgccgtgccatcaaaaatttgccgaggaatgccgaaatgatgactcactgttttgccgactgtgctttgtaacttatcgtatcaattgcaaattatgattccgcagttgcggaaaatggaccaaaaaacaaggattaggaaatgtccaaaattcaatttttcaaaccccataaaaaatttttttaatttaccattttttcagcactgcttcaaataaatttaaaatcgaaaaaattaatagatttttaatttttcagcacccggaagttcattcactgcaacggatccaatccaattgggtcccgctgatcagactaaaactgatcaattttgatcatgaaattgacattgttttcgcttcaattcctgggcccgtaccaaaagaacgaggtaagggttaacctacccgttacccgtactaaaagagcaaccccgaattgagggtgacttaacccggttaactaaccctcagctgcgggtaacttttcaacccgcacccatgccagggtaacaacatgagcatgttttttgaaaaaatattcgccctttggaacatgaaatacccacaaaaattcacaatgtttaacgtttaataactttcatatctaataaattggcaaccagcaaaaatcatcaaaaatgcacttgatgagggtatttgttttattaattaatttaaataatttataaattttgtaaagaatttatttaattatatatttatttattttaattgcatttaaatattgtcattttatatatttttgtaaattaaaaataaagtattttattttttacataattaaaaatttttaaaaagaattgtcaaattccctgcttttcctattttcagcatttaaattgttttattcttcaaaaagtgcaaatgaaaaattgcctatgctctttgaacaacaaataaaattccacgaaaaggtaaattaataattataaattggggacaaaaataattaggtaaatacgcgtaaataattccctattaattacagtactctcaatattttgatatcacttgtgtcgcatccgatttaaatatgtttaatgaattttgcggatttgttgttatacgcatacgcgttcaacttacgcgcctcagcgactgcacgcgtgacgatgtcgatttttgtcatttggttttgttaaatcgctgtccaccgtataatgtacaaaaatacacaaaaatgtacggta

SEQ ID NO: 1584 - DNA, 5104 bp, Heterodera glycines
atttattcaaaaataaaaataaccaaaagaagggcattgctgccgcttacacttgaggtggaaatacgacaggtcaaatgggtagtagtgatagaagacaattaacattggtgatgaaaaaaatgaggtcaatgggcagttgtgatatgagttgaaatttaatttaaagaagcggaaaagtcgacctccagcaaagggaaattggtttttataacaatttgagtaaaaaattttttgtgggaaatttttaagaaatttgtagtagaaataaatggaaaaatgaaatgaatttcaataaaattaaaatgaaaataatgcaaagaagtttttatgtgagaaaaagaaaaaaaacattgaacgatttgatgaatttaaaagtttatatggccaaggcaaacagaaagaatttgtgaaggaattgggcatttctgaaatgacattttggaaatggaaaaaagaagtaatgccaaattgtcataaatgtaagcaattattttaattttgagaatttttttattcagttaaatatgtttttagcaccaaataaatattccaatgaggaaaaattaagaaagataaagcaatatttcgaaactaaagaaaagaatccaaaaatttgtgatgaaacaaaagctaagaaattgagaattgcgagtgacactctgagaatatggaaaaaagaaacttactttagttccggaaaagtgattttttaaagaagtttatgtttttttgatattagcttgtttatgttatgataaaaaatttaattgttttatttttttgtgtgactaatagcgaaattttaagctggttacaaaggcctaaattaatttaaatatgtttagaagtgttttagcccattttcatactgctcgagaattttgttcaaaaaattagcatttgcgtcttaaagctataaaatttttagtcaatttaaatctcctaaatttgagaattttatgtcatattttaatttcttaggtcataatcaatataataattatatcaaattttacgcattgaattgagtttcagactaataaatttagataggggttaagatttcttagcggactgaacagtgagttcatttacccctcaaaactttttgaatatttttttttgtacggaaaagggcataatttatcgcaaaagtttttcgagggtctgaactcaggcgcaagcaactgggagcgagttcggcgccccaatacttaagaaaaactaattggaaatgccaattttgaaattcatgcatttttatattgtaaattgtataactctgttgagaattgtcgtcgactactgaaaaaattggacaattgatatgaaaccgccatgaaatttatagaaatgagaatttccttattcgaaatttattattaaaattttaaatatttatatttctgataatgagtaaaaagatgtaaaatattttgaaattaaaaatatataaatattattatttcttggtttttgcgaattttttttttattcaaagctgagtataaaattgattaaagaaatttccaattccttcacaaattctttctgtttgccattaaatttaattcttttttccattttatatatttttgcgactttctcctaataattttccaattttcttttgattagttttgataacattttttcattggaatattcacttgtttggtcaattgattcggttccattttcttcttctctgtttcttcactttcttttttgtcccattcttcgccgaatatttcatttttggtcccagtgccggggtccaaatcctacagggcgtttcctaaaaaccgccaagtgggcgtttcctaaaaaccgccaagtgggcgtttcctaaaaaccgccaagtgggcgtttcctaaaaaccgccaagtgggcgtttcctaaaaaccgccaagtgggcgtttcctaaaaaccgccaagtgggcgtttcctaaaaaccgccaagtgggcgtttcctaaaaaccgccaagtgggcgtttcctaaaaaccgccaagtgggcgtttcctaaaaaccgccaagtgggcgtttcctaaaaaccgccaagtggagcgatggagatgtgagagagataaagagagatcggaataaaaaggaggatacatagaagagagagcgagagagagagagagaaatagatgcgaggataaagagggaaagagtcttccaatttgttggcaattatttcatcactaatttttgggtttctttccttgattttgaaatattgcttcatttttcttattttgtcctcattggtattagactcttaaataatatttacttttatattttggcattaataaaaataatattacttttatggtattttggcattaattcttttttccattttcgaaatctttctttggaaatgcccaattccttcacaaattgtttctgttcaaaatttggtcggattttgttggattcaattccaaaagcaaagaaaaatataagaaataataagtgatataaaatcattttatttttatttaacgattttattgctattaaaataaaaatgtttaattttgctcactttaatattttttaatttgaatctttaacaaatctttgccaatggtaaaatgtcaagtaattctaattaaacgatttttcctcgaaattttttaatgaaaaataaacaaataaatggcataaatcaaaagttgtcagaactatttttctttatttataacgcaattttatttgtattttatttgtaaagccgagaaattaatagattttttcaaaaaattttttttataaaaatgctaaaaaatcaaagaatcgtgttatttttcatgaaaattttattataatgaaacatctatgtgatctttctatgtaaatttaccgtatttgttggttttcgtccacagtagtcagtcagaagctgaattaattggcgaaaaagtgactgaaaaatgagatggtaattttgaaaaaattgaattaaaatttcaaaaactatgatattaccaaaatgccctcgcaccattgcactcaatgaatggtgttgttcggaaagcctcaagacaggagcccgaagaacttaaaattcattttttcgaaactccagcagaccgcgtatatcccggcatctctgatcaaacattgccgtgaatttttcacttttttcatttttatttccttccatccatccatctccaaatatttaatcaaagtttggccaaagtttattattcattctaaccatttttttaatttaatcgaattttttcatatttgtatataaaagtcttaaagaatttaataattaatgaaatttgttgatataattcaacaaaattattataataaaatcatggaaaataaattatacttatgaaaaacagaaggatgaagtcctgtagaatgggagaaacttatgcttcaaaaatttcgggattaaatatcttcaatttttataaatccttggcgtttttaattattaatgttgtgacttgatgactagggatgccaattttatgtaaatacatattttttcatgcattctccataatctaaatagtaggaaaacactttcttttttgagtttgcgaacaaaagttgggactttatttacatatttttacatatttcggggttttatacatatttggtttatgacttgtcctggaaaacaaaaatgaaaaaatgtcatttattccaaaaatccttgtaaattcataatttgataataaatctgctaaaaaattaaataaatttcaaaaaaatttttaaaataatgaaccagatataaattatataatcatctttctatcaattcttatatatttaattgtaaatgttaaagcgattgattaagaaacaaaaaggttaaagccgagacttgcgacatggaccgagacttgaggccgagactctcgaacagcaatataaattagatcatttttaggtagtaattaaccggtagaaaaatttgttataagctataacttttatatatttatacaacattgacataatgttatgtggttatatatattatatccaattatagttgttaattctatcttatttattttccataatatccatagccatagccgccatagccacaataacaactgcgatatccgtagccgccaccccagccgccatagccgtagccgccccatccaccgtagccgccatagcgtctaccgtagccgtatccgtatcgtttatggcgtatcaaacttaaaaaacacacgtaatttcaaggaaatttcgaaccggatttgagttttctacagcactaaattgggtttagatctaagtgagtaccgtatgtgttcgattatttagactcccctcgaatatatgacccctttttaggggggcggggggggggttgaacaataaaagacccgggtctaataatcaaagaaatttggtaattatactattaattgtcttgtatcgcatttcatctcaccttgttgcttcatccgtgccaatggaagccgctaatttgccattgtttgcttcaacaatggcatttgcttcttctgcaactggtgccgaaactgccagtgccacaaaggcaatgacgaacagcagaagaagcacagtcactttggcatgggacgaggacattttgtgatttaatttgggcaaggctatggtttttgtttttaatttacaaaattaatctgaaaattaaaacaaattatagtaaaagttaaaaaattattttaaagaaattaaatttagtaaaatttttttagtgtttttgaaggcattaaatttcatttttggccaatgacaaatcaaaaattaaatttataaagtgatttggaattgtctgtcgttaggaaatttgaccttttttatattgtgtgtttgggtgttccattaaaacaaagtcagctgcgaaatttaacgaacaggttttcaatttatttatttttttcttcgacaaattgggggaacaaaactgacagaaattaatttattttaatttcaaaaaagaaatggtctttttttttttgtctttgagattgataattctcaacgaatttggcgaatttttgaatggaattgaggcgcaactgattaatgttatacaacaac

SEQ ID NO: 1585 - DNA, 2325 bp, Heterodera glycines
cgaaagttggagctgagttgggaagtttgggtgtgtcttctcacttttttcccccacttttcgcttccttttgctcaattagctcaactcgcccactcgcgtcgcaaatccctccaacggtcgcttcattttcaccgattttttgacgcaatccgtcgcttggatcaatggtctgtggaaatgcgttcaaagattggcacagagacgcgcatccgatcgatggaagaggcggagagggcactgcaacggcaccaggaaagactggccgaaattggggcacgagaggaagagatcagcgtaagtgacaagccaaaggaaaagccgaatggggaggaaaagccgagtcgcgaaaagaagggatgatcaaagcccaggaatcaccacaacagtcaatgtgttatttcagactctgagagaattcggccataaattggtccaggaacagcccgaactgaaaatggacgtgcaaagggcgcaacggcgcattcagacgatggagcaccagacgaaacagtactgggaacaacataacgccaaattggagagggaattgcgcagacagaaaattgaggcgaatttggcccaaatcgaagcatggactgcgacgaaagaggcttttctggatgggttggtggcgggcgacagcacagagtcggtggaagaagcactgaatgagcactgtgagaagaggcgcgggggggacggactacggaggggggtaattagccaatcaaagggaggaggaggctaataagccaatcaaattgcaaatggcaacaattaaaatgttgaatcaattggcatttcagcgcattttgccaaaacactgaatgtccaaatggagcaccgttttgggcaattggatactgcggaaaaggaaataagcgaaatgggagacgccgaagcggaaacggtgcgcgagagagtggcggagacgcgggaaaaatgtcgcggattgaccgaatggacagaagtggaaaaagccgataaatagtttaataaatggccacattcagctaaaatcggcacaactgacaaatgcccgtcatttggcatatttcctaagggaatgtgccgaattaatcatttggatgaatgccaaattacaattggcatacgacgacgcctttctcgacgcagcgaatttgagagcaaaactccaaaagcaagtgattttcgacgaggaacttaaggccaacaaaaatcgggtggaacagctgagagaaaagggagagaaagccatggaaaagtgcgaagatggcactgatcggcaaagagttgaggaacaattgagggaagtgttggacggatgggaggaactgatcgagtgggtttggggagactgtaaatgggagggggacaaaagaacgattgatcagaatctaacaacacacagagagaagagagagagaagagagagagaagagagagagcgagagagagagagcgagagagagagagcgagagagagagagagcgagagagaccgcgagagagagaaagagagagagagagcgagagagagagagagagcgagagagaagagagaaagagagagaaaggaagagcgaggaagagaaaagggaaagtaatagaaaaaaagggtagaaataaaggagaacataaattctcaaaaaaaaagaaaaccgaaacgaaaatagaaatttttttccggtcgcccgggcacgggagaggcgatccccgggattttcatctctaaaaatgctcctaataaccggcactaaatttttaatatctctaagctaaaatgattttgaaaattttcaaattatataaatctcaaaaatctacaattatatcaaataaaaatatcaaacatcaataacattttggtaaattttggtattttctgatcaattctcatttgaacaattggaccatttcccatttcttcacccatttgatcaactgctgtttttgagttcacatttcgctcattttgttcaattttcactgtttgctcactttcatttttgttccatccgttgccaaatatttcatcaaaattcgattggattttgccggagttaattataaaaaatacatttttacataaatggaaatataatattataaattttttcatcaaatattgctaaattttttctcatttgttgcatcaatataaaatcgaagatttttcaaatatgtcctgattaagaagccaacaattttgagaaatatttttaattttaaaaatgaacaaaattaaaaataataattaatggatattaaataaatatcttcaaaaatatacttaaaaagatataaatattttttaattaggaggaagcattgacaaat

SEQ ID NO: 1586 - DNA, 2693 bp, Heterodera glycines
tattttgatggccttttgcgttatgtcataacattccacatacatgtaactgatgttcagtgtcaccgcgtggttctgcagcgtgccaagttcgatcatgttcagtccctcgttgcccgtgctcagaatggcaacttcgggcggattctgccggtggcaaaggtgcataaattataaatatcatcaattcagtatttgtaagattgaaaaattacaaaattttgtgacaaaaaatgaacattttttactcttcgaaaaattaacattttgaaaacctattttaatacttttctgcactaaaaatcccatctctaatcacaacattagttaaatcatttcaccactatcagcactaatcagtgataattgataaaaaacccaccgaattgggctttaaagtgataaatccgtgcgtcactcgcatgtctgaagggatagcaaacactaagcaatttgactgattggttcttctcccattaccattttgatgccaacacgtgctcctaaattggaggagaataatattttgcatcaattaaattttagcgaaacgaacgtcaaattcaaagacggagggccaaacattggcacctaaaagggagaagaattgccagcatttaaactacgcctggggggagtgcctgggctggcgaaatgtccagcatttcctcgtactctcccgccaccatgtccgtcgggtagcgcagccctttgctcgcctgttccgcattgttttttccaaatgtgtggcctatcgtctacctgagaataccatttgcccatcataaattgtagcggttcgagtgccggggccaatggaatcggagtgagttctaaaaaggggaatgggggaaagagggggggagtcactgtcactgatcactcactgattgaagggtcgggtgagcacaatttgcacgaaacggcgcaattaatgtcgaagaaattggtcttaatagaatggcaattgtcattttgaaaaatgagtggacggaaaaatatttgtgaattttggtagccaataattacgacttatttaaaatggcatcttatggtttttttgtcaatcgaatgcgctacagttacggaatgtacagtaagcccacctgagttcggacgagttcgcatttctcctccatggcccaccggtcgcaactttggtaaatattgcgacaacgaccttcagttgtagggtttgtttgtgaattgaaatgggtaataagtcggcatacggtgacagtatttgcccatccatcccgacggacaatcgcacgaagtttttccgggaatgcatttgccaccattgagacaagggtctgacagatcgagaacactttttaaacacaaaagtaaaataattcatttttcattaattattcattaggtaattgaatggcatttccaatgattcaatttaaccaactaaatttgcattgctccttggagaatcgcttaatgaccacttgaccaactccggctgtcactgtgtgaaagaaaatcggaaataataatatttttttattaaaaagttcaaatattttattttttccgatttcttatccaaaaaaaaatcagaatttgatattgtttgtctagtcaagaaaatttaaattgagattaaggaataagcaacaaatgtccaacgtggatcgacgcgctgaacagaaataaccaacagaaaaagaatgctggccaaaacagttccaatttgtcccaaaattgatttcctcccattaatcctccacaataattgcgttgcattggacatctcaaagtacaataataattaagggaaatatgggcggaaaataattcgaagggataaataaaattatgggggggggggcagcggaagagagggagtggacaaagtctggcaattgcttaattggccgcttttgttggtggaataaaagcagaagatgattatatggtgataatgcgacttcgctgttctgcttcctccgtccgtccctttgtcttcggccgttcctcttccaacagtcgcaattcggtcgcgtaacagcgcgcgaatgtttcccaattgggtgagggggaggggaggatgaattggttggatggatgaggaagacgaaggatgaataaatcagaggaagagaaggaagagacggagaagggggaggggtggggggggtttttccaccggtacggtaccggtaccggtaccggtaaaaaccggtaattttccaacgtaaaaatttttggacaaaatttttcaaatacaaaatttttattcagttttcgcgcgagtgcctgttttttagcattagaattgttcagaaatatatgtatattgagggtgaccaagttttttttttcaaattcaggataaagaacactaaaattcagatgtagacctcaaaattcagattattgcaaaacaagggatcagcggccaattttccaattttgcgaagggtctccggccatgtaaattaatgtaaatcaatgaccttttttgctttcaacaccgcttttttcgcggcacgtttttctcaagacttttggggaacaaggagggccggcggtgccgataggcgccgccgggaaaaattttgtattttttaatgcgatttgttaacataattttgtaaaataaaagaccagttgattaagtttttgggtttttaggatgcttaaaattgaaaagaaaaaaagttggaatatttttt

SEQ ID NO: 1587 - DNA, 2239 bp, Heterodera glycines
ttaaacaaagcaaaaatagaaattacgtacctaattttctcattttacaaaccaattttcgaaattttgaaaaaagcccgggcccggcgggcgcccggccaaaatttttgaccggtccgggacgcccgtttaaacgggctttttttggccgggccgcccgggcccggccaattgtctaagcccgggcccggtcccgacattttcaaaattccggtctctagatatttttatatttagaaaatgcgctttccaaaattaaaaatgggaaccgcccacttcggcgccggccttttcggcgccgttgctaacaacttttttcctgatcaaccaaattaaaaatttttgttatcattcgatagctcttcagattctctattagcctgtaaaatttcaaaaaatttcgtcagtttacaaaaaaaagttatggccaaaaaacctcaaaaattaactttttcttggctttttcggcgccgcgtggcataacttttttatttttgaatcattcatttctatttttacatgtaaatatagagcacacatagagctttcaaatgatgccagattggctaaagctaactgacaaataaaaaagtatagcatttcaaaatttgcggcgccgaaatggtccgcgccgaagtgaccccgacccctttccaaaattaaaaatgaccaactcagtaccgttaactccgtactcggcaatctttttctttaattgttgcaaattcaccgaccaattcgactcgaaatgaccccgaccctttaaaagtcttaatgtttaacatatgtgtatttatgccgttatgctaatatttgaataatttatgaaatttgtttttgctttttaaaatggcacttcacaatcaaacattgactcatttcgacttagcaaagcaattgcgcgtgcccttcgccatcgacctgaactttatgggtggagttggaccagcaaggtctttcttctttgcctgagcattgttaagttcggcatttgtttcctttctcaaaggttggacttcgttggcacttttattggtcggtctccgttcgcgcggctttcccaaagtttcatttgaggacattcggtgaaaagttcgttttaaattgtcttcttcttccgccacttcaattgaaactgtgcgaatccgcgcattgtacggacattcggtcgcggaaagtgtgccacaaattgcgatggaagtgagctgaaatttactccgtttttgtaagtgttggggagtgggacgaatccaaacattgtacaacagaaatttgggaaaggtgcgaaatttatatgaggtggcggacagaacatcccctgaggcgtttaaaaaccttttgagtcattaaactgttttttgtttctttttatacccaacaacattttttgaggacgttataagaggaaatctaatttttttttattactttctttaccttttcaatttatttttaatattattattttttaaatttattttaagtttttttaaataaattggcaaattcaaatgattttttccttctttttttctttcaattttttcaccttcgctcactttttcagcctttttctccccctcatttccttttcgaatgccattttcgaatcgaagttgggaataaaaccgatgggacgacagtttgtgcacctttccgaggacatagagactgccaaaagtgttggacggagaaaggcgaaaagggacggacagccggcgatttttcgggtgattttggcacaaaatggaggggtgggaggatgaacaattaggacaattaccatccttcacagattgatgctgaaaaggctgccaaattgggcagatttcgctttttccgtccgaagaatgacggaaattcaacgctttggttggctgattcgattccattggaatttgttgaaattttccaataaaaaaaggcatttcatttcgttaaacaattcacatccattaagtcaaaattggcacatttattttatgtacatatttttcgatgcttttaaattttcactaacgactaccgaatttattatttaatccatggacattctccagcaggtgaatctggttatgatattaaactgatgaatgtaaaaatgaatggcataaatgccgagtttaataattttactcaattagtcataagaaattgccaaactttgatcacttgggctgtccctaggctaatgcaatgcattttctaatttcagtctgattttgcctccgtttcgaag

SEQ ID NO: 1588 - DNA, 1335 bp, Heterodera glycines
taatcaacggattcagaatgatcaccagcggagggttggccaacttcgaatgggtcaagccgttcattgactgcacaacgatcgccacttttcccgggttggcactctccgaaatggcctacggcagcacttcgcaagagaagtgccaaacgcgactccaaactttttccggtcctaaaggtggcagtcccttcggggactccgcgtgattccaaatgacagaagggcggcaggcggaagaacagtctctgccgctggcggacgatggtacccacgcggtgttcccttcgaagccgtgccatgttcttgtctgggacgagttgcggcaaatactcaccgatgtgctcagcaaagaaagtgccaattactcccagttcggccttttctccaaccaatttactgacaatgccaagccttctccgctgcctcccctcgagcctttcttcgttcggcttgggttcgctgcttcccttcccttccgttttgccattgtcttttcagatttcaaaatcccttcccttttcaattggtccttcgtaatttgtgtctttcccttgaccaagtgagtgccttatcaaaagtcgtcgttttccgatttgtcttatgctgtttctcagctgaagcttcgtcccggctgttctccgcctttttccgacaaatttcgctgttccatcgtttccgaattggtattttctccgttggctttggacgaacgaccgacagagaaagtgctgaaaaaacattttgttgatttgcacgttttgccagggcccgagttggaacagttctccgtcaatggtcttttgttggccatctgctgtgattgatttgtttgtttgaattggaataattcagggattaaattcgatctctgttcgccagtgcattttaatggatcagccgatgagattgatcattccgctgaaattgcctcagtttcggcattttttcctctttccgtgcgcggaaaaaggcttttcaaaaccaaagaacaggtggcacaaaagaagaagcactcacgcttttcttttccatttgtagcggatgtccacacaatacgccatggacaggcgtctttcggccaccgtttgctctgattctgtgccgttgctcagtttccgtcctgttggcggtgacccgggctttatcaaagccgtcactcattggcatcccctggaggcattctgcgaccaaattgtccaaattgtcttcgaaatagaaaatgtcggacagaatgatgttgagcaattgcgattttgcacaaattttgctgaacgaggtgttggtcatcatccaattcgattttttcacataaattgggttttagtctcaatt

SEQ ID NO: 1589 - DNA, 5960 bp, Heterodera glycines
tggcgctgaaacagtcggccggtggacgcaatgtccgtccaagggaatgccaaccgccttcacggatgacgcatctgtggccggtgaatttggcatggaagcggcaaatgttggccaatttgggaagatctccagagaatgtccgctgagtgttggcgaaaagattgggcacgtctttgcctccctaattaaagtcattatccttaggtttcgcttttcagcttacgagtagcgatcagagtgcagcagaagccgcagactttttactttctcttcctttacttcgatcagaacggtgccttccttcgccaattcgaaaggcttttcactgtttttgccgtccccacaggccgttcccgtcagtttcgcttttccgcccgagtccgtcccctctcgcgcattttcgatgccgaccattgcgtacttagcgggtccatcggcttgtcaatgctcacacttcgctgtttgccgttcaattctcacgaaagcgatgcaacagcaaaggcaacgacagcggtgacattgaccaaattggacttgctcagactttccgtcaaagtgacggatggaaatgcgcggacaaatgtgcgacgagtggaaaacgaaccaagtgaagcgaaaggacgaaatgaggggaaaacattcgtttaaataaacagtccaattggaaaacgcaacggaacagaatctctgcttttatatggccaacgaagaagcaacggacggacaatgcgtgccgacaccagcgattccttcggtgccgaaaggcgacggcgccggttgggccgacgtttggcttggcaaaacttatgtgccggacttcccggaatggaaaatcatggcacggagtttcgaaaagaaagcggaagtaattgggaatgagcagcattcgaatgcacttcagatgaagctgctttggttcgaattaattgaatgattagggggaggctaattgtacgcgaagagaccaatcagtgaaagggaacaaattttaggaaggcgtcactgatcagaggcgatgggccggtgagcaatgtgttcggagaacttttaaaacaatcagtcatggaataaagaaaggaataattgttagattatagtacattcaaagcatttgcaagcatatttatttaattcacttatttattctgttcaataaactgaaccggagcagctgttttttatttacatcttccggcacaatttgctcttctctctatccttctgttactatttatcgctcatttcttttctcttcagcctcattcgcttttcgctcctttttctccctcattccgctcctttttctccatcattccgctcccttttctacctcttttcgctccttttcttccctcttttcgttccttttcctaccacttttcgctcctttttctccccatttcacttttctttctccatcatttgtttcactcattttgttttgccttaatcgacccgctgctaaaattgcattcgcaaatactcgcgcattccttctgcgagcccggttccgttgcacaattcttgaaacatttgtcgttggtgcagctgaggcgtttgattcgcctgtgctcattcattcggccgttgacttccgaaggaaaagcattggccacggcaatttgggaaggatgctaaaagatggacgattaattataaataattaaataaaaaggatggagattaaataatcattttaaaaatgacgaaggaaaggacctcaaatgagaggagcacggaaagaagaagcagaacagcgaagaaaagcttcgtgaacatttcaaaattgaaaattacaggtcgagtgtaaaattgaagaaaacgagggaaacaaaaagcgatcggatgagaaaaaggaaagtgatcggaggatgggggaataatcagaggagggacaaagtgattggagggatgagggacagctgcttaaagaaaagaagagtaaaaactaggacaagacaaaacagaacaactgctggtgaaaggcaaagaaaggtataatttacaattggttaccgtatttctcaaaatacgatagttttttctgtgcaacaaattcaataaggtggcgcagtggcataaataaatgtgtcgttttttttaattttcggattttaggctcttattacactttgctgcattttaaaagaatgcgaaaagtgcagcagccactccttctcaagaggggtgaccatcgatcagaaagtgttcaattgggtcaatgctccgaaaaaatccattaagcgcagccaacgcaaatgaccgagcggagcttctcgagaagaacgaaaagcaaagaaagggcggacggagagagtgcaatttgggaatggtctcccaattgttttgatatccattttcatttgactcattatgaaaatacatttcaataaattgaaatgcttaatttgcattcaaattgacaacaataattagggaagaaacttttattttcggtgaattttccccttttctttcttttcatcgtccaatttttgcttttaacaacgaatgatttaaataaattggctttttattcaataatttgattggcttttggaagtgagcggataaaactgcttcaaatttattggaatgggagggacaacggccgcatttggcgttttgccaaattgggtaaagatttggttggtctgctccactttgatctgttccgtggacgtggcatttacggcactgcgaccggaaagtctccgagggggaaaatatgacaacttcttcactttgtgtgtgtgttatgggtgatggatgaccatttagtcatggtttttgtctgtgtttgttaatttttatttgcccctccgtctctcccccctccaattcccaattgtctttcaattacccccccccccacattaattggcactgttcagggaacgtttacgcgtccgtggacacgcgttacgccgacgcgtccgaccctttgacgcgtgtcaccggtccgctgatgtgtcttgagttggtgctcaatgtgtgcgctctgtgcttggcatgcgctgctccgccttcgtctgcgcttttcactgctccctttaggacttcgtctgtcccgcccattctctgatggccgcttttttaagcaatgctttggtgttctggaagacttccatttacctcagtctttttcttttgccaaatgaggaggcataccgtagtttggaccacggtaagtgtatttctatttgtcactaccgtaatccattgctgttttgccaaaggcacttttctccacttttcctttcgtggaattgccccacaaacgccattctggaaggaaatgcttctgttttgggctccaaactccgtttgggtgttggtccctttatttgccatgtttcatttgtgggccaaaattgcacgaggatggaatgaacaatcgcatgctgaggaaagaacggattttaacatgggaaaataccgaaaggcaatgtaagaggaaaaggaaaatgaaaaaaagagagagagagaatttgccaaggaaaaatggcaaaatgttgaacaaatgtgccaacgaactaagggaattgtgcgcattggacgaattggacccaatggaagcggcggaagagagtggcaaaagtgccaaaaatgggcaaatgatgccaaaacaactaaaattgttggtcaagacaaaatcggcgagtgaaaagaaagggagcgaccaattcaattctaatgaattctgaaattggaaatttgaaatttaataaactcatcggaggacagacaataattttatgccaatacgtgtcgagaaacaataaatgatgcttttgtgtttttcctttcgctaattaattgttccatttcctccgttccgtcattaattgtgccgatttcactgcacaatttgaacacagcctttcatcgatgatttctcatcgcatcggtgtggccctctgtaatcctaaagcccagcagcactcttttgcctttccatccccaagttttgttcttttcttaccgcatcgttacaccaaacacactgtgagtatttctgtgcaatgcatgcgccgtattgggcggaaaagccttggcaaatttgtcgtttcgccctcagttcgtcccccttttgctgttcctttcccagcgaaataactgcgaaaacgaacaatttaaaaaatgttttaattaatgtctccccaatttaccgacgatggcaaaaaggacaaaaacagacgaaaaagatggcattttaagaaaatttgacacagaaaaataattagtattgaatccaaatgaaatggtcgattttggaggttagaaagggataaacagctgactgataaaagaaaaggattggccaaccaatggggcgatcagtgatcggaaagcattgattggggaaggactcggccgtttcattttgccaaattccgaaaaacgagcagaaataaaaacgattttattcaaaataattgataatttaatatgcaatatattatttgtacccgtccttttctgcacttcatcatttgccttttgcttatctttccatttgttcttccgctgaccgtggcgaggacagtgacaattcgaccaccgattcgacccgtaccaaaggcgccattccccgcgtcggcctcactctgtttaccgtttgtacggctgaggcggactttcgcctcggcgttgtctccgtcccccggcacttttcgtccgcttcttccgccgccccctcccctcccaaattcgcttcgtcgccccctttcccccttcgatcttcccaattgcttctcatcatttttctgtccgctttttccctcttcggcatttcttccagtgcatattcgttcatcggatccgtggtggacatgtcgctcgttgtcaaagtcacccgcggagggatgggccaatggtcgggcaattggcggtggaatggcactttcttgctatttgctgcacttcgtccgtttccattggtttctcctgctgttgtgccgcaatttcctcgtcgtgcgccactgaaatcagttctctgaaagggcagcattatccgcacattctgtggtgcctgccaaagcaatgcttacttttgtcgggggtcccttcgtcgcattagcttatcgcctgctgaatgcgtatttctgagaagggaaggggcagtttatgatatcagcagcagacaaattcaacccattaaaacgctatcctaacgaaaacaacttttttaaattgttcactaatcgggcattaattaattaattaattgcgccgttcactccttaattgccgcacgcaccttctcgtgcacatcactttcaagccgttctcccgcatttgccccgtttctgttcttgtgatttcgccttttttctgctgcgacgcgtaacgacgcgaacgtcgcaattcggccgattcttcttgaatgacctgaaaaattaaaattggccaattaaattcgtcattaattaattacctgcgcgtgtctgtcacgcgattccaacgtaatgacacaagcgatgatcatctcaaagagcaattgccatttcaatgggttgagaagccaaagggacccaccaaaaacattccgatgccacagaaaaccgggccaatgtattgcatgcttttcattatgtaacgaagcaagccaaaatcagcgaactgatcgggggactgagtttgctgagcagccgaagggactgagttagcagtatcgaaatatccaatcactgaaaaggcaaaatgccaattattaatgccagttgggcaagcagtctctgacctgtcattaccaatccgatggaaatcatcacaatgccaaagatgacattggcacaggcagtccaaagggtctgaattgacaaagacaattcacaaaagtgttcaatggaggagtgaccttttttccatggatttcataggcattacgcaaatatttcatgcctttttaaacatttttgccaattagcgcatttgtgagatttttgtgtggt

SEQ ID NO: 1590 - DNA, 9819 bp, Heterodera glycines
  misc_feature (2102)..(2102): n is a, c, g, or t
  misc_feature (2109)..(2109): n is a, c, g, or t
  misc_feature (3071)..(3071): n is a, c, g, or t
  misc_feature (9746)..(9746): n is a, c, g, or t
  misc_feature (9768)..(9768): n is a, c, g, or t
ctatcgaaatcacctgggcacgcatacacacgcatcaacgaattagtgctaattgtaagtgattagacagtaagtgaattgtacaataatttagttcaacaatatccaataaaatgtcaaaaaacacagaaaaaatgtgaattgtatgttagaaaagttaactcatttagaatttttagatacggtataaccaggactcgaaccaagttaaaccagacagaattccggacaaaaattcccgttttaataggtcgggcaagttggacgcagactgcttcagcgccgccagatttgaaattgtttcttttcattgttaatgtgctccacttttatattccaaaagtccaaaagtaaaatgaatcattcaatagtaattaagttaaagctcgcattttaaggcatattttgccgttttagtgcctttttggcactttttcagaaaaattcaataaaaatgcaataaaggaaaaatacacccataagaattaaaaattttctcaaaaattgattttaaaaatacaaaataatggcaaaacctcaaaataaggtaaattatcttttccaaaacccaaaaacattttaattgagtaattatttaagaaaaacgaaaaaatttaaaagcgcatacatggttttttagctcttttcttcggggccaggacgttttcgcgtggcccgttttcgcgtgagtgcctattaggactgaaattggtcggatgtgtgccgaacatacatttcgacctatttcgaatcccaaacccgattttaaacaattttttgcttttatttactcaaaagcgtcctcatttttatgcttgcaaagattaacaacttcaagtattgacaacgtgaatgagacacagaatccgaccatcggcatcacgacatttctttaatttttttctttttccggggcggaggactcttctttcacatacatacatatccaagagattaacccattggaaagtcttaactgttttgttcaatttttggcaaaggtaaagaacattggtcccgaaaaaaaaaccccaaacattttacgcacaaataactcaattttatatagaaaaaattctgtaatagtggttggaatttttttttaaattatgataaataagcctgccagaaagagagaaaacaattttataccaaattgcatttgggatggtgagtttacactaataccagcagagcattagaccgttaaaaaattattagactgtataataatttgtcagacttaattagtttataaaattcacttaaatatatattgaattaagcaccagaagtaaaacgtgagtgaaaaaattttccaaactataaaaaagtaaaaaattcgcttatgtgcaaccacgcgaaaacggccacgcgaaaatggccctcacgcgaaaatggccacgcgaaaacgaccccgaccgcattttttcaacgcacaaatgctctcaagcatgaccgggagccccaattaaatattttagaaaaatattattctttctgaatgattttataatggcaatttataatattttggcaaattgttttaaaaaattaatttctaattaggcaattaactaattttacggctcatttttcaattcttaaatggtcgatgataactacgatgagattgatggtcactcactcaatcaatctcacaatcggagggaatgttctgaccttctgaggcaattatcattataatattcttttttccaataaaattgtaattaattaatcaattaattaatgttaattgtgatgtacgacacaaaatgccacactcaataagatggttccagttgcacggagcagactcgaaatgtgctccagcttggcatcggcttcttcttcatctttttggccttaaattcccagggctttattgaagaggcggtccttgactcattcgctcgaaaaggcattggtgtaaaatcccatgatggatatacaaggtatattagcatagagaaaaacaggagctttttacgattttttgtaaatatgttagggccacaaacttttggctgtaattacaaatttgatccaaatttagacaagtgtaaaaattatgggccacaataacctacctttagcgnaccttanatggtaagtactcaatttaactgtctgaacattcattatctcctatggcatattatgatatccttttttacagtttggccatcatttatgcatcattcacaatccataattttgtggccgcaccaattattgcctggttaggcgtccgatgggctttggtttttgctggtctcacatatgccatctttcaggttaactctgacagtattttgcaacaattttgccgaaatgtcataatttatacacggcatttttcataaatgaatcgtactgttgcaattacccccgccgctttaaacattttaatttttgtgaaaatgcatttattttgggctctacatattgcattgcacgtccataaaataattttacaaaatttaatgcaattagatatcatttaatagccccaagaatcctctattagtctacgaaggttgaaaaaatcatccaagtttcaataacttatgtcaaataattcagaaagttatttttgaagttttctggtcattgctaataagtaaattcaattttgtaagataattgcgaacccttatatctatttaatgttacaaggagttatggtgcattaaaattgccaaattttttatggtcgtgtaaacagcaaccgagccctttttgctctaaaatgaccttatttcttaattatttgtagtaatttttgagggctccccggaaattggacaccgaaaattggacaatattggatataaaaataaattattgaaataaataaacaaaaatggtgagttggtcatagattttattttagtttgcacatacctatgttttttataagcttaataaaacggaaataaataatgttattattatttttaacatcagcagaaaaaagcaatcataacattcataaagaaaaaggttttcgtttacatagggttcctattttcgtgcattttttggcacattgaccaatcatcccnccatttttcatgcattttttgcaaattgaccaatgatcgtccctgctgaatgtctgattcattctaagtgccttaattcgttaatccatttaccatactcaaattttatttttaaactaattcctggggttattttttaaaaagaaatttggtgtccacttttccggtgtccaaaattccggcggtgtccacttttccgcttggtgtccaattttctggtgtcaaatttaccggtcccctttttgagtcacgagaaccaaaatttttttgttgcatttaaaaatgaatttcaacgaacaaattcaggctggttttctgtttgtcaaccgttggtacctgttcagctcgtccacattgctgggactcggagctgctggtttctaactatttcatataaccgtatttcctctaacagaaccacataaacagagtcctgtggctcggggaattaaaaatatagacctcttggggctgtattagagcattataggtatatgtagttaaaaaaagtaataaaaataagtattaactgtaaaatttcatattaacatatcttacagaattatagattaaatgatgaaaggacgtaaagaataaaaatattttataatttgaaattttagtgatttggacagctcaaggaaaatacttggcaatgaacagcacagaagaaacagcgggacgacacagtggcctcttttgggccttgtcacaattatggtaatgagtcaaaaaattggcaaatttgaaagaaataattgtaaattactctaattaatcaataaacacccccccccccctaatcctgggtttctaaaaaagaaaatacataccctaaaaatcgaatttttactttccccctcacccgaagacaagggtcctggttgcccccttagtaaatggaagaagagagtaaatttgcaacaactataaaaattcattaaaatacataaaatggattcgatacattaagtcagtcatgcggtggcatctttctccttgtcgttttcctattgatgccaagcccaccgggtggtagcgagcaggaaacatccatttctgtgccaactgtgcgcttcatctacggcacattcaccgctctcactgttctcggcactgccattttggcattgttaccagtgccaacagccacaacaccggcacgacaaacaaatacagtcgacggcacttcctctgctgccgctgttcgtgacccctcaacagtgtcaacagaattggcacattcgatcgatgaaggggcagaagggagcggtgaagcagtggcagttgctgaacagccttcccatctggccatcttgagtatgaagaaaattgtttttgggagtatgacactttttaaatttcgtctggaaacccaatgtccagccagcaccagcggatgcattcaaattcatggattgcctattccagctcattcttccgttcttgtctttgtttgggtgcccaaaattaatagtttttttaaaattattttccaagtaaaaattggattttttctcaaaataaatacaaaatctttcttaaaatttttgctacatatcggctaatttcttaacaacactttcttccaatgtaccggggccggccatgcctggtctctattaattaataaaaaattgatttttgagttcaaatatggtgtcattccccgatcggggtccctgatccccgacaattttcggcttcccaaacctcggtcccattttctaaaaattttcttttttatcaataggttcaactgttaaactgatgggcacccgtcggatggtcttcttttcgttgccttttatgtacacgggcatcagccaaagcttttggagttccatttatccgacaacagtggcaaacacagaaatgttccagctgaaccagggagtcaatcccaagctgttgttggcactgaccgctattgtccaaggcgtgggccaagcaacatgtgtgtggtgtaaattagcaattggggttcaaaaaattggcaccaaaattattaagaaaaattcatcataccagatatttgactgccgtaaataagaaaaaattgacaaaagtttgtgaaattaatgcagtaaaaagggctttatttgcttgtttgcatgttgccactattctagtcttaaaatgcttttgtacattgacattttctgctaagctggcttcgttttcggcattttggacagtcggacacggcgttttggccgcactaaaattgtcagcttcggtgccgcgttgcaactgtgctcctttttgttggcctacctgaatttacctgcgcacgcaccgctggaaaaaacatttgagcatggcattctgaactcgccaaggcaagcaaaatttttaggaaattttcgttttaactatttatttgaaatattcataactattaacagtttaggcgatagattattcataacctgtggtttgaaatatatataaaatcgcaaacatggccatagaacatagactaaaaattatgaaaatggacatggtttcaaaaatatggacattaatctttccgaacaatttttcattaagaaaatttatagaaaaaattttggcccaaagagcaactaaaaagtcttcgggtttcgccatccaaaaatttttttctggctacgaccagcaggcctctacaaaattcctgaattttttttcttgatgcctctctacaaaaattttcaaaaaaaccttattttttcataacttaagcatcacgctcgcgttggttggtggttttttgctgagttttggcgatgcctgttggaacacgcaggtttttgccacactaattgccaaatatcccatcagagcgtcgcaagcatttgctgtctttaaattctttcaggtatttaaaattgatgatttttttaaatgataaatttttcaacaattacaataatattaattttcgagtgcaggaaaaaattatgatcaaattgcattctctatctttgatcacctatttttacgtttcaaatatcctaaaatttcgttcttaataattaaattaagaaatgatttaggtaatccttaaaaattaaaatatgacctctttacatctattcttttgtaatgcttaaatttagaaaattatgtgatttcgaatatcagatttaaattgcctcaaatttagttgattcacagtttcattaagcatataattaacaaacaaaattatttaatttttagtcacttttatgctgtgctgcatttttctacgccacttcaatttctttgccatggcatgtgctcattttggccattggtttgttaatcggcttaattggctttttgcttgccgagcgaatggtcagacaaaatgatgacgattttggagatgttgtgataccaacgcattttgaggaggataattgattagtttatcattttcaaatatgaatgtaaatagtttacctgtaaatagaacatttttttaatttaagaaaaaataataagcacctttccgccacccatgcgcgcttcttaaatccaccatggattcgaaaacaaaaaatatgtaacaaataaaagttcattcataactttgctcaaattcaaccaaattaatcaatcataaatagtcttaatttgaattctaaactactatattcaacaagattatggccaaaaaattatggcttaagatttttttaattttacaacacccttttttatattatttgaaaaaattttgaaaattatattctgatagagacagttaaagcttttaaataataacgtaaaatattaatttaattaagtttgagctaggtttatgaattttcatgtttcatcttttgttttcaatcccattggcggatcagcatgttctccaggtacaaacttatataaattgcttcctttttgaactaaatttctattttcttccctcgcgacgagcatttgtaatcaatttcattgaagaaatgtggcattcatattattaaaaattgacaatttttaaacaaatttcgtttaattagtataaaatttaaattcaaaaatctccttcgcagcgctgtcagctccgcaatggagaaattgatgtcaaatgttgaccaaaggtcacaaaactcgaccaataaaaaattcaaaaaagttttacaatcaaatggattttatccatgctccaagacaaatttttaacctaccaccaatttgaattcgctcattatcctttgtcgagaataggcaattaccgacatttgagtatctgtaatttttgaatgaggcaaaatgcacaggtaaaattaaaaattcacaattgaagtcgacactgctctgtccaatggtttaaagcttttatgcattttataaaattaccggaactcgtcaaaatatttaaaattttgaaaatttcttacggaaaataagcagaaaattgtaataaaaataaatacttttcaattcatgcaaggaatttcctgaatctataaattgatccattatggtgggactcaacctcagcagattgttcgacattccaatcactgagactcagttctccggcattccaataaccgagatcaatcccaccaaatcttcggaatcccaatcactgggactcaattcgccggcattctactccggaaaaaattttcaaaaaagtgttccgaaaaaaagagatagtcgtttttacatacgaatattgaaaagaaggcgtaaatggctctgaagcgtccataggccgcagaccacaaagtaaaatgggacaacattcataaaaaaggttggcctcaaaagggcccattcccaagctaatttcggaatttgctgataaaatcaaatagcctaaattatatacgcattataaaaaggaaatggcagaagcctcgaatgttagttatattgagtgtcacaaaatctcttccggaaaaaattttcaaaaaagtgttccgaaaaaagagatagtcgtccctagcgaagtctggacaaacaataaaattgcacaacaaatatacctactgttcgagttatgttttatacgagtcagatatgagtttttcctatggcaaggttgtgaaattcctcccaaaaactttcttacggaaaataagcagcaaattttaataaaaataaatacttttcaattcatgcaatgaatttcctgaatctataaattgatccactagaaaagtgttagtagaaaataaaaaataattggagcccatattttcgtcataaattgagtcccgaaagataaatagcatggcaaaactagaaaatatttgtcgatttattgcctattttccatccatgtttgggatgaggaaatgtataaaaagataaactttgtaaagtatttattatcatggaagtcgtcagaataatatcaaaagacttcgcataaacaatattgcaataatttaagttcgttttatttttcagtcaacaacacggccgagagaaattttgatacatcaaagacaacctaaaatacaccgcggtgagagccctagcgaaggctggactataaaattgcacaacaaatatacctactgttcgagttatgttttatacgagtctcatatgagtttttcctatggcaaggttgtgaaattcctcccaaaaactttcttacggaaaataagcagcaaattttaataaaaataaatacttttcaattcatgccatgaatttcctgaatctataaattgatccactagaaaagtgttagtagaaaataaaaaataattggagcccatattttcgtcataaattgagtcctgaaagttaaatagcatggcaaaacttttaaatatttgtcgatttattgcctattttccatccatgtttgggatgaggaaatatataaaaagataaactttgtataagtatttattatcatggaagtcgtcagaataatagcaaaagacttcgtataaacaatattgcaataatttaagttcgttttatttttcagtcaacaacacggccgagagaaattttgatacatcaaagacacacctaaaatacaccgcggtgagagccctagcgaaggctggactataaaattgcacaacaaatatacctactgttcgagttatgttttatacgagtcagatatgagtttttcctatggcaaggttgtgaaattcctcccaaaaactttcttacggaaaataagcagcaaattttaataaaaataaatacttttcaattcatgcaatgaatttcctgaatctataaattgatccactagaaaagtgttagtagaaaataaaaaataattggagcccatattttcgtcataaattgagtcccgaaagataaatagcatggcaaaacttgaaaatatttgtcgatttattgcctattttccatccatgtttgggatgaggaaatatataaaaagataaactttgtataagtatttattatcatggaagtcgtcagaataatagcaaaagacttcgtataaacaatattgcaataatttaagttcgttttatttttcagtcaacaacacggccgagagaaattttgatacatcaaagacacacctaaaatacaccgcggtgagagccctagcgaaggctggactataaaattgcacaacaaatatacctactgttcgagttatgttttatacgagtctcatatgagtttttccctatggcagggttgtgaattcctcccaaaaactttcttacgganaataagcagcaaattttataanaataatactttttcatttcatgcatgaatttccctgatctataaattgatc

SEQ ID NO: 1591 - DNA, 1637 bp, Heterodera glycines
agtgttagtagaaaataaaaaataattggagcccatattttcgtcataaattgagtcccgaaagataaatagcatggcaaaacttgaaaatatttgtcgatttattgcctattttccatccatgtttgggatgaggaaatatataaaaagataaactttgtataagtatttattatcatggaagtcgtcagaataatatcaaaagacttcgtataaacaatattgcaataatttaagttcgttttatttttcagtcaacaacacggccgagagaaattttgatacatcaaagacacacctaaaatacaccgcggtgagagccctagcgaaggctggactataaaattgcacaacaaatatacctactgttcgagttatgttttatacgagtcagatatgagtttttcctatggcaaggttgtgaaattcctcccaaaaactttcttacggaaaataagcagcaaattttaataaaaataaatacttttcaattcatgcaaggaatttcctgaatctataaattgatccactagaaaagtgttagtagaaaataaaaaataattggagcccatattttcgtcataaattgagtcccgaaagataaatagcatggcaaaacttgaaaatatttgtcgatttattgcctattttccatccatgtttgggatgaggaaatatataaaaagataaactttgtataagtatttattatcatggaagtcgtcagaataatatcaaaagacttcgtataaacaatattgcaataatttaagttcgttttatttttcagtcaacaacacggccgagagaaattttgatacatcaaagacacacctaaaatacaccgcggtgagagccctagcgaaggctggactataaaattgcacaacaaatatacctactgttcgagttatgttttatacgagtcagatatgagtttttcctatggcaaggttgtgaaattcctcccaaaaactttcttacggaaaataagcagcaaattttaataaaaataaatacttttcaattcatgcaaggaatttcctgaatctataaattgatccactagaaaagcgttagtagaaaataaaaaataattggagcccatattttcgtcataaattgagtcccgaaagataaatagcatggcaaaacttgaaaatatttgtcgatttattgcctattttccatccatgtttgggatgaggaaatatataaaaagataaactttgtataagtatttattatcatgtaagtcgtcagaataatatcaaaagacttcgtataaacaatattgcaataatttaagttcgttttatttttcagtcaacaacacggccgagagaaattttgatacatcaaagacacacctaaaatacaccgcggtgagagccctagcgaaggctggactataaaattgcacaacaaatatacctactgttcgagttatgttttatacgagtcagatttgagtttttcctatggcaaggttgtgaaattcctcccaaaaactttcttacggaaaataagcagcaaattttaataaaaataaatacaattcaattcatgcaatgaatttcctgaatctataacttaaacgactagaaaagtgttagtagaaaataaaaaataattgg

SEQ ID NO: 1592 - DNA, 1167 bp, Heterodera glycines
  misc_feature (54)..(54): n is a, c, g, or t
cgggccatctgtgctggtacatagacaaagaaaagaacattcaactccagtttntgcacttaaatacaaagagtgagaagagcgaggatcatttttgatcaaatttcattttttcaattttcaaaaaattcaattaaaaatttccatttttatttctctttatttacattttgtaagggttaaggcacttaaaattttcgggttcataactatttatattagggtttttttttaatttcagtttcctttttatccgatcactatttgctttacaagctttggattattgggttttttcattatttttcatccttttatcaaatccgtccgatcagtttaggttttcctttcaatcattttttacttaaattaagtccagatcacttttacctatttatttcctagttcaaaatattttaaaactttcccgtcttcattttttatgatttcgatgcttccattcattcgtttgctacttctttttttaaattactcgttgattttcttaatttttctttcactaaataattaaatttccgtctatttgatttattttaaaatttttcaattctcttccgatcactttttatcagtctcttcctttttcctccgatcaatttggattaattttttgttcatcaatttcctgctaagaaatttgcgttttttctaccgaaatttgtgactaaattcgctgtcactgaatgcagcacaatgtttcttccgatcacttttaatgttccgattgtgcacctttgctcgatcactttttctccaccaatttcaatcgttttgcacacttttcctccctccgccgatcacttcgcccgaattccgatcattctcgaccctcgccttccccaccgattctcgaccagcagcagcacagagtagtgttaattgatgtgattttataaagaacaaaaattagttttgtcgcaatcattattcattttttaattttaattattttcaaaattatttaaattaatttttaggttttaattttaattttatgtctttgatttaaattccgctccataaattgcttcaaaatgaacaccaacaatgacagtaatgacagttcacgaaaatacagtaatgcgaagcaccaacagcagcaatacagtagtaataacaatggtggtggccaccactttcttgtcc

SEQ ID NO: 1593 - DNA, 8271 bp, Heterodera glycines
  misc_feature (8221)..(8221): n is a, c, g, or t
  misc_feature (8237)..(8237): n is a, c, g, or t
  misc_feature (8242)..(8243): n is a, c, g, or t
  misc_feature (8251)..(8251): n is a, c, g, or t
tgcaggtccatgctgttcaaactgtcactatcctccacagcaatccatcgcattcggcgattgctgttcgctgagctgctgctcaacctcatcgcgttgatgatcaccatcaccaactgcagcagcactacggttgtgaagaagtacaacaagcatcaccaacagcggaggatggcacaaaaaatgccaatggcggtgccgacggcggggatgaccaattactgttactgtccgcattgctcggctcgtcctcgttgttgtcgtcgccggcgtcttcggcacggcatggcgcccagcgctggcggcgtggcaccattggggagcaaagcattgcggaagagtgtagcagcggcacaactgtcagtgccggtgccgttgatggacgtgaaaatgagggagacgatgacgaaaatggcacagattgtggcgagcatggagacgataaggaggataagtgtgttattacacagctgatggcatttgaaatggaaaatcaaatctattttataccgatcattgatcaatgattgggttttattttgatcaattcgattttgaaagttttattttaatctgttagattatcggactgatttattttgagtttttataattagttgaccacaaaattaaacacaaatttaattgaatctgttttctgactggcatcaaaattatttttcttccttaataaataaatttttattttttataaatttttaattgataatttttataaaatacttttattttattaaaatatgattttatcaatttattaaaataattgttagtaatattaatttgaattatttatttaaatttttaaattattttattccaatttgcaccattatttcatttcagaaagagtcaaccgcccctttcggcattattgtcagccgacaaaacgccaacaaagagccaatttgccaatgtcaatgccaaagttcaacaggaacaccagcaacagagaactccggtggcaaagacgacgtcatgttcaacttcgtcctccggcgtttcttcctccccgaatattaatggtcaggatcaatttttcgaaaattaaaaatgccaaatttagttaatttatgggctgaaaatatccctggaatcgaaaccaatgtgccaagaaatcatctttttttacaaaatacgaaccacagacctcattaaaatcttttttagccttttaaaaattttcgaatgcggaaattcggaccaataaaatccggaatcgtatttcagaattttcaatcgaatttgttattataatttgaaaaaaaagttattgactaaaatattgaaaatttgaaatatgtttaattttcaataagtagttaagaatcaaaaaaaaattaatatttttcataatttcatttagaatttttcaatttactgtccaaaaaatttaataatcccaaatttttttggcaaatgtagaaaagccatgattgaccagtttagccccagcctttctgatcaattgcactaattatgttttccccgttttttaagctggaatcagcggctgcagtaatagcagcaaaatttcgcgcttgatcgtccgtcggcattccgcttttcagctgccgcaacgcttcacggcagccgcctcggtggccattggcaaactgtcaggcgcttcaccgccgcccccagcccttctggcaacggcaacgacggcacaaatgcttcatctatacaatgccaacattggaaacaaaagtgctacccaaatgatcactgctgctgctggtgccgtcgacgacgacgatgataatgacgaagatgaggacgccacgactgatcgaccgactgatcaaagtgatgccaacggtagtagtaccgtaccgccgtcgccggcactgtcccaccagctgaccatggcagccgcgaagcagcaactgttgaagcacacggcgcccaaaagtggcagcggtcagttgtttgctcgagaatttgaattttgaaagcatttatgaaaaacgagacttgataaatttcaagcaccgaaaattgcttgctaaaattatactcgttttggggcccgggtaccggattttttttagaaacccgtgaactctggaattttacctgccaaaattaaatatttttatcccgattgccttagattttttttaactcgtcgaatatctaaattttctgcggcggtgcatacatatctcgcgattgccaattagcaccgactgacaataaaatcttattaaatttcaattaaattccggcataaaaaagctcttaaattatgaagcataggaatccggctgagctcatttcaaaggataagggaacaaaaaatcttatgaattctaaggttaacaaatgtgattaaaaaaagaggtgcatttacaattttcccattttccatggtcatcttggaaataaggacgcgtttagtttttccatgttttgaggcccagattcaagaacgtccctaaatccgaggaaaaatctatgtaatccctgttatcagcatcttttttcctgccaattaatccccacttttgctttgattaacttaatcagtcgccgctttttgtgccctgtttggcgatataaaaaggcatttccgatcaccgcttttcctttgacaacatttcgcggcccctttgtctctttctctgatcaccaccacaaaatcacatatttccttttttgttgtctgtcccttatttcggatcattcttttgtcggcatcattcattgatcacttttttcattcgtttatttgatcaatgccgcctttgtcactgctgatcagctactgcttgcgctttcctttctcactgatcgatagattgtcgttatttcgcttcactggtcaccactgttttctctttttgtttgaaccgtacaaaacactgatcggctaccattggatcacttactgttgttgattgatctgtatgtatccccatacgttgtctttcaatcgcagttgttatccgctatcattgttttgtatttcgctgattctgctatttgatcggctttctgtctaatttttgttgcatgctcttttcacagatcacttccccactcttatcaacatcattttcattcgtttatcagttttaattattattattcattctgtttttttcattgaatttgctgattcatttatattgcactccttttgattacattgtcatcctgatcaccccactgcttctgaacattttgtcactctgatcacccccactgcttctgatcaccttttctgccctgtcagttgatcactttggtcattcccattgttactactgatcatttttctcgcattaatcaccactatcatacctactctgatcagctctctcattctgatcatccaattttgcttttctgcttctgctgatcacttttctgtcaccattttgtcgtcgttttgctccttcgcttatcgactgctaaaacggcggcgtcgaacgaaacaaaaaatggatctaccggccgctgatccttctgctgaagatgatcgggatggggtaaaaagcaggaaaagaaacagagagagcgagaaagttgacaaacaaaatgtgatgtatgcattgtttttttttgtgtcgtcacaatcccttcgagcgcgggacggatcagtcccaaccaaaaaatccgtaacatacactccatcatcacgcattaacagatttatggctgtgatctgctaattctgatcagcagagcagatattaaagcggcatttatttttcgggatcagtccgatcattgattgattgataactggttgattcaaatcggattaaaaacaaggcttccatttttggcttggtccaattcaaggtcagtccgcagcttttgtctgcctccaatactgattagacttgattggacatcgttgattcgattcaaatcactttaaccaatcgattgaattctcataggcacctcagtttttttattgtacttctaatcactaattaaattttagtcaattttaatattaagcaatttaatttaaaatatttttacttacttttttattttttgtgtccaattttcttcaccaatttttttaatccatttttctttatttttttcctgttaaaataaatttatttcctcctcttctcatttcgaaggactgattcatccaaaattgcaatgctttaacccattgttattacttcttgacaaatttttttgttaaattttaaatttaattaaaagcggaagaaaaattttgatttttttttcaaaaattacatttttaccgatttgaagtggcaagaaaaagagaagtgataatttgaagtggacaaaaataaacaatttttttacaaatttcgctggttcattccttcttgtgttagttacttcctccttaatcttcaaaattttaaaaaagctaattatcgaaatgacagtcaaaaaactgaattcagcaaaatcgtgtccacgcggaaaccgggatagtaccgtagaatatgttccatccctcccaaattgcgcatccccctgatactgtcccttaattaatttatgtgctccctgatactgtataacagtagtcccatgcctcctgatacctaccgttcccggtctcttaatccttgtcaattggtctccctgagattgtaatggcataaattatgtcattataccctccaattttgtctcccccatggcaccgtccatggtcaatattttgtgtccgtggtgctgtctgagtgtcacatgccccctcacaccattcctagtctaaacccttgtactatttgtgagcctccttggtatcattctcggccctaagttgtgcagcgtcgactttccgaccgtcccatgtacctaccactaccgtacctggtctaaactgtgccgtcctgctaccatccccgcccggtctaaaagccgtgtgcttccccctttccggctaatgggatagtgtaccaccactctttccccgttttgttgtgctgacaaatcggttggagcgtttcaccgttttcatggttcatcagtcagtcggtcggtcgctggtcggtggttgatgtgcacgcccattacgcaatcaatcatcattagccgccgccctccggcagattttgtgggctgtgctttttctgctccattttagcagcttttcattttgcttactgcttgcttttgtttttgatgatgtgttgtgcttttttgtaggtgcgcgctttttaaccccttttttccttttttgatgggtgagaaatttaattaaacgaaatttatggggggtaaataaattaaaaagtgtgaaattaaaaaataaataaataagtaatttcacacaatgggagggagataaagttttaaaaaaaatgttttaaaaaatacatttttattaaaaaaataaatgccattttaataaaaatttatgtgggtaagaaaaaaaagaaattcaatttttgaaatttgcagaaaactattaggagataaactattagagatttaaatgataccagaatttttattataacctttttatccctttgcataaataaattattactttaaagaaatattgacgtgtaatttaaaaaaataaaaataaattttctttgtttttctaataaacgattttgtccttaagcaattccctagaaggaaattaaaaattgaattagaccttgaatagaaatattgttaatttatcatttattaaatgacattgatccacttctaagttgatttcatgcaatatttttttgttaatttggtatttaaatgccaaatttgtttttgattattatttatatataaaataaaaataaaataaaataaaacttcttttgatatttttaaaaaagacttttatttttttttttgttatatatatatatatatatattaattctttttcagctgacaaaattgttgacgacaaagctaatgtgcacgtcagcatgcaacaattgctggcaatgcgcgacgacggcatggaattggcatttgagcgttgcaaaggttggcagggcatttttggaactaaatttcaattttaaaaattaaacaaaattgaattgaatttcttttttcgattattgcataaaattttttttatttaaattttatgtttttcttattttaaccatttaaaattagtttacaaaaaaatgaaaataaagattttttatcattcaatcttttggtcaattttaaattttatcatcatgctttaaactttttgtttcttttaccaatttgccaaaaatatattttttcttaatgtaatgtaatttaatatattttttgattgccaactaaaactaattaattatattttttataaataaaatttttccgccgatgacaatttttgcttgtcggttggcacttttatctttccgccacgctttaaaaatttgtaaaaattatcgctaaaaacatgataaattcaaaaatttttatctaaaactaatagaccatttcttagtcaaataaggtgtggcaactttcaattaaaattccgtaattaaatgtcaatgttttgtttttgctcagcttggtccaaatacgtgtcccaactgttgcaaattgtcaaattgcgcctgagcacggaggaggactatgtgaacaaattgaggcgccaatctgagcaggccaaggcgctgctcgctgtcggcacggcacaaacagtggcagcgaatgttggcaaaatgccattggccggtgttttcgaacggatgctggacggcacaatgcaacagactgtgcacgcggaatgtggtgggaaaattattgaaaaattcagaattttttgagaattgggttattttataaaattaaaaaggattttttttaaatattcaatattcaatttttttattttattttttttaaaccgaaataaattaatttctttcataaaaaaatcgaatatttaaataaacagttacaataaaattccaaaaaatagttatactcatataatttaaataaataaattttatttaaaaagttatttatgtataattaattgactgaatcattataaaatgaaaattattttttaagttcacaaattttaattcaataaataaacaaaattgtgcaaataatttatttattcttttttttagattttttattaatcaaaaaaataatatttatataaacaattacacatttttaatttcaataaatttgatttagatatataaagaagaaaataataaatatatataattagttaataagtataattacatatttgattgaatcgtttaaaatgaaatattttttatttttttgaaatttcacaaataaagcaaaaataaaattggaaaataattcatatattttatttttatttgttttttaagcattttttagatagagaaataaatcttttattttattcaataaaatgaatatctaaataaataattataataaattcaaaaataataccaatatttaattttaaaaaattttatttaaaaatgtataattatatatttgactgaattattttaaaattaaaatttttttaaatgcataaattttgccaaaataaaataaaattatgaaaattatttatttatttttatttttgttaaaagcattgggtgcgatgcaacagcgtgtggttttgacgttggaaaaccggcagaaagaacacgaccaacggagacgcaagctgaaaacggagtgggcgaagcagcgaaagcaattggtaaatattgaataatttttttaatttaataatttaatttcatattagaaattggtttaattaaattcaatttgttcattgaaattttttcattaagataaaaaatatttaaaaatttattaccagaaatcatttattgagtaaataaaatatttttaatttgaaaaatttaaaaatatttttaaaaacattttttgaaggacgtatgtgttgaagagttgagacgtgccaagcaaacacatctgaacaaagacgaacattatttgagggccaaggaggtggaaattttaaatacatttaaaacaattaaaatgaaaaaaatatttatttatttaaatttcttaatgccttgaaaagttttattttttaaatttatttttaatttcgtaatttgtatttttcaaaaactacttgaaaaattttcattataaaataattaaaattttcctttgacttggcataattttttggtattttgccacctgctagatatttgttggcattttgtaattccaattntttgcctaaccataantcctnnggtcattnatcttttttttggcattttg

SEQ ID NO: 1594 - DNA, 1989 bp, Heterodera glycines
gcagcaaggatcaatttatgatccgcaagctcgtcaaggagatggagaagcggctcaagtcggaggaggagtcgcttatccgggtaaaaaaagacaaaatgccaaaattgaaataaattttgaaaataccgggcaaacggcatgtcatactaaacaataatttaaatctatcacatggaaatgaaaattttgtttaaaaaatttccaattatttctgatggctttgtttggaaattttctgcccattttttattttttcagccatccctgacaaatttttttgtcggggaattcctccccgatttttcttccccgaagatcgggaagtaacaccatacataaagcaattttatctataaaaaatggaacatttggcaaaattgcggacacaaggacacaaactatgctttgtgccaaatttggatgcccaggcgatggatggcaacaaactgccaaactaaaaaaaaaggtgtcaaaatgagtcggggtcggtttagtacgggccgttttagtacgagcgcaagtttttggctataacttttttctttgccaacaaaatccaacatttttagtatcgttcgatagccctaagtgtcctctattaatctgaaaaattgcgaaaaattttgttaagcttcaaaaaagttatggccagaaaaactcaaaaaaccagattttgggggattatccccaattcaccataatcattagacaaaaccaaagaccggccagtgaattaattgcttttttggggtatccttaaaataaaacaattgggatttgcggattcttcggtacatacatatttattttgattcatgtaattaattattgggacattttgcgtacaattaattaataataaggaacgcttcagttatatgtatgccaaaaaaaactgctataaaaagagtgttgctttctttaaatttaaacaatttttgcgcctgattataattcaggaagaaattttcccaaaaattttgcccaaggggataaattatttcggattcgaaatttagtgaacccgatgaaaaaccatagatgggggggggtgcttttttaactgtgtcaaggtcgcttgctgatcatggacatgctatttattttacaaattttaatttttaaaaattgaaaaatttcaaattaataagggtgtctccctaagtttttcatcggcgcccactaaataaaaaagtgcctattattctaaggtggaggggtatataagtaattaattaaaaaaagttaaattatttgctaaaagtcatttaaaaatgcaaaaagataatcaattaaaatggggagagaaaaaaattatctaaaatttttgttttgagttttaaatttttaaaaataaaattggcgaaaattttttttattaaaattttctaataataataattaattaataatgattaagaaaagcgatgcggagaacgatgtcaaacggttggagcgtgaattggaggaacgaatgtttcgcattcattcgctacgggtcggtttaaaatggaaaaaaaaattaattaaaaaataatttccgatatattttttttttaaattgctaaaataaaattataatgcttaggtgttaataaataaaataaaataaacttatcaaattaaattcaattcaatcttatcttaatcataattgctgcttaataactttgcattaattttttttaagtaattgacattaaaataattaaaaaagttatattttaaacaattttattactcaaaatcttaatttataagttttttaaatatattttttcctttttaatgcttttgttctttgaatgtaattaattaaatatgcttatatcagagttccattacaccaatattaatgtgtccaaatgtttaaaaaacttttatttttttaattatacaaagccagtcttattattttttgctaaaactttatttccgtgccggggggagttcacaaatttaacaaaaggggggaaaaaatatgaa

SEQ ID NO: 1595 - DNA, 3015 bp, Heterodera glycines
  misc_feature (47)..(48): n is a, c, g, or t
  misc_feature (105)..(105): n is a, c, g, or t
ttttgctaaaactttatttccgtgccattttctttcacaaatttacnnaaaaggggggaaaaaatatgaaaggcaatttttataaaacaaaattttctaaaagtntaaaaaaatttttttttttgaaacttttatgtttatttatttttttcagtttgcaagttaattgtaagcattccttcttcgtctatgacttcggtttcaaatttctcagtttttttaccttagagattcggattgccactcccaaattcttttcttaaattttgaatttttaaactacatatttttaaattttattccctaattatttttccaaggttaaattctttactaatttaaaaattaattttatctctacccctagcttattaaaaatttgccccccccctctcctcctcttttttgctgttgttttgtcccctttttttctttcgcccggccctctacgcttttcctaattggtttttttcttctccctcctccgttttgcctacgcattttgtgccatgccataattttcttgtgccactgtgttttttttctgcgtgtgtctgtgccgaaaaattttaaaaatataatttaattttcccgctttttttttgtttttggcatttttaatgactaaaagggcacacaccgctcaagcgacggcacatttttttcattttggcattgagcacaagtcttggaattaattaactcaactctctcttcctctcattgctgaataatcgagagtttttcgagaaaagagctcccgccgctttcaaatgtcacatgcttttaacatttttaaaattaatttctcgtcttttcatttctccaactttttgtgccgtcctttttttggttttcgtttattttcttgaaaagtttacatactaaatcctttttatgggttggcacaacgcgtttttcgagattttctacctttttctgtcgggatttaagcaaaattccggtctaatcctctctccattctcacttatattgtgtttatgatttcgtaaattgcaaatgttccaatccaaatttgcggaaacaagcaattttctctgtcgagagtctcgacgccaatccatttctgccccatttcagtctaattatctgttcatgtcaaatttttttgcgttgctcagttccgtttcggcatggaatcatcacttgctgtcccccaaccgcagccctttcccccgcagcacaacaatttgacctttactcggcccaccataccgcctccgttctttccggcatcctctcccctccctcggggggcgattttccgtgtgccgccatcgccgcccccgacctcttgacgtggcaccacagagttgaacttagcggaggggagaggagggaatggcaaatgaacacaacaatgggccccttcccccaactcagccaaaatgccgtcgtccgttattttgctccccctccactcaatggcaccctttccctgcccctgcccagtccccccagttgctttagtggggtgctctttgtgcctgtggggcacggcacggggcgggagccaaatgccctccgtccctcctcccgccccggcccgcccgcccgcgggtcccacgcttctccaatttccgccatacgccatcggcgccggctggccttccccgtccgccggcggggttgtgttgctcgtcccccgcggcgcttttgggctccctcgcccctccatgacggggggctcaacatccgcctattattctcattcatattattcactcgcttctcacactggcgcttgccccgtggtatcatccatcggtggtgcacattcacattttgagttcgcgccgttttctttgaatttttcacttttttaagtggcattttatgtatattaaaatcgaaaataatatttttttttagtcaaattaatttttctgaatttttagaaaatatttcctccctaaaaatttttcatttttaaatggcaatatatgcatgaacatttttgaaaattttttttagaggcgtgggggcggaggctcagccctaaattcgcttttttcgttgagttatttgcatggtaatttttaaaaacatttttgtagggagtctaagccgaagacagaggaaaattattttctggggtttttgttagaatttttagaaaacatttctccttctaaaaaatttttaaattatttcaaagacacaaattataatttattatttattaataaattataattttactaacttattttaattgtttaaaatttagtttttcaatttatttttcattttttatatattttttaaaattttattattgaaattcactcattaatatgaaccctaataaatgtttatttacctttttaatgcattaataacatttaaaaattttgaaatttaaatattatttaaataatttaattttttgcgccctttaaatgtttatttttcttatttaaaaaatctctaattttatgcatttgttccaaatcaaaaaatgcaatctttttttccaatttaaaggcaccatccgtcgcttttccaaaaattttggccacttttcacaaacggcggcttttccccagtggccagtccaagcaagccatgcaaaatggcaaatccggcacgcctattattcatattattgtttgtttgttgttccgttcatccccccccccccggggagcaaaattttgggacgggggacggcttatgccaatgccaatgccaaagtccgcttcttccctccgcccgtatttccccgtttttttgaacgcccctcgggaacaatgtgaatgtcacatcgatttatcacaagcttagagatgaagattaatggcttttgtttggctgaagccaagcgaaaataaagccaaaatttacgcggaaaaattctttaaaataatccaatcggcacaacgcacacattggctaaattggccagttttttttgtgattaggcaattaaatttgacgaattctcccaatcaatccttaatgtttggcgaattgtccgtttttgatttgata

SEQ ID NO: 1596 - DNA, 3496 bp, Heterodera glycines
  misc_feature (2338)..(2338): n is a, c, g, or t
gtgttggcacaggcacttctcaaattcatttattttatgttgcggcatgtttggcggaagcgcttttatgaattgtcagaaaattgcattttctgtgccgcaccggcaccggaaattgtttgagcaaagcaaacaaaaaaagcgcgtgagtaaatgggattgagttttgctgtggtggtggtggtgccgtactttgctgcctgttgcttgacctccaattttaattttattattaagcaaataaagtaaaagcgcgggtaaatacggtggcgctaccgtatgctaccaaccccccacccttcccattttttccaatttttagaaattgcctacgaaattatgtgtgtcattttccaataatttgttattttatagcgccaactgtcgagatttttttaaggccgtaacactttttatttgaaattttggggaattgtttaaaaaatgttacgaataatcgaagaatgccggagaaattaaatcataatttaaactaaacacataaaaattttgcgaaataaaaaaatgccaaaatttttaattttctattttgttgttttccagcaaatcgcttttttcttattccagcatcacactgtcaacgagctcagtgatctcattcgccaatggtgagtaaaatcatctttcaaattttgaacataatttttcggctttggtatactgtatctttttgggatacggtacttttggggtttatgtaaatgtgttatttttttaattgaaattcctttcagtgagctcaccacaattgctgcaacttcaacactgttaaagtcactcgccgatttgtgggaggctggtagatgatatgccaattaatttttattaaaatttcataattgagaaaataaaaattccaataaaatttaaattcaaattttggcaaaatgtacaagaattaattaacttgatatcggccgaaagcctattcatatatttttggaagccatctttcagctcttgctaacgaataagggcacaagcagaactcataaagttattattggtaccactaatagccattaatagctctaattagcgggccagttcatggattttttttatcataatgcatcctttttttattgcagtgccgggtcattttcaccgtttggcggatgttagccgctccaacgccccgggcgctgatttcttgtcttttcttcaatctttgccttctgccgattccttctcttcgtcctgctggtcagtcattctgatcactgattgatcagtccattctccgacccaaaaaaatttaaatcgactcattccaatatataagtaggctcaagctaaatgctgatcacaattaacccattttttgaccaatgttatttttatatcaaacgggttgctgatcacttaaattcgatcaaatacattaagcctaaagctcgatagagaatgtctatcgattctaccgtatatgtatcataatggaaaaaccacccttttcgatcgttagtgccacaatgtattatcgattgactcaaatgaaatgagcaatagcagatcactctgtctgttgatctgtacacccatttccttaactgatcaaaccagcattttgctcttaatcctctttttaaggcgtgaaagtgacgaggtgtcagccgccgcacccactgatcaccacgcccacccctactccaatcacaaccaattgcgcttgttgaacaacggcattggcacaacagcggctaaccaccacaatcataatcatcatcaccattatagccataataatcggcattattccgtcaacaacaataacagcaccgccacggcactaatgagcaacaacggcggcaacgcgtcgttgtcctcgagcagtgccgcctcctccaccgttgtgccaatgcggtccgccgccgcagcttcgtcgtccggcaccgtcacggacgctggcgctgtgccctcctcctctgtgccatcatcgtcggtgtgtcgtgtgcagcagcgccggaacgcgctcagctcgacggacgacgcgcctcctgccaagctgatgatgaccccgtcgcagcacaagcggaaaggcaaagcggcggaaatgagtgagttcagaggcgggagcggcgcaaggggcatgcgtggcacgcgcaaatttttgatcgatcgatcacttattatgccattataaatccgatcttgaatagaactgataagttgagagcaggtgataaaaaaatggcacaatttggaccagaatcaccaaaatttggcggcaaaaaaaatttctttttttcgaaacccaaaatggacaaactgggacactcttatataatttaaaaaaattaaatttttataaatntaaaatgaggacttaaaaccttttttttagctgctcgtctgttcgacatgcaatcatcctcgtcttcctcaacaccaatccaaccatcagacgcagcccggtgagtcatgttacaaatgataaagccatggagttcttttttcaaccaactaggagggaggcttaattgaagggggaggggtggttatttagaaggggagggcaatttaaaagaatacaggtaatttgccaaaaaatttttgtccttcttgtgccaaataatttggcaaaatgttcagatcccatcgacttgctcgtactcggcaagtgtcaaggtgttcacagtgcggacaattgttgatcttcgatgcagtcaagtgtcaatgctggtcagtctaatgacacttaatgatcaactaattagctatacataaatgaataaagcgtgaaactggccaaaaaatttggcgacagtgaggcattttttggtctcattgaccaaagcagatgttccaccattttttacatattttctataatattcgggatcattgactaggctaatcagagcgcttgatagtgttatttcatttctgatcagtcagtcacccattggttttggcgaatatatgatcaggaaattcaacacattgtccttatttcttgctgattagtttaattcagatcgttcagctcatttattgaaactaaaaaaaaacagacccactaaaacccggatcaatgacatgtacaaggattaggaatttttggaactccggcgagggggagggggaaatggcacatttttatatcccatgtcattaagacataaggaatttaaaaaccctaaaattagaaaaatttgaaggggcatgggcggaggggaaataatttttgccaaaaaatgcccctattttcagcggacttttgtcccacaaaaagtgccttggctcggtccaactttggtgtggcgaaaagacggccaaacggctaacggagtgcggtgccgaccggcgcatgtccatctttggcgtgccgttgtccgagtcgttgcgcacccagcacagaaaagtgccgttcattctggagcggtgtgttgccgagttggagcggcgtgggatgcgttgcaaagtgaggagcacaaaatttggcacttggcattttgccattgtaattttg

SEQ ID NO: 1597 - DNA, 7237 bp, Heterodera glycines
ctgtgctgtcgggataggcttggcatttgtttggtcgatgtccacttcttaggcatagtgaacagttccatatctccgttgtggcaattggtccgtttgatgcgacacggggccaatccccgcctgagctctcgttctcgttggcatgtgtgatcgatcgtctggcgaaacgggcgttcgtcccgtaccgctcctcgcttcgtgttccgttggattgtgcacaggttggttggctgtcccgtaccataaatgctctttgaaacggttcccgacctgcttgaacttcccgtcccgtctgatcacgttctgttttgtgatcagtgcgtacttccgggtctttcattgctgccaatgctgactctgctgaccgcatgcaccgtacttgcgccgtcaccgctctcctgaactcgcgcactgcccatttcgatcccatcatactttctctgatccgcaattccgtgagcactcgcaccggcaattttgcctccagcaatgggccaaatgagtcgtcgtccacgttcgctccgagctgctcgagttggcacacgcaccgctcaaactcgtcgatcatcgtcgtcaggctgttcacattgtcctttgtcggtggcaagtgaagaagccgggcccgaattgcccgctgtaaatcgtcagtgtcgccgaatcgctcttttaacaggtgcacaaccaccgggtagttgccgtcggagggagggtagacttcaacagcccgccgggctggcgatccctcctttaagcagcgcagaagatgcaattgtttttcaaacccgggaatgggtttgtcgtccacagctcgcttgaaataggcccaaaatgtcgtccaatcctcgggctttccggaaaaagtcggcggttgcagccgaacagtctcgaatgttgtcattcccgtgatttcgtccctcccgtgcttccgatcatgttctccctcgtctcgagcatgccgtcgaatcgggtatgtctgacgctcccgatagtcgtcgttcacgtgagcctgctgcttttcgatttttggttgcatcagtgccggccgatgggctgttgctgggggaaacgcccccatctcgtctcgatttcgattgatccattctcgcgctgtgttcgtcactctcatgctggcgacggatggtactttggcacgccgctgaaaaatcccgtccaaattcgacatgacgggtgtcgcgactcgtcccattggtcttcggttgtgttgctgtacaccttgtccgccgttctgccatcgtttggccgccacttggaaggatctctcacattcttctatgttccgattttcgagtggaggtggttcgtcccccaccggatggctgttgttggtcccgaatgacccgctcaatcgagaccgcgcgattgcttcttcttcatcctcgagtgctcgtcgcatcgttcttaagtctccgatgtgctcgtccgcaatttgaagcagttcagctggtgttggatggtttcgcaactgcaactctttcgttgctgccggcagtggcgctgtcagtaggtcgtagaagaagtcctggtgacctgcgggttctgctcccgctgctgccattccaatctcgaaatgtccttggaagatttgagttgcctccttgagtcctctctccatggccaaaagtcgcgctgcttggtagcctgcctccccttcggtaaggtcttggtcgatcacttctcgagcctccgcaattcgagcggcgagagtcccggatgctctctcgattctgtcccgcgctgtccgtaccgggatggatacactccgcaaattgcgtgatgggaagggtagcatcccttgctgatttgtcgccacgcctgtcgccatgttgcttcctctcgttgcttcgtttactctggcaactttttgttgctcttcgttcgttgaagcgacgggaccatccccgtcctgcacattttcgtcgtgctgtgcgccgttgcgatggtggccctcattcgctgggtccatgttgctctcgcttccgttctcgaactcgaattgttgcatttgtcgtctctcgaaatgttgagctggagccccctgctaacggcaccagtttgccgttagcttctcgaattcgtgctcgttggtcgctcgtagaccgattggtcgctcgtagaccgattgttggtggctgcagttgccccctgctaacggcaccagtttgtcgccaatctttttttcgggcgggctttggccaaatgcggcttggcccagctgaggcgggattggttcccgctcctcttcaccgctctcgtccctttttcctcctgctcactccgttcgcttgtcgtaaagggaagcgcacccttttttgccgttcgttctgatgggtctgatgctgctgaccgatccgatcagcgccaaagggggacgagaatgggaggggggaggggtgacaaatttggattggtgcttgagagaattgtgcagcaaatcgctgcttgcttaacggcaccaccgacaagattttggtgaagggcttgtcggacccctttgagcagctccgaacgggcgggagttgctcgacaagattggttgtgaagggggcttgtccgaccctttgagctgctccgaacgggcgggagttgctcttcgctcttgactcgatgaaacgggttttgactcccgtttcctgcggcggatgctccggctggcgggagactgagaccgaaccgcgagactccggctgcgggaatctgaactgctcgaacttcgtgacgttcgctctcaacttgatgagcacgggtttcgactcccgtctcctcctgtggatgctccggctggcgggagactgactccggcgatgcgcgcttctccggctggtgggattagcggcgacgaacgggcctgcccttcggtggacggtttggcaccgctcggctcttccttccttctctgccctgcttggtttcgtcgacgacgggaattcgccccgtccctacggctgctccggctggcgggagactgacaccgatccgcgagactccggctgcgggagtctgaactgcttgaaattcgctgacgctccgggccaactcccggattctccaatgccaaagggaaaggaactgggatcgggagaattgggggagaacgacgagggcgctgtcgggaaagggaggggtcaagacgggaatgggcgcctccgtttggccccgcacgagaatttgccgaatgtgatggagtgtggagggtgcttttccctcctttccgagtcctccaagccgtttcagcacgaatttattaaagcaaaacgaataatgaataaaagcgacgaattgatcgaattgggcgatgggacgggggaattggaggaattggtcacaggcagaccgaatatgaagcgaaggggagtggaaggaagagaagagagtgaccccttggcagggggcgcttaaatagacaattttcgaagggggcgggcaaaaggccatgcacgtggacaaattgtgagagagacaaaaaacggacagaaaattctagaagcgaagtgcgaacaagggaaatgggcgcacaaaaattgaatgtgaattggcagatgtaaaaagtgagaaattctgaaaggaaatctgagcacaaagttggccgaagatgagccaaccgatgagaaagatttgaattgtgaagggatgcgatggggcaaaaatgggacaaaggaacgggcaaaatgtgaatggtacgaaatggagaaatgcatatgagaaattggatggaaaaggggcaaaaattaggaatgatcaattttgaatgaattgatgaatcgggactcgccccgttcttctccaagaacatccctcattctttttgcttcgattgagtcccgtcccgttcatttgtgcaataggcggggattgacccgccttctcgtcgccaatgaaaaaattggcgacattgcccgcggcgccccttgacagttgaagctccgaagcgtgtgtccatgagttgtagcaacgggttttcgaacccgttttacgattggcattgcgcctcgttgtgttgaaaggggcattgctcccccaccagcatttgccatggcaaggatagccatgcatcagctttttcgctggcagtccgtagttcacatccgtcgactttggcattgttgcccagcatccgtcatcgcaacgaatctcgattttgttaaattcccgcccactcacatttgtgactcctcgttctgcacactccgtggtgcatgggactcttgggccctctcgaaatggaaggttcgggtccattcccgatgctcgaatggatggttggcagccgaacgttccgacaatgctgatgagcatgatcagcagtgccatcccagttcttggttgaattgcgcctcgttttcgtggtacatgacgttccggggaccaaattgcccggtttctccgagtccttgccgatttcctgggttcaacttcaggtactgcttgaactccttggatgttttgttcgccgcgtacttcctcccccggattgttgggagttcgttcgagttcgttttgttgctgttcgaccgctggtgcttcgggaaattcgcccccgatttcgtctgcctgaactgcttgaggttcgtccgcgccaaacctatctcctccttcagatatcgtcgaattcggctgaaacttggtaggaacattgaggagacttggggccatcgaactatctcccagatattttttctcatgtctctgagccgaatgcgggcgtgccgaatttcccgcttttgattgtgccgccgaaggcacttctgctgcttttccgaaaactgctgacttcttcgtcgtcgttgcgctgccgtatttctcttccgaatcgttggggcccttcccccgagaattgtcgctccgaatttctcgatttgcctttccgtcaggcggtacggcttcaatttctcgtcgtcgattttcaacactttcttcgttactcttggtttcgtttctctcctccctccttgttgccgagggtttgttccgatccctcgtttcgctctgagtcttggctgctcgcgtttcttcttcgtgtcgttcatgtactgcttcgtcagctcggtcgtccgtttcgcccgtttttagccgcgcttctttcagcggccaaattttcttgatcggtcgtctccgagttcgtccgttggccattctgattatggcatttctgttatgctcgctcgctccttttgtctcgactatccatccgatgggccactttcgctggttagggtccatttccccaattggctccgctcgagacgtaataacttcgttcgcacccaaccgatcgggaccaaactctgcaggtgagttgtggcggtctcggctaacaatccctcgcgaattgtttttccgactctttcgttttcgcttccaatttcgacgtacttctccgatttgttgtcgtttatttgttcgagtttggtggatatttccgcatggcatggttgttaggattgataccgcgggagttgccccgctgctcgcttgggtgccttcgccgcacaaaacttgtccaaacacggtgtcaatcacatgcgcgccactctcgattttccgaaatccgaccacgtaatcccagaactttcgaatgccgatcattatttgaggttgcgttgtctgtgtgatggttcgcgggtcgctatcgggtgttgctcccgactcgatgagttctgttctgattggcgtacagatctgaggtacttcggacacctcaatgctctcccatttgccgtcggtccgtttgagtcgtaggcgataagttgctgaccgaatccgctgcttctttcctccgaacacttgaactgtaagcggccgcttgtcgatgggttgcggtccgagttgttgaattagctccgtatctgcgccgtcgacatggcttcccgggtcaagcaacaaagttgtttggcactcgtcttcgccttcctctgcagctgcgatcactctgcatatcatttgctgggccgggagtcggcttccgaaagtggtaaaagctcgttgttccccggcattcatatcgaactcgtctcgattgttctgctcgtctcgtactgcagtgaagtgagatggtcgatccatcccactgatcagcgtcgcatggttctttgcccttcgttcgtgctcagtgaaggatcgggattggccacccgatatgctcttccagcacagaagccaatgatggtcgtcttttcggcatgcgttgcaccggtttactcgttggcattgtttgaataagtgatcggagctcatacagcgcaagcatcgtttctgctcaatgagtctcttcctccgtgcctgtgctgtcggataggcttggcatttgcttggtcgatgtccacttcttaggcatagtgaacagttccatatctccgttgtggcaattggtccgtttgatgcgacacggggccaattcccgcctgagctctcgttctcgttggcatgtgtgatcgatcgtctggcgaaacgggcgttcgtcccgtaccgctcctcgcttcgtgttccgttggattgtgcacgggttggttggctgtcccgtaccataaatgctctttgaaacggttcccgacctgcttgaacttccagtcccgtctgatcacgttctgttttgtgatcagtgcgtacttccgggtctttcattgctgccaatgctgactctgctgaccgcatgcaccttacttgcgccgccaccgctctcctgaactcgcgcactgaccatttcgatcccatcatgctttctctgatccgcaattccgtgagcactcgcaccggcaattttgcctccagcaatgggccaaatgagtcgtcgtccacgttcgctccgagctgctcgagttggcacacgcaccgctcaaattcgtcgatcatcgtcgtcaggctgttcacattgtcctttgccggtggcaagtgaagaagccgggcccgaattgcccgctgtaaatcgtcagtgtcgccgaatcgctcttttaacaggtgcacaaccaccgggtagttgccgtcggagggagggtagacttcgacagcccgccgggctggcgatccctcctttaagcagcgcagaagatgcaattgtttttcaaacccgggaatgggtttgtcgtccacagctcgcttgaaataggcccaaaatgtcgtccaatcctcgggctttccggaaaagtcggcggttgcagccgaacagtctcgaatggtgtcattcccgtgatttcgtccctcccgtgcttccgatcatgtt

SEQ ID NO: 1598 - DNA, 1564 bp, Heterodera glycines
tttaataaaacggttagttttatttcaaattcgaattctttttgaataaaaaaattgacgccaaataaaagtttatttaataataaatacaatattatcattttacttagtgttaataaaaacaaatggtgaacttttgattgtcttgataatttgtgcaaaaaaaaaatcaaacgaattaataatgatatcattaattgataatttaattgatttttttatgggtttttggtctttaaactagtagccaggcgctatttatcatttttatatgaccatttaaatttgttatgcatttagctttatacaaaaatgtacattcccgagagcagttcacgcggtgaggacctcgcttttgctacaattgcttgcaattcgatgcttataacagcgccagcttcaacattttcatggtaaaatgatggttttattgaattacatcatctcattaatcctaaacattcttttggccatctgctatatgtcaaaacattttataaaattaaatgtttgagcaaacaatttttttaaaattattttacatatttttttggaaaattttttgaattttggttggcaaaaatgagaatgtttaggtccattttaacgaatagctgatgcccttttatattgcatttatttgttattaaaatttctgtttttaatttattaccgattttggcatatgtattaagaatttaaaaaattttgcttggcgtactgtatttttattattttttcaagattttttttaaaatttaaatgtaaaaaaaatttagtaaaattaccaacaaaaaaaatttatacaaaacagctataaaattaacaaaatatttaaggtaagtttttttggttttaaggtggatggcctatttgatgccggacaattcgccaatttattatagtgcccacttggaaaagacatatcgtggcaaggacaactttctgaaggaatggatacccttacgactgatcgatggcaaaaagataattcgtgacggttgatccaaatccaaaaattctaacctattttttaattaagaaaaaaaagtgaaattttgattttcatattgttacattatttctgaaaaactatattatattttcatttcatttttttgtgacttctatgttttttacttagggtgtaacataatttttgatacccaaattttttttattaaaatttttttttttaatttcaacaaaacacaatcatgattcaaaatgcccgccattattatcaataatatgttgccattattctggcaagagatcaataccaatggaaaagtatttagggagttagagttaagtaagtaaaaatggtcattttagaggtaggtatttaaaaaaaaataaaaagatacagagccagagaaatagtgattaaatagagcaaagttaggactataagaacacaaaaatataaaattttaattacaaaaattgaattatttgagagccgagactgaaaagtggtctccaaaaacggcatttttcaagaacaccaagtaacataatgttttaaaaagtgggtttggaaattctgaatttaattaaa

SEQ ID NO: 1599 - DNA, 5066 bp, Heterodera glycines
  misc_feature (15)..(15): n is a, c, g, or t
  misc_feature (5030)..(5030): n is a, c, g, or t
tcaatgttggcacanaatttggcggaatgacaaaagattttctagcgtagcattgaattggcttagatcaatttgaccagtgatactgttgatgtggtcctttagtggcgttatactgtgctccgatggttcatatgccgtaattttattctcattgcttgcactttcacaactgactttatgaaagtgcccaaatatgtctaaaaaccataaatattaatgatttttagtatcattttaactattttctgatttgccaaaagcatgaattttaaaatttttaaccatttttttattattgtcctctgcaaggacaataaaacaaatttagctgacaaattagaagatagatttttctttttattcaaaattacccagtagcacaagcacagcaatgagtttgattttcatcaaaaaatggcggaataaatctaaaaaaataaaatataagatggaggcattttgtaatttattaaaatatgtcaattcagttcttttataagcctttttcataaagttatttatgtaaaaaacttttttttcatttttcttcattttgattaaagcaactaatattataaataacttaaagttgaagtcaaattttaattattgtttttggaaaaacgattaaaataaggagtgccagtttttgcctacacaaaattttgccctacagtctgccggaataatttagttttacttagcaaataaattcattcatttatatctttggttaacttataagaatgtaataatgaaaaagttcaaaaaaccatggcctctttaatcataaagaatccaaatatataattaatgcactaatacatggcgcaaaactttcataaattaaggatttataaatttttagtaatattaaaaaaggcataataatttaataaaatgaaaaatgtcttttattaatattcatatcaaaagagtgagcatccatttttacatttattttatgaatgcacttagtcccatgatgaaggttatcattataatttttataattttaatcgattctgagaattatttgaaataattcataagaaaagaatagaaaaaaaataaaattgtatgaaaaagtaataattttaaggttcctaagaaagacatttttttggatgggttaataattttttcaacaaaacgacttaaattttttttaattaactgaagataacgaattttcaataattgcctccaattgtccgtttttgtttttttgtttatgtgtcgttcatatgattttaaaaatcttattttaatgatcaaatttctttttatttgtttctatttgttaggttttagtttgacttaatatcaatttaaattctaattgaattttagcaacctaaaaaaatatttaaaataatatatttaatcatacaacaattttggcacatatattgtaaaatttcagaagctgaaaatttccaaacaatgatattcattcatggaaaactttccagacagacccatttcctaatgaaattgtgctttcgacgcgtaattgttccatttcctttagcgattaaaaattaataatgataaaaaatattattattattattagagccccggatttttatgtttttacatattttttctgcggcttagttatagtgagagaagctcaataatagaattttctccgaacaatttttaatttagagaaacttataaaaacacatatttggcgttttggcacataaaaaaatatggcacatgtttgggcacatattttgcttatcgaacaaatcacaaggtgctaagcgctcgaacggttgcgtaaaaattttagcttttataattacatatacattgaaggctttttcttgtaaaaaaatttgtgaactgcttcaattcgtgaccggaaaatgcgccagtggaaattttactgtcgtttcaaaattgcatttcataaaagcccaattccctaacaacttaattcgcttttgctgtcatcagatattggaaatttcttaagattaattttttttaagaaaaggcaaaacccggagaaaaaaaaacgaaattttttattcaaaattcgtaagaattatacaaaaaaaatgcgttcaaatttcccatgaccgctgcagtaattggaaataattatccatgttagtactgacagggatttgtcgctgcgtaattccattcacataagaagccaaaattgaaggatcaacagcagccgttgttgttgaacatttcatatatttttggacaaatttcagcgcatttcggcacaaaattgggtggcatctaagaattaattaattaatggtttattcagctttaatttaaaaaatggctcactttattgttgtaaacaaaatcaacaaattgttaattccctgcagaaacagagcaaattttccaattattagcaacaaataaagatcggtgatggtttgtgtacgtataactaagatcataaaaaatgaaagcaaaacgccaagaaaatggaacaaaaatgccggactcaattgtcgtcctgttcggatattttcaactaactgaaattggccaatttaaaaattattatcacataattacgagagattgaatgaataataattcttgagatttttagttgaatattaaatacaagaaataaaaaataaaaaatctcaagtaattaattgttatttgaaattttttagctatgttatattatttaaattacagtcattaaaaataaaatgattttcttattaattaaaaatttttaattgaacttaaatataatccttagtataattatttgtctttcccaattataattcgacctgatatttaattgccatattaaatgaagctgaattttcgcgattaaatcttcttttattcaaagccagcagcaaagtgatgatcttaattttttattttatttttcgtttattttaaaattaataaaacttacaaaaatttccgagaaacttgcaactgtcgcaaaaatttgtgtataaatacaaacattcggcgcgacaaacattgatgttgtagagtaataatatgcattcaaaacagacaataaaatctatgatcaaatttattataccgtaacatttaaatcgcttacgataattacaacacaaaacgaaagggtccaccaatttttgacagtttcatattttttgatgcagaaagtggccacaatcctttcagcaatcaacaaatgtcctgtaaattagtatcaattatatttaaaatttaatttattcagctttaaattaagcatacggtacagtgcgttcacctacctataaagttaccgtacaccagcaagaaataacggaacgcattcacaaaaaagaacagtgccatgggcgaaaacaggccataaattaccgaaaaaatttgaacaaatgcatacagaaatgcataaatggactgggcgacaagaatgaatttcaaattattgtgcaacagcgatgtttggtagacgagtcgccaaaacaaaaagcacaatacaacggttggacagcaaaaagcgcattccaccgcatttatggcgatgcagagaatgtcaaacgttggtttgggaagaatgccagtggcatttggcgtgccgtctttgccaatgctttcttccatttgattatgaaacgggaaatcagcaaaatatggatggaactaaattttccgaattcataaaataaaattaaacaaaaatttcggcgctatattaaaagtggccctttttgaaaattttttaaaaaagtcatgaaaatacatttccgggggggttttcggggccgctgatcacgaatatgacattcatttcgaccaatttcgaaccccggacccggatttatgatcagaaatttttcattgtaatttcaaatctctagacatatgtggtactcagaacttatgagacacatttatgataataacattatataggacagacacactatcctattttcctaatactgccccgatatgctggaaatggatagtgtgtctccttaacattgaattacataaatgtgtcttgggcggcgcgaattcagtgttgaaaagtgaaaatttacgattttcgactttttgttcgaatccgggtccggggttcaaaattggtcgaaatgaatgtcatattcgtgatcagcggccccgaaaacccccggaaatgtattttcatgacttttttaaaaaattttcaaaaaggccaacttttacagtagcgccaattattttcaattttattaatcctcacaaattttaaaaccggcccggcgagcgcccggccaaaattttggaccgggcccgggtcgccctgcaaaacgggcttttttttgaatgggcagcctgggcccggtcaagtaaaaccctaagaatccgagccctactaatcattttaggtattcatattttatatcaaatccttctatttcccgatttccgcaatgaaaaatctcagagtctctcatgaaaatacggtttctgatgagaaaattaatgtactgttcagaggtaccgagcccattgggtgtagtcaatcaaattaatgttttctttcagatgccatgaaaatgtgtgttgattcccacgacgaccttttatttgttgccttgaaggacggacggattgtagcgattgaccgacaaatgaagctggttggggtcaaattggaacgagtttttctattccatttttctttaggttgagaggtttggccattcaataacaaatatgggctgggatgggaaaagccgactcatcggattcgattatttgtacgacgatcagcagttgtgtttacttttggacgatgggaaagtgctgctctacgcaacaaataccaaagaggtaatgagataaaccacttcaaattttgccgttggcatttttctggtttgtttcacaaaattcgccactaattccaaatttcagcttaaatgtgcgatagaactgaaaagaaatgtcctcggctgttcctggagtcccgaccttcagctgctcatcgtcgccaccgactcgcatttgctgatggtttctcgggaattccnagtgatcgcagaggcaccgctccgaccgacgacagc

SEQ ID NO: 1600 - DNA, 1033 bp, Heterodera glycines
atcacgaatctgacatgtattttgtataatttgtaatacctaacccgaactcgaataaaaattgaaattatgaatttttcaaattatgattttttgttcaaatttagattaggaaatcggaattgatcaaaataattgaaggattcgtgatcggggaccccaaaaaccccagagaataaatttttatgactatcacaaaaaaaattttgcaaaacaaaagggtccccccttttgaaaaaattttcaaaaacggccacttttagactagcgcctaaaattgtatgagttaatttttgaaattaatttgtacttttttttaaacacaaaggcatttgaggtgctatctttgtcaatgctattttccatatgataaaagatttgaaaaaataaacaaaagaaaactttaaatttttggcatttcaaagcattataaacccaaagagaaagtgagtgagccctttggtttgttgggtgaaatcaaatgcaataattgcgaatgaaagaaaaaccgatgctcattagtgctaatgacattttgtcattttcgcacctgtcaaccaaattacttggccatattcttcaccataaatgttttctatccctttagagttaattaaattattgttcttaccaataaaaaaaagttattcacaagtttaagcaactctcaaatgtcagctgacctttgttcaaattcaattaattaatttttaaatgaaatattatgaatttatatgattatagaagtgctgaacttatagaaaatgatatttttaatttacaatttttgtttaataattaatttaattaaacaaaagaatgaatggcgtatttaaatatttgtacttttttaggttgcactcaaaatgggaattttattaacttcactaaaaatatccaaatttagttgattaaaattttcagaaatagatttattgattatactcttaattagtgggaaaaaagaattcatttttagattttcttcttcacaaaatttccggtgcaattttaaagttttcatttgtatttg

SEQ ID NO: 1601 - DNA, 6062 bp, Heterodera glycines
ttttttgaattttaaatttcttttaggctttcatcgaaagtattgagcagttcgccgctcaagtcaacgacgtcgagtcgctgtgcgtctttctgtcctcactgaaaacggtggacacaacgcaacaggcgatgttcgccccgttttatcccgaacgccaaccgacaaaccaacagaaacaacagccgaaggcgaacagatggacgacgtcagaaacaccgggcaaagttaacggaatttgcgaaaggatccgcaaccatttgatgagcctcggcgagggggaggaggaggcggggaggggccatttcctgcgactttaccccgtcgtcctttgctgttacgtcatggaaacgccgagccgagtgtccgccgctttggtcaatatgtgcacacaaatagcaaaagctaaaggtgagcgatgaagcaatcactaaacaaaataggggaaaattaatggtaaattcgttttaatttagaaaataaaaatggggacgaacattccgaattgattcgccaatggactcgccatttgttgaatttcctcaaggagagcgacctgtttaggcaagcactgaagacatatgacgtcgaaatcgctctaatggtcgcccaatcgaccaatcttgttagttttatgaaatgtttttgtttaattatttttttaaattcaggatccaaaggaataccttccgattttgaacgatctcaaacagaagacgccctcaacttaccaaaagtaacattttaatagacaatgatttttaactaattgaaaattaacgatgcaaatggattatcaagtgattttcccgcttttcaaccttttacagatttcacattgacatgcatttggaggattggaattcggcactcggacacattgcgactttgtcacaattgcaacagaaagatgttatcgacacaaacgatgaagacaaaagcgaagttacggagggtgaagcagtacaaaatacaccgaattatttggaggaatgccttaagctggtcagtttgtttaaactcaaattaaaataacaatcagccgacaaatatttaaataaaattaaaaaatcttcaaaacccattaatttatttgttaattaaggtccaacaacaaaaactttactcgtccgccttgaaattgttttgcgggagacccaactacaaagtttggaggggaagggggacaaatgaaaaagtaaataaaaacaaaacccaaggacattagcgcaattactgcaaaagaattggaaaagaacggccgtttaagagaggcggcgattttgcatgaaaaagcggaagatttggcgtcagcgatgagatgccatttaaatctgtcgcatttttcggaatattgtcgtttggccaaactgcacgagcaaagcgatgtgaaaacggagagcgaactgcgcaaaatgggcacgcaaatggttttcaaggacgaccatttgggagcagccgaagtgtttttgcaccttgggaaagaggtggtacattggcaaagcccaatcgaacaaattcaaattcaaaatgctttttattcaaattaattacaattaaaatgtataatatgtaaaagacaatttttcccctttcagaaaaatgttgagaagattttggagtgttacgagaaagcaaatgcgtggattaaattgagtgcttttgtgactgaaaatcaatccacgcttcatggtcagtttgattatattgtcaatacaattcagtccgattttgcatttctaaatatttgccaaaaagtttacatttaaaaaaataaccggtgagaaaataaagtgattaaggcattgtcaatcgtgcccaagtgcttatgtccactcgatgtgcgcagataattgaacaaattgacagttggcgggacaccatcacaaaacacacgaaacgattggaagtgctcagagaggaaaagcgggccaaaattgaggcgaagcaaacggcgtccggcggcgacgaccaattggacggattcagcgagtcgtccgtcacttcctcttccttctccgacagttcatccaaagagtcacgctcctttttcgagctttcatccaacgcattgaaaggaggcaaagattggtttaaactgcaaagaatggagcgtcagaaacggaagaagctgatgatcaaagagggcagtcattatgaggacggcgcacttctggtcgccctgaaggacatttatcaacgaattgacacccaacaaggtcatcacaccactcacattccctttgaaggctaaataaaaagtatcagaggggttgttatcataaaacggaaaaacatgcaaaaacaaatattgtttaacttttcgaacgcgacagggagaaatgaaatgcatccaaatacaattagtaatgttgaaatgaatttcatatttttgctcaacgatctaaaatctcagctgccccaaacaagcaattttacattgattttctgttcagacgaactgctcgaacttcttcccgctttgctttccatggaccttgtcgacagggcgtgtcgtctgcagaatgaaatgctcacttttcttgaatttgttgctgaagtccatgcgcaactttggccctctcatttggaggcatttcatttgacgggtcccctcgcattggtgaaaatataacaaataaataaacaaaaatattataaaaattatattgttttttgccagcatttcgattcaaattcatgtgaaccaatgcccaggaaaattcacctgacagatgaacttatgccgccgaaactgcgctcaaagggcacagaatggaaattggaaattgtcaaataataaaaaaaaatttcctttccccagtgaattgttgacttataaaatcaaagttttactatcatcccacactcatttgttgattttgttcaattttataaatccaaatttttatttttaatattttcattttctgatggatttaattccatttccgttttttcccaaattatgttggattttttctttgtcttcctcctattcgaatcaaattgttttgccgatggcgggtgcgaacagtttcagtgccctactctcccttttggtcgtcctcagctgcatcatggtcggccaggtgttcaagccgttgttggccgactcgcgccagggcaatttggctgccgggggttggtacttttcgtctccatttctaacaatgatttgctttgtaaagccttccctacctcactcatttcggcactccatttgccccccccccccctttttcctcagttttgggttcgttggtgttcgccttcgctctgaccgctctctccaacctgaagatggcctctgccggtgcttctgccaagtgtggtctgttcgaatgcgcttttgctctgttcgtcggctgtctctcctccgcctcaatccatcgcatttccatcactctctgtgtgctgttttccgctgttctcctctttttcctcaccggcatttctcacaaacggtacggcaccgatttgccgtcggctgcggcggtgggcggaggcaaaaagagaaagtgagaaaaagtgatcggctaatcaacgagaaatcgttcgttgggtcatttgcaccatattttaatttatcaattttaatatttatatgtaatcatcattaaattatttataaaaaatattgggtatgtctattttatggcattccttttttggtttctaccatttaatttcgttaattgtttttgtttttatccttatttttctcatttactgatttttggtcatttactgatttttggtctttttctgatgcgcttctttctcatttccctttttctcctctttttcattttgtcaaattgcgagttttcggctctcgaaatcccagctgatcagctgcaaaacggtgagcaaaacgcacaaaatttcttcattgtgccgcccgatttgctgccaaatggagaggcgaaggaaaagtgagtgaaaagagctgaaaaatcatttacgaatagtaaatcgtatatttgacacattgcaattcggatttcgaatctgtttgaattcgtctgttgttgctcccccccccataatgccgaaaagtctttgccgattttgtcttccataatgccgaaagcgccccccccccatcttttggcgtgttttcttccgcttttcagctgtttgccggagaatgcgtactgtgtcgggaatgcgctctctccgcagtgtttgcgttgcgactttccgcccgtttgtcctttcggtgactccgtcgtcgtcaattgcactccgtccgctgcctttgtcaattgcgctggtgacggcgtcgtcccccgtgccaatgtccccgccgttgttcgccttcaagcaaagtgccgtttctgttggcaacttgaacagagagaaattgtgtgtgaggagcgaaagaactgctcgaccaacgagttgacactgcacaggaccaaatgcagggcgaaaccgaacgcaatctgtgcgggacggaggcatttcttcaaaaatgtccggtgcgtcatcgatcagcctgactgttgataatgatgatgatccttttccgcttttccattgtcagttgccattggacgagtgggcacagctggcggaaggcactttttctgtccgtcactctcggcggattcggcgtggacaggttgagaaaagtggaaaaagagtggtgaatggttgtgccaatttttcgcttaggttttatttgggccattggaaaagtgccatcggaaaactgtgagtattttttatttataaataattatgttttaaaatatttgtcgaaaataaataaaaaatttctcaatgtttgtctgatttcgaaggttctcgttcggtggtcttggcgtgtggacacttctcgacattgtgctcattgccttcggttacattcagcccgctgatgaatcgctttacatttaaaagaaaaagcaaatcggctttatttgttttccattcagttgtatcaacttacaatttatttattatttgtttaaaattatgccttttttgaacaaaccaaaaattttggcattctttcaactcaaagggtggctaatttgtggacagaattaaaagccaaagggattgagaaaattatccaaattttaatgcttattgaataaataaattaaatgctttttatttgcattaagctttgtccatccgtctcttctgtcgttctttttgttttgttttctctatttaagcattttccccattttttgcctctctcttcgtaaatagcttctccttttcctcctcccctcccgtgacccttccgcccgggggcaatacatttagccaacaattaaccaccacaacaaatagccattgaacccatttcacaacggtataattagccattcattcccaacggcggcacaacgaaagggtgccgaatttggccatttgttggcccattttgggcatttccctcctccacctcctcttaagagagcgcaattgaattgtataaatgccgatgcaattcaatttgccttctccgttgcttctccctcccccgcccccttcgccctccgtcattaacttttgcccccccccccccctctcgtgaaacccgtcagtcccaatccattcattcatccaaagcagcaagggagccgcatctgttgcttactgctactgctgctgctgctgctgctcttttcctgcatagaaatggcgcaaaaaaggcgatggcactttttgttgtcccattttatgtccatgggattgctagggggggggggaagggagggagaggagagaagtccttccctcccccatccatccatttggtcagggaagataagaaattcgcaaaattacccatccgaaaatttggttaaagctttttctgtgccccctgccacccacgcattgatccctctcacatttccttctttttttgcccctcccccttaatcccctcggggcattgatctgtcctcctccgtttctctctggccctctcttctccgaccactctctctccgtccactttggcattgctttgactccgccccctcccccggccctttgccgtgttccgtttcacttccaaattgcccctc

SEQ ID NO: 1602 - DNA, 1887 bp, Heterodera glycines
tgcgacgattcgtcaactcagccaaatgtcaacgattcctcccatgaatgattcgtcaactcagccaaaatgcgacgatccttcaactcagccaaatgtcaacgattcgtcaactcaatgattcgtcaactcagccaaaatgcgacgattcgtcaactcagccaaatgtcaacgattcgtcaactcaatgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaatgtcaacgattcgtcaactcaatgattcgtcaactcagccaaatgtcaacgattcgtcaactcagccaaaatgcgacgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagcaaaaatgcgacgattcgtcaactcagccaaatgtcaacgattcgtcaactcaatgattcgtcaactcagccaaaatgcgacgattcgtcaactcagtcaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaatgtcaacgattcgtcaactcaatgattcgtcaactcagccaaatgtcaacgattcgtcaactcagccaaaatgcgacgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaaatgcgacgattcgtcaactcagccaaatgtcaacgattcgtcaactcagccaaaatgcgacgattcgtcaactcagccaaaatgcgacgattcgtcaactcagccaaatgtcaacgattcgtcaactcaatgattcgtcaactcagccaa

SEQ ID NO: 1603 - DNA, 1083 bp, Heterodera glycines
tcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcagccaaaatgcgacgattcgtcaactcagccaaatgtcaacgattcgtcaactcagccaaaatgcgacgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaaatgcgacgattcgtcaactcagccaaatgtcaacgattcgtcaactcagccaaaatgcgacgattcgtcaactcagccaaatgtcaacgattcgtcaactcaatgattcgtcaactc

SEQ ID NO: 1604 - DNA, 1322 bp, Heterodera glycines
tcaacgattcgtcaactcaacgatacgtcaactcagccaaatgtcaacgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaaatgcgacgattcgtcaactcagccaaatgtcaacgattcgtcaactcagccaaaatgcgacgattcgtcaactcagccaaatgtcaacgattcgtcaactcaatgattcgtcaactcagccaaaatgcgacgattcgtcaactcagccaaatgtcaacgattcgtcaactcagccaaatgtcaacgattcgtcaactcagcaaaatgcgacgattcgtcaactcagccaaatgtcaacgattcgtcaactcagccaaaatgcgacgattcgtcaactcagccaaatgtcaacgattcctcaactcaatgattcgtcaactcagccaaaatgcgacgattcgtcaactcagccaaatgtcaacgattcgtcaactcaatgattcgtcaactcagccaaaatgcgacgattcgtcaactcagccaaatgtcaacgattcgtcaactcaatgattcgtcaactcatccaaaatgcgacgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcagccaaaatgcgacgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaaatgcgacgattcgtcaactcagtcaaatgtcaacgattcgtcaactcaatgattcgtcaactcagccaaatgtcaacgattcgtcaactcaatgattcgtcaactcag

SEQ ID NO: 1605 - DNA, 3636 bp, Heterodera glycines
tgaagctcccatttttttttttgcatttttcgcacattgaacaatcatcgcccaattttgtacactttttgtcacatttgatcaatcatcgtgcatattgaatgtttgatccactctaagtgccttaatccatttatccacacaaattattttcaaactatttgctgggtttattttttaaaagaggaatttggtgtccacttttccagtgtccaattttccatgtttttttcgaaacgaaatttcatcgcatgaaatgctcaagaacaacatttttacctgtcttcttttcaaacagagcgagtttttagcacaataagatacacatatattggaacttttggctcttaaaaaaatatttttgggttttggtaatttccggcacttattttgccgattttttaaaatgattttttttctataaaaaacttttctggcactcaaggttttggcactgcattatacatgtttaagatttttctgtcgtctcctataggcaccggtatttaaaaattaattaataattgttttaaagttaaatgcttaatttttatttttacttatgcctaaataaaaggcgcaatgaattgaaagtgccaatttataaatcacattcatattctagaattcattttttcatcatcttttgttgttgattttgttttttttcaatttttatatccattgcatttttcatatattttcaattaatccttcaaattcattaaaagtttgacatatttgtttcaatttcttttttcgatcccatttccccacatttctcgttttcgtaattcaagtcttcttcatttaccaaattaatctcccaaataccattgtcatttttaaataaaattaagttagaatgaatgtaaaatttaattaattttagcaattattgatttcttaaaaaaaaattcgttaatttttaaatttttttctattgggaaataaatttctgtcctttttctcaattttcattttctacttaaatttcatatttgtttattttttagttggacaaatttaagtaatttatttttaaggtttcatttaattaacaagtttataatttttctggtattgcgttatgaaatttgaaaggtttgttaaagaaggtgatcaaatttgataatgttcaatccatggatttgaaggctttttaggtcgtaggtagatgataaataatttatcgaactgaatgaataaaaaatttctaaaaaatatattttacaatttacactaaaaagttgaagaaatttttttaaagaaaataaaaaacccaattgcaaaaaaaaaatgggaaaattcaacagaacaattcttaatgaaaatgaattggaattaggaaacgacttgaacaagagcgcggattttgtgggcaatcaaaaaaattatgaaaatggcgaccaattgaaagtgtcaaatttgtcatcatattcatctttcagtgatcttctttctatataatcttttgcttttgtcaatgctttttccaatttctccttttcttcgttggcattttcttttgtcttttcgaaaattttttccattttcttctgaaattcttcccaaagattggcaaattcaatttcatttttgtttgatgatttttgtcctttttccttcacttttctgtccgttggtcctccgtttaaaatttcttttcccttttttacattttttagtataattttttcttttctattttttttccattttctaagccaattttggtctttttcttcattttctttctctttaatttcataatcctctaataaatattggcttcaccaatggtggcaattgttttttcgacaattctgggtttcttgcttaataaaatagaaacaaattaggtttttattttttaattttttatataaatacaaaaacttcagcataaatccgaaacaaatattcatataatatgtctaaatatttgcgatatttttcgcattctctccgtttatcttcttcagattcctccccaattttcacagtgccaattctttctggcgcgccaacgattcgtcaactcgacgattcgtcaactcagcaaaatgcgacgattcgtcaactcagccaaatgtcaacgattcgtcaactcagccaaatgtcaacgattcgtcaactcagcaaaatgcgacgattcgtcaactcagccaaatgtcaacgattcgtcaactcagccaaaatgcgacgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcagccaaaatgcgacgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaatgtcaacgattcgtcaactcaatgattcgtcaactcagccaaatgtcaacgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaatgtcaacgattcgtcaactcaatgattcgtcatctcaaccaaatgtcaacgaattcgtcaactc

SEQ ID NO: 1606 - DNA, 1035 bp, Heterodera glycines
aaatgtcaacgattccaaaatgcaacgattggtcaactcagccaaatgtcaacgatttcgtcaactcaatgattcgtcaactcagccaaatgtcaacgattcctcaatgcaacgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaaatgcgacgattcgtcaactcagccaaatgtcaacgattcgtcaactcaatgattcgtcaactcagccaaaatgcgacgattcgtcaactcagccaaatgtcaacgattcgtcaactcagccaaaatgcgacgattcgtcaactcagccaaatgtcaacgattcgtcaactcaatgattcgtcaactcagccaaaatgcgacgattcgtcaactcagccaaatgtcaacgattcctcaactcaatgattcgtcaactcagccaaaatgcgacgattcgtcaactcagccaaatgtcaacgattcgtcaactcagccaaatgtcaacgattcgtcaactcagcaaaatgcgacgattcgtcaactcagccaaatgtcaacgattcgtcaactcagccaaaatgcgacgattcgtcaactcagccaaatgtcaacgattcctcaactcaatgattcgtcaactcagccaaaatgcgacgattcgtcaactcagccaaatgtcaacgattcgtcaactcaatgattcgtcaactcagccaaaatgcgacgattcgtcaactcagccaaatgtcaacgataaggcaactcaatgattcgtcaactcagccaaatgtcaacga

SEQ ID NO: 1607 - DNA, 3855 bp, Heterodera glycines
ttcatattgtgtttgatccaagcattgcgcagtatgacccttccgagcagtacggtagcggcttagagaaggaggaattcgactacttccggggcaccagcccttttaagaggggctacggtgttcagcgagtcatgagggggtgccgctcaaggaggcgttggtcagtgagggaaagcgcggaattgacactgtgctggagaaaggcggcctgcccaaacagtttggaagcggaagaacgggtataaaaagaaagagagcacgtgtgcctggtcatcaaacaataattggacgaccagttgcaaagacagcaagaaaacgagttcgctcagacgcatttggactttactaaataatggcatttcacaaaatcgacactgactccgtgaactcaatcaccaatgctttggactttttccgtatacccccttcaaatgtgagcgtctcgtcttcaaaagtgtttgagcttctgcccagcaaccctctgaccgacacgccctaccacttcaaacttcactcaagccaaaatttcattgacctctccaaatgctatttgctcacagagtttcgaatccgtaaggaaaacgttaatggacaacttgttgacagtagttaaccttcccgacttgtcgtagctgcgcgaagttttcgcgcactgtcccgtgggtttaggggggatttgttttgaagcctaagggattaggggggtttcgcgcactgtcccgtgggtttaggggggatttgttttgaagcctaagggattaggggggtttcgcgcactaaccccagggtatagggggaggggtttcccgcactaacccaagggtatggagttctgtttgatggtgccgtgagtccccagggtttaggcagtttttctttgatggtaccgaatccagattctcgaatctacctgtcaatcattttttgattgacaggtgtgttgacactggtggtgattgaaaaaatgtgcggccggggcccgactttggccgcacttgtcgtaggggcttcccacattagtcctagggtttaggggggttttctttcggtttgtccgctcggaagtgggggttcgggagtcccgacctgtcaatcaaaaaaaggggctctcccgccccatcctaagggtatggggcggtttgttcacttttatgttgccgcccaatggcagattttgtagccggtaagccaaaaaaaaaggtttacgaggggggggggggatttttcttcgtggtgtcaaaatattggattccagacttgtcaatcatattttttgtttgaaaaatatttttaaaaaattagaaaaacgccatggatagagagaatgagcttaaagtgtgaaaattttggcgcattttgtgtggatattgaaatacaaaaaaaagtgtcctaaaaccatcagaacaacgccgaatcacgtctttttttatgtaaccgctttgtgatttatatatgtccaataaaaaaagcaacttgtcaatttttttttttgctgaataaatttcattgtgttaggaacagggaaataaaattattgatttctttcaatgtgcgacagcacgaatttcatcagaaataaatttaaataattaaaaattattttttaaatgagttctaatttaaattcaattatcgatctgagtaaaatgggcgaatgacgaaggaatttgtgtattaacttactttatttttttactttaaaatactaataaacataaatattctcaaaaaattgtctcaaatggtactacaaatgtttcattttttgtgtggtgtgggcccccttttattttatcctcatcccaataaagagcaatttaggcccgcaggtgttgtgagttggtcggagagagggaggtgtcaagagttagagggtgtttctttgcagggttgaaagggattaacacctgttaatcaatgatgtatatagaaagggggttagacccgcaccagtgaaacccaaaaacaaaaaaacaacgaaagattcgatttaaaaaataagaattgacatatggtggtgaaacctataccaaaattctcattttttctggcttcgacacaccaatccaaaaattttaaggttcaaaattgtcatgttttggtgaaaattaatgaacaattcacatagaaaatttccctcggcggagcccatagccgaacccctttgttgaccaaatgttttttgaaaaatcgcgaaaaaaagacatacgaattttaagtcaaattaataattgcacaaaaattttatgaagaaaaacattgtatttaatttatcttggaaaacatttttaattcggatgttctgaagaagccaaaaatcgagtattcgagttcagctcatctaaagcaaagggtctgggggctacgctatcaatcaaacacctatagtgtattctttattaaaattaaaaataatattcattgatatttaataataataatttccatttaaatttaattaattttacattattacacaatttgattttcactttcatgatgtcggatacgcgatttttgacatcacatcatgcaaattgaattgaaacagaattacatcattgttggatagggatcaaagatcactttcccatcattgttatcgactattctctctccccctttctctgtccaacactatttccattctctctctctgcctatctcctccacatttctctgaccccacgtctttataagtgcgtccattccctcactcatggctctccgctccattcattggcattggacatttatttattattttattctcctccgtcgctgcactcctccgacctcatcaatttgtgcatttatttttatttgtgtttattaataaattgttgatacacaacaattttggcgcagtcagcagcagcagataaattctgcacatcatcaagccaaatcaaggctaattctgcaaaatcttcaagccaaatcaaggcatattctgcacaacctccaagccaaatcaaggcataattcagcaagcctaattttggcatttcaaaagcctgagcggcttccatcggacatcaataaaaactgatcacctgggtggtgtaaagttccgctgggtgcggtttaatcaacaatcaaaatggacgcacaacaacttcagcaaattttggacgcggctctaaaaaaatcagcagaagtttttgccgccgcactcaacattcaaaatcaaaacccaaacccagggtcatccacaacggcatcacttgcggcatcaatcaatgcccgcctcgaaaaattcaattataatccggaggttggacagacatacgatgcttggttgaatcgatacggaaaaatcgttcaacaagacggcgcttcgctcccagagcagtccaaagtccaacttttggtcggaaaattagacgaggaggaatacaaacggtacattgacagcattgcccctaaagccaccgaacaattcaactggctcgaaaccgtggcaaatctgaaaaagatttttggtgagacgaggtcgctcttcctccaccgtttcgactgttttcaaattcgccaaagccaaaaccaagacctttcgagtcttttggcacaaatcaattcatcgtgtgaaaacgccgaattggatttgactaaagaagagctaaagtgcatgattctcatcatctctttacgcgacgaattttcggatttgaaacagcgatatctccagcgaatggaagaagcccgaaccaatgggaaaagcatcaccctacaggaattgggcgaagaatgcaaaaagtagaaaattttgaaggaaaacacattaacactcagcacaaaacaatcaacgccaatgccattcgtccaaaccacaaaaagttaaggacaagg

SEQ ID NO: 1608 - DNA, 6107 bp, Heterodera glycines
cacttacacctcatcactgttattgacttttcccctccccctttctctgtcttacattatttccattgtctccctctctgcctatctcctccacatttctctgaccccgcgtctttataagggtgcccattccctcactcatggctctccgctccattcattcgcattggacatttttattattttattctcctccgtcgctgcactcctccgacctcatcaatttgtgcatttatttttattggtgtttattaataaattgttgatacacaacaattttggcgcagtcagcagcagcagataaattctgcacatcatcaagccaaatcaaggctaattctgcaaaatcttcaagccaaatcaaggcatattctgcacaacctccaagccaaatcaaggcataattcagcaagcctaattttggcatttcaaaagcctgagcggcttccatcggacatcaataaaaactgatcacctgggtggtgtaagttccgctgggtgcggtttctcatcgacaaaaactgatcacctgggtggtgtaaagttccgctgggtgcggtttaatcaacaatcaaaatggacgcacaacaacttcagcaaattttggacgcggctctaaaaaaatcagcagaagtttttgccgccgcactcaacactcaaaatcaaaacccaaacccagggtcatccacaacggcatcacttgcggcatcaatcaatgtccgcctcgaaaaattcaattataatccagaggttggacagacttatgacgcttggctgaatcgatatggcaaaatcgttcaacaagacggcgcttcgctcccagagcagtccaaagtccaacttttggtcggaaaattagacgaggaggaatacaaacggtacgttgacagcattgcccctaaagccaccgaacaattcaactggctcgaaaccgtggcaaatctgaaaaagatttttggtgagacgaggtcgctcttcctccgccgtttcgactgttttcaaattcgccaaagccaaaaccaagacctttcgagtcttttggcacaaatcaattcatcgtgtgaaaacgccgaattggatttgaagaaagaagagctaaagtgcatgattctcatcatctctttacgcgacgaattttcggatttgaaacagcgatgtcttcagcgaatggaagaagcccgaaccaatgggaaaagcatcaccctacaggaattgggcgaagaatgcaaaaagtaccaaattttgaaggaaagcacattggcactcagcacaaaacagtacaatgccaatgccattcgtgccaagccacaacaagtaaaggacaaggcagacgcaacaaagcaatatgccaaaccaaaagcggttccaaaaccgtatgagagcaagcacaaattgccaaaccgtccatgccaatcatgcggaagcacaaatcattggcgctccgattgtgggcacagagatgccaaatgcccaaaatgtggtaaaatcggacatctcggcaaagtttgccgaagcaattcttcaattcgccacatccaaacggtgaatacaactgaaaggcatgcacaaatcaacacagtcatcatcgacttaaattgcatggaaatcaaagcagaccatccaaaatggtggaaaataccaatcaaagtgaatggcgcagattatccaatgcatgtcgattccggcgcacaaatcacattgttcacaatccaaacatggattcaaatgggcaaaccgcctttgacgtcagcaaatattcgcgtcaaaaattgcaatgaccaaacatttgcaattaatggacaattcatgtgcaaagtgcaatacatggatcgtccaccaatgaaattgttggcatatgtgagccccgaaatcagtcataatttattgggcatgccatggatagaagctttggaggtgatcccaaaagagattatgcatccaaatcttcatccaaaaatcaatacaatttcaacgaaaaccaacgaaatcaaagacacggagacattaatttcggcgctcaaatcaacccactccgatgtcttcagcccagaattaggtcattgcaccaaattcaaggccaatctcattctgaaaaacggtgcaaagcctatctattgcaaggcaagaccagttccacatggcgctttggacactgtaaatgccgaaattgatcgtctactgaaaatggaggcaataaaacccatcgaatttagccactgggccgctccaattttggcagtcaaaaagaggaatggcaaaacacgagtgtgtatcgatttttccatcgggattaaacgacgcacttgagctacaccgccacccactgccacgtccagaggacatttacaatgcaatcgcaggctctaaatatttctcacgcctcgatttgcgcgacgcttatctgcaattggaattgtctgatgagtctaaaaagctgtgtacaatcaacacacaccgcggactcttccaatgccagcgtttaccgttcggcgtaaaatcagcgcccgcaatttttcaaagtttgatggacaaaatcattacacccatcaatggcgcattcgtctatctcgatgatgtgatatcgccaacacgactctcgaccaacacgtcaaaacgattaccaaagttttcgacaaaatcaaacaattcggtctccgaattcaactggaaaaatgcagttttcttcaaaaagaaaccgttttccttggttacataatttctgaaaatggcatccgcccggacccatcaagagccgaggctattcgaaaaatgccagcgccgcacgacaagtcaactctacggtctttccttggagcgctcacatactacggcaaattcatcaaacaaatgcgcgaaataagaagcccattagatgaattgcttaaaaaggatgtaccgtggaattgggaagatgaacaacaaaaatccttcgagaaagccaaagaaattatgctttcggatttattgttaacgcatttcgaccccaaattgccaatcattgtggccgctgatgcttcaaaaggaggaattggtgcaacaatcagccatcaatttcccgacaaaagggaacgtgtcattgaacacgcatcatgcactttcacggctgcgcaacaaaattacagccaaatcgaaaaagaggctttaggattggtgtttgcggtacaaaaatttcaccgcatgctctacggcagaaaattcactctgttgaccgatcacaagcccctactggcaatcttcggatcaacaaaaggcattccaatatattcagccagccgacttcagcgctgggcgttaattttgtcaaattacgaatttgatattaaatacgtcaacacaaaggcattcggaaatgccgatgtactttcgaggctcatcgcaaattacccgaggccatcggaagacatactcatcgcaaacatctgcaacgacactgattgctgtgttaattttgtttttgaggcaaaaattgagcaacttccgatcaccgcgaaaataatagcggaggaaacagcaaaagacgaaattttgcaacaaattagcgctttcaccaaacaaggatggccacaaaagctgaacgacattaaattgtctccttttcttccaaaaaagggacaaatatccgaaatcgaaggatgtctcgcctacggtgaacgaattatcatcccttcgtcactccggaacaacatcctcaaatcattgcattttgcacatcccggcattgtgcgaatgaaagccattgccaggaaccacgtttactggcccggaatcgactccgaaatcgaacgagtggtcaagcaatgcgaggaatgtcactcagccgccaaaaatcctacaaaagcgaatcttcagccatggaaagcagcaagcgaagtttttgagcgaattcacattgatttcgccggcccatgtgctgacggccaaacatacctggtattggtcgatgcttactcaaaatggccagaagtatggcaaatggaaaggacttccagccaactcaccatctcaatgctaaaatcattcgtgcatcggctcggaattcccaaagaaattgtctccgacaatggaagccaatttcgatccgccgaatttgcacaattctgcaaagaattcggcataaagcacacctttacgccgccgttccacccaatgtcgaatggggcagctgaacggtttgtcgacatttttaaacgatcaatgaaaaagtgccgtcaagagggaaaagattggcttcaaaaagtgcttttggcgtatcgcacgacaccaaacacggcactcaacggccattcgccagacgaacttttcctaggacgccgcatgcgcacaagaatcgcacttgtccatccggaaaaacaaaaactccagccaccaaacttggaaaattttcaacaattccaagggcagtacatcaaaaagatggaaaaccaattcaacataaaacatggagcaaaatcagccattttccaaaatgaggaaccaatttatttttggaatttgaaatacaataaagccacttggcttccgggaaaaattatcgaaaaattaggcacatctccgacgtatcgcatcttggcaccgacgcttggccgagccattcatcgtcatgccaaccaaatcaggcgacgtttcccaattgaattggaggacaatgatcaagttgaagaaaatgatcagacacaggcacaaaatccgccgcactcgccgatcgcgcataaaccgcagacgaatcgccagcaaacgcccgccgctgagcccgtgcatttgcgccgatcaggaagagccaaacaagcacctcaacgactggacctggacccgtcaaagcctaaatacggcttaatccgatcatgaatcccaaatcgagggacattcgacttaaggagggaggtgttggatagggatcaaagatcactttcccatcattgttatcgactattctctctccccctttctctgtccaacactatttccattccctcactcaggctctccgctccattcattcgcattggacatttttattattttattctcctccgtcgctgcactcctccgacctcatcaatttgtgcatttatttttattggtgtttattaataaattgttgatacacaacaaattcaaattaaaaaaataaattaagttagaatttattacaaaaatgtaccttataaagaagtaagagaacatttattaatgaaaagggttataaataaaaataaaactaagctatatttgcttaaataagtttattaaattttttggtaaataagctttaaagaaaacatttatattttagatataaatgaagtcgaatagattaataaaaatggaaaaaagtaaaaaaaagaaaaatttgaatttgtttaaagggatgtattttttattttgtgagatcccgaattaatgggtgtattttacaaaatttttagcggttttacgccaaaattactatttttaccattttagtctcattaataaaaatcatcattttaataaatttatgaaaaatttaagtcgttggcaatcaaaatacataaaagaaacaaaaatttataaaaaaaaagtaaagcgaactgaatatacaaataataaaaatttaattaaaatatattaatacatatggaaatataaattaattcaatatcataaacttgcaattagcctgtcgtactttcgtgcattgggcttctattgctcttcgatgctctgtgcgctggtacatttttttttaaattttaatgaatttaaataaaaaatcaatttctttgaccaagattttaaaataataaattcaaccaaatgatgaaaatgaattaaccttgaatacacaaaatttttaaatacaataaaaaattttaaaaataaatatttatagataaagcaattaattgaaaaacgcagatttgtctaattatttacaaattttaactataacactaatgacgacatagttcatggtgtatttgaaaatgaatttatatatgccaaaaaaaattctttaaagataaaaaacataaccaaaaaataaactacctttttgaacgaaaggaataaacatttaaaatgtaggagaagctcacatacttcatggacaggatctcgggacatta

SEQ ID NO: 1609 - DNA, 1005 bp, Heterodera glycines
acaattccaagggcagtcatcaaaaagatggaaaaccattcaaacataaaacatggagcaaaatcagccattttccaaaatgaggaaccaatttattttttggaattgaaatacaataaagccacttggcttccgggaaaaattatcgaaaaattaggcacatctccgacgtatcgcattttggcaccgacgcttggccgagccattcatcgtcatgccaaccaaatcaggcgacgtttcccaattgaattggaggacaatgatcaagttgaagaaaatgatcagacacaggcacaaaatccgccgcactcgccgatcgcgcataaaccgcagacgaatcgccagcaaacgcccgccgctgagcccgtgcatttgcgccgatcaggaagagccaaacaagcacctcaacgactggacctggacccgtcaaagcctaaataccgcttaatccgatcatgaatcccaaatcgagggacattcgacttaaggagggaggtgttggatagggatcaaagatcactttcccatcattgttatcgactattctctctccccctttctctgtccaacactatttccattctctctctctgcctatctcctccacatttctctgaccccacgtctttataagtgcgtccattccctcactcatggctctccgctccattcattggcattggacatttatttattattttattctcctccgtcgctgcactcctccgacctcatcaatttgtgcatttatttttatttgtgtttattaataaattgttgatacacaacaatcatattcacaatttttcgtcgtatttacgattttctcccatcttataaaagatgatcctaaatacgatgagacgtcgtgaaatgatgggaattgaaacaaaattttacacgatatgacatcatatcggagatacgacgggaattgaaataggccccagggctatgatcttttgtccgagattttagaaaatgtacagaagaaatacgaaaaat

SEQ ID NO: 1610 - DNA, 2110 bp, Heterodera glycines
cgcctggcggcgcagctgtagcgtttcggtgctgcttcgtttaagttgagccatggtatggggagcattttaaaaaaaaatttggcgcgattcgacaagtctgaagggtcgaaatgggcgcgcgcccgagcccgttttgcgccatagacagttatctatatatataaaaacgagggggggccgatttcaaatcgctgtagtgggcttccggaagcccgtaaaaatattccgtaaagcccggggagtatatgagcttcgaaattttgaccccaggtaaaaatccggaaaatccggaaatgttccggaatccggattctgacttttcaaatccggaattccggaattttgagcccggatttggattccccgggtccgaattagcggggaaaaaatgtttgccagttttccgggcccccggaaccggtccgaaaatcaggaaaagtgctttggcattttccggaagcccacctgacacttttcggggccccaaaagtgcctgatccggaacccgcaccggtccggtcaagaacaactttttgctcagtttttcaagggctttctccctggtcgggtccgggctccgctccctgtctttggcacccgtcctgggcccggcaccccggccgcagggcccccagccgcgccccccggcctctgtcgatggtcaacgcaggcggagcgtgtcggtgccagcggcttatttgtgcagctcgaccagctctacgcaacggtgtcgaaggcgtccggctgcgactgctacgagcggagaaaattggcgagaaaggagcgagaaattttgaaaatttgaaaattaaaaaatttgggggtgccacagtttccgcagcacattggcgttaagcgggcggcattagcataaatttaagcaaatttaattagattttgaccgcggcgcatgtttgcgcagggccttgggacggagctgggcactaatatttttgaaaatttgggccccggaccggttttcccagttccgtgaccgggaccctgacggggcctaagtaagctgatttagcatcagtttttaatgctctttccattaaaaaaaagcttattaataaatattaaatataaaaaaggttattgataaatttcgaaaattttgatttttcaataatgagccgaaattttgaatcgattttttgagtcctttctttcttctgtgctatttgcttttattgcattttttaatagcaaattctttgctctttcgattgactattttaaatccgggattcgttctcggggtaacaaattaaaaacttgggcacagtgaaaattatttttttgcagcattttggggtgtcgggaccggccgaactgcctgatcccgaatccggaacctgtttttggttccggattcgggatcagcgacctcgaaaaccccaaaaaagatgttttccggaagattttgagtacaaaatttgaaatctgaatactcaaaaggggggtggtatccattggggaaatcccaaaatggcatccggtaccgtagcttggctccggaaaccggtaaatttatggaaaaatatgatgattgtagagaatttttttctctattttatcagctttatcccgaatccgaacccctagattaagccgagaaataaatttttgaaaaatttttcggattttcgactttgcccctaaaaaaatcatttttgcctattatgagcgaactttttttagtgaatttcaccggaaatgcccatttattttaaaatttatttttaatgataaaaaaatcatttttgcctattatgagcgaacttttttttagtgaatttcaccggaaatgtccatttatttttaaaatttatttttaatgataaaaaaatcatttttgcctattatgagcgaacttttttttagtgaatttcaccggaaatgcccatttatttttaaaatttttttttaatgataaaaaaatcatttttgcctattatgagcgaactttttcttactgaattttaccggaaatgccaatttatttttaaattttttttaatgataaaaaaaatcatttttgcctattatgaaagaacttttttcttactgaattttaccggaaatgcctaaggagttttaaatt

SEQ ID NO: 1611 - DNA, 3713 bp, Heterodera glycines
tgctagggagtcaaaatttttttccccgcacgtctgctgacctgtaaggcttggaaaaaaaattgccgtctctcgccgggcgctttgcgctgagatataacttttcactctccaggccccgcccaacacctcccccgatggctaagtgttggacgggccaaacaaatgtcagaatcgtgttccccaccccaaattacccccggatactgattttcagaccattcggatgaatatgaaaatttcgattttgcttatcatcatatagaaaaaaatggggggggctcactgcaaatgtggtcgggacattgcgaattctgcacctatcgacccaattctttttgcgttagccaactgatctcccgctacaactttctaaccaggccaaagacaacaaaaaaatttgggaactgagatatgctaacttttttttgctaacttttcgaaaatcggctcatagcgcctggcggcgcagctgtagcgtttcggtgctgcttgcgaaaagttgagccatggtatggggagcattttaaaaaaaaatttggcgcgattcgacaagtctgaagggtcgaaatgggcgcgcgcccgagcccgttttgcgccatagacagcaatcttttgaaccatcaatgctagggagtcaaaatttttttccccgcacgtctgctgacctgtaaggcttggaaaaaaaattgccgtctctcgccgggcgctttgcgctgagatataacttttcactctccaggccccgcccaacacctcccccgatggctaagtgttggacgggccaaacaaatgtcagaatcgtgttccccaccccaaattacccccggatactgattttcagaccattcggatgaatatgaaaatttcgattttgcttatcatcatatagaaaaaaatggggggggctcactgcaaatgtggtcgggacattgcgaattctgcacctatcgacccaattctttttgcgttagccaactgatctcccgctacaactttctaaccaggccaaagacaacaaaaaaatttgggaactgagatatgctaacttttttttgctaacttttcgaaaatcggctcatagcgcctggcggcgcagctgtagcgtttcggtgctgcttgcgaaaagttgagccatggtatggggagcattttaaaaaaaaatttggcgcgattcgacaagtctgaagggtcgaaatgggcgcgcgcccgagcccgttttgcgccatagacagcaatcttttgaaccatcaatgctagggagtcaaaatttttttccccgcacgtctgctgacctgtaaggcttggaaaaaaaattgccgtctctcgccgggcgctttgcgctgagatataacttttcactctccaggccccgcccaacacctcccccgatggctaagtgttggacgggccaaacaaatgtcagaatcgtgttccccacccataaaggaacaaattttttttttttggtctgctggccaaaaattttttttggctgggaaattgaaattttggattttggttggtttttaaaaacagaatgttctaaataatgaaatgatcgatcatatttttttgttgtagtccttttattttgattactatatcttctttaggcaatgtgaggttgctctttgtcagtatgctattggattctctctatcttggttcgttcaaaagatatgtttcttgcgttcaagttggtttttgtcggaacttctcatactattttttcaataactcgtgaatgcgtaaatgaatttttggtaaaatagacctaaaatgtttgcatttttcatctctttcaagagactatgtgtgcattacgctgcgttttgtttaaatgatgtttgggtgaaaagtctaagagataaagttttttagttgcaaaattaacttatggttagagatgccatcggaaactattaaagacatgataatttttttatttatttttcataattatactacagggacattaacttatttcctgccagaggctttttttccttacgagcctttggtctaatttttggtaccttgaatttttggtcactttttgttctcggacctatatctcgaaaactgcagtcctaccttatatttttgaatggcctattttgaagcccttttcgagctctttcgatacatatatgtattgcttaagaaaatatttctctaaatgctttttaaaataaaaagaaattacaacgaattaaagcattttttgaaagaaatgttaaaatatgtatatctgcggaaatttacatttaaaaccgattattaaaaatttcgtctgttgtttattatcaatattggtttgctctatcagaatatgccaataattttattctatcttttatataaaaaaagatttgggtatttgaatagaaaattcacggaattgagactgtgatgttgaattgaaataacttttgtttaaacaaagatattatttttattaatagataaaaattattagttttagttatagatattttaaagagtggtaggtttggtcttcatagccttgcaaaaattggtagagctttagctgagatatttattggcttccactggccatttgataattttttttattggcatgcactggccattagacaattttcttttattggcttccactggccattagactattttcttttattggcttccactggccattagacaattttcttttattggcttccactggccattagactattttcttttattggcttccactgaccatttgataattttcaaatgttgcaccggtgatacgcatgttctagtagctgctattgcacagccagcagagcctttgcactgatgccacgcatgcccattcgccaagccctcgggttccaaactgctcacgggtgccacgcatgcccattcgccaagccctcgggttcccactgctcacggcgtgacaagcatgttccggtacacgcatgcccattcgccaagccctcgttttccaactgctcacgggtgccacccatgcccattcgccaagccctcgggttccaactggtcacgggtgccacgcatgcccattcgccaagccctcgggttccaactgttcacgggtgccacgcatgcccattcgccaagccctcgggttccaactgttcacgggtgccacgcatgcccattcgccaagccctcgggttccaactgagcacggatgccacgcatgcccattcgccaagccctcgggttccaactgttcacgggtgccacgcatgcccattcgcaaagccctcgggttccaactgttcacggatgccatgcatgcccattcgccaagccctcgggttccaactgctgcaagggtgccacgcatgcccattcgccaagccctcgggttccaactgctaacaggtgccacgcatgaccattcgccaagccctcgggttccaactgctcacgggtgccacgcatgcccattcgccaagccctcgggttccaatgctgcacgcgcgccacgcatgcccattcaactgagcacgggtgccacgcgcatgtgccggtagctgctgctgcacgaacatccagacacgcatctttcggtagctgctactgcactaacaacctggacggtgcacaccttacgcatctacacctcgaacggctagggcgcggctggctaaactgaaccgcgcatgccctcggagccggctagtgtgctatatatataa

SEQ ID NO: 1612 - DNA, 2562 bp, Heterodera glycines
gttcacatttttaggcaaaagtctatttttttcctgagctccccgtggcctgaaaagcacgaaaaaaatgtttttttgggctgttgttaagctacttttcgagttattagtgcctattttctaggcttttatttttagcgcctaaaaatttttgaaagagcctatttttgcctattttggcgttttgcccaaaatttgttaacaaaaatgcaataaaacgaaaatatttatatttacatagaataaaggaatctcggaaaatgaatccgggaaatgcacatttatgctcatttttcgtcaacgggagaaattggagcgaaaatccgtcgaaaattcgatgctgtcatcgcaaaaaacccgggctttgatacaatttttgatattggaaaaattctttctggtcaaaaaatctatttcgatatgcctcccaatctgatttctctttacaaatacgctccattgacttcatgtgatgtcgaacgatcttttttcaatttacaaatctattttaactgacaatcgctcatgtctatctcccaaacatcttgaaatgctacttatttgcaatgtgaatttcaataatgatttggttaatattgtttactttttggataaaattttacgattttacacccctaaatttgaggatttttagtgcctattttccatttttttattgcctattttgggggttttttagagcctaaagcctacctattttggcggtttttagtgcctataaatgtgagccctatatattaccatgcaaagtttcaccagctggtttaaagtttaaaaaaggtaaatttttaaaaaattaacacaattaaaatttttttgaatttggtagactatttaaagttgccaaatatacatataaaaaaaaatgcacataaatttttctaaattgagggtaattatccaaagtttcttcaaattcgtaaataagagttaaaaatctcgaaaatagctaattttacatgaaaaaaatacaaaataagctaaatttttaattttgaagaaaatttattaaaaagtaaaacttttcctttgaggactttttttcttaaatttctaatttttcattttcgaaaaataaaaaatttagttttttgaaaatttttggtccaattcggtcaaaaaggctgcttaatagagtgtgccatttaaataaaggatttttttagaaaatgccgaaatatccacttaaatcacgaaatatgcattcaaaaattcatgtattgtaaatttcgtcctataaggttcaaactaaattaaaaacattttttttgcccatttcatgggtattatggcgaaaagttataagcaataaattttctaaaaactctttttttgagtttttttctgccaataatttttttgaaaatgcacaaaattttttttgaaattttgaaggctaacagagagcatttagggttaccgaatgataacaaaaaattaaaatttggttacgctttttcatgggttttcagttttggctttccatagttcatgaaaaaatatgcatatgcatatactttcgacgtggtgcgacttttggggatatgcaacttggggaccgacatttggggacccgacttttgggacccgacacttagggaatccgacattttgggatggggatcgaacgtcttttggggatcagacatttggggaactcgacatttggggaccccgactttggggattttattaaaataaaaaaatatttaaaattttaattttatgtccaaacttagacaagtttatgtccgctttagtcagagttaattccctttgcaagaaaaaacaaaataatatttttaaaattaactctaattccggactctaagaaacagaaaatatgacctcggcattttgttgctgtacgcaattagacagtaaagtcgcctttaactttttgaatgcccttgatgaatttctgttcccgttggcccttgggaaaggcgttttaaataaaaaatggaaagggtttactgtaaatactaaaatgtattgtgatttgtctattgtgttgtggttagtatgggctcaaaattctgctaccgccacgcggtgagtccgaaaacagagttatttagaaaatattattttatttttcttgcaatggaattaactctggctaaagcagtcgtaaatttgtctaatttgagatagtcggatccccaaaagacgttcgatccccaaatgtcgggtccccaaatgtcgggttccctaagtgtcgggtccccaaaagtcgggtccccaaatgtcgggttccctaagtgtcgggtccccaaaagtcgggtccccaaatgtcgggttccctaagtggccggtccccaaaagtcgggtccccaaatgtcgggtccccaaatgtcgggttccctaagtgtcgggtccccaaatgtcgggtccccaaatgtcgggtccccaagttgcaaatccccaaaagtgggtccactgcgtttcggcgctcccgtttcggcgctcgcgtttcggcgcttcgcgtttcggtgatcgcgtttcggagatctcgtttcggcgctgccgtttcggcgc

SEQ ID NO: 1613 - DNA, 2838 bp, Heterodera glycines
tttactatataattattaattgccaagaataattaatataataataaatctacttgaatggacgaatttgagtttttgttccttcgaatcattatgggaacaacggaattcatctaaaatatttgtataatcgtatttgtaaaagatatatatttctatgttcgagttttatgtcatatttatatttcattttcctatgcctaaacgtaaataattacaatgattgcaaaatcaattttattttaaataaaaaactaaatttacttgaaactcccaattcatttttccatttgtaaatgctgtaccgagtgacgcccaatccttttgcaattgcatgttcgactttactagatgtatttattttttcatcctttttgaattcggtcttcattttatgaaattgatggacgagttttagtttttcttcattcgaataattatgggaattacgtacacctaaaataattatataatcatatttattaaaaatgtatattcctatgccaaaataataataaactaaatttagtataattgatattgcatctacctaaaataataaaactgtttttttaatattattaattgccaaaaaaatcataatttttttcaatttataaacgaaaagggctttgaatacccaaatcttttgatgttgttttttttttgattttactaatattttttaaatttttgaattcattcattttttgaaattgttccacttaaatcaggaattggatcgaaatttttcaaaatcagaatatcgtgcccaaaaaataagattttggcgttttggggaagaaataagcacttcatatatttgagtgcaatagggctcaaaaaatcagagaaattatggcccggccccagaaataacgcttttgtgggtcctgcggtgccaacagacgcatgccgaaaaattttgaaattttgtctagtttaataacagatttttgcccaaaatggacaaaaaaaactataaatttaaatcttaacattttaatttcactgatttggacccacaaaaatcagaacatttctgagaaatcagaacagacccaatccctgcactaattctattttttgttttctttgaataaatacgataaatttcattttattttttattaaatttttatatctaaataatataaaattaaatttacttgaaagtcccaattcttttttccatttgtaaatgttgtgccgactgacgtccaaatccttcgcaatttcttcttcgattttattgtatgtcttcttgtcacaattcttaatttcactccttctttcatggaatttattaattagttcttgtttttgttcattcgaataaatttttgtccctaaaattatttaatttctttcttcttaataaataaataaataattaatttaattaattatggtttgaatatgattatagaatttacttttctcaactacccccccccgcccaattaatttttggacttatttttagagccaattcttaccaatacttattttcaacaccaatcccgggatgaaaagaaattttttgaatcaccggaaggaccgggattatggacaaaaaaagaatacaacatttatggaataatccccggtaaaaatcccaatcctttgcaatcctaatagctctaaaaaatgccctgaaaaaattgcatttaattatttcaatttacaatttgccgttcctgtttcattggattcaattaatgggttcttttcttcaaaatttaacggtgtttgatttggttgctcatcagcagatggagaaccctaaaattgtcttcaaatgttttacaattttgtgcaatacctcattaaaattgtcatttggcactgattgtgcataaaataaaatgaaacaataagaaaaaataaataatttgaatttcattcttaaacaaaaatttaattttttgttgcagaatttctttaataaaaaaaaataaatatattttttaataaaataaaatttaatttaataaaatttttttagtttttcctgaattcattgcaaaaaataaaatatatataataaaaatgtacaattagataatatatttattcgaaaaaataacaaaaaaatatattaaagctaatccaattttgtccaataaatcgacaacgtcaatattttgtttgtatagggagtcaaattttttcatttttcattagcgattcgatttttatttaaaaaaatctgcaatagaagtgacaaatgtatgtaaattaactttaaaaatatttttaaaaaggccaaatttcgtcggcaaatttttacattttccatttttcacacctaggtaaaaattattccaattttttctcaaaatatttcattttgcataattaatttaaatataaatattttttaaacaatttctaattaataatttattaattttggttttatttaatttttattttcacataaaagtttaatttaaatttttaatttgcctataaatttttatgagacttcatttcttttattagtcgaatttcttctttatgattatggattatgaattttttctttaaaaattatattactaaatcctttattttatttgtttaatttttcacaaaaaaaaaatttcgtgactaattaaatatgaatttcaaaaaacgtaaatatgtttaaatattttgcaataacaatcaaattgtttatttccacaagcgaacacataacacaaatgtgaaaaaagcgggcggaaagcgagggcgacaacgacgacgacatcaaaaaattggggaaaattttaaataaattttgaaaattttttttcatttttttggcggcatcaaattcatcatgttcag

SEQ ID NO: 1614 - DNA, 4031 bp, Heterodera glycines
  misc_feature (3849)..(3849): n is a, c, g, or t
gagaggtgttttttctctggcactctccctttattggttcatctctcgttttttgaaacgctgtctaagtgtataaatatgcaaaaatttgcagtcaatgcatcattattttcttcacttacaaattctgccttctgtgactgttgttcgcctcccctttgctcatctgtgacgacgacacttcgtgaacgaacatgacggacactgcaaatcgacagcaacgaagccgaggacgaggcgggagacgtccacgagcggtaagacagttagccggagaacacaattctgacatccatttctaacccctgacccggattcgaacaaaaacgcaaaatttcaattttcgacaaaattaaaattatgcaacaaaatgcacgagataaaacggagaacatgtttctgaacgcaagacatagtgtatttcaggcatatttgaactgtttttgttgcatgacttgaattttgccgaaaactgaattttcgagattgtttgagtccgagttagggattcgaaatggacttcatacagcgcccccgaaaacccccctaaagcatcacaaagccgctcattccttttttcctcttttatgggaccacttaaacttatgattaccaaaatttgacataaattttagtcaattttcagcatctgcgcgacagtgccaagaaaatcaccaaagcgtccattcttcgtctggcccgacgtgccggtgtcgcccgaatcaacgcaaaagtctacgacgaggtccgtgccgcgttgcgctcgtacttggaaaccatcattcgagacgcgccaaattttctgttccatcagggaattgaaccgaagagacaaataaagaaagtaaaaaggtttagccacttgaccacttatgatatgaacacatgctaaaaatgaaaataaataatttaatttatttttatcaaaaatttctgatccctcaccaattcccttctcttttctcacccagacccccattcttaccagtgcttatttagtcccgccgggaccgggactggcaaaaccgggaccgggatttctgtttttccaaaaaccgggaccgggatttctgtttttccaaaaaccgggaccgggacctgaaaaaaccgggatttcccgccccggtcccggtcagctcaactctacttaaaagaaataaattaataaaaaatagatataagaagcatataaaaatattttattaataaaaaagtaaataattagcttttaaatgtgattttaaacattttatatacaattagaattaattttaataatttttggaatttaatatgaatgataaaaataatttttacaaagctttgtcattataagaaacatattaaaatatttttcctattaattgttatattaaaaaaattttacctattaattgttattttaaatattttttgcatatagattaattatttttaataaagaaaattaaaaaacattaattgtaatattaattattaccaaaaatgtaccataatttattatttttacccagttgcaatgctgcgttttcctggacgaaagcctgtccgaccaacagccatgcttcgctttccgggtcgaaaaccaactcggcctgaaaaagtttttaaaattatttttttaaaattttattttaatttattgcctaatgcggctgttcgtttgcccattgcagattctcgaaggccaatctcggcaagatcattttcctgctcatttccagtctcgggcagaagactaaaaataataataataatttttaaaaattgtttaaaattttttaataaataattaatttgataaaatgaaaatgattaatgtttgaaaaatgtacatattaaaatgcactcattttatttaatttatttataattttcgattattgttttttgaaatttattcaaaattccaattaattttttgctactgttaattttgaccgttcctttattgttatatcaatatcgtactgagagatttaaaaagcattaataaaaaaaatttcatatttgtattgttttttaaataattaagtaatgtaattttattattataattaattatataattaattaaaggtactttttatcgttaattaaaaatgaattaattaatgggaatatttttcgttaattggttaattaattatttccattaccgaaaattgatgtgacggacgacattgggcttggcttgaattggcacattgtattccacttcagacggtgccaaaccatatgacggctgtttttcactgagcagcaacaaatcatagcgtctgttttgccgatcgtgtgcataagcaccggagacgggaaaggaccaacgttttcctaattttcattttttaaattttttaaaaattaaaaaaaaaatttaccaggccgaaatgacagacggccaagcgtcattgaacgcttttcaaagccgggctccacttcatattccgtctaaagcattttaatcatataactggtcgcatttgatttgtataccctaaaaatctaaggtagaaccctttttttttagtatacggtacattatacaaacgcttggcaacactatttttctttggtatttgcaaatacaatgtaatatttggcaagttactgtaccctgattcatatataactgtatataaaaaaatgaatactaaagtttgacaactctatttttctgtggtcttcttaactaatacaatatacgaattgacaagctacagtaccgtattgaaataaatgttatactaatgtctaaacaatacaatttttctttgctttttgcaaataaaatatgataattgacaagttactgtatacggatttatgtattatttgtatataaataaataaaccattttaacttgatctacatgactaactgcaccctgacttatattattgtgtagaacaatgactaattctttttaatcatactgtacctcccgctgttttttctatttaaatgaataacaaaaatttgtactcagactaggcacctacagtacctcctcctgttgtccgtcatatgaaatgctgcgtgtcggacgaaaaatgccaaggcgtgccccgttgcccgtggcaatggaggccaatgatacggtattagccaagccagaaatcagcagcaatacagcggcgccagttggtgaacagcaagcggggccaagaaagctccgaattgccattttcatgctagggaatggagctagagaaactaaaatcaaaataaaaaaaaaatttttctataaaatgatagttaatatttttaattaaggcaagtgaaaaattgttaaataatgaaaaagacatttcattttatttgggttcatttaatttaattggttatttaaaattttgtaatattaaaaactatttaaatgaaataaaaagaaaagaaaatttaattgttattatttgattattttaattaatttaatttttaaaagaaaattcattttaatgtttttaagttttttgaattaaaaagataaaggaaggaagttcaaaaaatgtgtgttttttatgatgataacctatgaattaacgcaaaaaaaaattgcatgtttcttcccaaattcaccgttgccagggcgctgaaataagtcataaaaatgtaaaaaaaaaaacacagaaaattggaaattttatcaaaaaagaatttttatcccaaaaaataaagttaaaaaaaaatatttatttaaattgatggaccaagaacctgttgaattctcatgtatattaatcaaaatttgtcctcaatctaatggcttaaaaaattagtaaagaccgacttattgaaaaaagcctgagcctggacctggaattccatgttagacctggacctgnatttcctggacaaaaagcgaggtccagaaaaaaatcctggctctttgaggcctggatccaggcctgggcctaggttttttaataatgcttaggaacatctaatatctaatttacaaaaataatatgtttttttcatatatctaatcattattttataactaaaagactaggattagttagct

SEQ ID NO: 1615 - DNA, 3401 bp, Heterodera glycines
  misc_feature (21)..(22): n is a, c, g, or t
  misc_feature (26)..(26): n is a, c, g, or t
  misc_feature (1121)..(1121): n is a, c, g, or t
  misc_feature (3115)..(3115): n is a, c, g, or t
  misc_feature (3121)..(3121): n is a, c, g, or t
  misc_feature (3151)..(3151): n is a, c, g, or t
  misc_feature (3203)..(3203): n is a, c, g, or t
  misc_feature (3228)..(3228): n is a, c, g, or t
gcaaactatttagccaaattnntatntgggtgagtttgtcagataaatggaaaattttttgaaatatttttttcgtcattgtatttcatattccggaagtgttgttgaacactggcgtcataataagtaaaaaaaatgtcacgctttacatattatgacaaaaaatatatttaatgttttaaaaaatattatttaattcgttaaaatgatttttttttttgaatgtctgtctacaattatatttagcatgacgcaatcttttaaaataaaagaaaataaataatataattattcatttatttaagaatttcgcactttacataagagttattaaaaaaaacaatattcctaattagagggtaataaatcatctaaaactttccaaatttcctattaataaaaccttcttaagcttttcatattatgttttcgaattaaacgttaatgaatgaattctttaattcgatataaaaaattctgaataacaaattaacttttcaccaatacagttaattataattaattcattaattgggtcatttgaatatcatttgtgcattccgaaaaagcaagcgcattctttgccactctgaagacatgctccgcctgggcaaccaatactgtcacaagcaccggccttctcattaaatatgcattgcccatttgccaccatcatgaaaagcatgcccataccaattaaaatgtgcaaaatcatcattaagacgctgtacaatgacaaattcttcattttaatatcctttaaaaaatcaaaattattgctttttaaattggacaattgagcgccatagtcatttttatttattaaataaataaattttgcctacgaatttttgggaaaatttttcatttcttaggggtatatttttttaaattttttgggatcgattcttaggggtgtatttttcgtttttttttgctttggaatttcaagaaaaaggtcaaaataggtacaaaaagtgcgaaaacgccaaaataggtgctaacccctcatcttaggtgtctatggtcattacttttggaaaactaaatttaagctaacttatagcgatcatgaaaaggtatttttctgtaagcatcgggcatttttaaatatttttccnaattctaactgaaagcgatcaattattgttaattctgggcattgatgcataaaaaacaatttcattttatgagattaagatgaataaaatgaaattcaaaggggctaaatccacttttatattttccgaattgccgtttttatttttaatttttaaatattaatttttgctttaattattcctgtccatccctttccctcataatatttgtttattgcatcattttttttaatagtttttacacatattaatcccttagtatttatttgtttttattaatttaaaccattatttcttctatttatttctttccatttttttgcaaatttgaaattctatacaaaacccatttaaatataaaatctttcattattaatttacaatttttttttctaaattttatataaagttgagaattataaaatatatgggccggttattaatgtaaatttgtttttaaaaaatatatacattagcagtgtattcatcgccagagctgtataaaaattttctgtggttatggatttattgattcagaaataggcgtatttcaatttgccaacaaataacggatgatttgctttattaattggttttattttttcattaatatcattattatgagcatgaataatattataaaaatatattaaaaaaattcaaaactaatttttataatttaagatgaaatataatttttattttttcttatatttttgcgttttgttttatgcactatcagtgccagatgaaacttttaatgaggtttgaaagcaacttttagaaaatgaagacatttacaaaattttaggattcacaatctgctgggccatcaaaacaaacaccgaaaaactctgaaaagaagccactaattgaatccaatgaaacaggagcggcaaattgtaaagaaaaaaataaaggttaattagtctagcagccatagtccggttaagtgttcggtttttaaaaaacaaatcctcccgacttttcattatcccaataggatattggtgaaaacaaaattggtaagaatgaggtcgaacaaaggaaggtcgctaggttccatggagtttcgaatcaaatggggttgaagtgggggggggggggtagagctcacccccccccccctctcttcagatgctttcaatgcctcggctaacgaatggcgcctcgggcgtgccctctccctcgccatgttcgcctccctcgccctcatccgccgcttcctccactctctccgccatctctgcccgttctctccccgcacttttcctcggctctctctgtctctctgccgccctcctctcaatgctcattgtcctccgcccttccgctcgtgctttttcggtgctttcctttccaaacttttatttttaaatgaatttactcatttacgtctttaagcgaattaagcgatggatgaagcgaaagaaaggaaacgaatggaaagcgaagcgaattggggggaaaacggaggacggacggagggaaagcgaaggaaaagcgaagggaacggcggagggatgagcaaagccaatcagtgatattgagacaaatgcaaaagcaattattgtgatttaatatttattaattcatagaatgaaaaaaacaatcgtagccaccgaagggaaaaaaagcattgctgcggcgttttgtgctgtctttgccgaaccgttgcacaaattgccttcgcacgtgcatacctccaattcccctaatttatatattctaattatgtgattaattaatagcttttccgcttcacctttgctgcttttgatgtgcgtacagtccgcccttaggcgtccctccgcgtttttggcacaccatcgccacacgtgcccatctccgccttaaacaatgaaattcaatgtgagtgaacttatgaactatttcaattttatttgagttacctttttggtggtcgcgaaaccaaagtttgaggcaaattccatcggaacacaactgactacgaacgcggttgacgaagtgcncgaaancggtctaagaatttacaaattcagaactcnagtcgggaggacaccgcccatttggacaagaaggtatcgccgcgccggaatnttatgggatcgaaacccattattanatggttgaagcgatcagttcgagagttatcggctgagagttctctctccaacttctctccaattacctcaaagggatcggaccatttcgccgttctcggcactgtgcgcacttgctccagccaattgtgcccatttgggtcgtgcacttctgccatcagccgaacgggcgtcg

SEQ ID NO: 1616 - DNA, 1344 bp, Heterodera glycines
gcatgcgaaaagtaaaaagaaatctttcaattgctaaacgatggcatgtggcataatgggtacgcgtccgactacatttttcctagcctggttcaattccacgctatgcaaattatttttcccgttttatttttgcattttacgcaaataaattgccaaggaatctagcaaatttagttccgaaactccacggacagctactagggaccttcctttgtaagcaaaaaataatgcgggatattgggaaaagtaaaactatttacaatgagaaaatataaaataattaattatatcataataaccagggaacggatttttacgctttcaccttttttctttttgcgaatagcatatggtgagataagcgcataaaacacattttcttcgaacaattttcgatataaagcgactttttaacaactattttaacatttttgcttatgaacaaaaaactttttatcaattaggaaaaatgcattaaaaataaataaaaatgcacccctgagaatcgtttttttttcaaaaatacgcccctaagaatcaaattttcaaaaaaatttattataaatacatccctagcgatcgagttttcaaaaagcaaaaatactggccatgattttggcggacttaaaaatgtttgatttataattattcaaccgaaatggataatgaatgaatgaattttggaaaattcacacatttattgacatgtttttccaatatggttggcaactttttagcaactattttgccattttaaattctataattatattcaaaccataattaattaaattaattatttatttatttattaagaagaaagaaattaaataattttagggacaaaaatttattcgaatgaacaaaaacaagaactaattaataaattccatgaaagaaggagtgaaattaagaattgtgacaagaagacatacaataaaatcgaagaagaaattgcgaaggatttggacgtcagtcggcaaaacatttataaatggaaaaaagaattgggaatttcaagtaaatttaattttatattatttagatataaaaatttaataaaaaataaaatgaaatttatcgtatttattcaaagaaaacaaaaaatagaattagtgcagggattgggtctgttctgatttctcagaaatgttctgatttttgtgggtccaaatcagtgaaattaaaatgttaagatttaaatttatagtttttttttgtccattttgggcaaaaatctgttattaaactagacaaaatttcaaaatttttcggcatgcgtctgttggcaccgcaggaccaacgaaagcgtttatttctgtggccgggccatatctctct

SEQ ID NO: 1617 - DNA, 12016 bp, Heterodera glycines
  misc_feature (11897)..(11897): n is a, c, g, or t
  misc_feature (11941)..(11941): n is a, c, g, or t
  misc_feature (11994)..(11994): n is a, c, g, or t
attataataataaaatcttttagccaatgttgagtgcgcatccgatgccgcctgttcagacgggggcgggggtattggaggtaatgggcgaataaaatattgataataaataaataaataaaaatgcatttcaggtcactgttcctgtgcagcttggatcaccaaggtcacgcgacaccgatgctggcgacatcgacatcaatgtaagaaaaaactttattaaactaaataattctttacatttaaatataattcatgattttaggccaatgaagtcgttgagcggggccagacctcacgtgagcgactgcctcagcgacgtgccgcgcaacgggttggtttgcgggtccgattcaatttgtccccagaagtagaagagatcccgagaggggaaagacaaaaaccctatcccgcccgtaaaattaggttgcttcccaattttgacatttcacccattcacattgaaaaatcccttgactgcccaatttgcatgtgcctttttgtgattggggatggggccacttctcttcattgctttcatatttttcacacgggttgtattgttccttggcttaggatccaccgaatttgtccaacttgtaaatattttttgccatgaataaatttttgacttaattaaaggcagggagaccgattgaagaatgctttgtgattgagcggacaacggcaatgcgcaacgcgccacgtaacacccgaggcgaaatttgtgagctgcgctttctgccgctggaggatgctgagcggcctgaccttttgatggaggcgctaatccaacatctgctggatcgagtgctagagggtcagccgcgcccgtccctgattggcctgcaattccacccgccgggctttgatcgcccttatgtcatccgtcttcgaccacctgagcagaacaacgctgcgacactggcggcagcgattgagcgactaaacgaacagtcggcagcgggcattgatttgttggcgggaaggacgatcaccaaagtgctggctgtgtggccccttgaagcaattcgcgcggacccacagagcggaggtgagctgtccgtttattaaatgatgcgttgtttatgacgaaaacgcaggcgcatgcgaccatgccgcggaacaccacgtctcgcataaagtgcagtcgctgatccgcgtcatcaaccctgacgacaggctttgcctggcgcgtgccgtccttctgggtctgagagaccgagagacgagaatggccggtggcggtggccgtgcagcactttcggcgtacgccattcgtcaagaccaacacggcgcggatgctgctgatctactgaccaatgccggcgtcgccctcaacaaacacacgtacacgcttgatgacgtacgacaacttcaacaatggctaaacaatcagcatggagtggggcaaattcggctcgtggtgttcgagaaagagcaggagtaccggatagtgttcaaaggcgatgggtatgttaattattttttagtggattagtcaatgatatattgaagaattgccgcccgcttcatctctgcattttgttggagcgcgcgcattacaactatattgggcgcagtgagcagctgttcaaagtccccggctactgcattgactgtgagcgacgggcggatgcgcgttaccatgcctcggggtgcaaagttgcgtgtcgcctctgtctccgctttggtgccggatacccgtgcaagtcggaacaagtaagtattaatttgttgtcaatcatgtaattattttttcaaaaaaagttgccaaacggtgaaagcagtgcccgtcgttgtaacgagtgtggcttcgtcttcccctgcgacgactgcttcaactaccaccttgtcaaccaggcaactgacccattggacggccgtggtttgcgacagcgtcgtacgctttgtcagtggcgacgattttgccgagactgtggccgtgttgcctatcttgggcttcaccagtgtccaccacttggccaagccgatgagggagcgcaattcaggcggctgttcttccattcctttgacaacgcagcggcagacccagtggaacaatttttggactacctgacgcgtcatgggccaaaaaatgcgcatacggtgtgcatcgcgcacaacggcggcaagtatgattttaacctcgtgctagaggcccttcaccgtcgaagtatgccgcccaaacgactatgcacaaccggcctgaagatctactcgatgaagctgggcggatacaaccaaaggcggatcaccttcaaggactccgtcaactttttcgtctgtcaattggatgcgctggtgaagagcttcaacctgccacaacacctggcaacggttaagcccttcttcccgtacatgttcatcaagcgacaacatctgcttgagaggctggaaggacttcccgggcttgactactatcaaccggacaccatgaaggcagagaaaagggccaaacttcttcgttggcacggcgaaaacaacaacaacggcaacagatttcagcttcgtgagcagctgatcatgtactgcaccaacgacgttgccattctgcgcgagtcggtcatccgttttcgtcatctgatcgaagagcatgcacaaggccttgacccattcattgtggcatcaacggcggctggtcttgcgcttgccacgcttcgtcggtgcttcctgccggcaaaccatctcgtccactcaccagaaggcggctacctgcgtgggcgccgcgcatcggctgagtctcagcggtacatccgcttcttcgagctggagcaccccggggcgcaagtgcaatgcgcgagctggtccgtgggggaggcgcacattgaagacacgggataccgcgttgatgggctttggcaccgccacccgccccttcgtcctctcgccatcgagtggatgggttgcttttatcatggtaattttttttgtcttgtttcttttctttttcataaccaacaaaaccaaggctgcccaacgtgctttcccgagcgacagcagcaactggcagcggggcggacagcggaagacttgtacgaacggacggagcaacgcctttttgagttgacgaacctgcacggatgtgaactgcacgtggtttggagctgtcagtggatggagcgtcttcgtcacgacccggagctgaagcgcaggtacgatgccgtgttcgtcccctgcccgctggacccgcgcaacgacgcactcaggggaggccgcacagagccgttcaagctccaccacgtgtgcagcgacgacgaagagattctgtgcatcgacattgtcagcctttacccccacgtcatggtgggttttctgtgaaggtgttcatttcttacggataaaaaaaaaattcagaaggccaaccgcttccccgtgggcaacccacgggtcgtgacgcgtgaagtattgctccatccaccaacagcaccacttccgtggacatctccggaaaacaacagcttccgagggctgctgcttgtccgagtgcttgcgccacgcaacatccgtgtgcctctgctcggctaccgcacaaaggatgggcgcttcacctttccattgtgtggctggtgtgccgatcgacgacagcagcggccgtgccgccacggagacgacaggcgctcgtgggtgaccgcctacacgcacgtcgaactcaacaaggcactccagctcggctatgtggtcaccgacctatttgaggtagtcactcatttaaaaaaaaaatgttgtgcacgaaaacacaaattaggtttgggactacgacgagtgggacggcacgctgttcagcagctacgtcaacacgttcgtcggtctcaaagtgcaggcgactggttggcccgaggggtgtgtcacggaagagcagcgtcaagcctttgtggaggactttgagcgcactgaggacatccggttggactcgtccaaagtggagttcaaccccggcctgcgcctcattgccaaaaccttggcaaactccttgtggtaaagatttttggcttttaattttgaaaaaaaaaagagacctacagggggaaacttgcgcaacgtgtgggccagacggagattcgctacacgcggactccggccgagttccataagctgctagacgaccccacgctggacaagttggactttgtccacgtctctgaccacatggaccgctgcgtcgtgcggaagcgacccgtgttcgccaaggcgccactgacgaactgcctcccggtcgctgcattcgtcacatcgtacggccggcttcagctgtacagctatatggagcatgttttggccatcgacggtgcggagctgctctactgcggtatgtttgtcacaaaataaaactttctgtggacattactatgttttagacacggactccatttactacgtcaacaagatgggaggcccgtgcgtagcggaaggagaagcgcttggccaaatgaagcgcatgagcacagcgcccgccgcatcgtcgaattcattgcgggtgggccgatgaactacggcatccggcacacttcgcgggacggcaccgatgaacgaaccaacctcaagatacgcagcttccgcctatcgtacgcggccgagctgctgatcaattttgaggcgatgaaggacctgacgctatccacttacaacatcgacggacccatgtgagttcattaattaaagttatctttgctagtcaaatttttttatagcgatgatgtgttggacaacgatgacccttacgtgtacggcggcggcgaacaccgtgccatcctggtgaatttcccgcaaattgaccgcaatgtgtacgccgacctcttcacacgcgcgatgcgcacaaagattaccggccctactacgccaagtgacgtgtttgcccggggatgcagacacgccccttggctatgtggaggatggactgccgaacgatggacaacggacgcaacgacgaaagagaaatttggttgatcacgaccccacccagccagggcattccgggtggttctgatgttatgatttattgtgattttatttatttttgtaatatttcctttaattaaatatttattcattatgtttaaatttgtacaaaataatgtgaccaataaattacgcacgaaaatagtttggtataatattagacaaattggtaaatgactggtgcaaaatatcaagagactgggcccccgtgacaatgatcttccccgaaatataaactaggcacgtgactccattcaacaatttacaacgaagggctgggaaaattgttgggtcatagatgccacccagcgtgttttgcagtcgctcaacactgatccgttgggggaaggtttgaacaccgacaatgttgaccacacgcagctggtggatgtccagtgtgatgctctgcgtgtgttggatgcgccacaaaacgcgtgccctcattttactcgcactgcttgggtggggcactccggtgaggaccacacgggccgattggaagaccagcgcagccacagttttgcccgctgttgtacggatgcgaatgatgatagcgtgaaagcgcctggggttatactctgtgattgcgccacgttgcgcaattgtcaaaaattgctctcgagttaggggttgaacatttattttaaaaacaacagtacaattggaaattgaatacatctacaaaacaatggacaaaatttcaagagggaaaaaagttttgtgatctccgcctccaaattcaacgacgcacggcaaattggggtggcgcaaacggatgccgtgttttatgtaatagtgcatccggaccttcaaatttttttttgcactcacaaaaaataataataataaaaaaccgtgatgccgaggtagcctcggtaggctggggccgagtgggtgtccaggatggacaggtcattacagcacaccggaaaattgctcacggacggccgcaggtgggcggtacgcagttggacggagcgcaaatgctccacaatgtcccggcgtttctcaatgcttttgaagagcacatgcagctcatgggcactgcatttgaccgcttgcagaggtggtccacgagcgggacggggcgacggcgttcggcacacgtacatttttttggggtgcctaaatttaaaatttaatctcggattaaaaccaaacagcttgttgatggcgactcctcaccaatgggggccagcggctcgcgcttcatctcctcgtcaatgaggctgatccagctgggatcctccgcctcctcctcttgctttttcgttgactcttttttctcgttgttggcgtcctctaaatccatttcaggataagcgttgtttatccaatcggttgcaagaattaaatccatttttttaaatctattaaaatgtaaaactataaataaaaagaaaattccattaaaaaaaaataaaatggacgccttccaacaatttaaaagggaggatggacaatttcgtcatccattcacaatgattgtgtctgggagcacaggcagtgggaagtcagagtggataatgcgtctgttgcgaaatgtggacaaaatgatctctacccccattgaacgcgttatttatagctatggcgagctgaacacaaatgtagtgaatttacagcgcgccggcaaagttggcaatgtgccagtcactgtacacagcggcgtcccacgagcggaacaagtgcgggagtgcgccaaaaaagaaaaaaccttactggtgctggatgatttggtggtggggatgagtcagcaatatttagacgcactcttcacccgtggctcacacaattggggcgtcagcgtaattttggtgactcaacacctgttcaacaaagagctgcgtgtggcgcgcacaaattcgcactatctagtgttaatgcgaaaccctgcgggggctttgcagatatgccaatcgccaaccacctcttcccgtcaaggactgcccattttattgaggcctaccgggacgcatgcgcgaaaatttttggctaccttttggtggacatgcacccagagactccggaagagatccgccttcgaacaaatatatatgaacaaaaacaaatagtttacatgccaaaatgagaaggtcacaaatgctagcaagaaacgaattctttttggagacactgtgtagttctaaaaaagcgaatacccttattcgaggcgcatccgatgagcaacttttgtgccttgtcgaaatctgcctaaacattctaaagggacgggtccctttgcgtcctcggcatttgaataagctgaaagctcatacacaggtgcttcgccgtctcgctcgcacacgctgctctcgctcagccaaaaaggttttgctacagcacggagatggcctccccgctattgtggggctcattgcgtcaattgctcttccgcttattgcggatgtcattgaaaattataaataaggtgcaacaaggtaaaaaaaaattagtaataatgcagcatacaaagcgctatttgcttgtccccgaagaaatttatcagagtttggcagcaccgccaccggctgacggaacaccaattgggctggtccgcacccgaattaaacaaatcaaaaacgatgacggcataaatgaggcggaacgggcaatcaaatatgagcaggaacttaagcgtctcaacaagctcacaagggacgaggatgaacgtcccgtgggtgttaaattagaaaatttgagtgacgtggttgacgccatgcccaaaccagtcaacgtcagaagaccaattgttgtcgctacgcggcgccatctcaaggttgggcgtgcgcgaaaagaaaatgttgaacaactagaagatgatgatgatgatcatgatgatcatgaccatgaaactccaaagccatcgagttcaaataaacgacaacccacacaaacggaaatcttaaaattaatttataaaaacgcccaatctcttggagtgtctgaggaaggacaggtcttgagagcgggtgggcgaccgtttataaccagcagtgtttatgacattgttagtcacctgctgaacaaggacaaacgtgctcaaaacaaagagccaactgcattcaaagaatttgttgaaagggcaagacagatcccgctcttgagtaggcatttataaaaacatcacactgaaatttaagccatcattatggatttgaaaaagcttcgcttgctcgagtttttgtacaaggacctaagttcgcctgtcgcattcacgagcgttgaatcgctgctgagagaggcgcagaaaagtcaacgaaaaattagtcgaaaagatgtccaaaattatttagccagccagcgtacatacacactgcatcgtcaggccaagcggcgctaccgtcgattgccaacattggcacctggcttacacactgaatggcaggccgatttggctatatttgaccgacttgctaaacaaaaccgtggctacaagtacttgttagtctgtattgatacccttagtcgacaggtgtttgtggagcccgtaaagaccaagacgagcgctaacatgataatagcatttggtcgtatattcaaaagatcaaaatatatcccgtggaaggtgttgacggatcagggaaaggaattcactgcccgcgcagtacagcatttcttccgagctaaagacgttgaacgcttttgtatgctcacttcaccccaatttcatgccggaatggccgaacgtgcgaatcggagcatcaaagagcggctttatcgctactttacggagcgtaacacgtacaagtggattgatgttgtgcaagacattgttcgtgcaattaaccactcgccaaattcgagcattgaaatgcgcccagcagacgtgaactttaaaaacgcagaagcattgcgacaaaaattacatgatgcagctgaaaatgttgtacgacgccagccaaaataccgtgtgggagatcgcgtgcgcattgaaaagtacaagcacgtgttccaaaagggctatctcccacgcttcaccaatgagctcttcactgtggcagaggtacactctgagcgttcgccagttgtttatcgattgcgtgatgaccataatgaaattattagtggttggttttacgcaaatgatttatgcaaatcactagaagacaaacagcaaaaaatgtatgaaattgaaaagattttggtgaaaaagaggcagaacggtgtggattatgcacttgtgaaatcgaaagggtatagcgctcgctttaatagttggattcctgcaaattcaattaccgagaaagatatataaaaaagcactatttaataaatttaacaaaaatgccttcaaattctttttatgttgttgttccgtcgaacaccaatattgaaggaaataggacaaattctttccgagtgcgtttaccgtgcaaactacaattcaattcggaatgggaggtgggtctggcggtgattgtgtatccccactcttggccttccataggcaccgtggagcaacagtttgttcaggttgagtggcaaacgggaaatacggtgcggattgagcttccatcatcaaatgtcaccaacccccatgagcttggcaaaaatttgtacagactcctgggtgagggcagcgatccgttggcaaaaaaggtacgctcaacgcagaattctttcatgcttacgataaacaaggctcgtcggtggaacagagaagagtacattaagcgaaagaccaaagaaaaacggggcgtccgtgacgaagagctgctcctacaggccctgttgacagatactgggacagtggttgacctcaacatcatgacccacggccttctggcacgggaaaagcgtgcggaaaccagcaatatagcgttgagaatcccagctgacgataatgattcatatcaacaaaaattggatgaatacttttctagattaagtgagaaaaatttgagcattcttgatgaattgggcatgacaaaattgaccgccgaaatcaaaaatttgagcgaagaggaacgtgcgatccttgaagccacaaaggaaatgggaacggaagcatggattcaggcgtatcgtgaaatacgtcttgtctgccaatttaactacgacgtcaataaaaatcgctttgttttaaacactgacccacggtacgttaaaaaggtcaaagtctcgcctcaactcgcgtacattctcggtttcaacaacacggaatttatgcaggccgaaaacgaggcgaggtttatgccggacatgagcgggggtgtgtcatcctttcacgtttacacgccagaccttattgaaccaatgatgattggcgatgtgacggccccagtgttgcgcattgtgaccatacgcggagaccccgaccaagtgattgaagaacaattttttgccatacaatatcacaaaattttattaaaggaagtttctgaaattctgattgaaatccgtacaaatagcggaagtttgatgccattccaatacggaacttgtacattaactttactttttagaaaaatgtcctatttttaaaaaaatgaacacgttggaaattgacaaaacattggcaagaaacaacgtgactcgccactactatattggttcttttgcggcagaccaaataccagccggagcaattgtcaaatttccacattgtatggtggtgaatcttgaccccagcacctcgcgtggctctcattgggtatgcatttattgcgcttctcctttgcgtttggagtattatgactcattagggatgtggccaccacccagtgttcttattgtgaatcatttgtcacgctacaaacaaattcaatataattctcttccccttcagtctgccaactcaagtgcgtgtgggcgtcatgtcattttctttttgtactgtcgatgtgttggaatgacctttgaaaaaattgtcagctttttgcactttggaaagcagcaaccggatacgctcgtaaacaattttgtaaaaggcataattttcaaagaatataaataatgcaaaaacgtcagatttaaaaaaaatgcatgttgattttgatcctctacaagtggattggtccgcattctcgtccgactgcgtgcaatatggtggatacaacatttataggggattgccctatcagcgtggagcgggagttggcgcagtgttcagaagtcttatgagatatttgctgccgattggaaagcaaattggctccgcaattggacgtcaaggaatggaaagcggaaatcgagtactcaccaatgtgctggagggaaaagacctcaaagagtcgctcgttagtgaaagtaaggcgggactaaagaatcttcttgaaaaagcagccaacaacataaacactcaaaagggccaaggttttgattttaaacgttataaaaaagactcggctcccaaaattggaaaaataaggcgaaaaaatataaataaacttcaatcctcttttgggccaccaatggttgtaaagaccaaaaataaacgtctgcgtgttgactcattaggaacttactaaaaatgacttgcccacaaaaaatcagcaacagcagtcccttagcaattaacagtggcctaaacattttctcagttccaccgaccaatgtgtctgttgtgcgttctttctttcgtcaagtgcttccgctagcaacaatcacacaagaatcaccgtacctgtttcgtctgtacagtgacaatttgtggacagatttgtctcggatctatgtttatctcgaactgtccattgaaaaaccgggagcaaacgacaagtgggttgcgatagaggatacggatactagtgtctctgccattcaagggattggtcaaacatttgtccagcaactaaaagttacggttggtaacacggaagtatacgatagcggaaatttatacccatttaaggcatatatcaccaatgagttaagttttccaataaatgccaagaaaaattttcttggttcaacagggtattatcacaccgtanatcaagatgattcaacagacgatgggttcaaagagcgttgtaanatttttaagggtggaaaaatgcgcaatcctctctcgtctcgactttgatctgngaaaccagagcttatctcttaa

SEQ ID NO: 1618 - DNA, 1712 bp, Heterodera glycines
agggtattatcacaccgtaatcaaagatgattcaacagacgatggttcaaagagcgtgtaaaatttttaagggtgaaaaaaatgcgcaattcctctctcgtctcgactttgatctgggaaaccaggagctttatctcttaaataatttggatttgctgttcacaatttacaaagccaaagatgtttttcttttgcaaactttaaaagcaaatgatgtaaccaaatatcgtttgacagttcacgatgtcaagatttatgccaaaatggttgaggtccaaccctcactaaacatgagcctctacaaaacacttgaaaaacaacccgccacatacgcagtacgcaagaccgaaatcaagtcgtcattcatcagtgtcggtcgatacgaatttgagtataatgtcttcagcgcgaccattcctcggcgcgtgacaatcgcgttagttggaaattcagcatttcatggcgactacaaactgagtccattcatgtttgagccgtttgatttgcgtgaaatttcgatacattccggtggggtggtatacccagctgttccttataaacttaatttttcaaaggatcactttgtcagcgcctttgttgacatgtatgaggcactcggaatggccaattcagaacgttcatttgacatttcaatggcccagttcaagaaaggatggaccttttttctgatcccattgacatccacgcttgacgacagctgtggatttgagctgatgagaagcggtacgacaaacgtacgagcaacattcaattcaccaattccacttggtggcgtggagatgattgtcttgggtgaattcgaccaaatgattatggttgattataatcggcacattgtgaccgactcaaagcttggataaaatataaataaataaaaatgaaaaatattattatataatgttaaaatgaataacaccaatacaacaaaacccaacatacaaattttgaattccccagaagagcctaatgaaactcttttacatgtactactttttcgcattatcttcttgcatttccggtgtttttgcttatttggttcgttttaattcggtggcttaaaagtcacggtcacttaacgcccagcgaggcagagacagtaatgcatgagatgaaaaatatcccccgacacccaccaatatttttcgcaacaaaatgatgcaagattagagaaaactgacagtgaactctctctctctcttcagtatgaccaaatcgataatgagtcatgctggcggaggattctcaaagcgactcattttttttcatctttcattttacaaaaatgcctccaaatgaaaattctgaccgtccctttcaacaacccgacaatgttcaaccagatcaacaaccgcatcaacaacaaccagatgaagacaccgagttgcgtgcacaaattgaagacgcggaggaggatttgctcttgaattggtggcgtgaagacccaacaattgtaagcttttttttcaatttagcatagtttttttaatttcatcacatttttcagattcgttttctttttggacacagacgcgcccctgccatcgaagctgcgcttcgtcaacgcgctgaacgtgaggccgagatcttgcgccaatatgccgagaatcagcaatgagaagtgaccgatcaaaataaatgtcgtatgtttttcacatttttttattatggttataaatttttattaaaaatat

SEQ ID NO: 1619 - DNA, 4066 bp, Heterodera glycines
attttcttttgaataaattattgtttaacttaaaaaatatttatccatttttttattgtcatttttccatttttttttcttattttcagtttttcgctcagcgccaacagcgacgaaacaatttcattcagcgtaaaatttggcgatgattggttttggatgattgttgatgagaaaatcggagggaaattgaggacgagtgaccttgacgatggtaattaaaataaagaaaaaataaaataaattgaattttaaggaacaaatacaaaattcaaattaatccctcaaacatctggcaattttgtgattaaggtttggaaactaaattgacaaaaaataaatattgttttaattaataatttaaatttaatatgtttttttattgtatttttaaggcatccaatggaaaatttgtgagctgcagaagtgaaaatcactggttagtggcggacatggaatcaccaaagagtctctatgaagaatttgtgttggatatggtcaccaaaataacagataccgtaaccgctcgcgtacctctaaaaatacaataattctttcaattcttttatcctttgcaccagaataattaaaataaaaaaaacaatgtgtgcaattaataaagcaactgagaaaacggtacgatgaataaaagtttattggataaaatttgtttttccaagtttttcaatcaaaaaaagagagcaaatatttattattgttaaatgattattcatcggtaatttggtgtttaatagcctctaatctaagcaaatctgcaacttctctgctcatttcattcgtcgtccgcccaaaaaacggaattttcccgctccctttccttttgggggctttggcttttcatcttcttcctttttagcagaagctgaaatattgttaaggtatttgaaacattatcaaagttattctttttgcaaattattttctttattttcttttttctttaccttgttcttggccaggttcctcttctaaataaatattacatatattgaaaatatttaaaaattatcttttaaatttacccgaattcactggagcaataatgcccatcagtccgatgatgagcatcaaacatagaacaaatgttgaaaacaacttcattataataatgctaattgaattccttaaatttaatttaaaaaagaaaagaaagcatttttattgtaaaaataataattatttttgaagaatttatgcatttgagcagtaagaaatcgtttatatttcaaatgaaattatgaataactggttttgaattatataatgaattagaatcaatgacagatgcgcaattttttgaactgacgattttttttgcatcaaaaaacaaaattagtaatttatttctttcgtcattattattattttttgtttttctttatttatttttttccaaaaaaatatccattgtcggttattttagattattaatcgaatttcttcttcaaaatattaaaatgaaaatgcctaaaattggttatttttagggtcgtcgaaattaggctgaagagactgttgtactacactcatcatacaaatacaaaagccattttgttgaaattttgtaatctctttttatgtgtaatatccacttaaatttccaacatatttgggattgaatttgaaaaaagttctcttctgtagatccatttctgcgattttcacaccatcaaatttctttgacatataacaaacgaaaatttttttaaaacatcttttttagataataaaacttttttttttgtaattatgttttaaatattgaatgttatgtttatattcctcatttttaaaattgggcccaaaaagtcaacatatttattaaaacttataaaatgtaaaaacttgctttttatttcggatattttttaatcaaaatggattcgataggattaatatcagtcaaattgcgtttttcaaattcgatcatatgacaccgctaagttcgacttcggcacactgttcaatcagtgccattttgatacgttcggcgtccaactcgggtcgctcgcataaattggccaaaacataggcatatttaagcgcgtacggattctaacgaagacaaagtattaatgaaaaaaaggaaaaaatgaatacttcgctaaatttgaagcagaaattgctgaacgtgtgcaccacctgaaatttaatttaatgatttgtttttcagttaattaaatacaattagtgtattaattatttatttgacgtttaaacaccagtaatcgcttgaggtggacccaagcaaaatgtatttatacgtaattgtttgacaaaatctaattttggatcatttttgaattaacaatttatccaaaaaaagttcaaaatcctcaagactcgccaaaagctttaaatgcgattttttacctttaataattattgaaaattgatttttctatgtttttcttttaggttttttaagttttttatatgagttgtatttgctttgcactttctgcttcacctcattgtgacagtccaagtcgcgaatttgttgcggatacgtcgtcaaaatctgtcgccggttgttcatgtcgtgcacaagttggtgcacaatttgtttaatcgtttgctcgagaaagcttcttttctgtgatacaatatgtgattgaaattttaataacctaattagttttccgcaaattttttttaaattttattatttaatattttgcgttttccaactttccacgccacgcggagattgtgctgaatctgcttagactcattctgacggcgtgccatcatgaacatgggaatgtctcgagaaggaaacattggaaatttgtgcggtgatggctaaacgaaaatttcaattccattaatggtttaattaaaaattaatttaaaaagttcaaattaaattttaaattgcccattaattaattcactgggcgttcgttgcgcttttgcgcctgctctttgcccataaactcagaaacgtgttcgtcctgaatttgcaagtcgccgtagtgcatcacgtggcttttgttcgtttcttcgcgcacaatgccaaattgtttccgcagagtttcggtgcgtaaattttcctgaaaatttgaaattttcccccaaaaataatgactgaaatgcctggtccgagtcttgcatccaattcactgaaaaaagatcgcccaaacaatttccgggcaaaaatttggtgtcgcaaaaacagccccagctcgattcgtcgccattggccgcggtgactgcgtaaacttaattgactatcattataattattattactattattattaccattttaattagtctatcttatttattggttttcaaatattttttaatttaaaaaatacacttttcaaactctgcgccaatgtgtggtcaaacattgagcccgattcgcatgcttcgagataaaatgtcaattcgccgtacatttttttggcatgcatttccttcagtgtttgagtcaattgtttaaccgttaactgaaaaattaaagacatttgcacatatcaaagatagttgttatgcaaattattcctaattcattgttaaaaaattcccgcgcaaattacggtaaattcatttaattgtttacagtacgtcggctgctgggaatccgataactccgaccgcgccatggtccgagaagtacacgaacactttgtccttttcagtgctgttaaggtggaattcaatttatgatttattaagtattctttgtgtgaatctcaaataatgtttttaaatgcttttaattaattgttttcgagtttaaaagtaaaacacataaaaagcggacaaaatcgtatgtgaattgcatctttgcatagttgatcattttactgtttgctgctttttaaattttgttgttttttttaaattttaattcaataccgaaaacagaaatttttcgcgaaatttttgaattttaatattgaaactcagtaaatgaaaaaccaattgtgtttataatgttatggctatttgttggtaatctcatggctgtcagatttgaacaaaaaaatttggaggttcagaaaaagtcgaaaaaatgaatggtttctaa

SEQ ID NO: 1620 - DNA, 4337 bp, Heterodera glycines
aaaagaaaatgatcgtgtaatggcataggtaattatttttgtgctcaaatgggttttgttttgtgtctctccgttggtctctctctcccccccccctttttttttgatttgtccgtcaatttttgctgataaattcggcacaaacaaccttctctttctctcttatcactgcagatgaagaaaagtgatgaaaataatcacacggacaaatgacagctgaacaaaaatggcgagtgatcagagaaatgccaaggcgaaaatgaaaaatgaacggagaaaatgccaacaatttggcaaattaagtagaaatagtagaaaaaagcaaattaatttaatttttaatttgacacacgaccgaaacgaaatgtttttcccatttgattacattaggaaatttcaccaattaacattaattaccccgttaaaaggcaattaaccttggatatgatcatttgatcggcaataaattacagtccggtaacgaaaggcgattaaaaaaagtaaaaaacttctcatttctttcacattgtattttaatagaatattatcaaatttgctaattacaatcaattccagttaaatatttttcagttaagacaaaaaattaaaatgacaaatttaaaataaaaactaaaaaagagaaaaaagggaccaaaaaaaattaattcaatttacacgcaaatatattgtgaacaaaagcaaaaacaaatgggcacgcccaagtgcctcgttagctcagttggtagagcgtgagacttttaatctcaaggccaggggatcgagacccctacggggctgttacttttttcaattttattcttcctaatacaaattgaaaatcttgaaatgcataattttctttttttttttttttgaaaaaatattcaaacataaaaaccgcaacaaattttaaattaaaaaataatttcttaataagttcggctaaaaatttgctttttcagcattttctcagcaaactttttttttgtcaatgcttctttaatttacatttaatatgaatgacataagacaaattaaaattgaatatgcaaagacacaatgaatgcattaacgtaaatggcattgattaccttttgtatttacgaaagcgaatacaataaaaattatacacgtaatagcctcaatgattgcaataatcattgcataaaacctaataatacatatattcatcaaataattttaaattattttcaggattatagcaatgaaaaaagcattatttaatattattttatatgtgcatctaattatagaaaaaacgtctggaaacgatgtgaatgatgaagcacatttaaatggtaattaatatacataagaaaaaacgaataaaccccggaaatttttgtttaaaatttttatttttatttttttgcacaaccacagaaacagacgcagaagatgaaaagatgataaatcagtacaaaatgtatttgaaatatcacgaaaggttgctgaaattggatgcttatgggttggaggtagaaaataataacatggacgacgacacagaagcatttataaagttcaaaattgaagcagcaaattggcacctaaaagcgttgacattggaattattggaaaaggcatcgcaaattgcaaaaaataaccaaaaaataagcaaaaatgaaaaggacggacaatcacagctaaatgaggcattaaaaaagaatgtggaggaattagcgaaacgcatgtcaatggaaacaattgaaaaattggtgaaaatgcatggggaagttgagacaaaatgcgccaaaatgaaagatgatataatcggcaaaatattcaaattgtacgaccgttacaattttgtagtcagaattgtggtcatagtggacaaatggacgacggacaaaagagcatggagcaacattggacatgaaaaacgcatcaccgaattatttgaggttcattataaagggggaagaagggcctaaagccccaaaaaataaatggaaattcccgatatttcaaaaatattccctaaaaggtttcatatccgttctcgcaattggacgaagaagaattgagcaattcggaggaggttgtttttcttgacacttccgtcgctttcgttggcaataaatataaattgcgaataattcatgccgaaaatgtgaagaaaatggtcaaagagtcgccagtttttcgcgattttctctgtaaaaactcagacgattttgagacaaatataaagccgtcgctcgaacaaatggtgggctcgtccgaactaatacgacttgaggaccaattccccgaggctttgagaatcggtaattttgaaatttatgattaaaaataggtggatatgtccgggaatggggggggaggtcttggatataattaggaacaattaatttcttgatcaatgactgatcaataattctatggcttatggttgttcttccccaccttatccagtttcaatttcttcctaagaatgctgtgtgttaatttttattttaatgattttttgtaatctcttcaaattttaaaatttggcccaaaattcaccattttctccacaatgtttcaaaaatatccgccgctgccttacggcagcatcggactccattattctcttaaattttttagttcagcaaaaaacagcaaaaagaagaaaatatgaacaaatctcactcaaaattcaaaattttctcggcacagccggacatttgttctgattagacttttaaatcggatatatatatatatatatatatatttataatgtaaattctgaaccacacctgtatttttagttttatttattttatttcatcttttgtattttgtgcataatgtaagggtattaatgtgccgtaaagaaaattaattaaatattttaatccataataatcgtttacgaccacccatcatttgttcgtataagggcaatgattaagaatttaaattattatagacatgcttcaagtaaaatagcattaagttatttttttagatattatgagccaacagactttgttagaaatttatcggcaaatcctttcgccggcaacgaacgaagaagcaattgacgacgacaaatatggaagcaaaaaaatgttagcacgaaaaatgatggcaatgaccgtccaaattatgcgagaaaatgaaagccaattcaaaaaacaaaacccaaaaaatgggaatttgaaagaaatttttggacgaaaaatgaaagcaattttggcaaaagcatttgacaatttattctcagcaaaatccctttgtgagatggtcaaatttattagctttacgcgcgaaaaacgggcgcaaaagcaattggaaacggagctgaaaaagtgggagatgaacaaatgcgaaacggagcaggagcagaagcagaccatgtacgagttccgacagaaggagctgaacagtcgatttaagcaggacattttggtacttttggaggccggcggtgaacagaagaccaaaatgggcgaaattttggcaaaagacggtgccaaaagtgggttagtcgagctaatcgagtggaagcagtacaaagagttggacgacggcggatatttgcttggcatattcccatcaaatagttggctttttagggaaattcatttattttcatttgtttaggcttccaaaatgacgaaaggcttttcaaacattacaaggaagcaattacacacaagaaaagctcagttgtcagtgtaaagaacaaaatgtcggcagatataattgtttttctccgttttcttcatgtttatataatggcggaattaaatttgcaaattctgtggcataaaatgcacaaattatttgagtttgaatatgacagactctttagggaggaggacaatttggtaaaatttttgaaaattgagagacaattggaaggaatgataatggaaacaagcgattttttaaagaaagaaataaaggaaaagcaattgaaaaatgcgacaaaatttgtggatgaaaacttgcggaacaaatgggaaaagaaaatggacaaatgccaagggaaaagcgggccaaatttggccaaagggagcagatattcggagaaggagcagctgatggaaaagttgcatctgagggaaatgctcaatttgttaaaacagaaaaacagcaacatgaaattggaagagagtaagccaaaaaaaaacgaaattttaaattaaaaaattacccgggtgctgggtcatttcgcgaaaaccgcaaatatttcacaaaagagaccgagtcacatcagaagcatggggcgcggacataaaaatcccgcggtcgcggattcaattagccgcggtcgcggatcgcgcaaaaaaattgccgcgaatcgcggatcgcgc

SEQ ID NO: 1621 - DNA, 4525 bp, Heterodera glycines
ttcctttatttgttgatcgcctcgatactatttcttttgacataaattgcacagatttcgactaaaaagtaaccaaaatttagggatttttgggtaattttttttaagaaaaaaaattttttataattgtgaagcatatgctagagataacattactcccccgtttatgtatggctacagaaatggccgcttcaatatttttacatatctataaaaatataaaatttatcaattaacaaatcacataatgtcatccccaaaatttttaaataaattaattataaattttctttttgtttattctgcgtttaaaatattcatgtgctttgttttatttgattgtaatggtttgtgtgtcaacggttaaagcccaaaacacacataattttttttcaaacagggacatcgtactgatgtggcccggtctcttttattaaatatttgcggttttcgtgaaatgacgctgtgcctttacccggactaaaaaacgcgaattcaacacagactaaacatataaaagtttaaatttcagttttgctttctaaaaaccctgaaggtataaaattgtttgttgatgttgaagaactttatgcacaatggaaaaaattttttgaaatagacaatataaaaatgggaatacatttgttaaaaaatggggaaggaactacgaataattggatggaaatgttagaaaatattacaaatcaaaatgacaacgtaagaaaacaaaaatataattataataacaaaatattacactaattatctgtgttgtgtttacataattaattattaattaatctgaatctaattaattaagtcttacggttgccccaagaaaagcaaaaagcccgaggaattagcagccattgacaaagcgaaccaagtggaaggtagacataaccatattaagcaaatattcaaacagattttgaatgaattataaaaaaacgatttttacagaagagatgataatgaatttctttgaatattttaaattggaaaatgaccaaagggaaagtgccgacaatgaaaaagagtgccactcaattgaaatggacacattggcatggcattttaaataccagatcaaatcactcaaaggcacttccaattggaagaaaattgaagaaattttcagcgacaaaaacagagaaattaaattgtgtcgaatttacactcactttgaatacgtcactaaacgtgagaagggcattctctacgcagaatttgccgatgtttgttatttttaattaatagatttaaaagattaattaactgtttttttaatcggttttctcccaatacttaggagcaaatgctttccgcccaaaatgatgagcaattttttgagtggctaaaccgtaagtgctccactgatgagcggcttttcgttgccaatgccattcacacggtctgctccaatcgtttgcaagtgcgagaagccaatttcatggcatttcgccatttgctgctgagttcgcagcaattccgtgcctatttctgcaaattggccaactcatcacaaaataattacgtggaaaacaaaatttatgacgccgaaatttggtgcgacgatgggtggacgaaagtgtgctttgaagtgcaaaagattggcgaagtgaaggagaaaatattagcactaatcggcgacgagaaaatgcttttgttggaggcgcaatttccggaagttttgaaaattggtgggcatttgaaaatgaatggaataatttgtggcttttcttagatgccataatgctccaaacacagccatttctctacaaaaacattttggcacacaaatcgcacaccgacgaaaccaaattttggtcggctcggcttggcattgcgcatttggtgcaaatggtcaacgcaatgctttccaattttgggctttcagtctctttcgaattcgacattaaatatgggttcaccgtaaaaagtcgcgacattttctgcgaggcattcaaacatttgacacaacaaaaattccacggagggattggacggactttgtgcgcattggtccaattcaaaaattacgcgcaaacattttacgaagtgttttcggcagcaaacgatcgcttgaacttagaagcaattgccaaatggaggccaaaatgtgcagagaatgaggagcaggacaaggcttatcaggtgggcactgatcaaattaatagggacgagttgagaaaaactttctgatgggggaggactccgaagagtttcccttttggatgtaatttttcaaaattaaaaagcagttggcggaaaacaaagcgtaaatttaatatttttcgacaaaaaattgaccagctttgttcattttgagtctatctaaaaattttgcaaattttaagaaatttgttaagaagatttatacaaattttcataaaatgcacccattttcaaataattttatttctggggtccctccccccctcactttcccctatttacgttaaaaaagaaatgggtaaatataattgtcataatttgttaatgctacattttttaatgggaacgaatttagcaaatgaccaaaagccttgctacacaaaacggaacaatgctgaaaaatttaatcataggcaatgatgaatttaaaaagtttgtacaaaacacgcggggtgcacgagcacgaattggaaaattgctggtcagcgcagaggagcaccaaaaatttttggaattttgtggcgaaggaattcgaaatgaaaaaggtatttaagcgcacaaatggtgattggcttataccccacatttgcgcctcggattttacgttcccagcagatcccaaagaattattttaacagaaaatcatttgattctacatattatctcaataccttggcttgctcagtgcctgtcaaaatgggatttcagtttaaaataattcaatttttgtcccagtgggcttataaataattttttgatatttttgccaaataaatcaaacattcgaaagccattaaaagaaaaagctgcctttataagcataaaagaatcaggaaataattaaaataaagaatggatttttttatctgttaaaaattccgattatttaaaataatatgtgttaaaaccccttcaaaaaatcatagaaaaagttatccctaaattttttttatcgctagcaaaaaatcctttgttttcctcctcttcaaaaatgtttcattgtaatgtatttttgaacatattttttgtgaatcgcttcattatccaaaagagcactaacttttctccactaattatcttctctctaattgatggctctgcgatttttaaaaaacattcttttgttgctcgcgtttaaaagtataataattaagtgtttaaatttgtttaaatttttattatttgccacaaatatagcattttcagtgttcactgatcaatggcttatggaattgtatttggaattcttgaacaaatttgcaataatggacacagaaacacaaatgagatactttttgtcgttgtcctattcagtttgggtgcgttggatggaccgccaaattgacccaaaaaatgcaaaccttccgattggactgagacaaatttatgagcaaatttggaagaatcaacgcatacagtatgaacaaattgcgtatgataaaatatttgacgtaaattttgaggaattgtgtttcgaatttgcactgattttgaaggtatttgagccgttgaaaaaatttgttgaaacgaaacgaaacgaaaaaaatttgagaaaatttggcatcgaaataacaaaacgaaatgatgacaaaaactcaccacaaaagcagtacaaagagcacattgagaaaagtgagaaactgttggagcaatgggaagcaatttggacaaatgcgaagcaaaacattcgaatttggaagacgacggaatgccaaacgacggaatgccacacaacgcaatgccaagagggaaaactcaaaatggcacgaccaaccgaatggctacaaacattacattttgacacattgatggattttctggagaacaaagcgatgcaaagccaactaaaaaatagtatttcattaataaaaagaataaaaagattttcggatttataaaacaacgaaaataaatattaaatttaaattctaaatttattttgtgtcaattaaacaaaggtttgaaaaaacgacgagaaattcttaaaaaatggcttatgcaatttatggacaaagaaattgttgaaaaaattcaattggcaattcaattaaataatgaacaaattggagaaatgagaaaaaaacaaaaagagaaaaaagaaattagtgaagaaaaacagaaaatttatgaagaacatttgggaaatttagaaaaggaattggcggaagaagaagaaaaggagcaaaagaaaaaggaagagaaaatggcaaaagaaaaagagcaaaaggaaaaggagaaagagaaagtggcaaaagataaagagaaaaaggaagagaaaatggcaaaagaaaaagagcaaaaggaaaaggagaaagagaaagtggcaaaagataaagagaaaaaggaa

SEQ ID NO: 1622 - DNA, 2135 bp, Heterodera glycines
tttgaaaaaacgacgagaaattcttaaaaaatggcttatgcaatttatggacaaagaaattgttgaaaaaattcaattggcaattcaattaaataatgaacaaattggagaaatgagaaaaaaacaaaaagagaaaaaagaaattagtgaagaaaaacagaaaatttatgaagaacatttgggaaatttagaaaaggaattggcggaagaagaagaaaaggagcaaaagaaaaaggaagagaaaatggcaaaagaaaaagagcaaaaagagaaaaaggaagagaaaatggcaaaagaaaaagagcaaaaggaaaaggagaaagagaaagtggcaaaagaaaaagagcaaaaagagaaaaaggaagagaaaatggcaaaagaaaaagagcaaaaggaaaaggagaaagaggaagtggcaaaagaaaaagagcaaaaagagaaaatgaaaataaaacagcaaaaaagaaaagcaaaaaaggaagaggaggaaaagcaaaaaaaaagtgaaaaaagcagcgaagtgacgaaaagcagcggcaatttgggaaaatcggcagaagcaattgggaaagaaagggggaaaaatgaaagggatgccaattccatcgaaattggggacgaagcagaaggggatgaattggaagatgtcatggcaaacattggcttaaaaggtaaaacaacccgaaaatggagtgggagtaatttaattactaattagtaggcaattaaaagcaaacaaaaacctaatgacaaataattttgtttacaaaaatattaaaaagaatggggggaaattaagcttaaagacaacaaaatttaagattttttgcaagagaattatttaatgacaaaatacgacgaattcttagaggagccaaatgaattacaaaggaaaatcctcgacattggcatttatttttacgagatttcaaatagaatttctgccgccgaaggaataaaaaaggctatttttatgcttaaaaaaagcgaaattgaattcaattataatagggagaacgaatttaataatttaaagcaaaaatgggaaaaaatattgcaaaaaaatgcaattaaaacaacgaaattgagccgaattgagtaccaagatatgaaaaataatttcaaaaaattatgaaaaaaaattattttggcaacggaaggaattgaaagtgccaacatagctgagataaaaacggacaaaaacaaaggagaaaacagaatttaaaaacacaaaattccaaatgcatcgaaataatttggcaaatgcaataatagcacgaaacgaaatgggaaaaagtggccaaaattgggccaaatgggacgacgaaagacgatacaatgcgctgattttgttgtttgagaaggacacacaaaaaaggacgatctgttcaaatttggtcgcccaattcggcacacatttggagggatggcggaaaatgagggaacagcagcgaattggtgggaattaattaatcaattatttaattgattcattagtgattagacattaaattcaattaaatttagaccaaatttcgataaatgagcatgtgaattacacaaacagcaaaatgagttgctctaatggagggactgaacaaataaaaatgaccaattcacattcatttatgctgccccaattaaaccagcaaatattttttaatgataacaatgatgaagagcatttaaaagaggcatatgaaaatgtattttaaaaaatttatgaataaaatcatttagttggaacgaattctcattgaagagcatttcgtgctgacaatggacccaaccaaagcattgaatgagctaaaagcagttgtgtccaattgggtacgatataaatcattttgcattagaaaacaattagcaaaattaattaatttcattagaaaacaataaaaaattaagtaatttcattaagtcgcaaggagaggcaaagcttttggagatcggctccttaatgttgggcacaaacacagcaacttcggacgtggacataatttatattgtgccacaaaagacaaccaaatcggaggcaatggacaaattctttggcacttttcaatgcgatttgtcaccgcgaaagtgcgaggacaattcgctgtattgccttctttgcctggtcaattaattta

SEQ ID NO: 1623 - DNA, 1425 bp, Heterodera glycines
ttaaggaacataatttattagtgatttaatggagatggatttttatttattttggttttcaatttttaagggtttcgctaagaaaaataaatttaaaataggaattggtctggtgtgacttcatttaaaaattaaatattccaaatgaattgatttgtaaatttgcaagcatatgtgttttaaaatttgcaggttgtttggagcaaaatgggatgtttcatatgaatgagtcaacattcaaaattgtacaaaagtcgatgagagaaggtgcttttgcttttgtatttgttgaaaaaacaaaccattggattttcagcttttataaaattgcgtcaaattcaattcccaaatgaaaataattggtcccaattgttttcaccttcaaaattcactaaaaaggcaattaattaattgttcactaatggttcattatatttcattttttgattaagtacaaacattatgccgccatttgttgcgttgtcggcaatttaattcatttggcacaattttgtgactttgttgagcgcaacattcggtttcaattattgcatttcgacactgtgactgatggagtcaatttcacgcatattatgacggaaaatgacggggaatttaagtgcccaaattcaattttaatgcctgtcctaaaacaaaatcggtatttatatttttatttgaatatataaataaatttttttttgcaaaggaatttttcactgcacaaagcgtggctagtgggaatagaaatggaagagaaaacagcagaacagaaacaaaatttaccatcagaaaaagaggagggacaaagggaccgaatgataagccatttaaatttaaaatttaatgagcaatttaatgaaaaaattgtgcaaaagtatttcgaatctttgaaaggatgctttcaacgggtttcgctggtttcgaaatatgtcgatgagaaggaattggaaaatcagtgattgatttaaacctgttgattcttttttgattaaatgtgcatttttggaatacccattgtaataataattcatttgttgtcaaaaataaatggtgatgcattttgcaaaaattaattatttaaaaacaataagaaaataattaagcacaaaaaagtatgcatataactaatcgatcttcaattattatgatgtaagttaaattgttattatgaactaaataaatcatttgagtatttcaagagaaaattcggcgctacttgtaaaatgtactattttgaattttatcaaaagtaaaaacaaaagggaggacccttttggtttacaaaattttttaatgtatgatcataaaaatttggccccgggtatttttggggttcctgatcacgaatctgtcaactattttgaccaattcctattcctacctaaatttgaacaaaaaatcattaatcgaaaattcaaattt

SEQ ID NO: 1624 - DNA, 3073 bp, Heterodera glycines
gatgaagaactgctcaaagaacttgaggagatggacgatgtgataagcaacaaatataattgcaacccaactaaaatgtgtttaaggaggatctgagtggcaaattgctcgacgcgggtattgtgccggcacatagtgtgccaagtgttgcagacaaattgccaagcgcaccgaaagagttgccaaaaaagacggtggccaagaagcaacaggaggatgaggaccttgccgaattggaagcgtgggcaaatgcgtgaggagagtcatattttcaatccgatcagaaatgctcttaccattcaccactgacctaaccacgatgatttagtcgtatctggattgtaacatagacacaaccccgaaaagttcaatttgcaattttttctggttatttagagtttaacaaattttgataatagcgccaagccgcataaaaaaatctacggcattaaaaccaattctacaagggacctgcctagtcatttcttgatacggcttataagtttttttggactcaaatcggcaaaatgactttgacacacatttgcttttgatcagattgtatattctgtttcaaattaaggaaataaacactatttctaatcgtaagcatttgattttatcgttgttcaaatatagaaacttcattcccgttggtcaaattcttcattgtctccatggtctggtgtgcccgaccttccactttcgtctaactgctgctctctgtccacccattctacaacagatttgtgctttaatgatgacccttccttcgtcttctgctcgatgttccattgcttccttgtcatattcttacagtcaagtgctgttcgatttcgcgttcgccacactctccgtttttggtgctgttgtccctctgtctcggctgtcgctgtcgtctttcgatgttcgttggccttcgactccacttcctcggtttcatccgtagctgtttcggtaaaattcactgcttctctccggaggatgcttccggtgttgtcctcccaattggtgcctcccttacggctccttcgcctttgtctcccgcgcccaatttcacttccctgcggcgccgttcgttgcttcaacataaacacatcgttggatgcattgcgtgaaaatggagtcactgaaggatgagtaccgaggatttaaaattccaaacaaatgtgaatgggcaccaatgccacgctgtcgcttaaatgtgcatccatcctctgtcattgtcggcaattcctctcggattcgcttccatgcttctgccagctcggtaaaccttaaaatgttaatgatttttttaaaatattcaactacctatataaaatcagaccattgggcctctgtttttttagcgaaaattgagcgactattaggcaattggtatatctgacggcgaagttttgcaattactgtcccataatcatcttggtgcatcacatgtttttctgcgacattcaataaagaaaatataaatcaattaaggcataagatattcagagaattaaatggactttgtcactcaccaaattcatccattctcgtccggggttttagctcgcccaacaaaatgtaattgacgtttaaatcggcacaaatatgctcataaatgccgaatccaagcttggccattgtcagtccgccgttaacgttgaaagaacttgtctcaaacatggcattcaacgtgcgcatccgttgggacaccaaaagaggctcgagatcgatggatttggcacgttggtgaaggacaactgaataggaaaacaatagaaaattttttgaatgaggatgaatttaaaatgccaataatcacccaaattcactcgtcgtgcttcactttgtgggaaaagtattgggtagaacagctcaatgcgcatcaatcgccgcacaatgctcaagtcgatgaaccaatcgacgcaaaggacgacggaatggcaaatggagtacagaagcaaaagcaagtggaggctctaaaaagcatttgataaaagagaaatgacctttccattcacataaaattttacttccacttcaattgcgtccaatgcctccgcccctttgacacgtcgcgcacggcaaaagtcctcgagaagtggagcacaatttaagggctaaaaaatttcataaacattttgtattaaattttataaattattttcctattttcgaaactttacctgacagtccaaaaagaaagtgcgcagtttgggcacaacatacactgagacttttgtggtttggtaacgacacgcctcaacagcttccctcgcagcaggacgaaaaatgtactggcttaatactggtaatggaaaagcctttgaagaaataatcacaaatttagccgaaaaccaaaggcaaaaagtattttaagactaaaaattcggtaaaatttgactttcgtttcttgtactgtagtgatacattggctcaattcacgcattgtacaatgcttcgaaatccaaaaaaatccctgccacccaccggtacatatccaccggattgttcccggcgagcataccttaaaataagggatgtgcaaatcattagaaaaccttacgaactgaggatggtcgacttgccagtgccttaaattctctatcaaatgctgttttttctgaattccttcaccttgtgccccaatcgcaccaatgaccgaatattttgtgttggactcaatgagaaaatcctgaacaaatgagcaacagtcactttcttctacgagagattgtcgttcaccttcacagcgtcgatcagttccatttcatcgtcaatcagtcggatcgatgcgtccatttgggcttggtctttagatttatcatgattagtgagggacataatattttattttttggtgaaaaacggttacaaatcctgtagaataaccccctaattacccgtggttgcccctgcgtcttttgccgattgtttcgccactggagatggcactcccccgctttttgcgatttctgtccgaactgtgtttaaagcggcagatgagagaccatcggcactggtatttgaggtcggcacttccgcaggaacattggctactgttgtgtcgttggccttacgatgg

SEQ ID NO: 1625 - DNA, 9877 bp, Heterodera glycines
  misc_feature (9083)..(9084): n is a, c, g, or t
aaaaaacagcaaaaggcccagaattgcaaaaaacattcgtttccattgcgtaaattgctattacaaacgggcatcgaatgagaccgtagctcaaattgtggaatttagggcaatcgtcaagaattgcgtgtcccgacgaaaacaacattaaaaatttcgcaggtaataacccaccttcgtcgcattagtagcaatgtttttcatggcttgctctcccaagcgcagatcacatgcaatcaccacactatctttgcttctcatggcaatcatggagccaccatgcaatcccataatgttcggcatttttacaatagaaagacaacggaattctgtaaaacaaattaaaaaagaatataaaattgatatttaagaaaaaaagtgaatggaaaggaaaaatatataaattcgaacaatataagaacaaagcattaaacttgaacaaaaaagaacaaattttctttttcagaaaactcaaacctattatttgtgtaaaaactgcaataaggtaataacaacgtatgaaagtggtgatgcattaacagtgaaagcattacaataacaaacaccgtcaaaatttaagcaatgtaaaattccacggaataaatacaaatgaaatgagtttagaagatcctttctattgccctcaaagactgtaatgtaaattagtcagaacatttatccctggcgcacttgggaggcaaagatttcctgccgcactcttcgcaattgtttgaaacgtgacatttctgcaatggtcggcggctgcaacaccagcggcttctctctgttctcatatatcagcgagtccaacgagcgcggtctgtacaaacaagagaaatgttcgtccttcataatgccgtctaattccgagtcgctgtaacgtcgagttcggcccatcagtgccattcctgaatatgtgaatgctccttttacaagaaaatgtttaaggtttgcttaccgtctaagatcatctgcattttatccacttgcgaacgacggccaatctttttgtttttccgtttcggagttggaagttggacgaaatcagaggacttgacatgggacgccaattgcattatcacacttcttaactcatctcgcttatgcttgattttaaaagttggataccagcggcgaaatgagctgtgcctcgatataaactgcaattaatccaaccattattgggttttgcatggttagtgtcgcttttatgtcatgaaaaattttctatgattgattgaagaaaaataagcgatagtttaatgcaccaccatcgtcaataaatttcacttgcaaaaattaaaatcagatttcaaaattgatgacaaaataaaattcgagttaaaattggtttagtaaaaataacaattattctaactgtttttttttgatgccaagaaatctatgcttaaacctccatctaattgcgtcaaatctttgatttttatattttacagtatttaaaagatgacgattatcaataacttaagtatgtgataatgatggttgtacttaaaattgttttatattatgttgatcagacaaacttttggaggattgctgaggaataattgcgcaaaatgtagcagaaatagtccacagtcgatgaagttcttctgctggggcagcatcgtcggcacaaccacgtccatcatttgcttattgaaataagtcttggtgtcctgtccgagtttatctgcatattccaagtgcaaatattctccgagttggtccctaactgccaaatgtttgtcttcagctgggtcgatgagctgaaatattaccgttggaaatatattttttcgaattgccggcataaggggtaatatttgcaaatgataacgcactgaattgagcacgataagatgcggcactggtgaataatgacttgaagtaggaaaaatggattcattgtccgtggtattgagagagcaaatgccatgtcggacgtttacaattattgccaaatacctaaatgcaaaatagtgacattaagcaaaactaaagtaccaatgaatgtcctcattgatcggcacaataatataatccatgtcaaacagattgacttttttagtccaattcttcactttttgaaaattgctggtgacctaaaagtggtggttaatttgtttgaccaattaaaaaattcattttaactcttcgaattttagtagttgcagtaaccgtattggaaggttttccaccagctgggggctgtgttaaacgagtgaaaaagaaagtgttgaaaatgaaaattctcgctctcctctcctgtgggacaaggctaaaaagaaattaaaaaaccaaatgagagtactgaccaatgatgaatgtatttgaggtagaaatcgatgatcgtatcattgagcatgaaattcctcgacaagtacttcagatcggcataatgcacagaacaggaatctcttccggttggtggaaatgaaaacaaagtgtcgttggaacgtttatcggacggactatctttaacctaaaatgagcaagtcctttccaccaaaaatatgacgaggccaacctccgactcattttcctcgtcgtcaatcaaatgcacttctctctcccttttgccaacctttgctgaaccgctggttgtagtttttgacattctgtgactttgcaattggggtgaaaattgcgtttgcaggtcttgcgaagtgctggggggcgtttgaatagagagaaaaggaggtgcgcttctgcagatttgagagtttccattggttggcggagcctttggcaatttgagtgaccgtggcagaaatttattaacgctcggcgattctaaacaaacaactgctaaaaaggacaattgtttaagcctaaaatttgaatatttggggttttccacaatgctcgctttacctagggacaaatattgggctactgtagtctcaccaaataccgtcggactgtgattattgagactcggcgtttgctgttcattgtataaatgatttggtacaggttcaagttggaaaagcatatcaaatgtgtcttgacttgaaataggtaattgcgtagaaagagttggagacaattgggaagcaacgacagtcgtaacggcggcagatggagaccgaagggatggaatggccaaaaacgcaggtgaagacttattgtgagaagctgaagggacaattactagagcagtacaacacataaaaaaaactattatatttcataaccaatcaaaatgaaatgctaaattattttgttttttaataccgttagcgcgtatttgaggagaagcggaagactgatgagaagtaggaacactcaaaacaaatgaagaaggcaaaggagcttaacgacggaaaaatcacataattaagtgaatatttccataaatacgtttcgatcaaccaaccattgattgtaactaccgcgctgggctgattgtgagggagaattggaagggccattacggtgtacgctggcagatgacactttggttgttgctgatgcacttgtccaacttgaactcgaagttggcattcaacattcaccggcgggtgtacattcggactgtcagaaagagtcgaaacgaccgacactcgatgagaaccaacgccattctgattgttattgtcgatcagtttgagctggcgttgtttaaagtcggatcttgcaataccttaaatgtgattatgttggtcaaagcgaaggattgtaactgaaattgaaaattacccagcaatttattcagtgttttccactgagatgaagagatcacatctaaattcagactaataacaattttgtaattagataaattaagttatatgagtgggttatcaattacagtagacacaaactgaccaataaatgtaatgggaatgtcaaaatgtttctttttgattttgttcatttgctgaataacataatttcgatggtacgcgtccgctctatgaagaatttcgtgaagacggtgaaagaatttcaactctttgttttgaatggccaacacaataaatcttgaaaatgcgactgatattgtgtaaaataaaaagacaaatagaaagaaaccaacttatccttggagttgcttgtgtagctttccaacccaaagtccgtaaagccagctccttctcggtcgatgtaagtttggatctttctcgccatgaaatcattgacgaagaggaccaaacccgctccctctccttccgaattatccaaaaactataaataataaaaagggaatatatcccattaaattttattcaagaaatcaactcaatcagaaaattttttcctcaacttcactcatttgaagtggccaatttaaatgacatacttcaactttagtaatgtgtttgaatgaaagggaaagcatcagcgtttcttttcccttgtccaatggcaatgtaacaaattcatgtgtaagttcaatttgtttagttggtgcaaaaaaatatacgccaatttccaccgatgaacagttaatctgagtcaattgaaaaaataaactattaaaagataagctaaccaatatttcttgcactgaattcgctacatccattgaaattgaaagatggaatatctaaaattcacttatttcttttttttagcaaaatttgatgatttgtgatgataaaaattaaaaaatcaaaagaaaagcaaagtcaaagttagcacaaacatttaataaaatggcgttctgtttgaataccatttggcctttaatgttgcgttggcaatttagattttcttctttcaagcacctacgttcgctttgttccaaaaaactttctgggaaaggagtgtggacatgcgatgccgataagcgccggccttatccaagaaaaatcccagcctgggtccaggtcgaactctagttattataggtatatgaactgtctaatgttatctgcctcccacataaaaaaatacgaatcgggacagtaaaatcggccaatacgtattgggtttttggtaaaccgggtttttaccataaaaacacattaagaaaacccattcatcattcataagttgtaaatatatgacttccggcgaacaaccctgctttactttaattcatgtcgcgaacgatgttgaatttccatctgagggacaattgaaggacaaatttgagcatggtaagttatctaagtgcgaaattcaaaaagtatacttaaaatatgcgtttttagaaatttgaaaaataatttgaaaaggaaaaaacaattcaggtgacacaaagacgaagacggatgcattgaaaaagttaattttgatgattcaagcgggcgagaaggtcacaagtcagctgatgatgtacgtaattcgtttttgcctgccatcatccgaccattatctgaagaaattgctgctaatcttctgggaggtcgtgccgaaggtgctttttgttttttattagtttttgcttaaaattgtcgtatcatttgttcgtaaaatttgttaagacaaatcaagagggcaaacttttgcatgaaatgattttggtctgtgacgcgtaccgcaaggatttgcaacatccaaatgagtacatccgcggttcaacattacggtatttttacaatatgcaaaaaaataccgttgttttgaattataaataaaaatctcaaaaaaagtgcgctggcgcacctccttatgcatttgtgctcctcttcgttgctttcaaatgacaccacaaaggtgtaatttgtcctgtccccgcatacaaattccgatggagggttgcatatttcattaagaaaaattaggactataaatttcagaatattgaacctttttctttcgcattcagattcctatgtaaactcaaagagcctgaattgctcgagccgcttatgccttcaatacgaaagtgtctggaacatcgtcattcttacgttcggcgcaattccattttggccatctatacaatctacagtcagtttttttaactttccgtttttgcaatccttttttaaattatttccgtttttgtcgaatgcaatcctttttcatccaaaatatcttttgattttagaaaacttcgattttctgattcccgatgcgcctgaactcattcaacaattgttagagactgagcaggacgcctcctgcaagcgtaatgcgttcattatgcttttgcatgtcgaccgacagcgggcattggattatttgtcgggttgtatcgaacaagtcgcacaattcggcgatatcctccaactcgtaattgtggaactgatttacaaagttagcaacaaaataaacaccaaattttgcttctctacacaatccttttaaggtttgccataacaatccaggagagcgcaatcgcttcattcgctgtgtgtataatttacttcagtcgcagtcgggcgctgttcgttatgaggcggccggcactttagtcacactaagcacagcgccgacggcggtgaaagcggccgccaccgcatacatcgaactgatcgtcaaggaatcggacaacaacgtcaaagtctgtcttgggttgcgaaagtggtacattttttaaatttttcagctgattgtacttgatcgactggtcggtctgcgtgagatagtgccaaacgacaaagttctgcaagagttggtcatggacatccttcgcgttttgtccaccaatgactacgaagtgcggcggaagattctgcagttagcacttgagctcgtctcttcgcgtaacgtaagtcttttcagcaatttttcaattggcctatattaagtttaggtgcatgaaatggtgatgtttttacgaaaagaaatcgacaaaacgaacaatgacacgcaggaggacaccggacgatacaggtaaaaaacgcacttttcaaaaggaattctcagtgttgtgtccgtacacaaattaattcgacccggtcaactcttaggcaaagactggtttttggaaatttattaaaattcaaaaaggtttaaaagaaatgtgaaggttcaaaattaaataagcaaagtagagttaaaaggttttagtgagtttgatcgcttcaggcagggaacctgagatgggaaaattatgggtagaatgacctgcctttcgagatgggaagagttcttaaatagtgccacaaattgagaagaaaagagcagaaggacattacataggaaagggttgaatggcaatgcgaaggaaatgcaaaattaggccaatggaaagggaatggaattggttaggatgattgacggccagagggacaaaatgggaaaaggaatcaaaaataggaaagaaacaaaaatgcttttaaatcgaaaacgcagacacctcagagatcttagtaaaaaaaacaaaaatcattttgagatgacaaaaatgaaattattcccgttattctttttaattattattttaattgccaaaattggatcagcaaagaataaactgcaacaaaaatcatttgaggaaatatttggaggaaaatgggaagaaaacttggaagaaaaaaggcaaataattgaaaaattctataaaataaaagagaaaataaagcaaaaaggaagaaaacacacagcaaaagaatggagtaaaattgaaagaaaaatagtgaaacaattggggacaaatcggaattacattcaaaaatggattaaacaatttgttctacaaaaattcaaattaaaattggagtaagccatggaacaattaaaaaatggaagaaacaatttgacattcgatatatgagaataacggagaaagaaaaaatgaaaatttattggcaaataaaaagagaaaatccgaaaatgagtgacaaagaaattgcaaaaattatgaaaattgatcaatcgagcgttttaaaatggagaaaaaaaattggagaggaaataaacgaaaaatgaaaatagttgtaaaatttaaaaattatggccttttgttgtctaccttattttatttttattttgaccacatcaatttttgtattcaccgtattcttttcattctcataatttttgtattccattcaaataaaggagtaaaaaaggttagccgacatttgcggaccgactttaccaaagcatggaagtgaaacacgtaaaaattttccttggtataaaatcctgaactgacttttatgtgtattaaaatagcgaattttttcgctaatttcactacgtgtagagaagcaagaaaaaaatttccacttgttttgggacttctaagataaaataaaattctccaattaaaacagatcgccttgcatcagcttaccttcactaatttcaatttggggagtatttaattttttgaaaattcaaaaaaaaatttttttctttattttgacagttcaatcgggaaatactggtccgtaaatgtcgatccgcaatgtggcactacggtaaaaaatgcttgtaaaatgatcatataattgctattattgctattatggccataaaactctgaaatcacgatttttaaatttaatgattataacaacttgaatatagaacgaatatgcataatcgtgtgggaaaatatgctaacaaatgctggcgttgagtgccaagatgcaaatatctacaagctctttcttatagcagaattcgaaaatcgcaaatcccgctgcaatgtaaagagcctgtcctaatcattttaatttttcaaaatttatcgaaactttaccatatagaacaagtttttaaaaacaaactttactgtcgagatcaccactgtcgaaaactaacagcaccgatggaacgacgagttgtcgaccctacactggacaacactgaactggccgctctcaaccgctaaaattgctcaatttcagaaaaataattaaaattttgtaaaaaaaaaaagaaaaaaaaatgccaccatcgatagaacacgaaaaacaattttgaaagggtgggcacaaaataagaatcattttttatttgtaaaataaatgaaggaaaaatggcgggaaaaaaaattcttctactgttcttagaacaattcttctccaaattgtttcttccattttgaaatgctttttcgactaattttcaatgtttttccaatttccatgtcattcattttcggattttctctttttattttccagtaaattttcatttttccattttttctttctccgttattnntactgcgaatgccaaagtgtttcttccatttcttaattactgaaaggctaactccaattttcttgcaaatttcggcataatttttctcccattctttttgcgaatattttctgttttgtttaaattcatttttcattacaatgaatttttgcacaattttgcgtttttgttcatcagtttttgatttgtgatatttataaagtccaatttctttaatccattcataaattttgtgtcgatttgtccccaattttttcgctattttcgaattaattttattccattcttttgttgaatattttcttcctttttgctttattttttcttttattttataatatttgccaattatttctctttttttgagttcatttcgtttttcttcttccctttcttcccatttttctccaaatattccatcaaatgacttttgttccaactttttcttttctgtttcggtttgatcaattaaagtgattaaaaataaaattaataatacacatatttgcatttttaattggcaataagtattacctaattatcaatgtataggaaatttttagcttaatgaattatttattaaatgaagaaaatgagaatttattgcttttaaatcgattacaaaaaacagtacaaacacaaaaaaatcaggacaattatccaatgaatgaatgattcatcaaaaataagaaatattttacattaatttacaataataaaaaaaatcatatttaattcatatcctcagggcaaacggaaaaataatgacatatttaaaaaattcaaattgttg

SEQ ID NO: 1626 - DNA, 2157 bp, Heterodera glycines
agaaggaaccaaaattattgtcagtagagtaagttgcatggtttgtgtttggaaagttgcgagttgttttcatatgattattaccacttttgggtgcactatttaaatcgctcagcttcatgttcaaccaaacacatcccttacacatcaccttaacgcctccaaactgatcagtttcaaaagcataattgttgttgttgctgatgttgttgtttttagtggactcgaaaagtttttgagaacagccgtaacaaagattgaaggtcagaatatatttcttacgtacaagctaccataattgagcattctcattgacgctgttattgttgctggtgttgttgttgttgttgttgttagattcttccggcatgttttgctgaacattattaaaagtattcatttttattttgcaaaaaatcttctgattaaaatgaagttttgcatcatatttgcgtgcttttatatagcgaaaatgtacagtgctgcgcgctacgtgaaagacgaagttacggtgctcttacgcacatataaaagcgcttgaatgtgcacaaaatctcacttgcgtgcaatgcatttgcttatcgcattctcgcgcattttggactgttcccctgaagaagtgggcgcgcgaatttgtgctagcgttgcggatcgagaaaaattgttgaaggaatttgcgcatcgtaagctcatcactacatactccgaccgtaatggcttcacccacacgccttctttgctggactcacggaagagggcgccgactcaatgcttgcttatggtaacctgaggcgcccctacaatgtttgcgttgtggcccattattactcgcggcaccgcattatgctaaagtacccgcaattcccatgcgttatcgagaaatgttttggtcaaagagatgatggacccttgcacaaatattacccgcttgaactggtaaaagttgtcgatgactgttttccgcctgtgtacgcgaatttgttgtctcaaaaacgtgatggctcaacgtcatcatcatcatcctcgtcatcattgccgcgaaatttcctattgtcttcttccgatgatgttgatgatgacgaccatgtttttcatccggcggccatgtttcggctagctctacgcataaaactcgattggatgcacaaaagttcattggacgcataaactgtacttgagccaaaaaaaaggggggggggacgaaaaacgaaaaatagtcatggaaagtgccgagattccgggagacgcgagagcaattcactgatggacgactcatcacaaaattctttgttttccggctcaaaatcccaattttagcagggttacgaccttttgtaaaagtatgggtatgggttaggatttcatttagacaggaaattgaaaaaaaacaggagccggatctaggtaaattcggtaaaaatccgttttttcgcgatccaattcctggcgcagtttttaaaatattcaaatttcgaacccccccctgacccggattcgaacagaaaactttcggtaatagtgccaattgtagcctccctaaacccataatccagactcgaattcaaacccaaacagaaatctcttggaataagtcgaattcttagaattggggggactggggagaaaggtcagtccaatcgccatcatccatccccctgctgcccttgtggaacctcccaaatttcctcaccctcccccgccgccctcttagttcaacaaaagcacacagcacactcatctcatcagcattggtcttgtccattctgctgctgctgctgaatgcagctgctgtgggtctcccccattcaaagcctcgctcaaagaaagatattggggggatgtaaagaacacagataaatcgcggggatatgggggatatgctaactgatggggggaaaaaaaaaatcgaaattggcactcggaatcccaagataggagcacttttccatttttacctccccctccttccctcgcccttctaccacgatttttgtttatttttttggcgttctgctatatgtaggtaagtaaataaaaaaattaaattaataaaactaaatggaggccgaaaacacaaaaaaatttacctaccaaaaagatcctagttataaaaaattttttttttcgctaacccggatgaatcatcattattatcat

SEQ ID NO: 1627 - DNA, 5692 bp, Heterodera glycines
caaaattcaaatacaacaacatttaaatggcttagtctaacattgggatcacataatcacatcaataatctcaatcaaccaatcaatcggttcacttctgctgtttctgatcaccagaaaccgtcaagaagactgaaaaattgcggcactggcggcggcagttcaatttcatggcggactcgcttcaccagcttaaaaacaaaaatgtgaaaaagtaaaaaaaaaaaatcttcagcacgacgtcatttagcgtgccgccgactcgcctcccccagtacagatcatccacccatcccaccactgctcctcccaatttcgcgcactcaaccacgcccctccccacctcttaattagcccccccccctcacctcattaattattaatcaccccccccccgggccggcggcaaagatcaaagggagaaaaaacccattaatcattttcacaccctgcgatgaaagctggacactaactacttggattaacatggaaatttgagagttcgagcttttgttcgaattcggttccttcgttcggaatttttagttttgttttcttgctgctggttcattttgtagttaataaaagcctaactgttaaaaaattaaaagtatttaaaaaagattaacaaattatttgaatgcaatttttttttgcatatccactcgtacgaaaacggcggtacgaaaatgtcccccgtacgaaaacggcggtacgaaaacgtcctggcccggaattcgtaaacaataaacaaaacgccaaaaaagtttacattgttattaagatgctttatctttttaaacagggattaattgttttacgccatttgaagaacaatattttcattgtgttattaattaatatattttaaagcatttagcacaacagaaaaatggcaaaatattatgccggccgaagaaaaaataaaaagaaggcagcaaaaggcacttcaacaatgggaaaataagtttggccaacttgccaagagatcccggacgacgggccgccaaaacatcgccggcaccgtctcccatgaggcgggccacgccaaaataacgtggcgcaacagcccaaggaaatttttaaaggtttgttcaagcatggatgtccgggtgcacttcatcacccccccccccgtttcgttttcattccccaaaaatttaaaaaaatgttggttgaacaattttttagaaaatttttgaaaaactaagcaattcatctaaattttgaacaaatggaaaatttaaatgcattttccgttattttctcatataaaatatttggggttcttgaaaaaatccctttttgattaagatgaaaattttgagctcgagagaaggctggacgatgcatagcgggccagaccccgagacttacacgcggagggaaatgaagcgccttatggtgctggcggtagcggggaaggttgccgaggtgaaggcggtcgggcattcgtccggctgggaagaggacgagaaggattggtgccgcgtcgccagaaaggtaactgaaaaatgaattgaaaatgaccagttcaaattggcaaaaccatgcgtttcggtctcaaaaaaaatttttttgtaaattttctgactcaaaactttgtttaaaaatacatggaaacaaagcgaaagtcatcactgtttcaataaaatataatttcaactatttttggattaaaaatggaaatttgttagagcttttgttcgaattcggattagaattggtcgagagggatgccgaattctcgaaacgtgtttttagaaattacaaaaaaaaaaaaaaaaaatttctgggaccagtaaaacacattgttgccgtttaattgcagcctcaagacttaaaaaagtgaaacaaaaataaataaacttataatttaagcttgccatgacgtcgacaagatgggcagagattgaaggggaggaggagaagagggcgtttgtcaagcgggaggtccggcggttagagggatgggccatgagaacggcccggaaggagttggacgccgaatggccggatgttttgcgggtaagtgccaaaaaaatacaaaaaaaaattaatgctaattaatgatgctcctaattcagctctgtgacctgctgatggaaaggaagaccgccgggccgaccgacctcagaacgtttgttcatttttgttaaagaatttaaaaaaaaatagtcaacgggaatttttttgaaaattgctgctaaaaatgagcaggccgatcaaaaaaaacaggcagacgaaggggaaggggggttaatccaggaaattcaaaaacaatgcccacctgatttttgctgccactccaaccacgacgcgttcattccagtcgttcaccaaaggacaccttaaaattttttatataaatttaattaagaatatttggcgcatcgctgtgggaacagaataatccccagcacgccgattattcgtatgaggggacggatggagaggaggatgatgaggaggaggaggagggcggtggaagagaatggggatgaggaagagggggaggaagatgaggaccagcagattgaatttgtgtttaaaaaaaaacattttgatttttttttgtttgataaatttttgttgtgttgacagaaagcttttttttcccaatcggcggtgttcggttccatgccagccaacacattttttttgaaaaccatattttaaaattttgtttttcgtttttttgcacaatcaataatttaaaaacaaaataaaaaaggacgcacaaattcagaaaaatcttttttttttactccaacccctcacactcaaaaaacttttttacccaccgcccggactcgtgtctggattccattttttcaaaattttatcagacaaaaaaacactgctgcaccttcgtattctggagagacaaagagagggggtgaacttcatttccccccgtcgtttcccccccccccgaaaaaattaaaaaaaaaatttccaaacctagaaatttttcatcaaaaaattcttagaaaattccttagtaagaaaatttcaaaaaaaattttttgaaaaagagtgcgagagagatagagagagaaaggagcagagataaagaaagtaagacagagatagaaaacgtgcgagagagggagagaaagaatttattttctgtcatttatttttgcactttctgtcgcttacctcctctgctcatctgtcttttgcctctggccaccaccagcttcagcgcggcccctagtacacattgatgaagccgttccaacgcaattccaaccgccacttgcgctcgtcgacaatctgtgccgatacaatacaaaggaatttttagaaataacgatttaccatatttcctatacccttggaaaacttagtaaaaaaaaattgatttgcattttcaaactttcttttttttttatttaaaaaaatttgtgttctctcacccctttacgcaccatttgacaccgaaaaactttttaaacaaattttcattcgttaattttatgaggaaaactaagtttttgtcaagaaaaattcaatcgctcaaaaatttaaaaaaacggagggggaatgtttttgaaccttccgtcgagttaaagccgcagaaaaaataagtaaaaacctaagaatcccatccctacttatttcacactgacatcaatggccaatttcactttgtcctcgtttttgtcgtaagagcctttgctggggtccatcagttccttaattgttcataattggccaattaagcgaattttcactcaccacaaatgaaatgaaattcgggaatccccacgttcccctgtagtgattacacgcaagacgcgctacggcgcaggcgccacttttggccagcgacaggcgcaacagttggcggtgcgcttgtgcgtgtgcctgtccgggctcagggcctaaacgtgcatggggttggtttgtcgacacattttttaaattttcagaaaaattcaataaatttgaaataaaaaaacaattgtttatgttaattgatttattgttttctccttgtatttccaagaattccttttcaatgaatgccaataattcattcaatttcaaaaaaaaatttggggagaaaggaaaacgacggccggcaaaaaatttttatttaaagaaatgcaaattttattttcctacttggatttacaaggtgcttgccgatttggtcatgtttctccatttctataaaattaaattcgtttttcaaaaaaaagtattcaattttctcgccgtatttcttttgttgtttttaaatggaaaaagtggaatccaatttaaatcaaaatgtaattaattagaaatttggttcacggcctggatttctttttgtttttgtcaggaaaaaccaggccaagtatgacatctagataaagtcctatttcgacacgaaaaacattgtttcggcaacatttcgaattgtatcggaaaagagggaagcgaagaattccataggggcacgttgtgaccaaatttttgatagaccatccattttccggggatttggaaattcattacttttgcggtgagtgtcaattgtacatattgtaattccttaattggcataattattattctcgaacccacgactaaaatgaaacttgaaaaaaaattggagtttgacttaaaattttaaggttttcttgttgagctttttttgcaggtagggggtaggtggtgggaaaaaatccacaaaaaaattatctaatattttcccatttccaaaaaaaaaattttcagacggattgcgcgcgtttctgttttcaatgaaaatagaaaattaaattaaaataacaatcaataagggaggcctctcgcaatcaccgagcccaaaattttcacaatcaattaaaaaagtataaatgattctgctggcttaaatggcgcgaaattcatataaaatttggtttttgtagcgttgtattttcttttatgtacacaaaaaatgggaaaactactgaaaattttttaaaaatgaaacctgtaagaaaaaaattgggtttgcttaattttttgagttaatctggataagaaattgaatctttgtttttttacgaaatttaatactggaatgtaaacagaggatgggtttacggtagttaccgggatggtagcataccaaccccggttcacattcactgcagatgaagggaaaccactgcatggcaaaataaatggaagtgatcccaatcccctccccccctctacccgttttgatctattttcaactttttatgcataatttgctgtccttttctttgcccatcaacaacatcataatgttgctggatcaacaaattgacaagtttttgggatacccccctatttttcgtataatttgctgactttatgcccccatccccttttacctaaatgtttttagttattatttgcaacatttccccttgctatgtcaaagggtggacgcccccccccccctcattcgcttatcggcattttcgctcccccaattttctctgtgtctgctattctcatctcttcccctctctttcacactctccatctctctccctctcacactctctcttattttccactgtctgcctctctccctctcatttattctctctctctctctcatttattctcttctctcattttgttctctgcctgcataatatatgcatggcagcatcattcgccgctgacgcccccccccctctcacttcacaca

SEQ ID NO: 1628 - DNA, 3734 bp, Heterodera glycines
tcctttcagtgctttgttccattcagctctctcctacctgtacgtcttggtcagtttgggccttccgcttcatcagctctttgacgcccctcaaatcgctgcccttttccgcttcgttcagttgcttctccaactccgtcagtcgcgcgtttgcctccgcaattgtctcttccaaggatcgttgctggtccgcttgatccaatctttggcccttttttcgtgccatttcttccagctcggcccaattgtgctccaatttctcgaggatgggtttagtttggtcgggcaatgctttcccttggcccacaatttcatcgcccttctgaaatgccattgcttccatggtcatatctccggcccctccctccctcaccctaattagtcgtgccatttctgctcggttcgcggccaactcggccacgaatgcttcgtggcgcatgatctgtcgtttgatattcggcttgctcattggcaccgtgccgtcgtctcttggctcttccgcgtgcccttccccgctgtccatcagtctccgcttctctcccatccacgcggcaagttcttccgcgtctcttcgcagtcccacaattgccaatgcgttttgcaattccgtccgtcgctccgccgccctttcccgcactctttcgaaacccttctgcacctcttttcgttggcatcgaattcgttctgccgaggcgtgccccaaactgatcaaacgattggaggcatttgcgaatgacagcaaacgctccttcaaaagcaatcagcaattggcttaatcccaaaaacaaagcttaaaccgacctcttgcgcacttattcgtgcttcgaactgttcatgagacttcagaaggttttggacgccttccactgagctaaggacgacttccaactccaagaaggccatgtgaccgcgattcaatgcttcgatccgttctgcctcccgggagaatgccttaaccaaccgtactaattgctttctttgctttcttcgctttcattcccaattttcttccccccttttctccatttcccttccgccctcattttcgacctgtaactccagcaactgcttgcattccgtttcgcgcttcacccattcgctttccaacgtccctttcgcttccgccaattcggccaatcgcttttccactccgttcgctgccccttttttcattagacgccctccgagttcttcggcataagaaaattcgtattccttcgcctgcatttggtctctgattttggcgtgccggtggaggacatcctccgcttgagaatgggccgagagaggctccaaccgaatgcaatcgctggtctttgccgtccattccaacagctcccttaatcagtgagtgagtggttggctgtaagtaagctttcagcttaatgagttatagtcatttgctatccctgctggccagtcacttcccccccctgtgactgcgtttgttgccattgccatttgtcccactatttaagtcgcccctcccctcacccatccgttcagttcagtccgtctcacctcaccgtccgctcgaatagttccctgccttggctttgttccgcctcttcgatgcaccgccgtgccttggtcagcagttgtccgtacattctgtccaattcgtccgttctctctctgatcgcctgctgctcgctttgcttctgctcctccattatttcttccgcttttcgcctgagtgcggtcattctttccccgagtggtctcaaatccttttaatgtttcggtttgtccctcccttttttttgcattccctcgcccactctttctaagttctgaaagcgtctctgtacgatttgcagtgttcgcatgtccgcttctccgcccggcttctgctccaacagtgcgctcttctccgtcagccaatttcgcatgtccgcgcattcgtcctgaaactgcgccagccgtgccgtcctctccaattcgttctgtttgccattcatcgctttttgtaattggttccacaggtgacgcatcgctttctgtgccgcgtcaatgtcctcactgcgcgagtgttcctgctcgagcagttcgtctgctgtcgcgtccaattgtcgcaattggacggagccttggccacggatttcgtcgcgtactttctgcaaaattacaatacaaataaactttttatgtacagtctcagtcagtcgatcacattgaatttgtcttccacagctcgcgatgtgttcgatggcaattggctctttcaatcgcttggcacactcctcgcgcccattgctcaaagtcttgacattcggcgaagaatttgaataatttcagcgcctcttccaatagttttctgcgtcgttcggcagttgcgcacagtcgacgatagtcggcactcagtgcctttcggcggtttttcacgacggaggcgccatcgagaaattcggcacgcgatttgggggaagggcggtgggacgaaagttggctgacggtgatctttgggcagatagtagaactaattaagagggtgggggcgcaccttctcttcatccggggccaattcgcagtaattggccggcacgtacccctccacgccatgccgtgtcagcacccgccaccagtcgcggttggtgccgtcgatcagtgccaactcctccccaccgagcacttcaatgcctttgccgttgtacgggtacagcaccttggatgcattttgcaaaagccagcgcatggtccatccgttaccagtgcctttggcacaacaatttgctcctcgagttgctccgcttccgcctgtccgtcgtccgtccgctcctccgcctttccctcgccgccctccgcacccaatgcgaattccatctcggacatgccattggccaattgttccaaccgggcaatttccgctcggtacgctccgatttccttctccaattggcgatgccgctgacaaaggcattcggccgtactctgtcaaaagcatttcgtttttctattagcactctttgccattcctcccacaatgtctcttccgatgtcgtccgagtgtgccaacggcgccttttcgcggatccaactgtccgcttcatttgcgtcttggaagaattgggccaaccgttccgcttcggtcagccaatcggtcaacgcggcgtttgtcgtccgcaactcttcccacgaccttcaaaatccgttccgtgcctttgccctccctcccttttcccaccgttgcaaagtgtcggcgcgccattgcacttcccccggcactcccaacttttccccatccgaaattagccttttggtcctttcccattggctttgcatttcagtctccaaagatttgtgcaatcgttgcgagtcgcgcaaagcagaaaggtcgcgcaattggagaagggcgaagcaggcggagaggcgatcggaaagccaaccggacaattcatcgaagtgttggacgaacttaggggaaaagcaatggccaattaagcaatgccaaaatgattaagcaatgccattacttggacgccccgttgttcatagtctcttttccattttcctacctgaaaaaactcgcgcgtcttttgcagtgccactcgccgttccctggcgtcccttcgcagctgatcgtactgcttgccgaccgcgttcagtctgagctgcaccatctccaacgccgcctctctgtggggcggctgagttttgctgctaagttcggcctttcttcgcaatttcctcagcatttcgccttttgccgataagtccgtctccgccagttcctg

SEQ ID NO: 1629 - DNA, 2869 bp, Heterodera glycines
  misc_feature (11)..(11): n is a, c, g, or t
  misc_feature (33)..(34): n is a, c, g, or t
  misc_feature (49)..(49): n is a, c, g, or t
  misc_feature (2788)..(2788): n is a, c, g, or t
  misc_feature (2839)..(2839): n is a, c, g, or t
caatcggtcancgcggcgttgtcgtcgcactcnnttcccacgacctcanaatccgtccgtgccttgccctccctcccttttcccacccttgcaaagtgtcggcgcgccattgcacttcccccggcactcccaacttttccccatccgaaattagccttttggtcctttcccattggctttgcatttcagtctccaaagatttgtgcaatcgttgcgagtcgcgcaaagcagaaaggtcgcgcaattggagaagggcgaagcaggcggagaggcgatcggaaagccaaccggacaattcatcgaagtgttggacgaacttaggggaaaagcaatggccaattaagcaatgccaaaatgattaagcaatggcccattaagcaatgccattacttggacgccccgttgttcatagtctcttttccattttcctacctgaaaaaactcgcgcgtcttttgcagtgccactcgccgttccctggcgtcccttcgcagctgatcgtactgcttgccgatcgcgttcagtctgagctgcagcatctccaacgccgcctctctgtggggcggctgagttttgctgctaagttcggcctttcttcgcaatttcctcagcatttcgccttttgccgataagtccgtctccgccagttcctgccccttcatcagttcgtccacttcggccatgtgccgtcctttttctcgaagttttagttgcgccccgagactgtccaactcctcgcccaatgtgtccaatgcctcgacgagaaggctgagctcttccaacctaagaagaggagggtccaattggccatttatggcgagtgtttgcattgatcattcccctcttctcttcactctttcatggctgcggctaaaaagtgccattttctcccaaaatggcaatgccattttcgatcagagggactcggcattgtgttcatgagaatggtcgacctgtccaactccaactcgtgctcttccaacatcgtcagaaatgcgttccatcgtccgatgatttccctttctctctgcgcaatctctgcgcttccgtggaatcgttccgcctgcagttccgcgctgagttccttcagcaactgaaagcgttccttcttgggggccgcctccgtttggatgtttcgcatcattcgcttccccgtctcaacactttgcgcattcggcgaacatttgaactgtccgaggacgacggaactgaacgaattgatcactgatcagtctgttttatcactgataattcggtcggtgccttccgccgattgctttcgctttcatttgccttttgcgcttacatttctcgaagccacgcttcccgtacatcggcctttttgtggaagagttgggcgcggtgttccaatctctcctgcctctgcaactcttcgatcagtgcgccttgccttgcgtgctccgccttttccaattcgctccacgcgccctccaaatcgtgcagaagaaacccctcggggggcgcgtaagccctgcggcgcgaagcgtttcgctttgtttggatagcgaagaaaagggcctccaactgaaaagggaaatgatgtgaatcataaaagtgccaatttttcgcaaaatgccaaaaattgcgttggtccgtccgtcactttgcccttcccttcgcacgccttttacctcgcccttttcccggtacttcggcggcttctcctcctttcggaatcggttgaattgcgccaattcgtctcgcaactccgtcaaattgttggggaagtgtcgggcggacaaccagctgatcgaccgtcgcacccaactgatcagctcgctggccaactgctcgtactcctcttgcatgccgtcctgctccaccaattctccgatcactttggccactcgccttgcgccggtcatttccgttttttgtttggcgaaaaagtggtagaacagcgacacgtaagtgatgatggacctttgggggaagttcaaactaaggccaatgccaggccagaaacttctcgtcggggtgcgacacgttcacatcttccgcgtccagcagtggcgaaatgtccaaatgcttctccgccacatcgaaggccaagttcaaattgcctaaatcacaaaggcatgcccaattcccccccccccggtccaaccgatcgtttcctgcgggttcagtgcgtcgaagtcgagcagttcgggcctgaccaacgaaagtaaacccaatgagtcgccgccccatccctttagcacctgtgcgcgtggatcagtgcgcagaaggcgagtccgctgcgccagctcgagctgaagttgtccaccttcacgttcgggtagccggccgttttgcgctggcaccacagcaaaagcgcctctttcgcgtgtttccgttcacccgattctttcgtctgcaaaaaattacatttttatggacggatcaaaagcacagaatgatcagtcacctcaatttcgatgttttcgatggtaaatcggagaatgattgtccaaattaagcccaaaatcaatctttcgtttccgtccgttatatcttccgccccaatggttttccaactaaaaaccaacagaatattcctcccaatttctgctgattaatctctctaattgttcacctgaatccgtttgtactttagaaaatccaaacatctgagaagtttttccgttgttttccgttcgttctcctttttcttttacctggttcaggttttcgatcttctgaactctcattcgtcctctggttcggttttcccaatttttctccactgataatctccagaaatctgagcaattaaatcacattttngtttttgctgttgccatcatcaccaacttcatcaagagaattccatccganaaatcgctgaaacaatcgttgatctccaga

SEQ ID NO: 1630 - DNA, 670 bp, Heterodera glycines
gcccagatttatggggagaccgaatctttcgggaatagcttccctatagcctgtactttaattatgcgttggatttctgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattatgggacggagggagcggcggatgggtgcgccatgcaaagggaggcgttcccccactgcgcgggtgtgctaaaggtcacccccccccctttgctgttgtcgtcttcgtcgtcgtccactcaccacatcagcagcagtccttcgtccgtccatcaaatgtaatgggatgggtggtgaatgaggggggaggggggcgatccggtggcgacggaatgaggcgaatgggggggggggaaggagagcggagagggagtgacaggcaaagacacctcgggggagagggagggggagggaagagattagcgcaggatcagagtggggacaatttgaatttgtttgggtgccttcacaactccgctacgattcaatcagttcaagcatttattcgttgttctgtcgtcactcgcccaagaaaactatttttagattaaatgggattggaca

SEQ ID NO: 1631 - DNA, 3136 bp, Heterodera glycines
ggaggggtccaaagccccatctgccgcattaccccccccccccccccggtcaaatgaatgagtggaaggaccctttcccgcggatttacccatttatctgttcccttagaatggaatgtgaatggcttctcttctccttcctcattatacaacattaactggaagtgagtggaattgaggaatttagtgatcagatggaaattgggatgggcgagggaaaccgttaaaagcatttaggggagggaggtccttttaaattcagtccccattaatattgtagaaaaaaaaacaactattttgttatgttgagatatgtaaattgagtgttatggatttgttgtgacaatgaatggggcggggggtaattagcataaatagtggtgatagtccgccggtggtttttgttttgtttggtccgccggcgatgtttctgttgtactttttgtcaaatgcttttcaaatgagttgcgattaatcaatcagcagaagatgaccaccccttcccttcccttcccttccattcgcttcttatcttttgacgtccgttctttccattcttcaaattcttccaaccaatcatttgaatgttttcattgaatattctcttttgaaaacaataactaattgctgtgtgttatgtttggatcgccaaaatttaaatgcattttccatttcaatgggacggataaaaatggacattttgcatgccataatatcccttaattaagggagagttgagattctccttttcaaaaacttttttagatactaaatttgtttagtttagttggaaatgacgcgagttatggctgatcaaatctattatattaatcggcagttagccccgcccaccgttcaaaacaaagaatttttcgacgcgatttcttttcccttccattcttctccccgagggtgtttgtttactgtttccctccagcagtgctcattgattttgtttaccattttcaatgaatgcaaaattttttatttatgatttttgcttacatttttgaaagattttgaataattttatttcttaattttattgaaaaatgcactaaaaactaccaaaaaatagaaccttaaaaaatgctgatttatttaattatcgtcaattatataaactctccttcgcgggattttgtgaaaattggtgaaaatttagaaccttttggtatttcggaagagaagaaaatatgtctaaatttttcaagaattttttgacccgaccttttttctcccattctttccaatgctttttactaattttactccatttgcttattgtttttgtttactttattcaatggttacaaactttttgatttgttatttttacatgcattttaaaatattttgtatttttgtattttttcatttctttgatttttttccttaccaattttgggattatctaaatctacctcctttttttcaaattttttgaagtttaaaaatcaaaaaatgtttcaatgggattttctggcatgttgaacatgagtctgacatttaatttgatcaattttaacatgaattcgatttttcaaatttcgtttttttcttccaaaaaggaataaagtattatttaagcccttttgtacgaaaaatgccaggttcgtaaatttaaactcgacttttgctcgaattaatgttcgggattcgggattaaaaattgatttgacttttaaaatttaaagaaccagggatgggccccaaaaatttttggaagtccatacttcctggggtcaaaaatttttcgtaaatcgaattccgatcccaaaaacataggaaatctgaagttaagttggaaattttttaaaatatataaaatataacaaaaaattttaaacattttaataggaaattttaaaattcttaaccaagtaaaagatgtttcaaaaatgcttttggtatatcaggttgaaaaaaaattcagtgattttcagcaaaaccttttttcatgttattttatattgttttagaacatttttgagaaagggattattttgttcaccttttttatttcagttgaaattgtacaaaaaggctaaaattcaaaaaaaaatttgaaaatttctgtctttttttgttacaaaatttcggaaatcggattttcgtgctatccttgctacgtacgttgcataagagagagagagagagagagcaagagagagagagagagagagcgagagggaaatcatcgagaggaagacaaagtgagagagaaggaagagagagagagagagcgaggagagagagagagagagagcgaggagagagagagagagggggggtgagaagcgagaaaaagggattgagagcgagagaagagaggaaaagtgagttagagggcgaggggataagagaggaaaggaggcagagagagaaaagaaaaagagagtgaggaggataaagagagagagagagaggagagaacagaggaaaagagagagagcgagcgagagggaaatcaatgagaaagcggaataaaagagggatgaaggggagacagtgagaggagagagaggaagagggagaaaggaaagagaggacagagagcgacagggagtaagagagaggggagaaagataggagatcgagaggaagacaaagtgagagagaaggaagagagagagagggggagagagatagacagaaagatagagacagagagagagaaaggggggggggtgagagaaggaaaaaaagagattgaaagcgagagataaagagagagaacgaagagagagggaggagagaagagaggaaaagtgagtgagagagggaggagataagagaggaaaggagcagagagagagagaagaaaagaagagagaggaaagaaaagagagagtgagaagggataaagtgaggagggacaaagagagagagagagagagaggagagaacagaggaaaagagagagaggagaaaatataggaaaagagagagggaggaggataaagagagagagagaggagagaacagaggaaaagagagagagtgggagagaggagagaacagaggaaaagagagagagagggaggaaataagagagaggaaagtgaaaagaaaatagagtgaggaggacatagtagagatgaggagagaagagaggaaagaagagagagagcga

SEQ ID NO: 1632 - DNA, 4080 bp, Heterodera glycines
  misc_feature (97)..(97): n is a, c, g, or t
gagaaagagagatgaggagagaagagaggaaagaagagagagagcgaaagggaaagggaaatcaatgagaaagcggaataaaaagagggatgaaggngagacagtgagaggagagagagagagagagagagaggaagaggaagaaaaagaggacagagagcgacagggagtaagagagaagggagaaagagagcagattgagagaaagacaaagtgagagagaaggaaaagagagagcgaggtagagagagatagacagcgggagagagagacagagaaagagagagagagagagggggtgagagaaggagaaaaaagggattgaaagcgagagataaggagagagaaagaggagagaagagaggaaaagtaagtgagaaggcgaggagataagagaggaaagaaaagagagaatgaggagggacgggacaaagagagagagaggagagaacagaggaaaagagagagagagagagagagaggagatacgagagaggaaagtgaaaagaaaaagagagtgaggaggagaaagagagatgaggagagataggaggaaagaagagaggaaaggataaaatgagagaaataaaagacgaaaaatatcatatatatcgttagttgaagcaatattacaaaatgtcttggtttttgagcctaaaatctgattttttggccctgatggtctgattttgaaaaattttcgatcaacccctggttaaaggataaataagtatttggaacatgccgaagccacaaaaattttcggaaatcgtaattacagcggtaaatttttgcggaacgcggaaatacttaaaaattttaataggctaaattttaaaattattaccaaataaataatgatttaaaaaatattttcggtatatttgagtgtttgtatgtgtcactgtttgaattagtgtggcgttttgtttgagttttgcgttaaaaatgagtttgaaaagagatgaaaagaaattgttttgaaaaagaagagaatataaagaaaagagacgaaaataaatagttaagaagaagaagaaggcaaaagaaatagcacagaaaaagaaggtaaaagatttctcctcctaggatgtagaggttagagggagggatggtgggaaatagtgcactgtatgactgtctgtctatgcgggcagcggcagatgggaggggcagacagtgaacagacgcgtgctgctgtggctgctgtgcagcagcagtctgttggacgcgtgcgtggtgtgtgggagggagggagtggggaaaaagagagattaagtggaaaagtaaaagaaataagagaaaagaaatgaaagggagagaacaattgaaaatttgtctcgcatctcttgcttatttacatcccattttttattttaataaaagaaagggaaatgagagtttttttatttctgttttcgcttcagtgagaattttcctatctttcttatataataaagttgagtgtgtgtatgtgtgtgtccattgtttgaatttgtgtggcgttttgtattggttttgcgttaaaaatgattttgaaaaaaaagaaatgttggttttgtttttttcattttcgttttgtcagttttgcaaaaagcagtctttaaaaatgttttctcttcttttttaataaaaaataattttatatgtttattaataataattaaatcgcattgaatgctttcaattgcatttgttaagagaaaaaaataattagtttttgttattaataaaaagcatttggaaatgaatgctcttagtacttttgtaaacaaaaagaaaatgtttttgtaaatgaattcctttgttattggattaaaattgatttgattagttatgaattaatttatgttgtgagtattgtttttgattatggcaaactcgatggaaatgttattgtttttgatattgcattgaaaaagttttgattcaagaatttgttttgaactttgaaatgaaaataatttgcattctttttatttttgttttgtaaaaaatatttgtgtattcgttcattctcattttctttaaatgtttttacttttttggtattttgttgttaaaagaatacgtttatgtttttgatgcgatgtttggttatgattttttcattttgatttttctttttacgctgaaaaagaatttcgtgatattttcgtctttgtctttgctgtggttttttgttgtttttgttgggttacgtttagataagtcgattgtttttcacacaatgttaagctgttttgaggacataatcgcgatcccatgtgggactttgttagcgtaagttattttgtttttaaaatttaattggttgttatgtaatttgaatttttaagatctgccactggtgttattactaaagtgatggaatcggagaaaaaagtcagcgttgtcttggtgtgcggatctggagaaaattttgttgttactgaatttaaacaaaattctgcgaacgctcttcaaaagtacctttcagttggaaatgtaaattgttgtcataattttaaattattttgtatgtttaaggtgctgaagcttcaatctgtcaaagcccaacgcttcaatgagaaatttgatggtcaaaaattttttcaaactccttttccgtttgagtttgttgtgacaaagcactcgaaaatttgtttggtcaagactgaagttttggtggccgagaaatttacgcagcttgtggcgggccgtttttatagtaatgcattaaataaaaatcttttaaattttctttttagaaattaagtgtgttttaacgactccgttttcattaattggagaaatgttcgctgctgttgttggcgatttctgtgggaagcgcgcggatttatttatttcgggcgaaaaactcccagaaatgtttgggcaattggacagcaaggaccagcttgaactaaaacgttgttttgtcaaaattgaaggtttttgcctaattgattttttgtttatctatgatttaattattttgtagatgagtgtatgcagcttaatgttttggcttctgatgttaatgtgtgtggatgtaaagtgacgattgatgataagttggtcactccggtcaagagaaagagtgatgaagcaattttgagtccgcaatcggctaagaaatagtgtgtttttttgtttttgtttttttttatctacacataaataagtgaatgtttatgtttgtatgtttattgtgaatttattttggatggtgtttagctagatttttgtatgaatttaaaagtgttgtcagttctatgtttgtatttgtgtgatgttttggatattaaaacgttatgtatgtgtttgtgtccgttcatttatgtggtgtattgttttgtttttatttataatgtggcttaaggatttccacaattaattgtgtttcgtaatttaatgaagttttaataagaaaatttaaaaattaacgttgaacaggtctgtttaagttcttggttagttatataatttgattattgatcaattttttttttcattgataaatcttaacatttttttctattttgttgaatttgcaattttacctttatatttattaattgtgttgttaataagcatttgttttttatatagacctaaaattacacgatattatattgcagtgatgaatttggcacaattttttgtctggtgattgagagaccggaagaatatcggagaattgcttaatttgagtcgcgttgcttgaaatgccagagaattgagtctcggtgattgattctggtgggttgagtcctggtgattggaatgctgttgggttgagtcccagtgattgaaatgctggtgggttgagtcccagtgattgaaatgctgttgggttgagtcccagtgattgaaatgctggtgggttgagtcccagtgattggaatgctgttgggttgagtcccagtgattgaaatgctggtgggttgagtcccagtgattgaaatgctggtgggttgagtgccagtgattgaaatgctggtgggttgagtgccagtgattgaaatgctggtgggttgagtgccagtgattgaaatgcagaattgagtcccagtgattgaaatgctggtgggttga

SEQ ID NO: 1633 - DNA, 1212 bp, Heterodera glycines
ttttaataaaaaaatttaaaaaattaacgttgaaccaggtttgttttaagtttttggttagttatataatttgatttttgatcaatttttttttttcattgataaatcttacatttttttttttttgttgaaatttgcaattttacctttatatttattaattgtgttgtaataagcatttgtttttatatagacctaaaattacacgatattatattgcagtgatgaatttggcacaattttttgtctggtgattgagagaccggaagaatatcggagaattgcttaatttgagtcgcgttgcttgaaatgccagagaattgagtctcggtgattgattctggtgggttgagtcctggtgattggaatgttggtgggttgagtcccagtgattgaaatgctgttggtttgagtcccagtgattgaaatgctggtgggttgagtcccagtgattgaaatgttggtgggttgagtcccagtgattgaaatgctgttgggttgagtcccgttgaagttggtgggttgagtcccagtgtttagaatgccggagatttgagtccattgtttggaatgccggagatttgagtcccagtgattgaaatgcaggagaattgagtgccagtgattggaatgttggtggattgagtgccagtgattggaatgctggtgggttgagtcccagtgattggaatgctggtgggttgagtcccagtgattgaaatgcaggagaattgagtgccagtgattggaatgctggtgggttgagtcccagtgattgaaatgcaggagaattgagtgccagtgattgaaatgcaggagcattgagtgccagtgattgaaatgcaggagaattgagtgccagtgattgaaatgttggtgggttgagtcccagtgattgaaatattggtgggttgagtcccagtgattgaaatgtaggagaattgagtcccagtgattagaatgctgttgggttgagtcccagtgattagaatgctgttgggttgagtcccagtgattgaaatgttggtgggttgagtcccagtgattgaaatgttggtgggttgagtcccagtgattgaaatgttggtgggttgagtcccagtgattgaaatgttggtgggttgagtcccagtgattgaaatgctgttgggttgagtcctggtgattggaatgttggtgggttgagtccccagtgattgaaatgcaggagaa

SEQ ID NO: 1634 - DNA, 1308 bp, Heterodera glycines
  misc_feature (44)..(44): n is a, c, g, or t
gaatttttttttatcaaaagtttctaggtatgaaaaaaaaattnagaaatttctgcggcgatattttgtctcggcgatatttcaggcaccgatatttgtcccgtctcctaaatattgtgcttttcccccacccattcgagtcaattttttcaataaaatattttttattttcaaaagatatggttttccgggtcactcattgatcagtgatcacgaatccccggcatccatttcgaccaattccggatcacagacctggagtcgaacaaaaatgcgaaaatgcaaatttttgtttttaccagtttctgtctgtgttcacgaattgcttatcattgcgtcacttttcttcatttgttttttgtttttaagttcgtcgcctgtttccttgccctcccttctgtcttatgctggtgtttctctgctgcgatctcatccaatttgctgatcaattggacggacttttggacttgcgtcaactttcgcgcggattacactgaagtgccgttggtcactttggtgagttttgaaatttggagggattttcaaggtcaggaaatcgattctgacagtcattttgaccaattccgaacctcggctcttgattcaaatggtcaaataaatttgagttttagtgaaaattaatttttgattgggtaatttgtttaaatccgattttagggttcaaattagtccaaaatggatgccaggatgagttttccgaccctgaaacctctaaaacatctttttactatttttttttttttgttttttttgcattctgaacacagttaagtgtaccccatttttaagatgctcagcatcgtcatggtgtgttcgtccgtcgtcgagatgctcttcaagaacaagcattcgctggcccttgaatgcttctacatctgccggatgtacaaacagctgcaggaacagcagaagaagaacaagtgcggaagtgccatcgtgtggacgactgaagcagagacggatggcaacgatgctggtgccaacaaattcaacatatatatatctagaataaatcaggataatctattccttccataaaatgctgtgaattcttttcattttaggccattgtcgccaccagcgtataaagaagaagaagcggatcaaagcaatgaaaaggtgtgctcgacgattcacgggcccagtgatcagcggaatgaagaagaggataatgaagaagcggatcaaagcaatgagaaagtatgcagaacgattcacgggcccagcgatcatcagcggaatgcaaaaggattatgaagaagcggatcaaagcaatgcgaaagtgtg

SEQ ID NO: 1635 - DNA, 1700 bp, Heterodera glycines
gaattacttcaaattttcagttgactaagcgagccatcggcacgggttgaaaattcttagctaatttaaaagttagcgtcaacaaacagagttagcataaattcacatttccaattaagaattcagaaaaacaaatcattgccacaatccaaatcaaattggacattgttcaaattgttgtcctccgaattttcgtctttcttccgctgaaccgccgccttctcccaaattgggtatcgcttcaatatccaaataattatcgtcttctttaatcagtgtcagggagaaatgcctaaacaacaaattggaaaacaataatcaaaggcaatttcaatcaatcaatcggtcgtttaatgaaagagtgagtagtggtccacacacctccttgaaattgttgatccattcaagctttttgggatccgaagaatgatcagcagcagagcaatccaatcgctttggttgtccgtcttttctcggcgtgtgcagccatttggacaaccgggactggtcccggtcaaaaccgggacctcggtactcagttgtcagtgttttggtcccggtcccgctctactctattttttcactaatggtactcaaattttactataaaagttccctggtttcttcttcccctcctcattccgttcattcgctcattcatttttaaccgaaattttccccgctcatttttgttgctgcaaaaatgccttcttcagcacttcggtacgtttattatttcttttttctgtcgtttcgcattttcttttgctcatttttgttgccaaaattgcaagatgaaaatttaaaaaagttccaaaaccaattttgaaggttttagcttcattggcctcaaaaaatatgaaaaattcacttattgattccctcactttgatctttgaccctttcattgattcatttgcccaattcatttttcagtttgtttgccgtgactttactgttggccagctctggaagcattctttggtccttttttgatcatgtcaaaagccttcgaactcgcaaaaaaatgtaaaaattaaacaaaaaatttaaaaattttgaaaaattcttcaatttttcagctttatctctgccgattgttggcttctggtgttcgactttctttcgccttctcaacttggctttggaattgcattgatcagccgtcgatttgacctccgagtggacgaacatttcaaaacacgcaaatggaaattgaacaaacaattgctaatccaatgggacattgaagaaaatggcacaaagaaaatgcaaattgtcgaacccaatggaaatccattgccaattccgcaagaaccgttgccgagcaaagtgatcggattcaacggacgcattaatatcatgtaaaaaatgtttagatcagcgcataggcaaacccttggcttcgggggggggctgaatttttaaaaaatcgctttttagggtgtttttttttcaattttagaatcctgtctgaattagggggggggggggggtaagagattgtttgaaattttcaataaatttgcccatttttcttgaaattttttatttttttagattggaatttattttctggcacttttcaggtacatcgatcaaagtgtgctcacttttctccgccgcttccatccttctttcgccgccgcttatacagtggatttggacattatcaccgaagacagtcgcatttggaattt

SEQ ID NO: 1636 - DNA, 2962 bp, Heterodera glycines
attttctggcatttttcaggtacatcgatcaaaatgtgctcatttttctcagccattttcaccattttttcgcctccacttatacagtggatttggacattttcaccgaagacagtcgcattttggaatttctgttgctcaacatttggccaatgttccgcgcttcaattcgtggtatcaatttgaacgccatcacttttcgtcgcatgtgccaattggccccatcaatgctcaccgattgtccagcacttcgttatgtcgattccgaggatgccatttttcccgaatttcttctgcccgatgatgacaatgcccatgcggcggatggccaagcggtggcaaaatggctgtttacgcctcttccggatggtgcgtccaagcggatgaaatgtcttgtgaatttatcggtggatcaatggacggcttctatggaacagctcagaacggtgagcatcggaacgggcaaactcagtctggccaactcagtctgagccaactttaagcgtcaatataactttttaagttgttgactgaaagaatatccaacaatcttgatatccattcgaaagctcttcacaggctcaattagtctactaaataattacagagaatgtcaaactgtaaaaaggatagaaatagatggagacaaaaaaaaacttcgaaaattctgctttttttttttgcggttttcaagcgacaatttttttttgttgtgagctgcttaatcacttcgaaatagctcagaaacatcatcttctaaacattaaaaagcttctcgattgatacccaatgtttgttaagtttggtgaacaaataaaaagaattaggtataactttttgaactttgctgattgtgtgagacgggtttggccagactgagtgccccttatattcttcctctatttaaatggtttttcaaatgatttttgtcccattttcaggcattttcaaatgcttcttcaccagtgactttccacattaacttgacgctttcgtccactttggttggctccgttgtgccattcttcatgatgaacgaagcgactggggaacaattggcactggaacaatatgacctggatgactttgagctcttccgttgcccaattgaatgggattgggaaaattggaaaaatgagtggaaagaatcgtgtgctgctcgaccgagacggattagcttttggatcagagacggcggatttgaagaggggtgaacaaccatttaattaaaatgatcaatgctttttttcctgttgttttatggggtgcactatctcaattccccctcattgtttccccccgagaaattaaaaaagaaatttcgttgctaacttagaaattgttcaagaaaaaatcttagaaagttttgattttgagccgaagttatgaataattttttgtcaaaaatttttcatttaatggttttttgactaatgtctcccagcacctttgaaacggacaggggatatgtggcacaaaaaatcaaggattgttaattggttggactcataaaatgccatttggacccataaaaattgaatgagcttaaaatacaatttaaatctttatttttcagtcttctcgaggccgcttctcctggaccgagtgatcagcagcagtagaaatgaatgaattaattgatggttaattgatgcgattatatgaccgaaatgatatgttggcactgtgccatttcaatattatattgtataatttgcttgtatgtacctatttgtcctttgcttgttttccgtaaaattcgttcatttccattttattttatgtgcatgtgtaaaatcattgtgatatgtaatcattgttaaaaaatgatttgtgataaaatggatttgatttctgaattttacaaaaccaggcgggatattcatacaaagcatcttttttctagcattatctcttccaaataaaaatctgaacaatttaaatttaatgaaaaatttgttggcgttctattttttcaaatttttaattgagcctggttttaatgacaaaaataaaattcattttcgcgttatggccattatttttggcaaacagaccattttaatctcctccatccctttcaaatcggtcaattttgttttttttttaccaaaaaaatggccaagtaattgatccatttgagccccttaaataatattgtgccgcggttgtgtgaatttgcgcgcttttattgttgattttcattttaaattttgttgcttaaaacgagaaagtcgaaaattgaaaatttttattttattttttgcttttttatgtgtatataaagacgtcaaacagaatttttcattcataataccgcaaaaatgaacaaacggtaaggaattttttaaaattccaaatttttgatttaccctaattttttccatgtttcagttggatttgtggcgacgtttggatggacattctcccatcttttaatcgtccccaacttggtctcaaaatggcattgctttccgaccgtttcgatgttttggtggacgcacattttgatggaaaaagcgaattgacaatttggaggatgatcagaattggcaaggacgaaggaccaaaagcgaaactattagtggaaattaatggctattttgtgcaatttccgatgccgaatcgtccgttgcctaacaaaattcgttttcatttccttcttattcgagtaatttgaatttttaatatatttaaagcatttttatatgtcttcgagctacgattgatcgattctgtgctcgcgatttctccgctccgaacggagccgatttgggacgagaagtggcaccgatttgacgttgtggccgatacggaaccgaggatgaacggcggatttgggatgttatggccgagtgaaatttggccacttttcgcgacgaaaccgttcgccgtttggactttgacggtggcgatgatatggcggattgcgtcaccgcacttcaccaacaattctcactga

SEQ ID NO: 1637 - DNA, 3952 bp, Heterodera glycines
caattttcatgcataactgttttgataattgtctaatcgcaaagcaatagcttagaaaaagcttctaaatagattaagctttcgaacgacaccaacaatgttggatttggtttacaaagaaaaaagttaagccaaaaacatgctggcgccgaaacgcagtggacccgggaaaaataccacctaacaaataacaaacatttaaacattttttaaaattatgcgtctctaccgcacatattagaagggtccgtggaaacagagaaagagaaattatgaaaattgctttcagaaaaaattgtcaaatttattttattgcctctttttttatggtcgtgtgaactgcaatagagccaattttcctgcattcgggccacctaggaattccttgaaattttcaaaatttttgccaaaaacttaatctgtgcttgtttaaaaaaggattttccaaatcaattacatcaatcaattgaaaaaggccaaagtgtgctaattgcagcaaaaatgaacaggcggtaaagaaatttaaaattaaccttaaaaattttaattttccattttttcccatgtttcagttggatttgtagcgacgtgtggatggacattcttccatcttttgaccatgctcaacttggcctcaaaatggcactgctttcttatcgtttcgatgcgctggtggacacgcatttcgatggcaaaacggaattgacaatttggaaatggatcacaattttcaaggacaaaggaccaaagccgagactttctgtatggattgctggcaaatttttggattttccgttgccggatcgtccgctgcccaacaatgttcgatttcagtgccttcagattgagtaatttttttcaaaattgttgtttatgttaaagcattttttattttttcagatacattgaccactctgtgctcacatttctccatgccaacaagcacatttgggacagaagtggcaccaaattgacattgtggccatacagaaccgaggatgaacagcggatttgggatgtttttatccgtgaaatttggccactttttgcgacaaacattcgccatttgagctttgctagtagcgttgatttggacaatttgcgtcttcgcacttcaccaacaattctcactgatcttgatcaattgcactcaatcgattctggtcatctgtgccccgatggaattgctgattttgatgtgctgaatccaactgctggccaagtgttgtccaaatggttgcacacgccgagcaaaaatggtcaaccgaagcgattgcgttacagtaattttccactgaatctcggatgggtcaacagcttcaaagaggtcgtctcgccagaattttcgtcaatttgtttttgttttaccaatttttgtgtgtaggcatttcgccgtgccatcacttcggtcagttaccatattcaactttatttgtttacgacaacaatgacaactgaaccatttgaattggtgaatggacggaccaatgagaagctgacactgaaaccgagcaaagaatacaatttggttatttggctgttgcaacggtgcccaattggggagacgtcgacggcgccagttaaatgggcagaccagcatgaaaattcgggtgccaatgccaatttgaacaatatcaattttagtctgtggattttcaataaaacaattgggtgagcagccaaaacagcatttgattttgtcgaaaataaaattaattaattttaggccattgtcgccaccagcggaagaagaaaacgaagaagaagcggatgaaagcaacgaaaattaaattatatttgatgaaatggtcgatctcaatttgatgcttattttctcgcagaaatgcttttgtttgattctttcgtttgaatttcaaaaccattaaaaacggtcttaatcgctgtaaaaatgatttttgaaatgagtaggaaacatagaattagggggcgcgtttgcccttttctaggctgaaaaagtgccggaattgtagtgccaaatccagcccgtgactcaacaactgtccacgctataaaaagcgctcaaacgcattttaaacgattttttattgcttaaatctagggttggtcgggaccgggaattttgggaaaaccgggacctttttggttgaataaccgggcatatatttataaaataaatccttgcagaaattgcccccctctggctatggcccctgtttttctgatccaaatgttactatcatcaattttcctaaaaattacgcctgaggcaacaaatttttggcgggttctattttctgttctgtgcccattttccatgacgtaatcaaaaatcggcggatttgcttaatagtacaccacccaacacaacacaacggcgacgatatacaactgagatccgatcagtcattcattcattaatttccacgcaaaacaatggcgcaaattcggcgcattttcgggcggccgcgggccggcgacgccgagctatttgaagggcacagcgcgaagcggtgcgcgaccctaaaatcctcttgcgccgccgccgattggcggcggagtgatgtgcggggaaggacggcacgagatggtcatttctgtccctgccatctcagtctcagcgcatgaatttcaagttgtaatccattttaatgtgtaaagttgtccaagcaacaaatcctaaaattttttgcacttaaaaattttcagtaaattctggatggatttgccaattaattgaaattttttttaaatttcgcgatcaaatttttaaaaatttcctctccccgcaacgattggcttccccactggaccaccaaattttgtaaagcctgcttcctgctgctgtcatacaattacctgcctaaactttagtgatgcttgataccaaaattttcctgagaactcaagacttaaccccgggattcgcaaccgagacgaaaaaacccaagttttttcgagtcgagactttcaagcttcttttaataaattttataaactctcaagctcctgactgaattggcttgggcagtgtgttgcattcaagctagggggacagctgcgccccatctgatcagtttccacatgaattaattaatttgccggggcgctaatgtgacccagaagaagacgaagaattaggttgaattgaactgaacaacaacaacaacaccatcgcaataacaacctacctaagttgggttgtgagctgatctcaaggttgattattggatcaaccccattaatcccggagaaaactcccgaaggtaaaatttggtggagaagcaagcatcatttggatcatttttgtgaattttgtaacattcgggttcgtttaaaactaagtttttttgtttagctgaatttatttttcgggtttttggtcttagttatagagtttttttggttatttataccctttttagtcacttaaaaaatcagtttttcttgaacaaattctctcaaaaattccaaaaaaaagtaaatttccgatggcaccagaccctaaatctcgtctataaaaattttgtaattcacatcccatttttcacaaataatttccttaaattttcgtgaggggtaccgttaaacaaactaaaaacataatgccaatgccacaattttcattttttcaaaatttgcccccacccctattaaattttccattttaaaaattcccccaacacaacaatgccttccttcttccccgaaattgatacccccccccccccccacccatccgcccaaaccgccaaggaatgaatcctttcccaaatggccaccgccgccccctccaaaaagtgtcagaaatttaggtggatttatttccttcaacaaccgccacaaatccggttttggaattacttttcatttcttccccgtacaaaagtcatttgccccccccccccgctttttcacctccggcgctggcatcggcacctcgtcttccaacatcgaaattcacccataaaag

SEQ ID NO: 1638 - DNA, 2680 bp, Heterodera glycines
ttaatcagtatgtctttgatccggatttatatgattcgtattacatcggccgattattatatgccttacttaatctgtgattgttaatttgataatcgttgctaatcagtgcactcagtccgacattgacatcatttgctgattaactttgatcagtgaaatgttattggtccttaccctgatcagcctgttgctttctgatcatggaatgattaatttttcgattttacttttatgttcagcaaaagctatccgcagatcacttcttatcagttgatcacgtgggttatcatcagaggaatcagaaaattgatcaatggcaatattcaatgctttctgctaattgatgaaccttcgtctaattatgcaatttctaaaaatctaaattttcgattttttttttgttaattcccgtttgggcctcaaaatgttatgtaaattttttcataaattatataccatataacaaaatttgtcttaaatttgatcaaatttaaagccacaaaaagcaacccagattaaaaacactaaaacaattattttcccccctaaaaaattgctgccaattatattcatcaacacctccacccaattttcatccttttttgctgccgttgttgttgttgtcgtcgttggtgttgttggcattttatttattgcccataatttcatttgcatcccgcctcgcgcagtcctccgtcgatccgtcgacggacggacgcacggacgacctgtgcgatggatgacccaattttcgcccatttttgttttatgtttttatggcgctgtgccgcccgcgcccaattcatcaatttcaatttgtccgtccgtccaccgttcacaaggcgcttcctttctctctccttcctctttttgcgtctttccgcttcttttcccccaaaattttacatccaaatgaaaaggaaatttttttgttcattttcaaagcgcaatggatcaaagttcaatgatcaatcaaaactcactttttgtatgtgaaaatgccatttttttgcatggcatttgtgtgccgtaggtgcaaaaaatgcttgtcatatgtacaatgtacaatatccgattttgctgattgaaaatgccaacttttgtttgtcataaataactgtgtgccataggaagtgaaaatgctctattttattcaatttttttttaaatttaatttttaaaatttcttcaatgcttccatcggcagcaattctcttaagcgcaccttatcaaaatgttaatttgacttattttttaataatgcctttttaatgttaaaaataaaatttacaatttttaaattattgaagcgcttaatccctttacgaaaaaatgaccaacggcgctgtggaatggccttcgcatgcgattgccgagccaattttgtttgtttaaaaattaaattaattttaatttttttatattttaagaaatgatttttattattttgtaatatgtttttaagtatttaccatgaatattttaaaaaaacttaggagcatcattgttcaaatcaattttcgcccattttttgcacaggcattggattggcatttcacgtccggccaacaaccaagcgcaagcgcgtgtgctgcacaacgcactgcacaacacggtaaaaatccaacatttaaatttgtttttttttctctaattttttcagctaaatatttcgttaataagattttcactgaaatttttgggagaaagtatcaaaaaatgataattgtcaattatttctttaattaattaattaatttttagagcactaatttgcccgcgctttcttcggttgccttcctcttggacgtgtacatgcccggccaatctgatctgctttttgcgcttttgtacgttggcgccaaattgtccctcttctgatcatttaaaaacgccaaatcgcatttcataaattgaaaatcccaaaattacggaccaaaaatatgataaatgaccaaatgtggacagaaaattgattattttgaaatcattaacatttttggcactaatgccataccaaatttgtcaaatttgcaattaattaatggggagacaaaatgctaaccccgaaaaaggttcccaagcattaattatgcttttagtctcattggcgtgacaactgcagtttgcttgctgctgttactaattgtaaggagcaacgaataaagaaataattttaaattaattaattctttaaatattttggaggttttcatttaaaataattaataatttatttatttttatttttcgggtgtttttatgtatttaaaataatttttttttattattttgtgtgtttttatttaaaaataatttaaaattaattttattttcattccaggtatttttcattttgtgcacatctcgtcggaatggcatcatcagttgtggcacttcttcttcaaatgaattcggtgtgcgtgcttcttcaattgccccgtccagcgcctcgggggtggacgcattctcaactgatgaggtaacgcaaatattttttttcaacttttatagttttttatttttatttttttcaaagtttaatatatttttcaatgtttcccgaaaattttatatttttttaatattttggttgtttaattttttcgacatattttttgttgcctaaaaatgggactgaattggtcggtttcaattttttctctagaaattaaaa

SEQ ID NO: 1639 - DNA, 10650 bp, Heterodera glycines
cctcccccgccctttctctcccttctattttttaccataggcccttcgctcactcacaaattgggtcgtgggtggcggcacaggaaagcgatgtgatgcaattgtgttgcagcgacagaacggagagtcggccgacggaggcaaacgcatggcatccgatgcgggaaatgttgttgccgtccagagaaagggagacgagcgacgcactgtgggccaacccgcgcaaatccgagtcggagatggacgtactgaaaagggagaggatggagtggcatgacggagaaaagccagtgaagaagttaaatagaaagggttgaactgaaccatcattcatcattgggaaacggacatgttattgttgtccaagtgcagcgagcgcagtgcgtccaaatcggagacggacaaatgggccaagtcggacagggaattgttgttcagaacgagccgttccagcgccacatttccgcgaatttcgacctgccaatggggaaaatgttagtttaaattgacgcggtgaaatgcgcgataaaaatggctaacaataaaattatctttaccctcgtcaaattgttgttgtccaactcgagcactttcagtgccttcaaatgcacaaaagcatccgcgtcgatggcattgagtcggttggcggtcaaagtgagcacctccaaattggtcagccctttgaaggtgttcctttgggaaaacggggacaaattgacacgcaaacaaagcgagaaaactcccaaatggactcactttgtaatccgcacaatgttgttgtgggccaagttcagcacgcgcagtttggccaacggttcgaacagtccgtcctccaaacgcacaatttggttgccggccaacaccaaccgttccaagtgggccattcgggcgaagtgcgagcggcgcaattcgaccaacttgttccagccgaggtccaactcgcgcagctcggccaagtcgacgaaggcacgttcctccaaaccctgcaaaaaaagattgacggatttgggactcaaaattggtcgaattagcagtcataaatttttattaaaaaaaaaaattcgttgcccttcaatttgacgactggaacagtgaactaattaaaaaatgccttgagaatgttgtggcgtaaactcagcccgcgaagagtccgtccgatggtggcgaaggcgccctcccgaatcagtccaactcgggaacgttcgatggtcagccgatcggcgagcagctgaaaaaagaggatttgtgaaaatgaatgggaagtggacaagctttacaatatttaatttatacaaaataaaacacaaagcaacgaaatgtacgccacaaatggctttatagttgaaatgtcatttttcgaaatccgatttaaatgcgtttggttgcagggattcactaggtatttattaatttattaccctccccccccccaatttgttgcaacgcaataaatccgctgctcataaataattaacctgcgtgaacattggcttcgggtcgttaggcaaaatgttgatcagtgagtcccaaatgtgcaagtgcggcacgcgagtgccgttcagtgtttgcaacgctcggaagacggcggtcattttgtgccgagtgcaaccgatccaaaattggtcgccgttgcccttttggtgtggcgttggcaccgttttgcccccaattggtggcggaacattcaaaatgcattggcaaacctaaaattaaaggagggggggggaataaatatttctgacgcttttcggtatttaccgacgcctcgccaggcttcacaacatttgcaaaggcaatttcaattggggcacatggactaattacaacgggggatcggcccggcgaaagtgttgtgggaacggcaccattagcaattgtcggaaaggaggtaacatttgcatttgcgctgcaaagaccgccaaacggtggggaaaggacgaacaaagaaagccaaacgaagaaaagacccatctcaatgatggaaaattggtggattaaagacattcagcagagggttagcaataagcagcaaaatatgcaatcagcagagaggaggacattcagccttggcttattagtcgaagctgcagaaaaaaaagtaatggattttatattagccatagggatttttaagtaattgatttattaaatccgcgaaattaaaattaaaattaacgatttgagaggttttatcgaaaaatatggagtttgtttttcgggtacaattaaaaaacttggggattaaagggagcctgcgatgccagtaggtgccgctggcgaaactttttaaatctcgaataatttaaaacgcaaatgttaaaatttcaaccgttcatggtgaagcggtaaacacaaaaaggagtatccttatttttcaacgcattgtagatgaagcgatattcaagaattggtaaatttggtgagcagtggggggggggggggagggcctttctctctcccgccggtgaatgttttgctgcttcccactcattcattgcctcagccgtccccgcagccaatcgtaccaggcgccgccatctttgctccctttctctctcattttgtctgcccctcccttccaccccaacactctttccttttcatttccatttttttttcaattttaggctgtttttatggtacttccgggttatgctgcccccttcaaaaaaattccaaaattcgtaatttggggttttcaaggttgctgatcacgaatatgatatttattttaacatctgatgactttttaatcatagatttgacaaaatatctatgattttagaagagtgcaaggaatgatcggaccccctccccctgcccagtttttgccaatcggcgacagaaaagcgcataaattaacacaccatcccagaaatgagctcctgtaccagaaaagatttgcatgtgtggctcagtggtttttgtaagatagtaaagggacaaagggtggtggttcgagtccgttgtgcaacatgaatattttcatttatttttgtccaaaatattaaaaaatcacgatatttgggaattatttttgaaggtttttgccaaccaaattggataatcttggtatctttcgaaagctcttgataatgagaagctttttctaagcaaatgctaagcgatttggtgtaccagagaaaagttatgaggctctaaaattttgtttttcttataacttttgaaatagagcattaacaaaaataaattcagcattaatagatgcagaatttttttctctaacgatatgcaaaatttcctatggatctaacatatagaaaagaagctaaacatagcgaagtaaatgttgtttttcctaataataaaaatattagatagtacgccaaaaggagacaaaaaattagagaaaaaagataatgtttttctctggcactctctatttattggtacacatctcgttttttgggatggtgtgttaattttacaattttcacacataaatattttttgccactgtcggaggaggcaatgttcgacgactgttgcttaacgaaattgggcggtcccagcaaacaaaatcattttaaaatcgaaaaattatccttaaagataggaagcaatttaaaacaagtaatccaacaatgatacataaaaatgtgctttttttattgcgctttcaaaaaggattacatatgtacgtttttcaaatttatttttatcaaatccttcaaatcagttgttgttgttgttcgtgaagcacgtctgaatgtgtcttttgtccggaccatcctaaatgcgtaattatacaacaattgtttttttgtttgctaaattcaaagaagcaaaggcttcgacggggggagggggtaggaaagccacgcaataaaaagacattttggccactgggtctttcaaatttacagggaaaaaattagttattacgtgactaccaatataaaccccggaaaaccgaagaatacttgtacatacttgagacaaatgacttaacattggacgcctcagtctgcaatgcacgaaccgaaagaattttgtcggaaagcactatggaccagtgatggtattccgagcccccaaaaattttcggaataggaaacccgagggtcgaaattttttcggaaacagaaaatcggaatttccgaggcccaaaaatttttcggaagtcggaattctgacttcaaaaaaccttcgggcttgaaacgtccaacgggtaaaaacgcattggtgttcaacaaaatgtttactcatcttaacaaagaattttgtctaaactcttcgagttagtcttttgcagagcgagaggaatcatttgctaaatattttgttgagcattaaatcgttttaccggttggaaggttcggcccgaaggcatttggccatttcagtcccgtgtccataacacggcccaaccgccaaaattcttcggttcgggaattacagaccgagtcgtcgagtattatatcataagccgaatttagtaagttacaagcattcttcagttttaactgagtccacccgccccaggttatgataaaattttaagcagagaactcacaaagaaaccaacaagttggccaattcggacctctccgcttgctttcatggtaactcgtctgcccgtaccgtccacatactcagccaccacttgcttaggttggccagcagcttcgtctgcttctgtaacaaaagtttaaattgaagaacccaaaaacaaacaacaaaccaataatctgaacaattcgcacttttataattggtttgctcattttgggtcgaatttatggaatagtgattatgagcgtttgtttttctgttctgcgattttgaaattgtttattatttttctttggtgttttcgttgtggaaatttttaaaaattattttgccttgaattttgcgctgacccacaaaatgtccaggccacgaaatgtccaagccacgaaatgtcctccaatagagtaaaaacccacgaaatgtccaaaatttttcaaaatttataaaaacaaaattttttagtgttttcgggtcgctgaatacgaatataacctttatattaccccttgcctaaccttagggcccatccgaataataaaaaactcaggtaatagtagggtttgtcccccccctttttcaaaaataattttttttttttgaaattcatcaaaacgtctttcctgtggttttcggggtcgctgatcacgaatatgacattcatttcgaccaatttcgaaccccggacccgaattcgaacaaaaagtcaaaatttaattttttaacaaaattcacatttatcttccaaaatcgattcaaatggatggaatggccattaactgaccgcctttcgtctccaacgcatttgtattgccgttccatccatttgaatatgagcaattttgtctaacactgggcttgacccatagagatatagtgtctaactcagctgtctgttttttcattggcgtattgttcaccattaactattaatagtgtctaactcatacagtgtctgccgtttcttcacacttattgtttttttaactttcgcttcgaaacttaattttttttataatgttaggcaatttttgtcaaaatgatgatatatgtgtgcgcaataaccgttattctaaatcgatatttctttgtttcaccaaaaaactttgcttctctcacactaagcttgagttaagaattaaaatttactcaaaatgaaagggaagcatttaaaaaaccaagtcgcagaaaatgttacacctattaaaacatcataccattttcatttttggtacccgaaacttttattttacttgttaagtatagaagggaaattatttctatactaattgttttattcatgcatcaaaaatcttttatatagtgtccatcacagttactaacaactcaaaaagcgctttagggctcccagtcatgtggtgttggggagattatttactgtggttattcagatggcaattttgtttttatagttgccaaaggactgtctaagacgcatacaaaaagcattattaattttgttttttccatgttctttgtcctttttcatgcctctgattcagccctttttgcaggtatttatcccttttatacaattttttttttcgaaatgcattaacagaaaaaaaagaaaaaataacgaaaaacaaaaaatatatagccttgaaaggaagacctttttaaatttatctcctgtgaattctttggttatcaaccgtcgagcttgtgctaatacacataagagcactttaaaaaatggaaaattccaggcaagccttgcctaactccgtagtggaccgaattctatccaaaattgtgttgcatggaagggtgaaaattatgcaaataaaatttaaaaatacaacgccgcttgcggttaacagtcaagggtttgtcaccgtaaaagattaatgataataagaaaggcaagagttagactcctacaaacaattttatgatttcttaggcttcttattcattggtaggaaataccaaccccactctaaacgacaattaaatgattgaatgcataaatttctggaaagaattaaaccgaactttaattcgattggtaggctttcttccactggacaaacaccatattttttctaaagaaaattttacaataatacaatatacgtatctgcaattttttatgttggaaatttcgaatttgataattttgtcgacgttgagtcccaattcaacaaaaagcagaagcacacgcaacaatcgtaatagtgtcactttcattcattctcccatcaatttaggttttggcttaccaaattattagtgcatcataaacttgggagttattaataactgcctttggctaataaagtcatgttgagggataaatttaattatgacatttggactaaggaatcatggaaacaaaaaattaattgactgtacaaaactgctcaaccctagctttcctgattcagaaaatgctcaaaagcatccttatttttcactttaccaatattgaaaaattgaccctaacactaaaagttaacaaggaaacatcaatcaaatgagcaaccacaagaagtggtgcttggcactttgaataaggaagctgaactctttcatattaatttattacgccaaattctgtaaatttgtggatcaagaatcataaaacttgatgactttaaaagagatgattaaattttatttcctttgggagtgcagtcatgaatgagcgaggcatggcttggcaaaaaatttgctgcatgagaaaacatctattatgccaaaattggaaatggcagtacattctaaaaaatctctgtacatcggaagcaaatcttttgtggattaatcaggtgccaaaattgaaaaatgacaaccctgacaatttccactcgaaaatatgtacattttcatttattcctcaatctaattttcatcatatcatccttattaaatatatttatgatctctatactcatctgcgcctgacaaatcagtgtaattgagctagataaaatgccagtccctggttgaaattttggttacgccacccgaaattgaaattgatcagaaaaaatgaaaattagaactttgttcttattgactgtaaagtgagttatttctatttttacaatgacattttagcagctggacttttcggtaatatttcgagctaaaatggcaggaaatacttttatattaacccgaacctaagagagattaactttggtacaaacgcattctcgggtcaccagtcatgaattgcttttcagagcatagtcaacaaaatgacagcacagactttttgtttgcactcagactcaacggcccaataattacgctacagttaagtggatacagaagaaagttactgtacagccccaatcaatttcttactaattaaaacgcaaaattatgccaaaggaattgcaagcaatcaatgcctcgcggcatgttaacttatggaaaatttaagacattctttgcgattgtagacaaaactttcaaaaaattatttagataaagatgaaataatttagtatgctgttggaagaaaaaaattaaaatttttcgtactttgcggcaaataatttcaacataactccaaacacacaaaaattcgttgagggaagagtggaatccttattaagtctagtcaacaattattaatttaaaggacaagcgcgtaattgagtttttaatagggcttattccatgtgttaacgtccctcttgggggaacagtcaaattggtggcaataaatctgccaaatagaaccaagaaattttatcaaagcattttttaaaagaataaattaatttcgttgaagatataaataaatttttgtacatttggcaattcaaatatgactaggcgcattaggagcttcttcacacctagtgctacaggtaaatgcatggcctcaacaacacgacaaatgcagtacaatactgagatggatgaaaaagcactttggagggctgttcgcggcaggagtttgagtctaaaatccaatgggtcacatcattcgggattggaattaccatttccaagtggtttctgtactcaattttttcaaaagcaaattggagtcttatcgaggaggatttaattgaatttgcgcatcaaaaaagtaaaacatgaagtttaaaaaaaatattttctaattattttacagtcaacagagaatgtagcacaagggtggaagaagcaatggctgcgcctttggaagacttcgattctttgattgacgacacggaatcagcaagcgacgacagcattaaatgtatttgaataattattttatttttaatttatcatgctttaagtcgatatttggaagcccaagtctccagggagtgtttcgatgccctcaattgtttctggcacttcacagtcgtctcatcaatcacaaattcatcttcaattagcaattcctgatttgtttatactggcccggattgttcattcaattcccgccacatctgtgtcatcggaaaggctgttctcgtaacgttccctaattttctaaggtttcgcgccccttccattttttcaaaagattgggattatttttgtccttttattgtaaagaaactttggaaatgttggaaaataattgcgaaattgccaaatgtttttaggggccaactcattgactgttagcccccgacgccgcaagcgcaactcggagatggtaaagcatatggtcgtgttgggcttgtcgctgggtgtttcgtattttgggctgacatcactgaaaaggacgcttgagaagtacctccaatactttgaccaacccgtgacaatattcggaacggctgtcttactgtatctcagcacactctacgcggtacggtagaggccatttcagagaagaaaaagccacagcggaagaagaaactgtgggcagatatgattgattgtccgtctgtctgaggcccttccccagcattttaaaaatatttagcatttaaattatgaattttggaagaattgtacggtaaagaattggacatcgaagacgtacaggaactttacattgactaccgtaagcaaattgcccaaacaaaaggtagagaagataggcgaacgaggatggaatacggtagttcgtcgaggaacgcaaggcacagtatgagaagggaggcagcagaacggagacggtagtaatttggaggaaatactgcgggaaaatgacaatgttggggacgaaatacaaacagattatgaggaggagtatttgagatatgtggaaaaagaaagaaagaaggcggaaagaagagggaaaagcataaaaaaggcaattaatctaattaaaaaataaataaaattacaaaatttatttgaaaaggaacgaattaaaggtaaggccacccgactgacaatgccggacttttatgaataaaagcaaaaggaaaaggagaagcagaggaaaaagacacacataaaaagggaatttcgatataataaatcatttaattatattccattgaaaatataaatcattgttcatcttaaagaaatattagggcatttttggctatttcaaattattacataagaatttaatgggaaaagtgaaaatttttggaatttttcacttaaaaattagagtagcccgtgtatggagccgaacatccgaatttttcagggcccgaatctgaacacggacccgatttttagaaattcaatgtcgggaacccgacccggtaggtcggtttctagacaccccgtttcagaagaaacaatacacttgaatcaatagttttggggaaatgttcttggtaccccacattctaatgattgtgattcagtgatgtttatgaaagtaaaaaaaactgtttttaataataaatcgattttgcgcttttggaattcctttaaaaataaatttatagaactcatgctagaattcacaggtggtcagatggttgtgttgttgttttcctttgggttcattccctctgtcggcaatgattaaatttcttccaatttgagccttaacgggcggtcgttgccttaattgggctgcactagcgactgattcggtggcattgataactaactttctccttctgagccgaaaagaataaattctatcatttttctaaatttgagttggcaattggcaggcaacattaagttcagttaactgagatcgtgcatttttaa

SEQ ID NO: 1640 - DNA, 1136 bp, Heterodera glycines
tttatggcatttataaggtgcccccaatttggccgcaaaattcgctggaacatttgtggcccagcccatcggccacgaattcgtccccggggcccatccgtccgggcgaccatgtggcgtcgcagtcgctccgaatcggacgtctccgccgcgactgaagcggccgaggcgactgcgagcgccgaaagcggcggcggcggctgtggcgacgcgtcggcgacaacaccagcgacggacaagccaacagcacacggtaccgctgctcaaagtgccgctcaacgaggccacccacgtgtgcgaacattgtggccaggtgattaatgctgctcaattagttaattggctcattaataaagccattaagtaaatgaaattaatgatacacaaacaattaatttgatcattaattaagcgaatatttttcttgaaacataaagatggcattggcactgtcttaaaattaatcacttatttattttatttattttttcaagaaaacaaaataaaaaattcttaggctgaaggggacgggctgtggactaaatactagatccaggaattttgaaaaagtcgggattgggatttggattggcatcaggccgagataggattaccgatacttaagtcctggttttgccgggattactggattcaattgatcaggatttgcatggttccagggcttctcaatgcatgatcggctcgccaaacacatcgccagccgtcaccgggaccgatcatcgtcaatgaacgacgagaacagtcgggtccacaaatgcacactttgcccaaagagttttggccgatcggatatgcttaccaggtgagggaatgaaattaatttttaagaaatggtaaattttttttatccgacacgccaaattttcaagaattagcaaaaatttctcaaatccgcccgggccattttggataaaaacacacacaatcattttttcttttttcttttggctgattcagattgatcagcattttttgatttacaaacgatttttctaattaaaatttggtggctcttaaataataaatttggtttgagaaaccgaaaaagttcccgaaacaactgaacaccgagagttaatcccgagactgaaaagccgggaccaatatcagcaaaa

SEQ ID NO: 1641 - DNA, 1631 bp, Heterodera glycines
tccaatttcgtttttttaaaaatatggtttcatgtcaatgtaatttatatgtatgtaattagcactttgttgctgtgttttttcattttccagatactcccagcaattcaatttcaatttcatttcgatttatgataatataattccattattatttaggtgtttctccaatatttgcttctatatttttccttaaaattattcaatcaatttgtaaaacgtggcttttattattatattttttattaaatgaaaatatatataattttttattacttttttgatatttaatatttctgtaacttttttgcttcatcccccgtcatttgatttcaattattattatttatttatttttgaatggctcgggttcgcttctgctactttttccgcttcgttacggtcactttttgcttttggtttacggtaattgttgcgcaacaacaaacacaacaagttggtttgacatctaataaatcaattttcaaatatatataaacatattaagcaatttgatcaaccgttttccgcatatttgggaggtgaattcgaaacaaacgcatggaaaacgaatggcatcaaaaatgggcagccgaccaatgctcaatcgaccggaaacaattggggacagacaaattgtaaaaaaaaaaagttaaatttaaataattatttttaataattattggggagggtaagtgcactttccgtttcaatttaatgatacggcaaacaatagcatattttaacattagtcgaggaaaattcaattaaaaattaaaagggctaaaattttgggtgacaaaaatttcgccgaaataaaaaaatcaaatctttaaatgaacaattttcagcagtgggaaatggtcagcagaatcagctgaaagggttcggcccggaattgaaagacgtcgctttggtggcgggcgacaatttgaagcgaacggcgtccaaaacgggcacattggtgaaaagggcattttcaaaccaacaaaatgggggaaaagcaggtgaaaacaaattgaagaattaatttaaaataggcaaaatgattggccaaaggcataaaaagggaaatattttgtaaatggttttggaaagtcaaaactcgaaattagacaaatttagaagggttttattataatgctttctaattaattttaatagaaataaaaacatccaaaaatgcagaattggttaaagaagcatctgaaaatgttttgaataaaagtgaagagaaatcaaaatcgaaaacggaaggatcaaagaatagcgaaaaatgggagacaaatagtgaaaacggaagaacaaatggacaaatggcaattaatgatacaaaaaaagataatgaaaatgatgaaacggaaaatgatcaaaatggtaagcaaacggaacaaagtgatcagaaaaaagaaaaatatgaacacaaagcagcagaagatgatggttcaatgattgagaaaaatgagaaatcaaagacaattggagaaggatcatcaatattttcaaattaatttgctttaggttatcagccaatcggacgacatggctcttcttctggccaaggctcgtcctctttgagcagcaacagtggagggagcagaagggcgagcagttcagcatcagcaggacgg

SEQ ID NO: 1642 - DNA, 3358 bp, Heterodera glycines
ttcttgtctatgtgtcaatgtttggctatgtgtcccaatttattttccgttatttccttattgtccggtactttaattaaaaataatttatataattaagcaaaattaatcaacgtaattaagcggcaaaaccatttcggctctgaattatttctgatgcttctgttcccatttgcttattgcgtccatttgttcatttgctattttccgcctgctgaacacggactaatggaggataattatgttgcggaaattctcggcattaatctcgacgaacaaattccgttggcagctttttcctttaatgtactgatataaaatgtacttgagcccagcctgggattttgaaagtatcggcactttggtttagacaattgacgggacctggctgctcggtcaaaaaagccgttttaccgggcgccccgatcccggtcaaaattttagcgcggcgtccggaaattttttttaattttactaaatacttgaaagtatatcaaattttcaaaaaagtcttatttttgtctttaactttgaactaaagtcaaaatgaccgggacggggctcgaatttttaccattaaatttttgtattctttagggtttacaacaaactgttggcttatgttacattatcattttgtgcacttttgcttttctcttaatgttcacattggcttatcacattaaaaagtatttggacaatgagtcaaaaatatggtaaaatttaaaataaattttaattatttttttcattttcaattttgaagcgcaacttcttattgttctttattgaccagaaaaaggattgtaatgaataaacaaatttctcggaatctcctcatccaggtttaatattcattaatttaataattgtatatatattttatttattattttctaattttttggcttttaatttattaggctttggtgcccgtcatcatttattttgacgttctttttctgctgattctttctttatttaaaattgacacaaaagggtgggaacatttgggtatgtgcaaaactcattaactttttattgcaataattttttgtccatttttaaatttatttattttacaggaaagtgctttcttaaaactgatcatcaaattagcactgtaaatgtttagaaactgcagcaaaagaaacagcatccagcaaaatgggccatcagtgttataaaaagagaaaaagtcgatttacctaattagcctctaattattttttagatttcacttatcacatacaccgttaaggcctcagaatccctgcgtaaactgggattctgatcaccttggattccgctgggggctttaaaaaaaaacgggcgcgaagcgcccgtccgaacccaataagatttaataaaacgggcgcgaaacgcccgtccaagctcaacaaaatttaaaaacgggcgtgaagcgcccgtccgagaaggaaattacgcgaaccactttatcccagctaaagaaccgactgttcacacacccgctagttatacataaatttaattttatttaaagaaaagaaataattgttgtataaatttataagaaaagattatcttttgatgaggtaagtgaattgaatgattggtgccacgttttccttttgcatttccatgtgattccaaaatgggcacttacgaaggccttttcaattgaataatataatacattaggaaatatttcaaatcattgccttttctttgctccaaaaatggcgccgttttccctttcgcttttcccttcggtttgccttttcttttcgctgctctttcccatagaatttgccgcttcctccgctgatcaacagaagagtaatttggacaagtttttcacaaaatttgcggacgaattgccaccaaatgagcgatcggcggacactttggcactgtttgccgaaatggacgaggcagacgcactgctcactgaccaaatgtcaaaagttattccgccaccgcccagcccggcacatccgacatttcaggtaagattattttgctaattttaaatgcaaattgtagcaaaagtttatcgtcaattgtccagtaaatccctttttaggtaaatattaatcataaatctaaacaaactcaaaattgctcaaaatatataaaaatacgaattaaggattcgctttcgtaatatttcccccctttagactctgtatttggacaaaaacaaaggtccaaattcagcagaaaaaaacagtgcttttcaaagtgatcccaaaagtgccgtcgttcggcgactcaaagggagcaaattgtcaaaattgcgatcgcttttcccgaggacaaaattcatgaagcaaacggaaagaattgtgaaagtgtatttgaaactgaaggacaatcccggcggggggtggggcccactcatccaaaaaatgtttggcgaaatgattttggccaagaaattgggaaagggcgacggcgcgtcattgcgcgccaattgccaattggcactcgaactgatcggagaaggggacggtgccaccgaagcaatggtcgatcagttggccaaggcgaagccgtacagcaacttttggactctgacgaaacgaacgacaaaagcgattttgtgccttttaaaaggcaatggcacggaaagtgagcgacaacggagcaccgaagacattctgagaatgctgaagacatttgcggaggacggtgaatcattgaaaatggtgcaaaaaggtggcaaaagagaggctgataaagcgggagttatacgggattcccgctaccggaagatctcaaactcccggctcccgcccccgtaaattttgacccaaatacgggagtaaaaatacactgctaagaactgagtttttttggtaaaattcatcatttttgattgaaaatctgttaaatataaagccaaaatttcaaaaacaaattttcccggcggcgcctatcggcaccgccggcttccctcctcctcctccctggtacgcaaaaagttcttttcaaaaaatacggcgcaaaaagttgtttaaattaataaagggaggcgagaatacaaaataataaattttttgttcgaataaattaaaaaataatttatttgaagcaatttgaaaaaattttctgatttcgaccttaagatctgatttttttattaaaaatattagcactagtaataaggtttctcctgctgtcgctattactcaatttcgtgctaatcaaaagtctttgccaacaaaattggcctttgatcttggtcaatttttgttttcatagtttaatatataaaattttttcattctaaatatgatttttctgcccaaaacatttgattggtcttccttttcgattacattacaattttaaaggaagggaaaaaaccgac

SEQ ID NO: 1643 - DNA, 766 bp, Heterodera glycines
cttccttttcgattacattacaattttaaggaaagggaaaaaaccgacgacgccgtcgaaaacgccaattgaccattttggtgcttttcgggattattttggcgggtgtagccatttgtgcaatgatttgcaaattatttcccaaaaaaggcagtgccgaaggatagcgatgcttttcaaaaaatgcttgttgttttcctatttttgcatgcataaagagtgatttggaattttccttaaatcatcggtcacaattttaaaaatgtttacaaaaatgaatgtatgaattgagttttggtttgacaaaactttttggaaaaagattttaaaaacgaaaaaattaataaaattaaaatttgatcaaacggtgttaaaggaaaagtaaaaatttcgatttaactttcaaaaatatacggttttagcggtcttggcaattgaatttcgaaaaaatttttcgctcaattgttgggaagaagccgggaattgatagaatcgcccaactttgtcagattcttttaggaaaaaaaaactaatttttttgacgtttttgcattttcccagacttttttgcgtgttttatgatattttagtcgactttgtggagacttttcgtgatttaaattcccatccctaaaattagtacaaataattaattcgacttcgtctagagtttgaaaaaccataaatcaatttttaaatttagcccacccccaccgaagccattagtatggctacggctacccgacttttgagggacccacgcgtt

SEQ ID NO: 1644 - DNA, 4946 bp, Heterodera glycines
tttagaaaatcttattttataggtcatgcaatggagttagctctggctaaagcagtcgtaaatttgtctactctgagataaattttaaatgttttaataaaatccctaagtgtcgggtccccaaaagtcgggtccccaaatgtcgggttccctaagtgtcgggtccccaaatgtcgagttccccaaatgtcgggttccctaagtgtcgggtccccaaatgtcgggtccccaagttgcaaatccccaaaagtcgcaccacgatggctacacctattaaaatcaggcagcgaaaattgcgcaaggccaaaaattaaatcaaataataaaaatatcgaaaattcagagcccttaataaaaaaaatcaaaaattaatttattaaaaattaaaggcataaaaagtacagtcattataaaatagatgaagcaagaaaagagtcatttaaacagaaaaaatgtatgccattcatccgtcgttagctgaaacttgttgaaagaattaaattgctaaacataagatatggcatgccaactacaattttggaaagaccaaacactttgccacatgatggtggcaatacggaaccggggtcggggtcgttttcgtacgggccgttttcgtacgagcacaagtttttggctataacttttttctttgccaaccaaatccaacattgttggtgtcattcgatagccctatgtatcctctattagcctgcaaaatttcgaaaaatttcgtaaaggttcaaaaaagttatgaccagaagaattcaaaaaaccaaattttccaacttttttggctcgaactttttttgaacttgacaaaattttttggaattttgcaggctaatagagcatctgaagagctctcgtatgataccaagattttagctataacttttttctttgtcaaccgaatccaatattgttgatatcattggaaagctctaagtgtcctctattagtatgcaaaattaaaattttgaaaaatttagtttatgttcaaaaaagttatggccagatgaattcaaaaaaccaaattttacaacttttttggccataaattggttcaaaattaacaaaatttttggaattttgcaggctaatagagcatctgaagagctctcgtatgataccaagattgttggatttggatgtcaaagaaaaaagttatagtccaaaaacatgtgctggcgcccaactgaggtagaccgtggcgatactcaaagaatatgctttgtttacacctttaatcaggcacgcatccagaacaaaaaaggtcactttaaaaaaaacaatggaatactgaggtccggcggtaccgataggggccgccgggaaaatttttgggaattttaatgagatatgataagtagaatttttaaaaatttgctcctttttcttgaaaattttaaatttttcattttggacatgacccccccccccgcctggatatggcctgcctttaattaagcattaatgggcataatgatggtaagggtgacaatgccatgccaaccaacaatgtacggaatagtacaaaaataagaatatttaaaaaaattatttaaaaaattagagaagatttaattaagatttggcaaaacattggattcattcgatgctcagctgaaatgtccgaatttgcattggttggagcacaacattttcgatgtcaattgttgcatcgtttagcaagacatttgcggccaaccccatttctttggctccattcaaaagaatccctttgaaaagtgtctgaaatgggtaattaactaattagttgattaattaattgtttttattttcattaccttcaaattaacagttgttgcttcggtctgttcttcctcatcttctcccctctggtaaatgtgctccaatctgagcagaagttgcttgttcgtcaaatgtttcagtgtcatcaaatttatattttgcggaagactttcaccaaaaaaggaaaactaaaatttaggaaaaatgcgcgcaaaagaaaaaaaattgaaaaacacaaaatttagtgagtgaatttaaatttgaatatatatttttacgccagtcttataattgtgcacaaagtcggcccaattgccgtggagtgaggtgaatgccaaaactggctgatggaacatttcaaatgcccactggcgatgtgccgcaaaggcggaaggctgtccggcaaagaacagccaatgtttggcacggatgatcagaccacggccatcttcgccctgaacaagaccattgggcaacagtacagcatacccgcttttcactaattaaagtgtaattaaaatgaaaaaaattgccggttcatccaatggttcgtccacgccccaattgtcgtcccaaaatgagcgccggtggagctgagagcatttttttaaaattaagtttaaaattcaagaaataagatcaccatgagttccaattctccgtcccttaagcttgtcccgccatgggaccgatcagtgagaatggccatttgtgtccgctcgtctctgatcatcagtcggctgtcaattgggtagtaatttgcactgatcggctccgaattcgactcaaatgagaaccattcgttgtgatttcttctggaaaattttaaacaataattatgcatgggattaagatgaatttagttctttcccaacagtcacattcatttaaaagtccccaaaatttgtgaaaaaaccattttttccctaaattaaagctaattttcatgcgggtacaccgccctatttcatttctattgaatgtttctaaaaatcatactgatctctagttgatccatttcattgcctcattagccactgttaattagttgcttcccaccctcaccttctctgcatcatttgtcgaccgtttgaatccgtccagaaaattccgttcgatttgattgatggcatttgatatttggtcacaatttccatggtcgttagattgctttaagaatattacaatttaaacacataattgatgtttattcttttttttattaaggctttactcttggtccttgtgcaatggaccaattaaatattcgaactccacgaagggtttgtccatgtaaagtcggacaatttgggagagccacggctgcacaatttgacgtgcctcgtgaacgaggtcattctgtgattaaatgtacagaaaaattaattggattcttttattatgcccttttttgtgttgctaattaagttcagttgattggattcagccgatgcgagaaaaagggggatcagcacattaagaggacgacattaaatacaattgaccaaaaaatacattaaaaaatatccttttgggcaaatttcttcaaatttgtaaatggttcaaaaatagttttaacattttgcttagacatttttttcgtttttttctttttcaaaactttataaaatcaatttaaaaatggttttaagtgtttttgatatgacattcaattttattgaattttctatgtaatttaatttgaaatttaataataatccaccattcaaattttcattaatttgtgttaaataccttaacaaattgcacctcagccgttttcaattcatttgccattttttcgtttggcctaaatttttttttacaattttaaatttgcgcatttcgccaaatattccccagcaccggctaatatttgaacttagtttccacctgaacacatatgccccggatgtctgctgctgcttttcctctccttctgcgctcctccgcccatttgcccccgtgtaaaatgcaaatttttgcgagaaatccattttgacttggccaattaaatcctcaaacgatgccaacagtccgttgccgccaaaagtgaggctaatgtactgaaaattaattttggcatcatgttcatttcaaaactcgcttttgacctgattcgaaatttggttggattgcgccccatccttaagcggcgtcgttttttgtgcgtttttctcctttgaattcgctcttttattgcttctttaattgtaaaatgcaattttgaaaaaaattgaaattatttttaacttaaattaattaattaccttttaattgattgatttaaattttaaatatatttttaaaatacaagccttttttggcgtaatgtcgtgtccacgtaaaacgcctcgtagccaagccctttgatttcggcataaaacaccaattcccattttgagggccaaaatttcctcattggtatttgataaggacgaacaaatgtcggaatgacctgaaaaatgcgaatatagttagataaatttgtccataatattagggatttactaatttaattaaccaaaattcaagattttaaatttttaagtttcaaaataatttcaattttgtttttgcctgtgctatgatgtgctgattgtttctgtccaaaacccttgcatttggtgcgtttattggcactcgaattggccctgtgtatgttttgctgttcccattgaacacgacgatcacaaactttttgttgttcctgaaaaaaaaattggaaatttttcgttaatttattttcgctttttttacacgctctccgcgcaataactgtcgttgattcgtctgcaaaatttaagtgttagcgcatccgattcatttgaattggcgttttccgaatttgttgccaatttgctgaatgcttcgttcaagatttccttgaaattaacaaatttttgtcagttaattaattattatgcattttaattatcatgccacaattaattgctaattgttttatttggttttattcacctccccaatgtcccatcccttccaaaggcgctgttcataattttgtgtcaccgcttcttttgctgttcccctgtaaaatttgtattgaactttgtaagaacgagagtctcgaacaaataaaaataaaaattaagcaataaatattcgaaaaagacaaatgttaggcttatccttacagtatatatact

SEQ ID NO: 1645 - DNA, 1492 bp, Heterodera glycines
  misc_feature (101)..(101): n is a, c, g, or t
cagtattttgatcgactcgcgcacgcttttcgcatagcacgagggcgtcgagtaaaacaggcggatgcccgtggaattggtctaaccaatagaaaaattcnaactttaaaaatgaatttaaatgcctaattaatttgtcacccctaaaaaatttaatggacgatttttgctttaatcaaaagaaattctttcgcacattcaaaatttaattttcttccttttaataaaattttgaaaaatttaataattattatccattttttaaatgccttttcaccctttcgtttgccgcattaatcaaaatgtccaaattggtgaaccatctgttggcactcccatagctgaagtcgccgcccatcgtgaacatcacgtggttgtgccgttttgtcttcgcctttcaaaatcaattaggatttaattaataattttaatttcatttcaatttaatttttgtttttatttttgcctcttccaccgccgcttctaaaaatgcgttcactttctgctcaacattaaatccctccaattttgggtcgtcaatcattggatcgtcatcacataacacatcaaaacagaagcctttcggcgccgaatatgttccactcgcaaaagcaccggtaaaaagcgaattattgcctaaaattacaataaataaataaataaaataaaataagcatatatgtatttagagggaataattgcgaaatcgattcataaaaagcaaatttaacgaaattttaaaaaaggtcattttaatattttgaaataaacaaacacaaaaaaaccttttttaaatttggctactaaggtaattaatttactgaaattaaacttgagaatttttaagtttttgcttccacagattttaccatttaattaatgtgccattttttccctattagctcttctgtttttcatgacctgtatcatctgtgctccacatcatttccaaacttttgttttcaattcgaaattttctttccaagtaatgcattcgggcaaaaagcagagcctcgtaacccatctaaaattattaaaatttattttcttaaaaataaattattgacgtaccattgagaccaaattagcgtgttctcggctgtgtccgaatgggtcaatttgccatgccactttcgggcgcccgcaaacgccttttcaaattggaaatgaatcttttttttcaaatttaaattatttttaataaattataaatacaatccaaatgttctttaccgtatttctccgacagtttgcccagtccgagtgcgtattgatccaccaattcgtagtaatgcgttgccgcctcgtcgggctgtgtccaaccgcctaacaatcgcaaaattaaattaaacaattatttctttttaattttccaaacctccaacaaattcgagttgacctgaataaatgcaaatcatttttaatttaaaattttattttagccatttgtaaatgccgtacttccttatttgcctttttttaaaacttttct

SEQ ID NO: 1646 - DNA, 6204 bp, Heterodera glycines
ttcacctcaatggaggcggtgccaaggtgtgggagccctcctaacggcacacagcacgcgtccgcgttgatgggtgccctggacacgagcaaccttggaattttggggggaaatgggatgatgggaaaatgttggaatattcaatgggtgggcagggggggggagggaatgtttattcccacaatccgtcagagagagttggagacgaatggattggaccacccccattttcgtgtaatcagaaaattttttgtattatttgaacaactgtctgtacaacaaaggtgggtaatgtgatttgaaaccgcgaaactcgaattttagatcattattcaaacaatggaattcaaaatttactctgctgaatggaatttttttcgagttaggcgtgatgacgaaaaattttccgagtttttttaattatacggcgacgaaatattccggccattcggcctgcgccatttgtgcatttcctttcccctacagaacgccgtcccaacactcaatgtaacgcaacaattgttttgttaccgtaatgacaattttccaaaaattttaaatttcaaggttttccgaaaaaaattccagaatcatcaatagttttttttcctaattttttttgaaaatatctcccttcgtactcacttgtacgctcgctgcaccacctttgtgcgtgccaccgggtccaaattgtgcagactttcgcccctgatcaggtccatttcggcaccgtccgcccgcaacgactgcagcgtgtacagcaacgtgcgcgcatgttccgagtaccgctgggcctcgccctccacaaacaaattgacattttgcagctcatcaatgaacgagtccaacgcctcgtcgctgagtttgcccacctcgaacagcgtaaccgcgtggtttttcagagtctgtttgaatttttaaaggatgaatttttttgaaaattttgtgccaaaaattgtttaaaaattggcaaaaaatgggggggggggaatttccggtggcgacaaattgtgaaaatcacaaaataatattggattcaaattgttaaaagcagcccgagaaaacttataatttttttcggctgtgtgctgtaaattgtaagaccaaaaaattaagggtctttgatttatttttcacattttactcatttttttgcgtcacaatagacagttttttgttggatttcgtctgcaaaaacataaatggtttgaaagaaaataattaagatattcgtttaccgccgacaaattgcccatcatcagaaaggcggtcagcgacgagtcgaaaatgaacgcaatgcgtttgctgcccaattctgtgacgggcgtttgctgctgctggaggacaggcgaaatgacccgaaaaaaaagatttttttagacaatttattgtacaaattaataattgcaaacagaaacagaattcgaaatttaaatgaattttttttacaaaaaatgagcaattttttcggaaattttttttaacaataaatttcaatggtttattcaaaactcactcactcgatggttttgcggtggtcctttgagcgcattttccaccgccgtcacaatgtcgtcgtcgtcgtcggtcacttcgtcggtgcccgtggcatttgtgccatcctcgccggtggtgctcaacaatgccatggacagatcagcaagctgtgcattggcactgatgacggacagttggtcagaggacggggaggccaaactggttgtgaataatgaacaatggaaattgagcgaattttcagattatgaaagatttcagcgaaacccaaccaaagaaatgcatattttacagttccggcattttttttgagtttaatcgaggcttcttcataattaagtttttttaatttcattgtcatatccccaaaattcgggcgaatcgaaaaaccagtaagtaacattggaaagcatggcattttttcttggaattaaaattcaaaaaggtcaaaccgtaccccgaactggttgtgcccgtggtgtccgcattggcatagtcccccgtggcccatgaggcatgcaggtgcacattttcaatgccggtgacgcgtttgcgcgcaaagccaagtcggcaaaaaacggaaacggcatttttcaccaagttaatgtcaattcctatggtgtcagccaactaaaaacttaaaaaaattgaggaaatataatttgtggacccaacccacctccatcactgatgtttgtccatcgatggcgacaaaaattttgtacaacaatgtctcaaaatagtcgccttggacccgattcatcacaaacccgtcaagagttggcactgaaaaaattatagaaaatcaaaaaagtggataaaaaaaaccgtatttttcaaaaaaaaattttttttttttcggagagaccaccaccataattctaatcccacaaaattttaagttatataaaaaatacaaaatcgaccagaaatgataaatgacaaaaaaagggaggaggggttgtttaatattgactcaaaaccaaaatgacgtgccaaaaacgtagtcatcagacccaattggcacttccaaatagacgaggccacggctcaacaggcgcagaacaatggctttgtccaacagaccacagcagacggaaccctcgtcaagcagtcggtcgatgatcaactgctccggcgaactgagcatcttcagaaagcattttttgattcaaaatgattaaaataaatatcaaaaaatcgaattgaaatttatggtaaaaattttttgaactccttgaaaaagtattaaaccgttttagttttcgactaatgactgcttggattttgaatttcaatgaaaccaaaattgtgatccattatatttaaacatattttttagaaattcacttttttaagaaaaattgcaaaaaaaaaatcgtaaaaaatttttgtaaattttcactcgaatgtccgcctccaaaatgcagccgaagcacagctgaaaccatggctcaatgggcgcaaaattgcacggcttttggggcagaatttcgcgcactggctttgcccgtcgaaacagtcgccggttggcccggttttggttcatcaagtcaatgtactggttgcgaccgatgcccaacatgcgcatgacgtcaactgttaatcaatcgttaaagggagtagcaaaacttgatatgaaaagctaaatttttatggaaaaacaatttaaatagactccaccaccccctattttgaaaaatttgtgacaaatgaatgaaaaatggggttacatggtatgaatttccgtcatttttgtctgaaacacacaatttttagtgcaatttaaaaaaaatttaccggcagtgaaattcgggatggaatcgtagctcttctcggcttgcatcacctctacaatcatgttcctaaacagtctttcttttgagtcataaagcgattaaaaagcgcaaaatttcttttcgggaacttaaaaatttaaaaaataattttttacaaaaaaaaaaaaatttttgaccaaaccgtacgtgtaataagtgaacggagtgatgcgaagttcgcgcaccaaaatgtccgacaaatggtaggggtaaagcatcatccgctgctgactgtagctcaacaaactgtcgtagtactcctcctgagagcgcttcacaaaacgaactaaaaaattatgttttaattgcctaatctttaaagtccgacattttgaaaaagcctgggttttctggacaaaaatcccaaaaaacgcttgacatggcatggacccaggcggggaacttgattttttggaattgatttaaaaaacaaacaaggaacaactaaaattatctaattggcaatcacattaaaacccgggttgccaaattaaattatattggactattatttcttcttcttctggtaataaagggggagcgtgtggaatgagatcagtgtttccggttggatgcccttgtgcagcgacatcacaaatgggtccaccggatggaacagcacacgggcgtaggacagtgttcggatggcactgatgcgaaagtccagccgggtgtgaaggcatttggtgcgacgactgaacagcctgaaaatgggggaacgaaatgttttggattttcaacaatttatgttcattagggctgataatgccggacagattagcaaaacacgggtgccggactcaactaatggcgaggaccagtcgaaacaaaaaattgttgaaaacgttttggcaggaacaaatgaccgattcgaaaacgaattatccagagtagctggactaagttttaatcccgggattctcaaagtgagtcattgactccaattcgggattttagcaaaaaagcatccccattcaattggcattttgtttgattaaaagcatatggcattttattgaaacaaaaaatcttaatttaatggctgatcaggagggtagcgacccgtttcggtcatattcagcaatttgtcatcgtagctgaacatatttgggtcaagatatggtgaagtgagcaaatattgcgtgttcggatagggaagagctgccaaaaaccgtcggcgaacatcggaagcgggtactgaattggtgcgcattcattaaattaatcgtacatggacaaatggattgatgtgacagaatgcccaacgaagcacagatattcgatttcttaaaaacttcgggttttcgaaccggtccggcatgccggacggactggctgatgtacggaccggtaagcagggaagactgcttgagcgcctcgtgttgggcccgttccgcaccgcaatgctccatggaagtggggaacattgtgcgcacaatgtgcccgttgcggaactgctcgttgtgccgctcgaacgcgccgaacaacgcctcggaggagcggttgaacacgccgacaatgcgccccactcgccactcgaacagcacaaacatatgctggtaatgatgatgatgatgttggtgattagcagcagcaaatgatgacgaatacgatgatgatgaagagggagggcaaaaggaggaggaagcgaattggtggtcgtcaaaatcatctgtaaaatgttttagcattaataattgaataaaaaaaattccgtaaagtatattttataataattgagtaaaatgctataaatgattatgtgcacatttgttcaattttaatcacagttataaatgcatgctaatttgaaatgataaaagatttgttaaatcgacgaaaattgacacataaaaaaatcaaaaaaaaaaaaaaccgaaaggcgggaataacaaaacaagcaattatcaaatgatattctgcgagcaacgtgaaggggactggaacccaatctccctcattttggtggccaacgccacagaccactaggacatgaaaatcgttttcgttttcccttaccgtcgcccttcggctgctccattcgaatcagcagcagctcgggcccaacaaattgcagcttgcgcattttgacatgtcgaaagaggtcgaaatggtgcaaaaactgttggacttggcccttccgttggaactctctgtacagaaaggtgagaaaacgctgacggaatgctgcaaaaaaaagagcaaaaataaattaattacattttaattaaaaaatgggaaacggaaatttgttcgaaaaatgattagattagactaaaacgggttgatcaggtgcaaagtatcggaaaatgatctcgccaacaattggtgtgcgaacaaaagagcattgacaaatgacaaattgtttttgagacgtcaaaaaagtataaaacgactaaaaatttgcacatttaatgcatttcatttcgaaataccaaaattttgggggttttcataaatggcatacattttttggaaaaagcgcgccgaagacgcttttcgaaaagcaaaaaaaaaaggtcatcggcgggccgacccccctttgcaaaatttttttccgaccccacccccccccccttttttatgtatgataaatggtcttcaaaatccattttttaggctcagattatattttttattagtgccgcaaaaatttttaaagagaattgtcaaacaaaaaaagaatgacagatgatgtatatatatacaactgccctctctcggcatttttaatttagttaaagataaatattttaatatattttcatttgctaccggtgaagcagcgctccgtccgcgcactgatcagctgtgccgccccgctgatcagctggtcgtcgggaagcacact

SEQ ID NO: 1647 - DNA, 1008 bp, Heterodera glycines
  misc_feature (942)..(942): n is a, c, g, or t
cggcagggtctcgttgttctaaaataataattgaatatgcaatgtacgaacaataggaggagtaccccctgttaaatattccatactttttcggaaaaatccaatgaaaacaaaatgaaattcaaaattttttatttcccccgaatttctttaaaaaaaaaatttaaatacattttttgggacgggccgatttgtttgttctccagggttaaccccagggatttcccggaattccgatttccgacattttttgggtcggaattacgattcccgaaaatttttggggcctcgcaattcctatttctgaaaattttggggcctcgcggaatgccatccgtgcccccctcccatctccccgacccaggcacccgcagaatggtgcggaagttggccttggactcgggcaccggcacggaggcggagacgacgaggaagcgcgagtcgggcgtgcacagggcgcactcgcgcgacaacggaccgccgagctgcgggtgaacggcgagtgggggcggcgggcgttgctctgccgccgccgccgcagcggtcgctggcgaagcgatgtgccgaaattggacggtttggcagcgcgggaaaacggcccaaaattttgtaactcttacaattatggcgtttaaaaagcaagcgcatttcaattcctatactccctcaaaaatttcaaatcagaaaattattttaaaaaaatttttaaaaacaaattttttaatggattttcaaaagtaaattctcacgatttttttttcaatttcttccatcaatatagatgtagaaaagttaaaattctgcatcaaaaacggaatcttttcaaaaaatttaaaaagatgggttaggggttcgcccaagcggaaaaggtacagcagacgcaggccgtagccataaaaggaggagggggggggggggggggcgaatggggtgggaaacccngaagattttttttgctttccgggacaaaagttaaaaaaaaacactctctcccagtgttattttaaa

SEQ ID NO: 1648 - DNA, 4682 bp, Heterodera glycines
  misc_feature (4551)..(4551): n is a, c, g, or t
ccgtcgcatttggaccactttctgctacagttggcggcgtaggttgacggaaattgtgcttttgcccgccttccgtttgcattttggcgtttcgtccgtcgtagagggaacacaaaaattaaattccttaaaaatttcattccaatgcatgccttggagaaatttcggctctaatgcactttatgagtccaatcaactgacaatacctgctttttatacaataactttattcatgctcgaacaaaccctatcgttttggtatcattcgaaagcacaaagtctaaagaaactaaaatatataaaatcttgttgaaccagcgtcatcaaaaaaactcaattcaaaaaagaaagtcaaagacaaccaattttcataagacaaaataaatacatcagagagaaaaaccacaaaacttatcaattaacaaccaacaaaaaacccaaaagaaaaatgggaagggaaaaattttaaaccaataaaatgccaatacaatttaaatataaaatcagagatcaaaatcaacttaattactacagctttttcacgtgcgtttaataagaaaataagcgtagacgacgccgagcagaagcagaaacagttgaagcgaaagcacaaccagcggggacacgcccaagtagagactctgtggcacaaacaaacaaatatatggtggacaatactcattttcctatctctttaatttaaatttgctgtggaaaaatgttgcattgatcagtgattaataccaaaatttagtaattaaaaaggagtcagcacccggtaaattattattcctttttcggtattttagcacaacatgctgccacatatatatatatatatatatttattattttttggtcgaaaaccgctacaaattcctgctttttcgccccggcattgaaaattttgaaaaataacattggagaaaaaaatttttggcccaaagagaaaaaaagccttcggattgccccctccgaattttttgtgttgttttggctacggacctgcaatcaatgcacaacaacaggaacatcaacagcaacaaacaaacccaccattccggtgttggcacaatggctgcacagtgtgaacacggcggtggtcacccacgcggagggccgtccaattttgtagcagcaccggtgaaaggcgtcccaactgcagacggtccacacaatgttgaacagtgtgagcagggcacaacccaacgcatagaacaggggaaagaacgcgtcggacgggtgcaaattgccggggacggcggtgacgccaccgtcagcagcggcagagagaagaatggccgggtcagagtgatggggctgaaattatcaatttttcgacaaaaagagcatttttttaataaatggatcaaactgaaaaatttaaaaggtattttgttgttcgacggttctgctagagcctcaaaaaaaaattttttttttgggggggggggggggtaaagtattttattatgctcaccaatggcactgcgtttggctgtgccgttgctgacgcgtccgttggttcggccatggtacgatttgcctgcacagcgcccggcaggcccacaacgccgtcgtcccaataggcggccaacacgttggccagatgaaacagtgccgcagcggtgcccatgccgaggccacagacaatggccaaaatgtgccgggacgagtacagcaagcgcatgctggacactgtgccggtgcggttcgcatcggcggccatcagtcgggccaaattgctgaatattatgagaaattacgaccggtttacattccgccgagtaaattttcccacaaatttttaatttaaataccatagggctaacctatgtcccttttaaaaataaggccatgttcgaggggttgaaaaacaaaacgcgctgcgtcccgcccaaaaacaggacaaccgtccacattaagaacgtccagtatttggaatatggaaaatttgttggtaaccaaccaaagaacttttgtttcgcttttaaactcgagttatattaattgctattccacgcgtaaaatacgtttaaaatttttgaaaacccatggttttcgcacctttgcgttttgtacaacaacaggtagaagagtgcgcgcgccacttcttggaacagaatggagaagaaaatggcgaccagcaacagatgttggccgaacacggcgaaaacgacggcggacaacagcagagaacagagccaaaagaaggcactgaaaatggggcacatttcattgttgttgtattgtgaatccgttttcacaactccggggcgatactttccaatgggaacattaaagtgccgagttttgatggaaaatgcccaaaattgaaaacccacccgagcacgaagagaatgatgcgcaacgggtcgggggcaacgaaacggcgaaaaatgaacagcgaaggcgtaaaggcgacggagaaacagcacaggacgaaggcgacacccatttgtcgtcgtttatctgtttggctggtttagctaaaaccaaattacagaaaaagtgagaaaaatttgaatttaattggaaatgaaataaatttgcacttttaaagcaacaacaattaaaatttgaaagcaacaacaattaaaatttgaacaatttaaatgatctaggaatttaatttttttattaagagtatgataatacaattttcaaagatggagagattgaagagctttcaatgatttgctaatttgtaaggtcaaaaaggagttttgtagtaaaacacatttagcaaatattcaccaggggcttaaccggagtttttttagatttaattccaaatttaaaatttttgggggcctccgattaggcccctgatatgtaccatggattataagggttgggtataaatttaggtatatttaatacatcatacaaaaatatgtctgttgaaaattggggtgtgaatttttaaattcgcatttcacggcacaacccgactagtaggcgaaccccggacaagaaaaacatggtgtacatgaataacacacattgtgaagggtagaaaattttttaaaaccgaaattttcgagagacaaaattggattttcaaaaaattagccattcgtaaatttggcaatacacaaaaaaagagagaagtcacaaaatttgcatgcaaaggatggggggcagattgtgttgagtacgtcatttttgaagaagtcaatccatccgataaaaaaaataacggaattattttttttcaattaatttttcatcgtcaaaatggcctattaactaaattggatggaaaaagcgtggcggacagacattacaattgttgtaaaatgaagaaaatatggagagaaattcttaacaggaaaaaaatgcttgacgcgtaatcaaatgtcaaaagtaaaaaaatttgatcactttttggctgttgatcaacccaatcgatcaattcaattaccaatcaatttgtgacgactgatgggcagagggagtgactgactgactgatcagttcgtcagttcaattagttcactttggcataggacggcggggagaaacgtcgacgcaaaaatttgatcacgtaaagcggaaggcaggaaatcagcgtgatcacggtggtcttggccaagaactcccaggacagcacgaattggcggtcaaaatacttgtcaaagatgatcaacgaggcgccgtacagtgtcagagaaagggcctttaaggggggggggggaatgacaattaccaagaccaaggtaaacaagggaggttttgtttacctgtgctaccagcattgcccagtgccaagtgtgcactgtcatggcgaccctaaaaagacaaatacaatatacctggggaaaagggaatgatctgcggggaaatctggggacgggacaaaatcttgccgccgaaaatttttttaatcttttcaagcctaatttttcaaaattaaacatgaaattgaacatctccaagatttgttgaacgggtacacaattcattcattcccctcacattcgtctgtccatgccaatgattcgtcgtgacttacatgatcaactcggtgatgatcaaagcggtgaaactgatggaaacaatgtgaattaagtcatcgtcaaaggcgtacagtgccccgtacattatgatggcacctgtttttcaattataaaaattaattttaaaaattacaaatggacgaacaccttggtacagactgatcagcacccaaatgcaaaatgtcttgtaggacagtgaccgacccttgcccaactctttgtacagttccggataggtcagtgcgttttttgccgtcacatccgtgtccaccaccagcgagaagacgggaagcattgtgtaagcggtggaataactgtaacaattagagtaaatgaaaatttgggagtgtaaaaaaataagaaaattccaaaattcatgggatttttgtctttgaatacctcactgtttattgctagttatacaatatattaaaaaaatacaataaacttacgcaaccatcaaaatgccctggtacagagacactgacgcgaaataaaacacgcaagagaagatggcctagaattttanaaatcgagaattaattagcctgccaattacaaaataaataaacaaaaaactatgcatatttcccaacaatagaaattttggaaaaacgaaaaataaatggcatccattttctatcaaataaacgttacgac

SEQ ID NO: 1649 - DNA, 2527 bp, Heterodera glycines
  misc_feature (2522)..(2523): n is a, c, g, or t
aatttttactttgttttttattgaataaactccaaacgtttaagctaaattaaattaatgaaaattttcacatcaaattttcttcagtcatttcaaacaattaatcattttggactaaatgatcgaatattatagaaattcagatttacgtttcacataaattttttcggcgcgctttttccaaaaaacttttggcgaagaaaggggtccggcggtgccgataggcgccgccggggaaaattttgaaaatttgagtgtaatttattaacagattttcaacaaaaaatgataaaaatgtgttaatttaaaaaaaaactatgaggaatcatattttgtcgataggaaagccatgagtatacaaaaagaaaattcaaaatattttaattactgtagaggaattgaacaatgggaaagaagaagagaaagtcaaggagactagccagtaggccatttgcacaactggcagtgttacttttaaagaatattaattattattttttaattttttcctttgactccaattttcatcactaatttttcactcagacccccattcttaccagtgcttgtttttcccaattcccggtttccctaccgggaccgggacctgagcttttcaaaacccgggaaccgggacctcggatgaccgggaattcccggcccggtcccggtcccgtggcactctagttttaatacatgtatttacatcggatacatttgaataataaaaatgttatgaattttttatttaaaaaagaaacaaaacttacgcaaccatcagaatgtccggtacagagacaccgacgcgaaataaaacacgcaggagaaaatggcctaaaaaatttttacaaattgagaattaactagcctgtcaattacaaaatagataaaaacaaaactatgcatatttcccaccattaatccaggacaaatgtaatttgaaagaaatttttaaaaaacgaaaaataaaatggcatccaatttctatccaattcgaacccacgacaaataccacctacctgcatggtggagatgattagtccgcgatgcatcacaagcaacagacgacaaatgtgatggaattgagtgatggagaagtcggccgcgagcgaggcttgttttcctggaatgggaaaaatttaaaaaatttcttttttggggggggggactactcccaaaaattggttaaaaaacgactcgtcggtaaaaaaaatctaagtaccttcgttggcatcgatgccaatgccggcgtgtgccgcttggatcattgacacgtcatttcccccgtcgccaaccgcggcaacacgggcgggccgtcggtagcgcttgagcacgttgacaatttgcgctttctgttacggtgagcagcaacagcacacaacagcggtgcacgagcagaccaactcggccaactccgcctcgtagtactgcaggcacatgttcagcgcagagccggacatcaccagtgcaacgtcacttttcctgttgtgtaacataataagattcgaacaacaagaaaaagggagagaaaatgatagaggggagatagggggagagaaacaaagagaagaaaagagcgagagaagtagagagaggcgtcgggtgagaagaagtaaaaggacaaatggggtaacagagtataggaaatgaatgaaaatagggagagaaagaatgaaagaaagggggaaaggagagagatgaaggaatgagtggaagagaaagggagagaaaaaaagggagggagggagagagagagagagagagagagaaagaggggaatgcggaggagacgagacagggagagaaaaaaaggaggaaaggagagaaaaaggaaggcgtgcaaaagacaaacagtgaaaaagtgtaccacaatttgaaaaaggcacaacaatgctaaacattgtccaccacccacttgcgcaatgcgttcagttcgttgtgtgcctcggtgcggtcccgcacttggccaaacacgtgcacattgtccgtcttggagaagaggccggacgatttggcaatgcaaattgcggtctccattttgtcaccggtcagcatccaaattttgatgcccgcgttgcgcaacagctccaacgaagtggtgacttggtccttcaaagaagggaaggggtgtaaatttgggatcgccattaaaaatgacgtatttcatgaatagccccgaagtcctaggggtgtttattcaaaaatatgtattaacaaaaaaaattacaattaaatttctgtcaatttgtttttgtataatggctggacctgcagtcgatcttcgacccctgtcaaacacaacagttgcaagtcgttttcaagccgtcgcaccaccgaagccatgtgttcagtgcggtcggtgacattcattttggcccggtgatattcccgctcaaaatcggccaattgttccgcggtcaacacttttttggccacaaccaaagtgcgaaggccttaatggagggtgaggggcaattatgaattaattattaatttaaaattaattgccttctcgtgactcnntaga

SEQ ID NO: 1650 - DNA, 2599 bp, Heterodera glycines
  misc_feature (2355)..(2355): n is a, c, g, or t
  misc_feature (2471)..(2471): n is a, c, g, or t
  misc_feature (2501)..(2501): n is a, c, g, or t
ataggggccttctttcaccggcatgtcgaactgatgacttctctatctctggctgcttttgttgtcgccgtcctttattacatttcttggtcccagtgccatttttaggctccgacgcgtcctttctcttccctccaaaatttcccggtgttttgtccaagttttggccatcaataacaaatgttttgaaaacgatcattggagaattctcgagcattgaagcgggtgagaagtctacgatttggttgctaacctcgtcgatcattttgaagcctaattgttttaaggcattcgtgccgaaaagcaaatagtagccaaaagctgattgcgcgacgaataaattgatcttcgtctctaatgctccacgccgaatgggaagacaaacaacaccgtaacacttcacttccgttccgcttatatcgataatgcggctttcagagcgggcgatgacgttcttttggcttactttatccatgatttgtgagaagaatttggctgaaattagagaaatttgggatccgctgtccagcatggcattcaacttacgtccatataccgaaactttggccgccaaaattttaccaatcgccgagctttcttacaaaaagccgcctttttcctactcattcgttgttttggaaaagaatttctcaatttcgggatggtgttccaaatttacggctccgacaaacagatttccccttttcggcagtttatcattttgctgaaagtgaaaattttgcttcatgtgtgatgctgtaaattgatgttttgattgtccttgtacgaagaatgtatttgttgtgccgtacaattccgaaaaatgtgtccgactctgccgcaattgtagcaggtgacttgcctattccaatttaaaggcgcagcgttagcccctgaaccttggtgttttgcgatttgatttcggttctcttgaaaggaacaaaattttggtggagccatacaattccgagagacgtggccattttggccgcagttatagcatgtaacccggtatgacggatttgagccaagctccggtttgggccaattatttgagcgattatttggtgcataattattggctggacccgttgagtttgtcattgggcgttgatactgttgattaggccgcagtgcacttctagcagctaactgagttgcttcagctcgtgcggcttgcgcgataaactcatcaaatgttgcgcctggtctacgcgtcatttcaagagtgatcgctaactcagtgttagacatggcccttataaagtgcatgattgaatactcgtcgtattgttgttcggttagacccggataagcacggcgaaccaatcccgaaattctgtttcacagctcatcgatactctcgttcggtcgacgccgaattcctcgcatcagttggtcaaaagacgtcaattgttttgcgtcagtgttgtccagttgtcggatgatcgctcttttaatgagctgataatcatgacggtttgcgtccacagctgaattgaaagctctctcagcctttccaaaacatttggagcgtagcgctcgcaatcgtttatcttcgggccactcttctgtagcaacatcaaattgcttgaagaaagcattcaccgaatcagaacctctgttgccgtccaggttcggaattgcgttgagtgtcatcgtgtatgaaaaaccgtcgaggcttcgaatggcctgtgccatcatgccatcgaataccagcccagggtgaagagatcggtcattctctcggaattcatttggcatatgcaatgagtcggcgtatggctgtgctcttcgcgtaattggtggtcgttgggcctcatcagagattggccttccgttttctctgcggccaatgtcctgttcgccgtgtctcgccaattctgcatttccgtcttgtagcaccttgacttgaagcagaaggcgtctaatttcattttcatccatttcaattccgttgttttcgttgtcgaattggacatttccttcatgaacaattgatgaattggtccggcgattctgctcaaagttgtgttcggtcatccctctaagcggcggcaataaaatttggcgtttcggagtccaaaagttagcaacaatgcgctaataagtcggtaccacgtcctcacttatcgcagcaatgcgttagcagtgggacgaaaatcgttgaaattcgcaacaatgcgttaaacagcagaaccgcagcaatgcgtatgttctgtccgcaacgaagaaaattgcagaaccgcaacaatgcgtttgttctggacgcttctcgaatcggcttctcctcagcagtcaaaaatcccacaatgccggcacagctaactcttcgccaggagcgccacgtgctanataatgctgtttgggtcggggcctattcactgcttttcatccacaatatttccaaagtggagacaattcactttaatttaaaatcagcaacaataaaatggggggggaaagtccgnaggataataagacaaaataacaaatacaanaagtgcactgccaacagaatgaattgaagcgaagacgggggaacttttctgctggaaaggatggcaaatatcgattacatagagagtatagacagaca

SEQ ID NO: 1651 - DNA, 2649 bp, Heterodera glycines
  misc_feature (1138)..(1139): n is a, c, g, or t
attcggctttttgtttgaattcaggtccgggattaggaattagtctaaatgggtgtcatatcatgatcagcgaccggaaatcccctgagtgactttttaaacataaaaaaccagtttttgcacattttgatctcacaaaaataattcatttgcactttgactttttcatcttcattctttattttttcgtgcaattaactttctcgtttttcagcaaaaaagctattaattatggatagaaaagcttcaacatcgaaaaggaaggagcaaacgaagaaggcgcgcaacgaacaggagaaggtatgaacggtcagacagttttttttggtagcaggggagtttgtatctcattttttgcaaaaaaaaattttagaatttttttcgtttaaacgtcttgaaaacaagtaccaggcggttttctaggtcgctgatcacgaatatggcatccatttcgcccaattcagaatcacgtacccgaattcgaacaaaaagtcgaaagttcgagtttttcaaaattcgcattattactctaaaattgattaaaacaagctaaaataagtcacatatcattgaaacatccattttgttcagattataataaaacaattttcgaccttttgttcgaatttggtttggaggtttggaataactatattcgtgatcagcgacctcgaaaaccaccacaaaattgacactttctttaaaaaaaatttccctcgcgccaccggactccaaatttttttaaagattaatcttaaaattctttaatgaccaatattgcatttacaggaagcctctgactcggaagacactgactacgaaagcgacctcaacagcaatttgacctgtgtgcgcgatggcaaatttgaagaattgctagtccgcgttcgcaatgcactgaaaaagcggaaacagccaaaaattgacagtctgcgggtaagttaacaccaatttaatatctgatcaatgtaatatataaattattaatttttttcataaaagtatttaagcttttttgggggacccgagcatttcgacactcgttttcgccgactgtttttttgacactcattttttgtgttctttttgccgcccattttcggcgcacgggtaaaactatagatggtgggcacttttnnggaagaaaaagtcgttaaaacatgtgttcggggtttttctgggtcgttgatcacgaatttgaattcattttgaccaatttcaaatccttggtccgaatttgacaaaattcgaaaactcaaagtctatttttatgtttgtatctatacatatgactattttttgacattgcaatggttttgacaacatttagcttgttttgatcaacttaagaacaaaagtaaatttttaggatgtatgattaagcagaagtaagcgattagtaaattcaaaaaagtccgaaaatattttaaaaaatgtcttcgagaggatttgaatccgagaccccattttggtggcgatcatctaacagattattgcgacaaaaattaacaaagttaaatttggttaaagaaaagaatgatcaactacctcatttagcagcatcaaagttgtttgcaaaaactttattcgatttcaaatttttggtgttatttttttattgtgattggctcgcaataaattaaacaattgaattttttaatttaagtgtatttaaatggtccaaaagtttttttaacaaattcatattttttgggcttattttttaaatatgggatttagcctaaacctgttttaaaaatttcttaatttggctctatttttcggattgataagttctcaaatttaggacatgttcaaagtgctcgaaaaattctcgaagcggacaggtaaaatatagaaaaatgaaattttatttaaaatgaatttttattaaaaaaataaaattttaatttaaaaaaatgaaattttaattaaaaaaattttaagtgtgttttgctgattatgactcacgggctgtacgacaccatctacggaattgtctgcggctccattgatacgcgcgatgctttgctggatggagacaagtgcccagcgcttaaagataaaccgaaattggtaattttggattttcaaataaatttaaaattttcttaattgatcaaaacaaaatttttacacatgtaatttatttaggtgtttgtccaggcgtgtcgtggctgtacgtttattatttttcataataaccgaagagtgcgaaaggctaaaggcgctaatgatgtgagaaggacgttcagcgcgtccttttcttgtacaaaaaatctgggaaatgaaaacgaaggagagagaaaaaggaaaaggaaatgctggcggcctttcttggaaaaaaatcgacggcatcagcactttatgtccccaaattgttaaaaaaagcaattgaatgctatataaattgtaccaaatgctgggaagttgttgtcaatctttgattattttggaaagttgcataatcaaaaataattaatattaattaataatttacactagaggtagagcggagaccgggaccaaaacacggacaactgagtacaactaggtaccgaggtcccggttttgaccgggaccgggaccagtcccgggatttttcccggatttcccagccaaatattcccggtttttcaacccgaaaag

SEQ ID NO: 1652 - DNA, 2931 bp, Heterodera glycines
tcattgaaatcaagacttatgaattgttcataaactcaaatttattttaaaaaaattcttgaatttttgcttgggacggagttggcgggacggagttggctcgggacggagttggcctgggacggagttggcgggacggagttggctgggacggagttggcgggacggagttggcctttttgtattgggacggagttggcaggacggagttggctctggacggagttggcctgggacggagttggcctgggacggagttggcgggacggagttggctgggacggagttggcgggacggagttgacccctaccgttttcgtgtgagtacctgtttaggactgaaattggtcggatttgtgcaaaacatccatgtttcgaatcccgaacccgaattcggacaaatttcttaactttttaatttttttatttcttgcggctagtatcttctacagtaatttgtcagtttggtcggatgtgcgtcaaatggaaaaaataattaaaattttatatgcacgaaaactgaccgaaatatgcgcataaatatgcaaataaattcgtgaaatatgcacaaaaaatcttaaaaattaggggtgtaaaataatttaaaaaattttattcctcataaattttatcggttgtttttgtaattgcaaatcaagaatttctcaaggcagtgaaactcagtgttttgagaaagaaattccttgaaaaatgaaaaattctttacatttgaaaactattaattaaaataaatttcagaattaaattaaataataatatgattaaatttagagtagagcgggaccgggaccaaaacacggacaactgagtacaactgagtaccgaggtcccggttttgaccgggaccgggaccagtcccgggttttttcccggttttcccagccaaaaattcccggtttttcaccccgaaaaggtcccggttaagcccaaaattcccggtcccgctctactctaattacaccgaacatgtgttttagtaatgctggaaggtcccccttttttccattaacacatggaatcattgttaggaccagaagtccaaacaacgaatgaatttataatatttttgaatatcagttattattgttctgaagaaaggagagcggattgagccgataaggtgcggctgtatgagttgaccaaactcaggggataagaattcgaaaacggtaaaaatatacagagacaatattgtctatagaacagaaccaggaatctcagatttttgcaatgtctccgcatgcgcataagattttaaaaacttggatgatccaaataatagctttaattcgctcctgttggccctggcaaaggcttgttcttttttatactgatataaagtcgggtcctcaaaagttcaaaagtcgggtactcaagtgtcaaatcctcaaatgccgcaccacgctctctctctatctcccctctctttctctttcctgcaacaacctctattagaacagcccaaaattgataaattggcattttgaccacaaaaaccggaaaaatttccaaaaaaattattttttcgcaaaattttctcgagaatattgaataaatttaaatatctaaaaatgaataaattaatgtcaaagataagcaaaagctaaaatttcgcatttcgggttattttcgcttaaaattagtaaattttagctttatcgtgttttaacttggaagccctgcttaaaaacactcaattttttgaaattttaattgaaattttaattacatttagcaaacctgaagaaatttgagaattttaccacaatttggaaaaaatagccctattataacggagtccggacaatccgtcaatggacaattcgtcagcaaattttttgagcaatgattaaaaatcttgcgaaaatgattgttaaatttaataaatataatttcttatagattcttaacatttctaattaccgtatatgctctaattatagcccatgggggattatttttcaacctcctcagaatacagaggataattagagactgcgtgattaatagagactgtgggattatttttcgactgatatcattcgccgaagggcggcttcactgttcatagacactgacatcaaggtgagaaaactgctacctatactactaaatgaaaattttctctaggcatcagttggatggctgcagaaatttctcaagaggcataatttcgtgctgcgtatgaagacatcagtttgtcagaaaccgccgtccaactatgcagaagctgtggcaaaattcatcaattttgttgaacaaagacgaaaggcgaaaaacaattttcccggcggcatctttgcgatggacgagacggccgtttggttcgattgcccggacaaccgatgcatagacatgaaaggcgcaaaagatgtaataagtttttgaaaactatttagagctatttcctcaaattatgtgacagtggtggccaccggccatgaaaaaatgcgagtgacagtgtgcctaacagcccgcagcagacataagctcaagccctatgtgttgataaacagaaagcgaccggtgccgcaaattatcaaccaatttgctggaaaattggtgatcaatttcgatggctctgtgtggatgaacgatgacacaacggaggactacctgcacaaataatcggggcaaagctgttcgttggcgaacgcctcttggtttgggatgcgtttggcagccacaagagcgagagaacgacgaaggtggtgaaaggattgggagtggaaacggtttttgtccctggcggttgcatcaaattcatccaggtaccaaagcatccttctcaatgaaattcacttttcttccctaggctcccgatgtctttcacatggtacttgactggatccaccgatcgtggcaggaaatcgccaaagaagtgatcatcaaatcatttgagggtcagtt

SEQ ID NO: 1653 - DNA, 6721 bp, Heterodera glycines
cacaaaatcgctacgaaattcctgccgtttcactgggatgttttgaattttacccagaatcgagatcgggaccccaaaaaaccatagagattttttcggcacgagaatggacaaccgaatttttgatagtcagaactcgctagggagggacacgcgagaaaaccaaaacaaattggaaaacaaagaaataatccatgcttattgttagctcagttagtaacagctagtgctgctcgagagtctcggtctcgagtctcgaggcttgtggtcaagtctcggtctcatagtccagtctcgaggtttttattatattaaaaaataggaaagattgtttcaaaagaggcggaatgtgcaattgtgccaataaaaaaaaattccaggatgccatggaacaggcgctgacgaagcacattcggtcgctggctgacttctcggcacagcagcggacggacgcaggggtgccattttacctggaaaacccggcatttgccgggttttgggggtccttgccgggtttttgccgggtttttgaagttgccgggtttttgccgggtttttgggtttttttccggctttcctattttcaattcatttatttgaattttattaaacattttgccaaaattaagagccaaatatagttttcgttaatgttcaggtttattttattgatttttgatctcattttctagtctgcagaatgtcccaaaaatctatttctgatttcatttccaaagttacatttcaacaatcatcttcaactcaaatttccagcgctgaggaagcaatttcagatttagccgtttctgtctcgagtgatgaatttggggtgatttcaacaaattgactttttacatagcaaagttcagatcacctctccaaaaaggaagaaatattcgcacaaaaagcctggaggaggaatatcaaattatgaaattcaaggcagattccatccaaaaagcaacaaaggaaatgacaaatttttttgcaaagcctgtgatctaaattacaaaatacacaaaatgggcgaaaaaataatcacggaccacatcaaaaccaccaaacaccaaaaaaatttggctgaacttaacagaagcgtgcctttgaccgattttgtcaagcaaaaatcggtagttcattttgggactcagtaattaatctaattcaatataattaaggctacagaagagaaacgttgtctcgccgcagaattaacactgcctaccattgtgcgcgattttacgcggacgcacatgaatatttgggcaattggtcacagcaattctctgagacggatgaaattattggagattgggtcatttcgagtcagagccaacaagtgaaaaagttcgaaaggcgtataggcatttctgtggggcatcaactgacgaaatggatgctttgtttggtgagatcgctgagttgaaacaaacattgaaggagctcgagggcgaccggttcaacaggaaaaacgtggacgaaaaatgggcggctattttcaaaaattggcatgcctttgttaaactcgctaatttcaatcaaattcaatgcaaatatttcatgtcccaatgctcacaattactttctttcattgccaaatttgctcaaacaggtgaaaagcggtgataaatatgttgtttaattgtttttgacgttttttacagtgaaaaattggcttaaaaaactgccgggttttttgccgggtttttgaaaatttttgccggggttttcaactggttttcgagttttcgagatggcacccctgatcagcagcgaccgccaccactacaacgacaccaaacagtacaacctgtgctgggctcccggacaatcggacagtagacaatccgacagtaaattacactaaaagataataaaatgccgtcgccgaagaggaccgattgtgccgtatcaagaaaaaaggaaaataggcaaataaattgatgagtttttgtaataaccctaaaaatcaaacgatatgaatgtgcgattaatactgtaagggtgtggaaagttcctgatcgatttcagattttttttgatcgcattcaaagatgcaacttttgacctcgcttcttcagactccattaatattgaatcattcggacaaaatgacaatgattgtttaaacgaaaataattgaagggtaaaaatgtttttattcatacaaaacaaaattgtcgcaaaaaataagaatataacagagttaattttaagactatattaataggggtaggaattttagttttgttactttatccagaaataatggtttttgacatacaaatgcgtttcaaggaaattacagaaacaggaacaacttatacaattcatcatttgtggtgaataaatggtgtgcatacatctcaacatatccaaagccggaataatttaaaaattgattcgtagataatccaattgggattacacaggcttttgaggtccaagtgcttatgtggaggatcacaaaactgcggaatcgtgaatgttcggttaagtcgcccgtttgctgctcaattgttgcgatcatcgtaccaaggtcaaacagtttgtcattttgcctgcaataaataaataaataatttttgcctttttctacaaaattgccaatttgattgttaaaataacgattttcaccgtataacagattcgatcgcatttttttttcgaaccaaaccattcgagggcaattgctgcccttgcctgggcacctgttctgtggcgtaatatcacaaagttaatcaaattaaaatgctttaaatatgcgcaataggcagatggacaacgaaaccaaaaattggagatgtaatcccagttttgcgtaacaagaacttgggacacgcatcttaacaaaatgaatattatgatgagaaaatctgcccgattcattgattcttaaaaaagaaaagttacctatcaggtaattttagcgacaaaaaattttgactatgcaattcgggattcttcgccccaacacatgatcattatttggaattcatgatacaaactccaaaatccagaaccagaaacggatcacaaatctgaactctggtttgcccaatttcgaacaccggaccataattcgaacaaaaaaatttttaatgtgcggaaaaacttcaaatgcattaagcatctatttatttgatgcaaaacaattgttaaaaaaacgcagtttgcgcgaaaatttggtctattaacgcgtattttgaaaaaatccatttaggttcgaatttgtgtgcggggttcggaattgggcaattccaagtcagattcgtaatcagcaccatcgaaaaccactggaaactgattttaagcccaaaccaaaaaagtaaaattagaaaaccccattctccaggattgacttatttttttattaaaagtaacttttttgtttataaattgcattcatatgaaattaccctagtggtcctcttgacaaaacttcattgttgatgcgatttgcagtcgtgttgtaggcgtacgggtcagtaatgtctttggtaatttcacgtttgatattccttatgacttcttctggccacgcgtcactctgcggaagaaacgaaaaattttgttaaatggtaaaaatgaaacgccagaaaaagatatgaaatttttataatttttaaataaattctcattttaattactttgaggactaagacaaaaaaaaaaaattttttggtagtttctgtttggaaacaaggaaaattaaagattttgaaagatttaccagaaatttaaaatcaaatatatttaaaactattaataattttattaaattcaataaataagacttactaattctttaccaatccactgtgacatattgccagtgatgtctcgtacatatgagccaagttcatcaagctgctctttaacttgttctgccgcaccagagaaactcaaattggcacaaaagcctccaatcaatgcctgaagaatgggttttacatattataaaagcccaaaatttgatgcatttatgtttgaaatgtttaggtggctttttataatttacttcaaaatttttagaaagtgttccaaattgtaaaaacactatggctcaatcagggctgtacgaaaactttaaaaaaaatttcgtaaacgaaaacgaaacaaaaaagtgccaaaaaggtgagacaaaacgaaatttcgtttagcccttggcccaatgacagtctcgcaaattttgcctaaatttaaatttcaaacatttttctgcaaattaccattacccattctaaatttaatgaaacgaaatataaaaaaacattttaaaccgtttttctcaaatacttttccgcaagctactgtaaattatggaattcaaccaaagatcaacaaaactgacatttttaatgcaaaccgttaacctaacaatcaaattttccgttttcttacagtttcaatgacgtctattgtgactgactcggacaaacgcagcaattcgttcctttttgcggcataactctcgtaaacgcttcgaagaaggcaactgcaaaaagtgacaattaaatagtttttaaatttcaaaggaaatttatattgttaataattacacgtcagaaaacggtccagggacaacggcgaaaattgatctgatcaattcatccaaatcgaaatcaggtccgtccttttttgtgaacactaaaatgaaattatttaaaacaagttacaaataatttgcatataaaatgaaaataattttattctaaatttatttaggcttacattcgcggaggtctgctagagtttcatttgcttgacccaaagataaactctcaaaactttcgagcaccactaaaatgtaaaaatacttgaaaaatacattaaaattgaataattttgaaatcagtatccgatttcattataccataaaaaaaattttaaaatatttttcgtttgttattttaagaaaactattaaattatcactcatccaaatattacgtacctatgtatgttgtaaaaaaattttcatatgatgttgcatatttttgatcattgataatgacgaacacctcatcgaagacggacttcacttcgctgatgattggcagcatttctctcgttttttgctttttgcaattgatgttgactttcgtattgatgaactgaaagtttggcaaattatttctcaattattcttcaaacttttcaatttatgtttatttctgacttagttaaattaaaaaccaaaattaattgttttgttttttgtatgaatttacttccaaaatatccaacggcgtaaactgccaacgggtacacgccgcgacaaattgttctttgtgcgtttttgttttcgcgggattaatcacttttttaaatattttggtcaagcgggctagcgggacattgacaacctgttaaagtgtcacttttttgctcaatgggttacggtacgtaatttgaaacaaatactgtgtcgtaatgattcaagtcttgggcagatcttagtgaactcaatgctccctcaatgaatctgccttgagcttcgaattttctgtcaatgtgctgatgtaaaaatgcaagagacttcagaacagggtgttcgggctaaaaaaatcaaaatcaaattcattttccaacttcaaatttaaatgtaaataccatcaataagtaaagttaatttaatcactataaatttatttttgatttaattaattttctcaccgggaaaaccgtctcagcaaaagcagcaagaatgctgccagctggtcctgtgagctttaggaaattttttgctttttcacttattttgccgagatgagccaaggtgtcaaaagaagcgccggacaaaatgttgtactcagttgtaacacggcgcataatgaccattgctgaacgtataaaagagatgataaattgaaattatacacatcctactgtaattcttcaatgcccgtatccggaggtgggggaggatggtgccccctcccgcccccgcttgaaaagaaaaatgaaaaaaatttcaagaaaaattggtataaaatttaattttcttatcacatttcttaaattttcaaaaaatttcccggcgatgcctatcggcaacaccggacggactccattgtacagtttggccccagaatgataaaaatttgtcatttttcaaaaaccaaaaaaactgacgatcttcgctgttggtgtttggtgaaaagaacagcacgagaatgaagagcaaaaaagcctcgaaaattttctgaaatttcaaatcattgaatttttaaaaaattaatattatccactaaatttcaaattctttttttttaaattttcaatgtgtgtattctctaaccctcatgactgttatttgcttctctgctccacggcaggaaaatgtagtggatttgtggattctgtatttgaaatcaaatgtatatattaaataacaaatttgtttattcattaatatatctttattatttatccatttaaaattataaattatgtaaattggctgagtctcatgtaaaaataataacacaaccgccggagcttggcttctttcggatgttgaagccagccagaaaatttaatcaaatgaatttaccctaagaatgctaagtaacaaacgaaattattattaattaaatttatatcaactttattttattctttaatgttttttggtaaatttatttataaaattattttttgtgaaattatttacctaatggtcaccaaaaagcgaaataaacagccgataatggtga

SEQ ID NO: 1654 - DNA, 2453 bp, Heterodera glycines
ttgtaattttttgtgataataattcgtgaaaaatatgttctctatggttttagggatacgaattttacatccatttcgatggattccaaatccctaactcgaacaaaatttatttttgtaatgaattttcggttattgttttgagttctttgatgggattcagaatttttgaaaaggagaacaggttcgtgaagcgaccccataaaactcccagaacaagtttacaggactagacgacagattataaaaacaaaagggccctccctccctctgttttaagtaaaattcaaatgtgccacttttaaagtagcgcccaatttttattcaaattcataaagaaaagttttggccatcccatttttctgaaattggcccaaaatcattttgtaaatgtttaaaattcggtcaacatcatcatctaaaaaattgccaaaaagcaaattgtgcaatactgaattgtatagtaaaatgtgtcgtaattttcaggctgttgaagcgcatccaaaaattgaagacggacaaggaacagttggcccagaaatacgagcaggaggaggagtatctgatcaacgatttgatgcgaaaattgacacaggttcatatttttatttttcaaaaactcatgtttaacgggtggttggggctcggttcaactttttggcgaaacactccggttttttcaaaaaggaccattttgttcatgagtttctccatttctttggttttccaaattgaatgcatttattatctttcgatagagccccaaatgttctctatttatctgcaaaatttaaaaaaatctcgttaattatcaaaagagatatgatcaaaaacttcaataattggttttccgaataatttttgcctataacctcgacggaattctttgaaacatgtccaattcgaacaattatgaaaggagttattagaaaaatgcccgtttgaaatcgcccaattgatcctttacgggacgactacgtaacaggacaaaaagttgtcagccaaattgaattcttggacaataacttttttctctttggacccaatttgtcattgttcgaaagagtttgagttcttctggccattaaattttttttgaggtttgacagaataataatgaacaccttagactaatgaacaaacaaagaatacttaatttaattgacaattcatccgacgaaattttggggtgcaccggggcggctaaccccctccccaaattttagaaattgcaaaagtttttcaaaacttaattattatttataaaatttttaaggttttttttctaacatttagtgtattttcttcctttttttgcagttggaaggcgaacgggacgaattggccaatcggttgagcacggaccaaagctgggtggtggcaaatctgttgcagaaaatccgcaaattggaagccgaaatccagaacaaccacaaagtaacgaagggatatatttggcgaggacactccgtctcggtttagcactgacctcatttttcacgcaaatttttccataaggggggggggaggcaaaatcaggcccgtatccagaaaaaaatcacaaagtttgccattttgggctcaaattttaaaaaataatggttcaattggtcgcctggaaaaattttttggaaaatttaattcaatatgataagaaaatgtgcaaaattttcacaaaattctgtcaggttcaagtctgagttttttcaatccctgatagcctaaatagtattgaaaatgatattaaatgattatgaccgataatttgatcatcagtgttatgactgagctgtagaccattcggccgaatggtctacagctcacaatcagtcacaacaatcagttagttttttgaaaaaatcagtaattattcaaacgacataattaatgctatttcgtctatcagggattgaaaaaactcaaatttgaacccgtttttagacataggcgcaaatgtcccccccccccctagcgtgttaagacatttgtcggtctcgatgttagaggtctgctgaacatattacattggctgcctgactaatagatgacggacatgttctatttgtatctatacgtttcattttataatgatatttttcctttttatcgagattctcataaaaatattttggcattttcgaatttcttgagaaaatccttaactattgtgtaaaaacaagagaagaactactgtccctaccacctgagctttttgagaaaaaattcaatatttataaaatggatctcaaccttagtcatttgcatagcaattaaaagtgattatttataaaattaattagccaacttttacatcttaatccttttataaaggaaagcacctgacttggactgcttaaacatagtgcactggaatttgtcaactaccacaagcgccagctgagcagaatttacccctaaaggtgcacgggtggactcccgcaattttcttcccc

SEQ ID NO: 1655 - DNA, 1297 bp, Heterodera glycines
ttttcaaaattgggcttgtcaaacccccactagagctctaaagttgatagtcagtctaccaactactgtagagatctgagatttcctaataatgttctccatccctttgggatttgtttcgctgatattgttttccttctcttcattgcttccagttgggtgggggttaggaaatttttttctagaagacttgaatcggcttattagaaagagcattaaattcgattaaatgggatggaaaataattttctgaggtttttattttattggagtcgaaaaattgagccgcaaatatcatttttggctgtggccgcaaatgtcctaggcgcaaatgtccgaccgcatttgtcgggccgcaaatgtccgattttcagcaggccgcaaatgtccggaccgcaaatgtcctacaaccccccccccccccctagatacgggcctggtgccaaaataatattttgaacggagaagcaattttataaaaaaaattttgggaaagcgaaaaagaatgattgggaggggattttcaaggaaaaatgaagcttttaacaactattaattttatccccataattcaaagaaatatgaattgcaactccataacaatgcgtttttttccaaacataaatttttcatcatgtgataccgttttttcatttcgtattttcagcgatttttgaaaatctttgtaatacaccataaatttttcgaaaaatttttcttgtaattttctgtaaaaattctaagatttttttcttgcataattttttttggtaattttttttttttgaattttcgtgggaaatggcagggacggaggaaccgcaatacacccgggaggggcgaggtattcgtaaaatgcaaatttctggcccaccccaaccaaacacacatttgggtgagattattgaggcccaatctccaaacacaaatcataaaatttgaaattcatttgcctttttccagtctttggagcagttgcgccgcgaaaaggtggacttggagaattcgcttgagcatgaacaggaggcactgttcaacacattgggcaaacggtgtggaaatttaaatctcatggaatttttttatcaaattgttttgtggggttttgagcttaatagataaaaatccaatcaggccgtatccagataaaaaatttcggggagggcaccgaacagcttcttttttttttgctcttcgggctatatatttttaccagtgttgttttccaaaaaagttcagcgccggagccacaaaaacaggcaaaaaagacaattttcgccacttaggggtcaaatgg

SEQ ID NO: 1656 - DNA, 7814 bp, Heterodera glycines
  misc_feature (10)..(10): n is a, c, g, or t
ttctttcgcncacgtttcaatggcgttggtggacaaacatttcaatggcaaaagcgaattgacaatttggagaccaatcgaaattcgcaaggacaaaggaccagaaccgaaactttatgtacaaatggatagaaaatttgacaaatttgtgccatttccattgcccgaccgtccgttgcccagcaaaattcgctttgattctattcagattgagtacttaaaagcagagctatgacattaaaagcattctttccattttcaggtacattgatcactccgtcatcgcttttcttcgttcaaatcaccaaattttcgacaaaagaggcatcgatttacatttgtggcttccttcacataccacgaatggccaactaatttgggacatttttggtcgtgaaatttggcccatttttgcgccaaacattggtcatttgaccatttcaaacgctgagcatttggacaatttgcgtcgtcgcatttcgccgacaattctcaccgatctcaaccaattgaattcaatctattccggtgctttgttgcccgctgcgtttggtgatgattttgatgggccaaattcaacaatttctgctggccaagcattgtccaaatggttgcacaatccgagaaaagatggccaacccaagcgattgcgttgcgataattactacgaacaaacggacttagattggatcaacaatttcaaggaggtgtggcccataatctcgacaaatcactgatttttgtttccaaattgtttagcattttcttcgtgccaatgccatttcttccgtcagttacgaaattcatttttatgttcatgtgccgtcaatacaaatggtgccatttgaattggtgaacgaatggacaaaggaaaagctgacattggccaaagcaaatgaaaatgaattggacaaccgatggataatgaaacgatgcaaaattggagagacagcggcggtcaattgggaagacggaaattgggacaacaattgtaacaatgtgttcttttggcttttcggtaccactaattgcattgggtgagcaataaaaaggggatttgtttttatacatatccaaatttgagatttgcgcttaatttaggcctttgtctccgccaccggcagaagaaacgggacaaagcatcacaaattggccgtcttttgctggcaattagtgatggacaaaagaacaaaaaacacaatgatgagcaaggttttcggggacgctgatcagtgatcacgagtccgtcatcccatttcggccaaatccgcggattcaaacaaaaaattttaaattttaaaaattcacatttgtaaattgttgagcttttaactatgttttcagcgcttaatatacctaaatggctgtattggaagagtttcaaaattttacattgaaaaaattgcatgaaaaactggctttgaatgacaatgattttgtcgaatggcttgagcatttgggactcttgcattcgcgtcgctcatgtccttgatgtggtggaaatacttcgattgtagcagttggtggaaattggcgttgcactacaaggaattgtcgggcaaaaacagggttcttggttcgtagtgcgacttttgcggaccactatttctcgatagaactgtctaaataaagaaaaaaataataagaaattttaataaattcattattccaaattgaattagtgaaggtaagctgatgcaaagcgatctgtctcaattggagagaagtcttatttgacataacttttttctttcttttttatagaatttctaacttataattaaactgtgaaaattggcgaaaaaaattcgctaaattaaatataaaagtcagttcaagaattttatagcaagaaaaattattatcgtgtttcacttccacgctttagttaaccgagagcttaatttttttccggcatgccaaaccaattaaattaacaaacaaaaactaaaatagtttttctttttctcaaaaattgtccgtaatttgctgttattaaaactatgggtccaaaattaaaaatgagcaactacatactatatttatctatggaaactaaacttctttaaaaaaatgggttctttcgatgttgattgcaaacagttgatcgattactcttgaagggcgatgttcaacttggtaaaaatcacaaataaaactacttagtcactcaatttttgaaaaaattatttttttttgttttttttgacagttcaacccagaaatagtggtccgcaaatgtcggtccgcaaatgtcggctaacctcttggttgggactttttttgaaggtcttaacttgatcaaaagatacacattgggtgtattggttctattataaggttcaaaattgtcgactaagcaagtttttgaactatcatgtttcgcaattttatccatgccaataagcatgttttttatttatttcgtgcatttaatggcatttggttgcataaatgtgaatttttaaaatttaaatttttgttcgaattcgggtctggggttcggatttggacgaaatggatgccgcggattcgtgatcagcgtacccgaaaacctttggaaatgtattttcatgacttatttatttatcgaacaaaccacaaggtgctatgcactctaacagtggtgtaaaaagaaaaaagtgagaataaaaataaaacataaatggcagtcaaaaatcacaaaaataagtgtcaaatcacagaataggtgtcaaattaaaaacaatagacataaatgaaacaaatcacacctctcaatggggaaaatatgcattattgcttaattatttcttttgcaatttctcggaattttttggggtcatttatttccataatatttttcggtaataaattccatgaattaataaccctattaaaaaaattattttttgtttttgtaatatatatcctattttgtaataaaaagggtttgcgaatagcccgtttagcaacagcaaaaaagttagatggtttaagatgtgtatgtttttttattattttaaaagtagttgtaatatcattaattttgcgcctaatttccaatgtcttaattccgcaaaactttaatcttttttcatacggcatggggacaagcccacattttttgaaggcttttcttgtaaaaaatttttggactgcttcaattttgtggacattttcttttttcaatggattccaaatttctgtggcgtattctaactgtggtctgatatagcttttatatgccaaaattaatgtttcaagcctccgagtttttaacgctcggagaagctgataacaagaaaaatatgaattttttaaaattttattaatatggtcagaaaaggatagtttttgatcaattaaaatgcccaaatcccttacacattttgtttctggcaatggttcgccatcaagaaaataaataaattttgtgttattttcacccaagtaaaggaccattgttttttctattgatatttttagtccattattttttgaccatttatttattgcctcaagcgcggaagataaattctctctatttttatcatttttatgctcaatataaattttaatatcatcggcaaacattttaataccaacatttttaggcaaattattcggaagatcattaataaaaataagaaaaagcaaagggcctaagacactaccttgtggcaccccactataaatgttttttgagttagaatactgttcagagattttaactctgaatgaacggtcatttaagaaatttttgataaatttatgaatcttaccattaataccgatatttttaagcttttgtagaagtaatttaattggaacactatcaaaagctttagaaatatcaatatatattacatcaacacaacttttattttcaatcgatatataaaaatcatttaaagttgatagaagttgtgttgtggtggatctttgtctcaggaatccaaactgaaatggactaaaaaattgatttttattcaaaaatttaagtatttctagctttattattttttccattactctgcataaagtacaagttagtgaaatggggcgataatttatgggattatctgtatctccttttttgaagacagggataattatggacgttttccatatttcagggattttagatgaatctaaaattattctaaagagttcagttagtatgggtgccaagggtaatgcgcattcttttaataatatgtaagggatgccatcaggcgatgtcgaatttcttctagggagtttttttaataaattccaaatattatagacattaaattcaatgtctgtgatctgattagggttttcatggctgagtaagtcattgttattttccttgtacaaaaatgacttttgaaagacatcagccaataaaatacatttttgttcattccgaaaaataatttgcccttgttcatcaataagtgttggtattccggtgttagttttaagccgatttctaacaaatttatagagagaatttcttccatttgaaataaatttagcttcattttcacaatataatttgtggatatgttttttgtactccctgcataatattttatatttaattttaagctcacggcactcagcttttccttttagcatgctatgggttcgggctttttcccttactaaagtttttattttttcatcatgttttttcttaatagttgttttaagcaatttcatgggtacatttttatcaaaacgcttttttaattcagtggtaaatatgcagtatttctcatttatgtctgaaactgtaattgggagggagtttggcccattaaaaagaatttcttggttgagtttagtaaaatttttctggcgtaaatctctgataaaaattttttgactatctgtttttggaatagtttgatttatatcaaaccaaacagtattatgatcagaattagaaaaaggggagccaacttttacattataaatgagttccttgggttgactaaaaaccaaatctaaaatattattttcccttgttggttctttaacatgctggaaaagttgattttgtgccgtgaactcaattattgttgttgaaagtttatctttttttgttattttgcattcagaccaattaattgaaggacagttaaaatcgccacatataattgtattttttgaatttgtttcagaaataaatttcagcgcttttttggtgttgctaattgtacagctgggcggtctatagatgataaatatttgaataattttctgtaaaattaatttaatgtgtataatttggcagccaaatttagttccattaaaaatagttttaaatggtattttatttgagactattatggcacatccacccccttttgtgggacggtttgcaaaaattgggttatatttccccatatatgaatattcagaaattattgtattttccttcaaccaagtttcagttataaaaattagtcccggttcttggttttccattaaataaattaattctggtaccttattgcttattgaccttgcattaatgagtgtacaggagaaatattggttttttgctatttccgtattttgtagtggtttgttcgatgacccctatgcattattttcccgtgttttgagagggtgtgggtttttcaatgtgataatggaaagatcaacgacaatatatttgaacagtccttcggacttattcctttcatatgcttgagtcctaagctggtataagacttgcagttccgaacgggtcagatcccgacggaccgtgatattttgcggaaaattttggtgttttttaagtgttttgcgaaaattttttatgaaaatatcacggtatttgcgttcagtgaatgggattttgacaatgcggggctttttgttcgattgatcggaacccacaacggtccatggatggcgatggacatctccagcgttcaaatgttcagtgattccgcattcgtcagtcactttttgcaccaattcattgacattgatgccctcgggcactttctccagcaccgcccgcattgattttgccttgatttggtcggcgtcgaggatggcattgttaaccatctgtgagatggaccccggttggagatgagaagattgacgaacaaagtgagggggttgaccccactgagtggcgctgttgttgatttggtcgtcaccagcatggcactggcattgatttttggttttattgaccaaattttgtaccagtttttccaaattttctagccgttcgaggaccgagtttaagggtgggctttggattgaatttatttgctgttcaaggcgatcaagacgatccaaaatgtcgtcagattcgttgagatttggggtagtgcgtctctttttccccatttgtgaatattttgtgaggaatgaatagtatataccaagatagtttgtcaattaagaatgtattatttaacaaaaataggctgtgccaagtaataaatgtccaaatcatttttctccccatgcaaatatggcataaaaatcacttctcagcggacagaacgaaacaaaaaaatgcgagcacaaatatttcaaaagatggcaatctcaacggaaaatacacccataagaattgaccccaaaaatttcaaaaatacgcccctaagaatctaccgaaaatttttaaaaaatacactcctatgaaatgaaaattccctcaaaaattcttaccacattttttttttcttgacaaattttgatttaaaaatgttcagtatttgctaaggaaatagtttaatggaaatgtacctcatttgcaactgcaactagtgaataaaaattatttttacttaatttttggctaagaattatgtcactatccatcactatttcggactttttgtcactatttcttctttattttggcactttttcgtcactattttagtttactattttgggatttttcttcactaaaagttgcttccctacacataaccaatgcttcagctcaaagctcaaatctgacaatgttcatatcctcatatttttcgtcttcccactgaaccgccgccgtctccccaattgggcatcgcttcattgtccattggctatagtcccatccagatggcttctgcaggcccgtaaagaaaaaaatttcgggatgtgcaacagaacaaaaaaaacatgaatttatggccgcttcggcaaaaaacgattattttttgccatttttgaggttaaaattcaaaaaaataaggtaaaatggaggtccggcggtgccgacaggctctttatgcaggggcagatttttaccccaaaactacttatgggtactgactagagcccggaaagttcaaatttgctgatcccgctgcgggattggtactgaaaatttttgcgggacggcatcccgcgggcataaatcccgcatttaaatttgcgggatcccgtgcgggattttggaaatttcaaaaaatttagaattaaattttaaaaacccaaaaaactaaatatacctgggcattttaaaaaagaaatttttagaggctggcggtataaaaagttaacaaataatctaaattatatttacccatgtcctatttgtctacttaataggtcagcagcgataaatgagctctattttggttggtaacatgtgatttcgtcagtgagtgatttcgtcaatacggggttttgtagtagtagtaataataatttttttacgaaaaaattataataattcaaaaattaaattcgttcaaaatatattaaataatatgtaaattcaaaaattaagattatttgctcgattatcaacctgttttcggcccggtctacttacgatataagctaaacataatttgtat

SEQ ID NO: 1657 - DNA, 4080 bp, Heterodera glycines
  misc_feature (4018)..(4018): n is a, c, g, or t
ctgtgagttttccatcgcccactctctctctctctccgctttttccgttccttctttgtccatcataactgatcggaagatcatattgtccattctttattaacattgttcgccaattctcccatgtgcctggatcatcagctgactaatgaatgacttttcttttcttttccttttcctatttaatcgctttctccgccccattattttccattatttttgcatttgccatttccgttctttctttgccaatgaatttcccctcgattttctccgttttgtctcttttgcttctttttgcggacttttcatggctcgccgtttcttctcccactggtgatgcttttccaatttcaaatgctttacctaattttctttttaaaaatgccttcaatttcagacccatcttatcgtacgaaggcacaaattgatcattcgggcaccaaaaaagtcgttaattctcgccactctcccgcgccggcgccgcacagccaacggaaggagaagcagggcaaaaaagagaaggccaaaagcagcagcagcagttcatcggcggaggaggaaggaaaaaaacacagaaaaaagggaaacgggcgacagatcgtaaagcattttggaaaggggaagaaaaaggacgactgatcaaataaataattgattaataaatgaatgggtgattagtcggctaattgatcattcattcgacggctaaccgtcggctgatcattgacgcgtgattttttggcctggaaaactgggaatttgcccgttttttggggtttcagaatttattcaatacctaaaattaacagaaaaaattttttggggcattctgttataaaaaaaacaattaaatttttaattgcggtggcgcctgtcggcactgctttacccccccccccccgcgcccattacaaaatttagccgattaaacccgcggccaaaaaatgatgatttctgggaaatttttattttttggtacaaaatctgttaagaatctcctaaatttcaaaaatctttttgtcaatcggtgttttgtgttacggggccggggaattctcggctcggtgccgtactcccctaatttctaccaaattcaattctaatttttcatgtaacactactcacttctgctcaaattacaatattccaataattttgttaatatatgtattaaagtggtgataaagtgctgtttgaatgattttacgtttttttaacttgaaaaagcggcttaaaaattgcaagtggcactttccatgtcccttaactcgtccctcctcctcttccggtcaaattttttacaaaaataaagcatacatttttattcgatattttaccattttttaatttctgtgagtgattgtttaaatagggaactattagaaagaaaaacggtggaaaaaagaagcgttaattaaacaaagaaaaccgcccgcagaattggaatgaattgtttttcaaatgaatggactgacaaatgagtttaaaaaatgtaatttaaatgaattgcgcattgaattcaaaaggacaaaaaattaatatttttacgctaattgccccgcccattttttgcgaatggaactgaaaaactcagcggggactgtgcaaattcgccgagcattttatttgtcgattcaaaaatagctgagcaaatgagcaaaatttactatcaaattcatttttaaaaattaaatttgcccgaaggaattttaaatttaaacgaataaattgttcaaaaattatagtgaaaaatttaacaaatgattgtactttttctgttcatctcttcactaatcgctttgtcattttacaatttttattataaacgacgcaattttccgccaggtaaaaaatacattaaattattatttaatgtaggaatataattttatgtaattagatattaaaaagcaaaaaaaaactgtttggaaaactaaagagtgatttttaattaatatttttgtatagttcaaaaatattaaaaatgttattctaagactaatttggcttttgtgtatttgtgcccatttctctcttttttaagaatttattgtccaaaaaatcaaataatattattttatttatatttttagaacatacatatttcggggtttttgtgcttaattcataaattttatcttctttttttttacatattttgcgacttttaataaatgaaatttgcattatcctaaattttaattgtttttaaatgcctaaacttccaactcatcaggcccaacccctttgccgatttttggcaatttgatcgcaattcatttgtcgggtgctggcgaattggcatttaaaaaatgggcgaaggaattcgggccaatttacacttattggataggcgaattgccagtaaaagttttaattatcatgctttaaatcaaatttatctttgaaggttatttgtgtggcggcctatgaacaaatggtgcaaattttccaaaaagacgccgaaaattatgccaaccgatatatttttcccattcaaagagtgatcaatggtgcaaaaaattaaagaaaatattaaatttaaaaattgaatatttcggacggacaacccgcctttggcattttgatttcaaatgggcaacgatggcgccaacaccgccgtttcgcacttcatgtgctgcgcgattttgggctgggaaagaatttgatgcagcagagagtgagcaaaaaaaaaggggggggggttatggccaaataatctacggataattacaaactttttggctcagtcaaaattaaaaaatataaattttaaatgccttttgccaatttccattcggtgattaatttttgatgactaaaccaactttgaatcgttcagatttttgaggaactcaaagcaatgtttgccaaaatcgacctgaacattgatcaatcggaaaacaatgagataaatttggccgaatttgtcgaacattcaatcgcttcaattgtcaaccaatttctttttggcgtcaaattagacgaggttttgtttgtttattgctgtttaattactgtaattatttaaatttaattttaattttaatgataaaattgtttaagaaaaatgcggcggacttttacgaaattaaacaaatgatggacgaacattcgggcgaagtcggcggtcattctctgttttggatatacattttgtggccagatttactgcgcaatgtgccatggttccgaggaaaacgttggatttaattttaatttcaattaattaatttggtattttaagggttacaattggaggaaagagtcgtcaatttccatcgatattttgagaagcgaatttttgaaagacagatgaaaatggaaaatcctatcaattttgagaagccttcctcagattacgtggaggcgtatctgaaggaaaaggcacggagagacgccgcgggggaaaagggacaccaattcgagtggggggggggggcgggagggcggaatgccaaacagtgccatttgaatttggcaccctttgaggagcacttatcagctggggatgatgtgcttcgacctgtggatcacgggacaagtcagttttgtaaaccgaaggaaatcccggtttaaaaaaataatattttaattaaaatttgaaactttggctttttttacaacctaaggaaacggttgtgtccgttttgagttggggcattgcccttctgctgaacaatggcgaaccgttggtaaaaatgtgcgaagagattgatcagctgatcagcagcgaaaccgtaacagaagggcggcggccgcggatgattactgtagcggacaaggcaaacctaccgtacacttgcgcagttacaaacgtaagtgcactggcgatacagtaagcccaagcaaagactttacggtagtttaaaatcaaagccaataaaaaaatcaatgcacttttgaggaaattctccgctgtgcgaacattgcgccacaaaatttcattcggacagtcgccagtgacgtccgattggccaatggttttgtcctcctcaagggcacttccattctnccccaaatttcggtcgttccagttaagaaacgggtgaaatcgcttcaaataaatatttaccg

SEQ ID NO: 1658 - DNA, 1025 bp, Heterodera glycines
aataacttctccgcacctgcctaaggcaccatccgaccaaaatgtatttcttgtcctaaaatgaaatcaggaccccccacacaaaaccggagttcaattccggaaaacccgggttttactctcggtaatcccaccccccggcctcactgatgccaatccccgacctttacaaaaattccggcctctagtaattacagaattgaaattgaaccgatcagttcttctgttcagacaatgcatgggcgaatcgatggcacgaatggaattgttccttttcatcgccaacatttttagccgatacaaagtgaaggaattaatgattatgtaatttgggggaaacaaacaaaagggaaaatttaaagcacaaatgacaagaaacaaagcagccaatcgagtcaattcaatttttaatcaatgccgttaattaattaattagttaattaaaatgtcctttaggtctctgccggctcagtccctccttcgctgaagcgaattcccagtgcggtcgcccattgcgcgccgttcacttgtaaggttgagaaacgaacgaaattttgaagatagaggcccaaaatttaaatttgcgatcccgctgcggaagcatttttttatcaattcaacatttaaaattttttaatgaatggcacaattacattgagaaattagaatttgaaaatcattttatggcatttcaatttttcgtttggcgctcttttggcccaaaaagggcattggaaagtgtcaaaagtgctggtaagacgagcaaagtgttgagcaggcacaaagcaatggtcaaacacatcaaacggacaaaaatctgacggaaaaattaattttaaaaatttaattagttaattaagagtatttatgaattgaacccgggcgatgtaaaggtccaccaaatagtcgaccaacacacacagacacgtgctgaaagaagcttgaatgctgggcaaaccgaccgatcgaattgtgtttttgagtttgtgctgaaaagtgaccgattcgccgtttctcccctggag

SEQ ID NO: 1659 - DNA, 6696 bp, Heterodera glycines
caatccccgacctttacaaaaattccggcctctagtaattacagaattgaaattgaaccgatcagttcttctgttcagacaatgcatgggcgaatcgatggcacgaatggaattgttccttttcatcgccaacatttttagccgatacaaagtgaaggaattaatgattatgtaatttgggggaaacaaacaaaagggaaaatttaaagcacaaatgacaagaaacaaagcagccaatcgagtcaattcaatttttaatcaaggccgttaattaattaattaattagttaattaaaatgtcctttaggtctctgccggctcagtccctccttcgctgaagcgaattcccagtgcggtcgcccattgcgcgccgttcacttgtaaggttgagaaacgaacgaaattttgaagatagaggcccaaaatttaaatttgcgattcagctgcggaagcatttttgcatttgttttatcaattcaacatttaaataattttttaatgaatggcacaattacattgagaaattagaatttgaaaatcattttatggcatttcaatttttcgtttggcgctcttttggcccaaaaagggcattggaaagtgtcaaaagtgctggtaaaacgagcaaagtgttgagcaggcacaaagcaatggtcaaacacatcaaacggacaaaaatctgacggaaaaattaattttaaaaatttaattagttaattaagagtatttatgaattgaacccgggcgatgtaaaggtccaccaaatagtcgaccaacacacacagacacgtgctgaaagaagcttgaatgctgggcaaaccgaccgatcgaattgtgtttttgagtttgtgctgaaaagtgaccgattcgccgtttctcccatggaggcctaaaaaatatatttaaattaatgaaaattaaaattgaaaaagcaaaagggaccggaagtgaggtaatggtaggagaaatgggcaggcaaatcgacggagaagccaatggaaatgatcagagatccgatcatcagctgattcagcgcctcccccgtccaactgagtacgcccagggtttctgaatttgtctacaatttagcaaaacactccaaatgcccaaaatggcccttgtttttcaataattacccgttattattgctgcgatcaccgccgtggaaacgattaccgtgcgccagtcttggagcatcgccaggcaaatcagcgccatgcagaccaaagtggccacggcggattgccaagtgtcggttggcatattgtccatctttttgggggtaggggagacgttgaaaataaaaaccgttcttcgaatgccaatgtttgtccttaccaagtccaaaaagatggcctcgtcgtggtgaacggacgcgtcgatttcctcgccgaatttgtccaccgttcttcgccactctttcaacagttcgacccttcgcgaccatttggtgagattttcgttgtgaaatgcggtggtgaaaaagaaacggtccacggagcattgggaatcgctgaaaatggcacaaaatgaaaaatttgcattttctggcacttttcgacactgctcaggcgaatgaaccccttccaatggtcaaactcggggctgttcagaaactgttgcaaatgcgcacaatcgaaggcagctaaaccattattattttgatttaaaattttaaatcggcacatttcccaccatttggcgttttgcctccattcgccgttttcctcccgcccccggcattggccaacagtcgttcttcctccgcattatcccacagaaattgctcaaactctcggacgaagtaccgagtgctttttgcgccccaactttcgggcagtgcctccatttggcccaccaaagtgtcaattttggccaattgggcgggcgacgaaagattgccgggacggccgacgaaaacgacggccgttgtgtaggagggaatgatacgctgttcccgaacattgtcaatctgcgaaaaagagcactcccaattaatggtgaattaggacagattaattaggcaatgggacaattgagtcgagacggaatcgggaatggaagccaaagacaaacgaattaaccgacagaaaaaacaattaaagtcaattagagggaatgaacaaattagccacctcaagcaaaggcgaatcgcgcgcatagagctgtttggaggtcatattcacttcgaagttggaaatgccctaaaataataaagggaaaagggcggtgaatgaatgaaagggaaaagcgaacgatggcacaaaaagcgatgaaaaagacggagcaaagggcgacaagcgaagcgacgatccgatgggaaagcagcgcaacgtaagcatcgaccactttcgaaacgaattccttcgctttggcgtggaattcgaactgccaattctaaacagttgcaattggaatttgaattttgatttcatttccaatttcgtttttccttttaccctttccgttcccttttccttccgcgtttttctctcaattattgccactgttcccatcaccgcgacaaagtaagtgcactgaaacagcaaattgatgctcaacgcggccatgttggccaagcacagcaaagtgatttcgagcgacccaatgaaacagccgatggcatcggccaaaatgttggccaatgccgagacgagaatggacgggcccgtgtccatcagcacctgcggggggagggagggaaaggcattagtggcattaattactgtggtatttcatttgcattttgttttccattttgcatttcgattgttttccatttcgttttgagtgttattcaacattcattgacctttgccattgtgtccgccactttttcctcaatttcgtcgtcactttgtcccgcctttgtcgtccttttgtccccctcctcctccctcttttcctttgttattctgttccacgcgtgagtcatcaaaaaggcggcgtccacgccgatggccaaaaccaaaaaaggacaaacgcacagaatggatgagaagcgcattccgcacaacagcagaaggccaagtgcagtcccggtggccataaaggggcaaatgcaagcgacgagggccaaggaaacctggggaaaatggggaatatttggacaggaaaatgggaggggggggggacgaatgggaaaagtgggaaatggggctgggattggaaaatcttctatctgattcgaagaaagtcaactttttcccaattgctgaaatttactggtcagttaaactaatgagtgaatgccttgtggacggtcgcctgttgaaaatacgcggcggacaaaggaatgctaatggccgtacagaaagccatgacggcgaatccgaagccaaggtacggcagcatggacaagctggcacggacgaactccgcctcgacataactttggcttatgctcatcacatggatcaaatcactgcgaaattcgctgaaagttaaaaatgatcaaaacaattatagtaattgattgaacgaacttctcgaagaacttggacactctgatcagatactgcttcatctcgtcgctgctcagccccaacagtgtccgttcggctcggtattgaagggcgaccatctccacagaagccatgttggtgatttttgtggtcaaattgtttttggcaaagttaacgccgtggaaatggggctgaaattaaaaggtgatttaaaatttaaacccgccgatggcctttgtttgcctgaatattagcttttcgcccccacacattgatgttcggatagttcagacttatctccgctgcttgcctccttcttccgtttgggtgacgaatcctttctgaaatttttaaacactaaaaatttgttctaacaataacacgtcatgtttggagtgtgtttgtgtatcagtgaaagcaatttaatgatattgttaagagtgtgcaaatgtagatcaatttcacaaacaataacaaattgagtgactttccttgttaattatttacacatcataaatttaaactttttatctgcattctcatcaaatgcgagatcttcaacgatttcaatttcttcttcattcttaaggcatcgttcaatgattgaaataaaattattagccatttcaatctcgacaggcgaaatagttgaatcattaaaattattcgaaaaatgtttttgaagtaaagaaataatattttggggattaacttgcattataattaaattatctaaatatgtaattttattaaaaacaataaaaaaaaatgtttgcgtaggggggactcgaactttccattacaaaaatgaaatcgtgacacacaaccaccctgccaaccggtcgctttttgcttctccttttaaatttaatataatataattattaaatatttaaagcctcatatctcggcacagaagcttattccgcagctagaaaaaaaatttggcaatacaacccaggggtggtctacccacctacaaagtttcatttggaagttccaccatcacccgaacactctcctttgtgaggggaatggcactttttagaatttacagattcaaacaaatttttctttccgcgcccatgaaaaaattttatttttcattttttgaaaatttatccgaataattaaaagcattcaaatggaaatattaatttaaaaaaaccggtgcttcaaaaaaattttgaaatttaaatttctaccccaaatttttcgaaaattcattgcgccaggggctgataacaaatattagaatccggaattttgaaaaatataggaacacctagaattcctgcaaaaatccctctgcaaggttctaggagcatttttgaaaaaaaaatacagactttcagacaaaaaatagttcgggcggaaggggcggggggagcaaatagcaaagttaaaaaaaagatcactaggcagatatagtaatagtactagtaattgccgacccacactcacttgtacgggttgggataggtggcacggcatttgcgctgtttgggcacattgtgccacactttggccagccgaaccatcgcacccgcgtccaacagtccgtagccaaacgaatgcgacacgttgcgcccgatgccgttcagtcgccagtcgccggcacgcaaattcaccggcttcgccgttcgcacgacaatgtgctggaatggaggggggaaatgaatgcacatttggtacagaaaaacaaaaaaatcaaaactgaagccagaaaaaagttacggaaatttcagagaggcgaattttattttatttatttattttgctctttggggctaaaagttttttttcctccaatgtttatgttcaaaaatgtgcagcaccggggagcaaaaactagaacttcttaagccatttcagtgaaaaatgacaattaattgcttgtgtcattttggagttatatttcaacagtatgacaaaatggcgcgaaattttggaaattttaataaaatttgtgaaaaagggttttggttgtaaattcaattttgtgacagaatgaacaaaaggcgtcgaaagagggaatgggaatccccctcacctgcaggtcacgccatcccaagttcgggttggcctccagcgtcagtgcggcgatgccggcggccaacggggcggacgcggaagtgccggtgtgcgacttggtgcaggagtggtgcagatccgtggtgacaatcatccgttcgcccgacgaaccgcttgaataggcggtggccagcgttgagctgcacgcctccgaatacctttgcggggggggggggttagagaattttggattttttgaaaaaacccaattacataccatgggattgccccgcgttcggtggccgacgaaatggaaagtgtgtggatggaattggtgtacccgtcacaattgcatgagtctgcgtctgtcaaaaaaaaataatattttttttaaagaatggcttggaccagggcctcgccgagactctaccgaatcctggccccaggtttttttgggacaacaccgggaccggaagccctggcaaaatgggactttcagtaacacaaatcccggcccgtttccataccatttcaaaattccggttcatcctgtttgctgtgttgcgcgagattacgggtttttagaaaattacgggttacgggaacatttttacaaaacccggtgatgaacccaacaaaaaattacgccgtaccctttcccccgttgccggatgcccatatgaaaatggagcctttgccctgccgtccctcggtgatgccgcgttcgaacgcgctgcgcgtcagcgtggcggggccgtccaccgtgcgtccgtcgtcgtccgggccccagctggccgagtaaatgtcaatgtgctgcgagttgtggctgagcgaagtggcctccaccgcgtcggtgacatcgcctgcaacaaatgatgggaaatagtaaaaaaaaatggggcggtgaaaatttcgaaaaatccgtttaaaactgacggaaaaaatacaggaaatgatggctgcattttcagtttattgcaagcatttcttttttggattttttgtcagttcttctactctttggtgacttttttctttatattttttgctctctcgtcactaaactcacagccattcaaaaattcattgcttttccagtggccctaatttttcgaacttctccttcgcttgcaatttccagtccatccatttttaattttgggttcaaaaaatgaaaattttgaaatttaaaatcgaa

SEQ ID NO: 1660 - DNA, 2688 bp, Heterodera glycines
aataaaatatttatagttccgataatgattaataatctcattagaatatttattgtttttataaagttaattattttattttttcaacattcatttaatcgagtttgcaatcaattattttattattaatatttattgtgcgttggctaattatatatttttagcttaataacttaataatatgtcctacattaaaagattgttagtcaattttattttagtcgtattcattattttatcatttaatctctttggatttgttaatttattgcctattaaatttttgaataatttctcttattttttctacacgttgtttttccttaatttaattatttgcttattcaaatcaagaaatcctttctcgagatattttctaattatttgtaataaatccgaataaatggacgaattttgggaggaaatttccaaatgaaaatgaatggggtgaggagtagtgatgctcgagagtctcggtctcgagtctcgactcgagaaaagtctcgggtttttttggtctcggtctcgagtctcggtctcgggttttcaagtctcggtctcgattttcgagactcgagaccgagaccgagacttttttacacccctaatgattgttggcctttggtaaacttctatttttataaattttaggttcttttttgttcaagtttgttaatatatgcgtggtccagcgggttgtgttcttggttttgttccttatttttgcgttggatcagttcccctccaagtattattttttcttctcatttttcaaaattaatgttttttttcgatgggagttcaaacacaattttaacaattaaaatcgtaaaaatgtcatttttggacaaaatccgttaacaaattgcagtaaaattttaaaaaattttcccggcggcgcctatcggcaccgccggacccctgttcccgaaacatttttttgaaaaagagcaccacaaaaaatggtgtaaaaaagtcaatcatatgaaaaggaaaaatgtatggtagcttaaataaggaaaaaaacaaaaatttttgagaaaactcaaaagattgatttttttcgatttttaagtgtgtaagaaaaaatttttgaaaaaagtctcgggtctcgggtttttttggtctcggtctcggggttttgggtctcggtctcgagtctcggggtcgagtctcggtctcggtctcgagtctcgggaaatttttggtctcgagcatcactactaggtacacctctttgttaaggttgttttcgactttttacattctatattatacgttttcatttatgtttccgaaaaatccaaattttgccaaggtactgatcagaaaagcacaaaaaccccccaattcgaatgtgaagactgatcaaaagtgccgaaattttggtcattatttaataaccagccccgagaattggcaaaaaatgtcaatttaaccgcctgttaaatgcatctttgatcatttgtcctaataaaaccccaagtaaaccaaataccgcttggctgactgatcagaatgccggttccaagccttatttccattagcggcttctgatcaaaaaggaacaaaaatgatgtcatccttttaagcacatgttcatccccagcaacactcacgagctgttcatggccaatgcttggccttcaattccaaccacctctgcttctgctgctggttgtggaccaacagcagctgaacaatcagtcgctgctgatcctacagtagttgatccgcaatttcacatcgcaattttgtacggtaggataataatagtaagttttgaatggaaaaaaatttgccaaaaaacaaaaaaaaaaattagtttttttttgaattaaaaatttcctgaaaattttcccagatggacggcaaatcggtcctggttgtctacaaaatgttgccatgcacagcagatgccttccagaaaaacccgaattaccatcgttatgttgaaccaagcacaggcgaagtaagagcaatgaatgtgtccggccgaccctacaatttggcgttggccatttttggggtgccaacctaagccttggcattcttgaattttggccaagatcttgggtcggcggctcagggcgtggttccttttttggcgccaaagcccaagtttttggactttgacttttttctttgccaaataaatccaacaaatttagttttgcatctttgaaaaactctattagaaactcacaaaaatgcaaaaggttgccgggtcattcattcattactcaaaaagccatcaaaataaaaaaaatttgacagaaaattattcttaacttcgccgcccaaaatgaatcaaattttataatcttgatatcattcggtagccctaacaaaggagaggtacccaagtgacggttggacttccgaatgaaacttacagtgtaggtagattatccccccccccccccctttgtattataaaatttttttaatttttgttaagccttattaatgtcattcacaaaacaatgaaaagccatgtaagcgtctctggtcgattggttataccttccattccttttttcttcttctaaagttcaatttccccaccctgcaaataattattttttgttttttacatgtccagatagtttttaagccttttaacattaataattttgatcataatataatattttttaaatttttattctacattaatttttggca

SEQ ID NO: 1661 - DNA, 9687 bp, Heterodera glycines
caagtgacggttggacttccgaattaaacttacagtgtaggtagattatccccccctttgtattataaaatttttttttatttttgttaagccttattaatgtcattcacaaaaaaatgaaaagccatgtgagcgtctctggtccattgattataccttccattccttttttcttcttctaaagttcaatttccccaccctgcaaataattattttttgttttttacatgtccagatagtttttaagccttttaacattaataattttgatcataatattttttaaatttttattctacattaatttttggcacatgtgatagtttttattgaaatgaatgaagcaaagaatttgtttcatcatgcaaatctgatcattattagagaggggatttagatgtgctaaaaatcttttggtggtttttaagctaaaaaatttttttttgtttcaaaaaagttatggactgagaaactcaaaaaagcaagttttcttggacatttttggtcataaactttcattaaacttaacgaaattttttgaaattttgcaggataatagaaaacagttttttttagtaacttcatagcaccagtaaaagtgctaataaaaaaagttacagtccaagaactcgggctgtcgtgccgaaatgacccacacgactttggccaggcccgtacccaggggggctgagtggaagcacttatttccttccctttaattgaaaaatttatgaggaaaaattggtacgcctattttgaaaccaaatcttgcagatttcattaaactttccaaaaaattaatgtgctaactgaataattttttggtcgaaaaatctgttaaaaacagttaggtcttcgttccccaaaaaggggttgctgggttgttactcaaaaagccatcaaatccggttcattatccagaaaaaactggggatccggtttagtcccctaatcctgatccaaaaatttaacaaagtctctgacttactaattatcccattttaattacctctccaaattaatcataattaattaaattaagtttttatatatttttcattttaatccaaaaaaggaagtgtcaatggttggtttcatttgctcctccttggaaatggccagcgaattggagctgttccagaagtgccaaatccaggagatggtgtgcattgtctgttcatcgaggcttataaagtatttaaaaatgcatatttttttccaaaatttttaaaaaattctcgtccatctgagtcccaagatactgcatctggtcaaaatggtgaatggaagctcagctttttttaaaatgaactccgacaaaaatacaactgtgtcttcctgtgaacatttgatgatcactacagcgagtgagtatatggattatatatgtaaagcaatatctaaaattggatgtgatataaaaatttaaaaaaaaagaatcgaaaatgggaattatcccttccattttaaatatttttctcttcctctaaaaaagacttcattcctaaatctgcaaattagctcattaattaattttgtcaatgaatttttgtaaagaaaacgaaaacccattcgaatttttccaaaaaaaaaatttttttttcctttaaaaaatctccattgaagctggctagattccccccacccgaaatttttttattgaaaaatttctaattgaaaattaaaaaattaaaaaaaaaaattcgggggagcgagaggggcaacgattcgtaggggtggggactactgacacatgaggagcagggttgttccgggacgagaaaaatatcgggccgtgattcgggtcgggtctgccgaaaaatcatcgggtcgggttttggaacgagaaatatgtcgggtttcgggtgacccgggacaaccctgaagggaaggagggaacggggagggggcgacagggaggtgggaaacgaactgctcccggagcgctagctagagctgcccacccacggggttgcgtggaggcgcgggttcgattcccacccggtgccgaacattttgccaatttgttattattataaaaaacattttaaattcaatcagtaaacactacattgatcgatgagcaacaacataggcggtatcttcagcagctgaacggagaaaaaaaaagaaaaagatgcgcacaatcggcacaaatgccgtcgtcaatgatgcaaaacaatggaatggagccaacagcaaaaatgccgaaacttcatgcaatggcggcacgaacgccagcagtagatgcacacgaagagagttaacagcgatttaaattgaagcgctggtgtggcatagtgcccaatttttgtgacaattggcaacggataactcatatgaacaaaaataatttttgaattaaattgattttcatgggcagtccttgagggattttgtactggattttgcatcacccggatttcggattttcacaagaaaattctcacccttgagcaaacattttcaagatatacactcataaagactgaaaaaactttggaaaaaatagaaaattgtcaaatttttcgcttttcgtctcaaaaatctaattcgtattcaatttttggtaaaatttgtttccatatttaggaatattttgtccatataaatcctggtcttcgttataactaaattttcgattcaaatttctcaaaaatttcaattaaaattttttcgaccacccctttgccaattgtcacaatggcacacataaatggcgcaaaattttttttttaactaatttgtataattcatttaccataatcatgaagcgttttttgattctcaattacggtaatcactactataattttcatacctatctctttctgtttaccaagtgatattgttttaacttttttttcttgttttcctgatttaggtatatatacattaattttttcaattatttaaataattcactgtgtaaaattactaatttttcaatttaatttaattttgtttaatttacatattaatagaactcagaagaattgtataaatgatattttttaatgaaacccaaattaaaaaaagaaataaagcgacttaaagttcaaaaaaatttattcattaactttcaaatttaaacctgactgggccagggccccgccgggaatttgccgttactcctctcggtcccgggttttttcgggaggtgggacggggggggggggggggggaaacgaccggggggaaaacgacctggtcccgaccgcgggacctaaagtctggtctttgtcctggaaatcccatccccattcattgaaaaatgccgttctctgatttcaactataatggcatattgttttaattctcaaaatatcgatggaattttcacccaggccccgcgcgacattttcgaaatggaaaactcaatttatgtatttgtcgaatttattattttaattatttccttggcagatggaccacccaaatcgttcatttttgtaaaacaaaatgacagccagcatataaggtacatacatctgtcacaacattaaagcatatgtaaacaaattatttttttttgaacgaacatacgaataaaaatgtttgagcaaatgaatgatgggataaattaaagaaaaaatccaataaaattatggccattaaaatttgaaaacataggcatccatggccatttttaattaaaaaagtgtaaaaataaatcgactcttaaagctccaatgaaagtagaattaaaatttttaagaattataaaactaatttggatgattaaccattttaaataaaagtttttaattagggttattaatatttataaaaaaagaaattgaggaattatttctaaatatttaaggtgaatttttttaaatgtctcatataagcaaattgatcaattttttggcaatttggtcaattattattgaagaaattaactgtgaacaaattaatgaggtaaaaattaataaaaaaaataatatttttaatttagtgtataattatttttattaatttgcagaatctttctgttgaaaatcaaaaagatgttgaaaaaatgaatcaagctgaaaggttccttccatataatacttaattaaattaaatgaattatttttatttttaaaataaataaaaaatttttcatttttcggatagatataattttcatattaagtttatgccgtggaaaattcacgatttctcctgaagcacaagcaaaattgcattgctatttaaagagggataaggtaactataaaaataaaaaataaaaaaaattatattatctaaacatatttaaataaattatcgattatttttttattaagccatttctgttgttggcaccgcataaagttgaagttgttcatttggaccctcttgtgctcatttttcgcgctgtgatttcggacacagaaatttttagcatcaaaactttggcctcgaaaaaggtaaattccggaaatgttttgggaaatttcagaaaaatttttcagctttgtcgtgccaaagtggttgatccaaactcgggcaaaactgcgcttgccaattacagagtcagcaaatcggcatggcttaaagatggagttcaccaagtggttgaacggatcacaaaacgagttcatgtgaggcattcagaaaaacaaacaaaatttttatgaattttccacgcaccaactaaattttagtcagtctgtattaccatatatattttcataaatgttactgtaataggcattggttgacctttacagtatacttctattacggtttcgaatgcataaaacaataaaattattcattttttgccaagattcgcgcgattatttctcattccccattacagtatcaataccttaaaatacagtaccgaaaaattctctacaggagcattttccacgcataagtttaggacatgactaacttggacacggaatctgctgaggacctgcaggtggccagctacggtattggaggtcattatgcaccacattttgactttttcagggtaaggggacaaaaaattcaaattgtttttcaaattttatttcgaattatgagtgaatgggtaacaattttttcattttcaaaagcatttttcgatttttcaaaattattttaatatataaataaccatacaatttatttataaatacttttttcagtaactttatttagtctaatgaagtggacaaacgaacttttgagctctatggcaaccgtatagccaccgttttgttttatgtgggtgaaggctaaaaatttttcaaaaatttcaaaaaaaatttcacagttaacccaaccccacgatggtggttttaccatttttacggacctaaacattggcattgaaccaactgaacatgacgcgttgttttggtacaatttgcgcagtgatggaagtgttgacccacgcacgagacatgttttgcaattttaaattaaatataatataatttatttaatagttttaaattatataatatttaggccgcttgtccagtgctcagcggcaacaaatgggtggccaacaaatggcttcatgaacgtggccaagaattcattaggccatgcccgctcaagatggcacaacaaattgatgaaaattgacatttatgaagcgagggacaacgggcagaaaaaaaacaaacaattttgcgtttaaatttgttttttttgaccaaacacaggttttcctcttctttttgtcgcgttagttaaaaaaccttttgtatcatgatacagaccaatttggtagctttttattcccctgaaatccgggaaaagcactttctttaccacagcagcgacactttgggaatggttggccagaaaaaggaagcagcaaaccgcgacagaaaagtgatcgtatgcatctctgaaaaaaaaaaatttaaccttgctggggtgctaggtcgttgtgtaaaatccaccattttagcgatttttcgacaaaacatatggtataacttttcttaaaagcaatcaaattttatattcttggacccctaaatcatgcaaatttaaattttcggaaaaaagatgaaagaaattctgaaaacactactttttcaaaatcccttcggagattaagtcaaaaaacattgaaaaattaaaacaaatttatttatttatgaaattcattttcatgctaaattattcatcaaactttctttttcagaaaaaattggttataatctaataaacaattagggttttaattattttttgctttcctaaatctggatccaggggtccaggtcgagctcaactaatcttacaataagacaaaaataaatttatttcttaatatttgaaaaaaatgaggttggaaaatgatgagattgcagggaaagaatgaccagcagctatttattagaacaatttgtaatttattttacattatttattacagttaaacgtgattaatgacatcatgacaaaattgggaaagcaaattccactcctaaaattggataatcaaataaatggctctcccctgttgaagcatttcatgccaattttggcaagcaattgccatcagggaattatgccgaaattgggcaagcaaacgttcccactatatcctcactttttcgttaaacaaagaaattccattacatgacataaatcaaaattggtaattcctgcaaagaaaagaaaatacaggacgaattttaaggacatatgatcatttccaataagaggtcgaatgtccacggttttggaagacaatgatgatatcggtattcggcttgatcgtcttgaaaagcttgtttcctccctcaacccgtcgatcaacgccacaattgttgagcggctggatcgcctagagctacttgtgcagaaattggttaatgacaacacaaaggagcgatccgccggggactcaatgtccttctccaactcctcacccagtgttctttagggtcaaccgccgcctcacatcggaatggtcacccaactggtcaacaatgccgtgttggactcggaggagattatcgcaaaatcgaagagagcagtgttggagaaagtaccagaacaaatcgatgccgttgaacttgtgcgtaaggtcgctaccgaatgtggactgatggacgaggtgatttttgaagagatccaccgacatccaaaattacaattgccttcgggcaaaaaccgaattgtcaaggtcccatttgtggacaaaaaaaaccgagacattttccttaaaaattttcgcaaaaccctcataaaattcattcaatttccaaaaaatgtctcggtcaggcgggatctcacccggcctgaactcaatttgctttatgagcttcgccgtaaggcctatgccatgaaccaaagtgaaaatatgtttaaatatgtcgtcgttgacctctccattattactttgaaaactccgcaccctcttcgcccactcagaactcaataatgttacacgagcaaaccaaaccataaaaatggaaaatacttagataaaaatccctgggtttcctgcctattaataaatgcccgatcaatttcaaataaaatatctgatttagacatatagcacataagtatgatccatcaatgttcatcatcaatgagacctggttaaaccccagaaatacaatagaaaatgaactgtctataaatggtagatatcgagtaatgcttgcgaaccgaaatgataaaaagggcggaggatcagcaattctattaaaatcaataatcccttatcagacactattctctgggacaaaattccaaaccgaaattttacacattaaactactttttaaaaaaccaatccaaatcataaatatatatcgtccaccgaattgtacagttcagaatactaaaaagctactcaaatttatttcggaccaaagcgattctgaaaatatcatatattgtggggattttaacatcccaaatattttatgggatgaaaataaggtaattcaaagaaatgattcagtgtcaaatatgctgattgagtttatagaccaaaaacaattgaaacagcatgtcaaggaaccaaccagggaaaaagcaattttagatttagtaattaccagtaaatcagaattaattcatgatttaacagtacttgaaaacttttcaacatccgatcacaaaatggtcggatttaaaataaaagaaaaattcagtaataaaaatcccagagtttatcgaagagattttaaaaatattaattttgcaaaattaagtcgagcgatacttgaaaatagatttgatgtttctataaattcgatgtataccgttgaacaaaaacataacgaattcttaaataaagtactgaaattatatgatacttttatacccaacagacctctaaaatcgataataaaacaatcgtaccctcaaaaaataagagacttattttcagagaaattacggttacataagcttgtaaaaaaattcccggaaaaaagtgatctcatcttaaattacaaaattatttcaagggaaatgaagaaacaattaaaacaattcagaaatgaaaaagagtcaaaaattatttcccgggggcaaaattcagttaacaaatttatccgaaataagttatcaaaattttttgagattcctactctaattgataatgctggaaatatgttttccagcaatgtacaaaaatgtaaaatattagcagaaatatttcaaaagtcttttttaagaaaatcaattgttaatggtccacaaactcagtcaacacagaataagaccaagctttttgacattgaattgaacgctggcataatttggaacatattaagaagacttccccggcgtaattccacttcacctgataatatcccttatattttattaaaaaattgcgcagatccaatcacaaaaatattagcagatatatttaggctaattttggattccggtcaaattccggaaatatggcgaacatctttggtagtaccaattttcaaaagaggcgaaaaaacggatccattaaattacaggccggtgtcattaaccagcactgtctgtagagtttttgaacgaattttgagtagtaaaattttagaatttctgaaaagtacaagattctttgataaagaacaatttgggtttttaaaaaatagatcgactacaacccaaatattaaaaacgatggacgatatatataattctatacaaaagaatcaacaaattgacataatctatattgattttgtcaaggcgtttgattctgttccaattgatttattacttctaaaaatcaaaaagattggaattgaaggaaaaatttataattttttaactaactttttaaaaaatcggagttttaaggttaaaatcggcgatgaattgtcagaaagtttcaaaatattttcgggagtgccccagggaagtgttttagggccattactctttttgatttttataaatgatctgccgtcctttatttcaaataaagcatcaccagttggcataaaaatgtatgctgacgatgttaaattatattatgcccacgaaaatgatgaccattcgaatcagttggataaagcgattgaggctttggaaaaatggtcaaaaataaatgggttagaaatttcaactgaaaaatgttttgttctttatttagggaaaaataatatgaaaaaagaatattttattaactcaaaaaagatttcagaatcggataatgttcgtgactagggaattataattgactcgaaacttaattttcaaaaca

SEQ ID NO: 1662 - DNA, 3489 bp, Heterodera glycines
cgcgaggcgcgggtcaccgaaaagaagcaacaaaagcacgtttcaggcgtcggcaaaagcaccaggaactgttgcaggtctgttttgatgacgaacatttacgaacaatttttttttgaaattcgaggcagattgatgcacctctcctcgaaaatttgaaaaaaaatttttcgttttttactttcttaaaattagaggtttttctataaaaaaaagaaagaaacttactcaattttcaaaagtctatgttttgcaacaaaaaaaacgctctaacaatacgaaagttggaaccaaaatttcaaaaaaaacatttttttttttgggggggggggggttggacatacataaaatgaaaagttaaacttttttatcctcgcgacggtcccagaattttgggtttttgaactaacctaactaaattaggtttgttgaaattttgccattgtgcaggccagcaaagagttcaaggagttccaccgcagtgcacaggcgcgggtgcaaaagttgcgcaacgagaaaattcgcatgatgaaactgatggaggaggacgacgtcggctaccgacagctgctggacgagaagaaggacaagcggctggtccacctgctcaagcaggtggaggaccaatttttaaaaaaaaaattttttacaaaaaatggaagaatgagttgtggagagtttgaccggcctggtgcgccagcatcagcagacggagaagaagcggaagcaggacgagcgcaaggaggccaagctggcggcgctcaggcagcaaatgcaccaaacagcacaatgccggcggcgatggtggcgccaacggaggcggcgatgactcattgcacatcattgttcggaacagtgccaccggcgaaacgctcaaaggcatgtgccggggggaccgggcggggaaggccagggacaaatgattgtacatgcgccaggagtggcttagggcaagggccatacaacggacgactgaacggtggggggggggtgtatctcgggaccaaaattttgaatgaaactccaaaaaaaataatttttttttttgcggcctgaggtactgatagccgtccccagataaaatttttttgaaaccaacgaggctcgtccgtatctgcaaaaaaccccgccggggaaaatttaaaaattttgattaattttgttaagaaaattgagaaaatttaggggaaaaagttgcccatttttatacatcccagcaaataaatgcctttaaaaaatttggacgaaaaaataaatttggttttttgccctttcacagatttggacgaggagcaacggaatcggcgcatcattgagaaggcgcgcaatgatgaggacgaatacgacaacaaaaatgcactggcccaaatggagtcgtattacgcgacggcacacagagtcaaagaaaaggtaggggaaacattgaggggttgcacttcaatttttcaatattttttttgaaatgggactggcttcgtcagttttgggcactttattttatgggttttggtcattcattcagccaaggacggcacgaaatattttcttttttggcattttcatttttccaatgactcttgggctaatatttttgcaatcattttatgcaaatttcatttaaatttgcaagcgttggctttaatttttgtttttttcatttcttttttacatttttccaattcctcccaatgtttttttgcgattaatttgtacaaaatactatttaaatttgtaaataatgtttgccatatttaatccttccctttggtgttcaggtggagtcccagttgccggagaagacggagtacgtgatcaaatgtgacatgagtgcgctgcaacgcctcctctacaaacacttgcagaagggacgactgcccattgacagcaaacatgagggagcacacagacgtcgatatctgatccggttttagcactcttatttctaggactttcctgctatcccccccccccccccccccccccattcaaaaactttctttttgttttgacatcgggttggtaattggtcgcaaaaaatggaatcaaaagatgtacattggtaacactttagatggtggaccttcttttggaaaaaatttcttttttatagatacgaacataaaatgtattttgaaagtttcaaatttttgttcgaattcgggtcagtgattcgaaacatttactaaattttaaattggttcgcttaagcacacccactaattccaagttagtgcgtcgtattttttattggtcatatttatgtagacggactaaacattcctgggtggtgtgtttgtggccatgttactgtagatagactcaacgtttcttagttggggtgtcaattacataagtaaccgttaccgaatgatgggaacatttgaaaatttctttcgaaaattttcccgatttcaagccatttttggcttttcaaattatcatgaaagagtgatctgaccaatttggtgtaaaggactttttgaccaggacaaaaagttatcgtagcagaaacttccagaattttttctcagcataaagcggggtctctttgtttacgcacccgtaattttttgatggattagataatcggaggtgtcttttaccgttttagtagggtaatattaggggtttgttttatatagaaaataaatattttaatctaatcacacgtcgcttgaaaaacagtttttcaaaatttttcctcttgcttccatactttttaccgtgactgtagttgaaaaataacattcatccaattggctggccacactcacaatacacttttaaattgctttttcaaccaagcgccatggccaactaaatgattactgccattattaaacaagccttttttaaatgtttattaccatttcggtaaaagtggattgaccacagttcatagttccaagtgctgtggtcgtatcctttcgtgggcatgttattgtggacagattcaacgtttcttagtggggtgtcgattacatcttcacggattacagtgcttctttgaaaatatccgttactgaataatggaccatttgaaaattaaaaaagaatatatgctaaaatgcctggcaatgtatgaacgttgtgagaaccggtacgtgcgatagagcccctccgcaagtacatctgctgacaacgacggtcactgcaaatgtttggtcgagtagcaggtgacgttgaatccgcgttgcggtttgcttgatgttcggaagcgaagcattgcatgggcaccaacgcatgtttaccatgttcgtttccaaaactgaacaaagcatgcatattccttcaaaacatcaattaattcacaaaccagctgttggtattattattatacagggagctcacgtcggtgaacactccgcaaggggggcggctgctgctgctaaaacgccactgcgtccgcccgtgcgcggggctacgcctgcactcatccctatgaacatcaagtgcggtgccaagctgtgcacgcggggcttcatgatt

SEQ ID NO: 1663 - DNA, 1826 bp, Heterodera glycines
tttatgcagagaaaaaattctggaatttctgctacgataacttattgtcctggtcaaaaaagtcctttacaccaaattggtcagatcactctttcatgataatttgaaaagccaaaaatggcttgaatttggtgaaattttcgaaagaaaattattagggggttaggaaaattcttgtatgagtaggcttatcagaaagagcacaaaattctctaccgaattgccttttgggatgatgggtctacgaatacctgcagagaaagagagggtaggtacaaaaattaattaccataaaaatgactactttctactgtatttcaaggaaaaatggcgcacccctaactttttgattgattagataatcggaggtatcttttgccgatttagtagggtaaaattaggggtttgttttaaatagaaaatattttaatccaatcactcatctattgaaaaaccgttttaaatttttcctttttcttgcatacttttaccttgactgtatttatttttgtcgcaaaatttcaaagttgtattgtttttctctattgtattttgttggataataaacaattctaacagcaattttttcccaagaattttttgaataatttttaagtttgaaaaattttaagaaaattttcgggaggaaacaatggagggaggaaatgaagtgcgccctagatttactacaagtacagaacagagagacagataatagtcgttaatatgtgacgggtggaaagagcccaaaattaaggcgggaaaaattggttgaaaataatatataatttttctataggatcagtgaaagtgatcaatcaatcaaatggtccggtccgatcagattgatcaatcagtcgtcctcaaagtcgtgtttgccacccattttcttgttgcggcccttgcatcggctgatgttccgttgcttttgctgctttgggttcgctaaaaacaaatgtttcactttttcgattccatccggtttttaaaaagtcggtcgacaaaaatgaaattgtgtgattagaatcccattgcttaaatcctcccgatccgcgagtgagtgttagctgttcaattaatgctacgcaataagctgataacagcgggtgtaattagtggcacaattagatacattttttggcaaataataattttatttatctccgactggtacggaaaccaaaaatggtcctgtttttggcccaaaacggtggcatttgccaactcgcccaaaatgcccgtgtacatcacatcctccagaaaaagcacattgattttgtgagtttgggctaagatagccttgacagtttctggggttgccatataaccgccaccgatcacaaatggcgggaacattttcggcgcgtacatttcacgggagacgtacctgtggcaaagtgccaaaccaaatttttttttacaagattttcaaaaaatattgccaacgaataatttcaattaaatttcgaaaaactggaatgataagttacggattttttttaaagcccattaggactgaaaaattatgggttcttctttgacctatcataattacggatgaacaggatttccgtaatcccaaatccagtaatatataaccctgctgacggtaaggcactccgttcactgaccatttcttgtaagggccatttgggtcccgtacaggattacgaaatccaccaatgccaacaaatagaagcggttttttggtggcaatgtgacggaatttatgttcaatccaatggtccatccggcgcagatggaccaccgtgtcgtcgtccaccttaaacagccattcggcaccggcacaggtgccgttgttgcca

SEQ ID NO: 1664 - DNA, 2299 bp, Heterodera glycines
  misc_feature (2276)..(2276): n is a, c, g, or t
  misc_feature (2278)..(2279): n is a, c, g, or t
atctccgactggtacggaaaccaaaaatggtcctgtttttggcccaaaacggtggcatttgccaactcgcccaaaatgcccgtgtacatcacatcctccagaaaaagcacattgattttgtgagtttgggctaagatagccttgacagtttctggggttgccatataaccgccaccgatcacaaatggcgggaacattttcggcgcgtacatttcacgggagacgtacctgtggcaaagtgccagattttaattcaatgaaatttcaaaaattcttttgggatttatccgctaggaccgtataaagagctaaacaaatagtttttgaccgttatgatggattacgcggattaaagatttttaaaagaatccttcctaattacagattacgcagttaggtcccggccccagccgggtgaagtaattgaaaatctccgtaattacggggttttcgtaattcaaaacccagtaaggcacagctctaacattaaggcctccattaactgaccatttcttgtaagggccatttgggtctcgtacaggatcacgacgtcctccaacgccgacaaatagaagcggatgttttgtggcaatttgccgaaatttgttttcaatccaatgggccatccgggatagatggaccaccgtgtcgtcgtccatcttcagcatccacttggcattggcacagtgccgttttgtaataggattatccttatgaacaattaattaattaggaacatatttatataattaaggcggtcatttatttacctgttcaataccaattgtgaatgctcttttcactttaaaattgacgaaagtgtccaaatgagtgccacgttgaagcaatgccgggtaacagatcagcagtttaaaatggcaattaaagtatttattttgccagaaattataattggtaccggtaattgattgaaccgacactgatttaaaaagcattcatacaattggtttaatttttttacggaaactgaattaaacgccggtggtttaattctttaacagtattggtttaaatacattttccggaaaaggattcaactactactggtttaaaatatttacgtttaccggaaaaaattgaaccactctactggtttcaatattttacttttacaccattactagttttatatttacctttgccaggaataattaaaacattactagtttaaatattaacttttaccggaaaagagggaaccactactggttacttctgaaggtaaacacacaactggtttaaacttactttggtccgtcgctatttcaaattttctaatagaattggtttaatttatttacttttatacaagccgaattaaaccctttgtggtttaatttgtttacgttactggtttaaatgtattacttttgccggaaaaggattgaccgctttaagtgtatttacttttcccagaaaagtttgaaccataactggtttaaaaatatttacttttgccggaaaagtttggaaaacaactggttattacttttgccggaaaaggttgaagcattactggtttaaatatatttactcttcccggaaaagtttgaatcacaactggctactacttatgccggaaaaggttgaagcattactggtttaaatatatttactcttcccggaaaagtttgaatcacaactggttactacttatgccggaaaaggttgaagcattactggtttaaatatatttacttttgccggaaaaattttaaccacaactggtttaaatatatttacctttgccggaaaagttttaccaggtttaaatatatttacttttgccggaaaagtttgaaccacaactggtttaaaaatatttacttttgccggaaaagtttggaaaacaactggttattacttttgcctggaaaaggttgaagcattactggtttaaatatatttactcttcccggaaaagtttggaaaacaactggttattacttttgccggaaaaggttgaagcattactggtttaaatatatttactcttcccggaaaagtttgaatcacaactggttactacttatgccggaaaaggttgaagcattactggtttaaatatttacttttgccggaaaaattttaaccacaactggtttaaatatatttacctttgccggaaaagttttaccaggtttaaatatatttacttttgccggaaaagtttgaaccacaactggtttaaatatatttacttttacccgaaaaagttgaaccacactggtttaaatatatttacctttgccggnannaagttaccacatctggttta

SEQ ID NO: 1665 - DNA, 3174 bp, Heterodera glycines
tgcaggtctttactctattggttcaaatatattaacccccactgttttttaatgtacgtattgtattaggtttaaatgtattccggaaacggattgaaccgctattcgtttaaataaatttacattggagtcgtaatgtatgaaccgccgccactggtttcaaggtactaacattaacgctttaaatgtattaaccgctacttgtttgatgatatatacaatacttttcaaatgtgtgtacttttacgggaaaagagttgaaccactactggtttaaactggtttaaatgtgtttacgtttactctacttctttaaatgtacttactttgcctgatggtttaatttaatttactttttgtaagaaaggggattaaataaatatttatttaataatttaattatattttactttttaattattttatttccaacccttcgtcgcaatttccgccatcttttggaagtcgaaattcaattccatatgggttttccgtcccattttcgggcttacattaagacggtgcttcaactttgatgcgtttcactccgtcggtgccatttgtcaaataaaaacttgaaattacggtaattaacaaataaaaatccaaatttattttttacggtttgatgggtgacaattggccataggacaacaaatgaaaaagcacaatgaaaaatgagataaaattgctaaggatgaaaagatgcattttgttcactcttctaaaaacatggaaaaattatttaaatttaaatataaattattttattttaattttattttatttacaatagaataattaattcaattaattgtttttttactaattttgtcatattattgaaatgatttaacatttttaaaattcgttttctgtcgatcactatgtgaaaaaaatgaaatggatagatagaagatgattcagcagaatttgatgaataatcaccgcaaaaatgcaatgaattaaaaattgaaaattaattaaatttaaaaaataaaaaaaagtaaaattttttactttttccatcaattttactattgcttcttcataattttccaatataattttaaatctttgccttgcaaattttaaattttgaagatgtataacagtgcggcatattgacaaaatttgggcgggggcggagatttgacggattaatttggcggttttttgaatttattagggtcattaattcataatatagtaaattgctgcaagaattatttacacattttcattaattattccttaaatttattggtcatgtgagttcattaatttttcaaacttatggaatataaatttaccatttctttaaaaatttaaataattatttataagattttaaaacaatatttggctttagttttgagaaataacagataaatcacgaaactggctcagaactatagacaatattatagttctttaattatgccttcccccccccccccaaaaaaaaagacccaaatttcccactcgagactctcgaccagtcattactagtaattatagcaaatatgaaagtgaataacaacaaacaacgaaaagcactccctcaggagcttgtctacgaattggtcaatgctctgccgttttgtgtccggtgggcggcggttcgggtggcatcaaattttgaccaatttgtcatggaacggcaacttgactggatcaagacagtcaatgttcgtggtagtggtggtggttgtggtgtgccactcatttgtcagggatgtcggcgattccgaatgcaaatttctcaaaatttagggccccacaaccccgatttatgaattttggcttaagaaattccgatttacagttttttttgcatcggttgacatttccgattgcttttaaaatttaatttaaaatgaattttttaaggcttgttacgctacttatctgacattcaaggaatcattggtaggtgtgttactatttagagctgtctggtagactctgggatttattttctttgaaaaatcgtgacaaaaattaccaaggattccgtaaatatcgggcttttttgggctgggggtagtctcgaaggtgggaatttcggccttttaacatcactataatctccatgccaatcattttactcacatattggaacagaatgcctacaaaaaatcaatatctgttcattacgacgagtggaccgcgtaccaagaaaagtggacaatttatcagcaaaaatggacaatatatcaacaccaccagcagcagcagcaggatggaagccaaggagaagaagtggatgaacaaaaaatggacgaatttatccaagaaatgaaaggcgtttttgaaaaaatcaaaaaaacatcgcaacaaatgaaagttgtgtttggcttaggatggaaagtttttcagaaaaacaaggaaatttttggtctcttattgaaggcctacccaaaaataaacaccgaattttggagtggaggagaaaatgatgacgaagatgaagatgttgaagaagaagaagagcattgaaaatgcattttatgattttttgtaataaaaaaattaaaaataaataataaaaaatgatttaaaaatatgaattgagaaataaacgttttttcattagaattaacatgaattattaccaaaatacaggtcacaatattactcccattcaacagaaaccttaaaaattagcacaaaaataaatgtataacattctttagcatatttttgctaatatttcttgaacttttttggaaaaataccttgatttgggcactcatttatattttgctgtttgtaggtcataattagagaacggaaaaaaaggcagcaaaaatcggaaaaaaaaatgcattccaagcttataaaggcatgcatgatctggtcagtcccaaaaatatttggcatttctttatttgcagctcataaattctgcattttgcggatcatcgcgatatgttttaaagaatttaatttgtggaatcaattccatggaaaatgacacaacttattttatttgaaaaagttgggcctaagaatttatcaaatgcaaaagaaacccggcaccaagcccattttcgggaaaaccgaatgaatgcgaccaattccatcagcaattaatggggcaattttttgggttgtgaactcatttttagaacaaaatgaatgtgaaggggtcgcgtctttgccttatat

SEQ ID NO: 1666 - DNA, 2613 bp, Heterodera glycines
ttgttatcgacgggttatgtcgcgtcaaatcgccagtctgtttttttcggtgacgcgatttttttgatgagagaaggattaaattaaaagaaaatgaaaaattcagagataagagagagagagagagagaaatagagagcgctgtaaccttgagataaattgtacttttagctagggtagagggtcccggacccctgcccctgtaccatatggaggaaggcgtttaagctttcacagtttagcccagacattaccccttacgaatggtcgtttcaccatgccctgaataaacagccaataacaaatttctcagcaatttttgaattaacacttttaggaatgcgttaactgcaaatgatgaacattccccacgtgggaaaattatccaacaactcgcttccctcaaaaagcaattggaagagtgctaattatagcagcagaaagggaatttggaggggaaaagaaaaacgaaatttattaaatataaaaaatggattcctaaatttataagtcctttaaattcgaaataaaccaattcaaaaaaaaaaaaaactaaattgaccttaaattgcgaaaatgtgaatttaagaaaaaaagttcaaccaaattaaaaaaaaaataattatgtacatttgtagaactgaactagtatttatatgacaagcaattttacaatacaatacagggactagcaatagcaaaatgaaagactatgtattaaaatgaaagattatcacaattaactgatcaaaagctatgacattagaagggggcatgtaaaatttaaaaaaaatgatttggcgagatatgattgatcatccttcccctctaatgtcataacaatttattacaaatcacaaacttttcccgcccaataaggctcttatttaagcactttaattacttgaaaaattcagcggctacggacctcccaacactagggcctggatttttaggattttttatgagcttccgctgggtttttgctcccattatattaagatactttataattaaagtaaaaaattttcaataaaatttatgaaaaaaataatttttagtcaatcattttcatgctccaaaaatttaaattttctgtattttttctgttttactttttttttagaatcataaaccctatcatttgcaactttttgggtcctaaaaatccaggccttaaccatcacccgttgctgatcagcactaaatattattcttcctccatctgttcctccttcaccggtgcagcagatgggccaaatgaagagccacgcgtccgtttacagatgatttgtttgcgccatcgccgaccacattcgttgcacttgctgctgttcgctggcttagccggcgctgtcggcattggacgaacaattgaggcggttggcacccgcggcaatggagtgggaacaaccggaccaccatttacagttgcaagcggtgcaatatgtacaaaacgagatggtgcgggaggtggcggttgacgaggcgcatatatttggggcgaaaggattgggggaggttgtgaaattgttgccggatgtgaagccggcaacaatggtgcgtaaggcaatcgaaaaggaggtggtgatagttgaagctgaggctcgcaggggggtagaagactcataccgataggaggcgttgttattgcctgtaaaaaggataaagcttaggggaagaagatatggtaagctttcccagaggctgctaactggaatttttcaaaatcaatattttagcaataaaattttttgaaaattgttaataaatcttcacaaaaaaaactttttgagattttgggccaatttttaaacgaaaaaaagtactttttttttgggctcaacggtgctttgggtaaaaatagaaatttaattattttttaaacatattttcaatgaaaattggcaaatatttggtcaatataatatcttggaaagcataatttcagaaagaaaaatctaattaaacccttgaatcatcaaataatgggataaatctgcatttttttggttattccttacgtttgctggtacggtccaaacagtgacgccggttgcccctgttgtgagttgatagcgccctttcgcaattgctatgcttacggcattaaaattgtcttgcaatttttttaaagcccatttttttgtgtcttcctcccccgttgtatttggtgccatattttgatgtagctgttgctgtcgaaggtttggcaagaaactcatgttgttgttgttattattgttgttgttgttgttgttcatatttatttcgcttatctcggctacaaataattatattatcgatgaataaaacggcacacggacttgaacatggatcacactgtgatgaacctaaccattcttggaattcgtttggatgcggggtggaacatatacgtttcccaccccgcacatcatgtaaacgagcaaagaagcggaaagtggcatcccgccacatttccgaatttgatgagggttgggactcaatctgcaggatctcaagtgatttgcttcgtttgaagcgaatattttttcgctgtagaggaggggaaagtgatcggcttctcattttgccgacgcttgcggataaagcgcttataaagcccatctc

SEQ ID NO: 1667 - DNA, 5471 bp, Heterodera glycines
  misc_feature (3887)..(3887): n is a, c, g, or t
tcactttattttatctgcgcgattgtcaggtaatttttttcagagaataactcacaaatcagagattttcaagatttatttttgtattttatcctcatttgtcattcaactttcaaataaaattctttgttttagccaatcggtgtaaatccgaatgtgaatgaagtcaccaaggtactactctttcttgttccaacttttcctttccttggactctcttttcagctttggtgtcccaaaggcacttacagtgccgttgccaatttgttcttccaaaacccggaagagagtgtgaagagtctgttccattctccgtcctcctctttccgtccttttactcttttcgttttcgctgtcgaatatttcgtccttactttgtggacctacggactttcagttcccagtggagtgcgtttttgccgtcctttccatgccaattgttgttcattgtcccttaggtgttcattccgtcattgctcaccggcgccgcttggggtcgtctgtttggcatttgtgttcaaagtctttttccacaattggtttgtgcttttttgtgattgttttacgaaaataatttattttaattagggtcaaattgaccccgggaagtacgctttggttggtgcggctgcgcaactcggcggaattgttcggtaatttattcacgaccgactagtacatttgattcgaccttttattccgtcgttccctctttttacaggatgaccatttctttaaccgccatcattgtcgaagcgactaaaaacataaccttcggtcttccgattatgctcgttctgatgatcgccaaatgggtcggcgattggttcaccggagtcagtgtttctgttttccaatttggttggtttgtcaggtttttgctttaggggttgtatgacgaacacatcgatttggccgaagtgccccttctcggatgggaccctccaaaactttctcggaacattttggccaagaaagtgatgcgacgggatgtcgttgcactggagagagtggaaaatgttggccgaattgtggaaattctgcgctcgacgcgtcaccatgggtttccggtcgtaaatcgaatcgacgcgagcattggcgactcccaattccccaactacggaaatctgttgggcattgtgttcaggtcgcaactcattgtcatactgcagaaaaaggttagacggatgcattgagagataaacgtcaaagactaatcatcatttagcattttacgttggattacgagggaaagtatcccgcaaatggacatactccgataagtctcgaggatttcagtgagttctatccaaggtgggtgtgtttttctttttggcatttgagtaaacaactcccacactttgtttagggttgagtccaaaatatcccaactcggactgactgtggccgatgaacgctcttgggttgatcttaagccgtttatgcatccttcgccctatcgtgtgcccctcgactcttcccttgactccatccatcgtgtttttcggggacttggacttcgctttttgctcgtcgttgatcgggaaaatcgggtttttccttctttttatttactctaattctaagtgaattggattttgttttcagctgagagggatcataacgcgaaaagacattgcgcgcttcaaagaacggcgggtgaaaggtgcttatcttgtgcatgagattcacatctccccttacaacaattgattcttttttctcgttttgccttttccggttttcttttgtatttttatccttttttattattgactggtaaatcaacattaaattacatgttaataattttctttttttgcttgtatatttgcatttattttttattttaattgactgtttttatttaaaggcctttttgtcatttcacaagtttttttgcgcacatataacattggtagctaacactattaacaacggacaatgtctctgctgaatggaaagaatgccactggccattgtcaatctgacggcggtaattttggtgtttacaacacattttggaatcgttttcagattcatcgatcgctgtgaagcggggcgccgaagaattcgacttcggtgggagcgaagccgacggggcaattggccaagggtggtcaattgaattgagcatattaaattatttatgcaattttccagtggaaacgcaccgccggcagccaaatttcaaagggttcagcagttctcgtgctatgccgtttatagcagatcggcccagcccaaatcgaacgccattcgagggcaaattcagggtcagaaattataactacaatttattatacgtatttttctcaattcagattttaaacatgaattgcattacgttttgacgaccattttcgatgaaaaggctgctgaaaacttgaaaagtctcaggtaaaagggtcttttgttcctggtatgtaatgcctttttccagcttggtccaactcatcaaaaaggctattattccccaattccgcaactttttacgcacaaaaagtgtccaacttgaaaaactctttggcgtcttaaacgaactgtcctcgaactcgtcggtactcttttttcgataatgttccctttttattgcatttgattgttaggtcttttctctgtcctcctcctgccttttgtatttgttggctcgcgaccaaaagagtattccgccctctgaagtaacttcggcttctacttttgccctcttggtgcttttccctgctgttctctctctttcagaattgttttcgactcatttctgaacttctccggcaagactctcagcgtgccaaaatggacgaggaacacaaaaagcacacggaaacggtgccataatcattagggggaaaatgtgtacggggaaggaaatggaaaacatttttttgtgccgtcatttcagtgttttttcactaaattggcatttgtttttgtgttaagatttggctcataatgaaggattggcacgtcaattgccaaacactctcctctaagcaaataaaattcgacatggcactcgacaacatcgccagtccctacttggcactcgaagcacttgcttacatggcaacgcgagaacatggctcctttttcaagtcgaaccttctcaattccggctgtctgacgagcatagtcgcaaaatgtagcaaatattttcgaattaattgaattaattaatttcagttgacaaagtcatcctcgagttggtccattcaaccgccgatgtcttttcccgacttaacattgtcgagcggtgttttcgaattctggaaaatgttacggtatttgtcgaaatgcgtaatttcttttctatttgaggcggcagtttttgacaagaagaaccaaatgtttttaatccaacatcgcaacagtttgcttatattttcaaccgccaagtattattttttattggaatatttttcaatataatgaattctttttggtcaggtttttgaatttcgctgccaaatttctcgaggcctgccaaccctcgtcgtctgaatacggcacctcccaaagtgaaagtgataaactgttcgaatgcatttgtttgtcctgccgagttctgatgaacatcagtcacgagaatggtacttaaatttttggcatttatttattcatttgttgtcaaattttattcagaaaacgcctctctaaaaattggccaagtcgccggttttctcgccaattgtctctctctgttggcctcccattttcaaaatgcgcctaaagacaaattcttcgacgtttgttgcatggtctcaacatcatttgcttaattaattggcttaattgccttcttacaatttcatttgttcagatgttcggccttttggtcaatttactggagcgatgttctgcgaatcgccgaagatttgttgctttanagtcgaattttgtcgattctaacggcgaaacgctcaacgaattgtcgtctgtcgaaattctaacaaaagtgcaaaatttggcatcactttttccctgtttcttatgccttttccattaagcttttcatccgccatgactcagctgccaaaaccatcgacgaggaattggacaacgaattggtggcggaagagcaatttgtggaggaggaagaagccgaaggaggcgtggccacggagttgggggacgacgaggggagcaacggaacgacgaatggggggagaacagcgggggggcacggcaccgggggcacagagcactgacgaggacgaaatcatcgcggcaattcaatcggcgatgaacaaagcatcggcacacatggaagacagtgcgttggcgagagagagagggagagggaaaagaaagagagaaggagggcaaaagggaaaaagaagagacagtgaaaaagagaaagcaaaagaccgaaaataccaaaagtatcggtattctggatattttaaggtatgatcgcctcctattgctctttggtggtggccattttggtggattctgatgaggtggcacttcatttttctttgtttaaaacagtaaatggtaaatttgaccatagaaactggcaaatcaagtgaaggaattggtgccgaatggcgacgtgaggccaatgtctgagcaactgaaacgatttctcgaatttatgcaaattacgaaggtgtgtactacaagagcaatgccaaacaatgttccaatgttttaaaatggcatttcattcagagattgaaagagggaacggtcaaaaacatcgaacggctcataacttcgttcgaattggccacaaattcgcccgactgattcgatggcacgggacaatggccgttggttttgcccacatccatttccacttctcttctgctgttgctttgtgtctaactgactctttcctaacctttactcacttttcttttccttcagtttgtcgttcttatttctttttgatttgtatttcaatatttattttggcaaaaattgatttgcaattattgtttaagcgtatgattctgcttattttgtttaaaactgatattatatccctctttcctctcattatcaatcaacattaaatgccgggttactgaatatcgatgccgaatagcgttgttcggcgggtcgacggtgttgaacattgtccgtctccaattcccttttccccatctttctgatgactcccaaatcacttccattttgttgtccgttttcgtcactcaactttttgcccttttcattctcttctgctgttgctgatgctttaaatttcctcgagtagtaaatgtactcgatgagaagcatcgtcatggaaatgccaatgcccgccaaaattacctaagacaatataaaatgagttgttttttcgttgcgtttttgcccacgataaacactccgccgatgttccgaatggatattccgctgctgtcgtcctccaaattcgggcagtctttccgccgttcgttttgatgccaccaccgctctttacatgtttccaatttgcgctcattttgcagcctcaaaat

SEQ ID NO: 1668 - DNA, 1235 bp, Heterodera glycines
ggccgccaaacaacccgcaacattttttggcgcttcgccgcccccctggggggtcagcgaagtcatacaaaaccaaaggcattcctaaaggggggagggagtggacagattcgaatggcaaatgcgcactttaaatgtgaagttgcgcttctcctcgtcctcggcgtacctttcgctgttgtttctgtacgagtagggactgaaccggtcgaacacccaaagcaaagtgctggtgaacagataagcccctgggggacaaacagttggaaaatgccaaaaaacgaacccaaaatgcacatccaaacgggccattcgagcaccttttggtgggaattaaacataaaaaaggaaagagagaatcaacaaatcactttgaggaatttgaacattgaatattcaacgtccgatcgcttcatcaaaatgccaaggccgaccaaatcgtaaaagggcaccgtaaagtcaatgtcattttcacgctcggccaacactgaaagttggcaaaaagaaagggcaaaagtaaagaaaggcaggcgaatgtttggccgtaaatccccacccgaaattgggccaagtgccaactccgctttgcccaacaccaaatcgccaatcattccatcccaattgccattttcgtcaaaagagccgaataagccatcttcgaccaaatacagttcaaatgtgaaattcagagactaaaaaagacaattgaaaaagggggtaaaacgttttaatcagtcaattagtgggcaattatcgttgttaattggtcagcccacttctgttagcatcgttagcaaatcgatgcaatagccctccacgcgttggcccgtgttcagaaagacgggtttcgtgctggcacagggcctgggcttctcaatggccgaagattgagttgcgttttctgacaccaattggatgtacggttcatgctgaacaaaacgaacaacagaaaatgaatgacacaatttgcatttgattgactcaacgattattgtaacgatacggtagtgattcaaatgttgcacgtccacgttcaaatggccatacaatggccaaattcctttctccagcgtccaatttgcgacctgccaattggactatcaatcataagaaaggtccaattggccgagaatctcgacccacactaattaattgtcatttgaacttaaaattggcttagttccccgccccatccgattgtacatcgcctttgccatgccccccctctcacatct

SEQ ID NO: 1669 - DNA, 5316 bp, Heterodera glycines
ccccccccccccccccccccttttttttttttttttcccccccccccccccccccccccccccccatttttgatgtccgtcgggtttttcattgttttccctttaaaaatcattcgattctcccctgaacatttttttcttctcgttatcattgcctctccatcagtgcctttttcttcttaaattctcccacctgataaaactccttcccgtgattgtgtttatatcttccgaattcgaattcctcccgcggattcgatatcattttggtcagcgttttctcttttgtcgaatttcgctcattccaaaaatttttcggcaatttttttgcctttttgactagcaaatcgttggtcataagcaaatagcgagtggtaatgtttatgatgtccagacagaaggacacttgagtctcggaaaaggtcggcaccggcactttgtagtccatttccatctcctcctgggcatttggccaaggccaagaattaattggcatggcattgccaatgcaaattttttggtcgatggcattgccaattgttgccaatatgaattatcatttaatggctcacctgtctcaaaaattcgttgaagtttcttagcgtggccacccgaccattgggcataattcggaccctttaaaattttgtccaatttcaattggcaattttcgttccttcttcgctggtccgtcacccaccaaaataagctggcactcacacagtcctcacatttcagtgccaatgtgtcctttgtgaacacaatgaaattggggaagtgtcgcgcttcgaactgaagaatggccgcttgcatatatctgaaggcatacggtagccaacaagggcggtactgtacttcagcaaaagtgaataattctcacagttctgcatttttggtggaagcgacaatgaaaatgtttttcacactttttgagcccacgtccaactgtttgacgtgttcggtggcgtcctatgcaaaaagtggaaaaagtgatggatggatcggtactttccattgcttctgatcagtgggtgatcactgatcggtagaggatcaatccctttcttctgctaatccaacaaattaaagtttggatggaacattggccttttaaaaatgagtccgtctgaatttacgctcattttggtgaacatcggctcaaaaaggacggctttcttcgaagctgcgctgaacaattttctccagtcgtattcgactttctcgtcaaaatgtttgtcgtagaggacaatgaattcggagatgttcaaatggcggatgagttggtacaaaatgttgtcgaaaacgacgaaggcgggcaccaaatggaggaaattgtcaacagaatgatcaaaaggcatcgggagatgacctaaagcagaattaatcaatgaggattaacgggctaattgccctccttcagtttggcaattgactcgtcatgtgccgagtcgggactgactctcagctcaggaagggtctcgggattcgatttcaccttttggcggcactccgttccacgaactcagttccgcttgaatggccgcaactgatgaattggcagcgaaccatcggacgaactctttggcttctgcggactgagccaaactgatcagaaaggcactgttctcccgtagcgaattcatttctcaatgagaaaatgccaataattaaccaattaattaatgaaagcatttgactgaattaattggccaacttttcgaataaattgcgcttttgccaaagtccaaagtgccgttggcgtgtaaagtcagacttttcctgtcgacgtgaaaagtgtccaaacggagcatttcatcgtcaattttgtagtggtcccggaaaaagagcagagagacgttcaaatgttggacgaaaacggaagcgatcggatcaaagcgatcgatgagaatggctgaaaagtgacgaaatcggcggaaagtgacggaggaaacgcactgatagacaacggagacggaggaggggcaacgacggacagaacggagtcaccaaggggaaaaagcaatgccaagacgaaaaaggagacaaaaagcatcgcgaaataaggcgaatgttgccaaggcaaaagggaacggacattcctcccccccccccccgaggtgagctcgaattacaaacgcaaggccaagccaaacaaaaagcagggcacttgtgggtcagattaattaaagggactgcccgtatcaattacagaattggattggcggagacatttgcccgccaacggattgatggaaaaggttttcgaaaagcaaaagcagtttttggttctcagcgttacacctttttattattcacatccaaaggccaaataataaaaaagaaatcggcacgcgcacttcacagaatgtgtaataataaaataataagtgatcatttgggatggaaaaggaatgcatttggaagaataagtcaaagccattctcagcacttttcgtttggcaacacaaaagtcgtttaggaaaccgagcaacggctcagtaaccggcgtcctcaaggtatttggccattttctccaccgcccctcgcacgtcggcgccgacgacactttcctcgtccttgtaaatggcgatcagaatggcggacttggtcttcacagcgaaaaagctgaatgaaagtgaggaaaagcataaaaacatggccaaaatgggggaaaaataaaatttgggcggaaaagtaataaatttttgtgggttgagaatggtaaaaaaaattatttttagaaatgcacaaaccccgttttgtccctcttcccaaagataagattttcatccgttcgcggcacaatgtaatgaattcctgaaagtacaaaatagagaaccgaagtttcacatgggcaaaccctcgaggtcggcaccgacggacggaacttgcgaaagatcatcgaattggccgacaagtttcttgagctcaggctcactcgcctgaatgaataattgttgatttatttgcaaaaattaatctatccctttatatatttcgagttttatttccgaacaaagtcggtaactaaaacaaacacaaccagagattagagagaaccataatagaacaggcattcttactaattgtaagcccaaaccttgaattcgttctccccttcagtcctggcccaaacactcgcgtccgaattgccaattatggccacgcgagtaatctccgcacaactggaagtcaatgactgaatgtacgcatcccaaccactcattgctgcttctgtttgtcgtcaaagggtgaaaaaaaagaaaatagaaaaatgtctgtttttaaagaaataaaataaaaaagagaaaaaattaaataaaaaaaagtatttcacaaaaacggttgaaatgcgaatgagaataaaaaggcgaaggttcatttcttagatagtcaatattttctttaaaaaaattacctaattgcgagaaaagccaaagaatgaaataaaataacaaatttttattcattcaaagaaatatcaccacattattctactgattaaaggggtgacaattaaaacattagagagaaataaaataaattttttttataattaattatggcataacgccaaattaaaaatattaaaaatttaatttattaccgttattttacacacactaatttatgtatatcgactaaataaaaaaaaataaaaggcttgtattctacatattagcatgtcattgtcattgtgaataagggggggggggggggggaatttcctgtcaaaatcgaccatttttgtgaaatatgacgaaattggaaggaattggaaaaatttgcgggacggacggatgactcatttattctttgtcaatggtttaaaacaaatgaaaaaacgcaaagacaaataggagaagggaatgaaaagacgggagggaataagcaaatgaataaatgaaattaattgtaaaaaaaattataaattaactctttttaagagaaaagcaaaacattttcaattttagattggaaaatgaattaattgaagaaaagacaattaatgaattcaaaaaatataatgagtgaatatttatttaatcattttcctttatttaatgaatgattgaaaatggaaattgttcatttccggaaaatccttctgaacaatttgtgcagtgtcccctccaaaatgccttcgcctctttgtccgcccgtcctcagctgatgcagaattttctgcagtttcttcgtctgccatccgaactctctgcgcgaatgggcctccgtgttgcgcaacttttgggccaattgcgagcctaagggaggcaaaacaattaattagaaaggggcgaaacattgatcagtttgatagcccaaataaaaaggaagggttcctttctttctctgtgttttccctattattttaccttctcaaaattcgccaattcaaatttgccctttcattttgtcggttttccacactttgacctcaaaatggtcactcaaagaggtgttttagtgctttttagtgccaatgtcggccaccaatccgactaattacagggctcggatcccttccctttcctcacatatttttttctctccgctggttcttgtcactttccatatataaacatcacacaatttctgtccgcatcggtgtgccaatttactgacctcggagatttgccccccccccttctctttttctgtgtaatcatcgccgatgttttcattggaaggtgggaatgaatgaatgatatgacggatttgtgaattagtagccaagaaaaacagcggaaagcaatcaaaaatgaccccaaaagaaagaagacgatgagagaacgatggcatcaatttgtgacgaattgcgcaatttgagggcaaagagtggggaaaaggccggtgatttcatgggaaaggaatggaaaagagattgccaatttaaaggtactttaatcaaaattattggattaacatacaaaatggtgaatgaggaggaggagggcaaaaaagggagtataaaaggcacggatgcaaaacaaaacttacgcgcccaataaccacgcccccagttaaaatattcttggtattgtacgagagctctttttgttttctaaaaaaatctatggccaaaatggccagaaaaaaatcatttttttgagtgttttgaccttgactttttttacagtgccccaaaaaagtcttggcccaagctgatcaaattttcaaaaattaaaatttcgacttattttgattcattcattcattctcagggatgagtcgcttgatcacactttacccagaaaggaggcaaaaaaaagtcttggcccaaacatgaaaacccatcttgtagttcatctaaaa

SEQ ID NO: 1670 - DNA, 845 bp, Heterodera glycines
atttttcccaatttcaagccatttttgactttcctaatcaccatgaaggagtgatctgatcaagttggtgtaaaaggcctttttgatcagcatcaaaagttaagcaaacgcctgaattatttcagatttttagatgaaatacaagatgggttttcatgtttgggccaagactttttttttgcactgtatttctgggtaaagtgtgatcaagcgactcatccctgagaatgaatgaatgaatcaaaataattttgtggtgcatgaaaagcacatatattggagtaaataaaaacacacaaacaaaaaataataaattaaaattttcagtcgaaattttaatttttgaaaatttgatcagcttgggccaagacttttttggggcactgtaaaaaaagtcaagatcaaaacactcaaaaaaatgatttttttctggccattttggccatagatttttttagaaaacaaaaagagctctcgtacaataccaagaatattttaactgggggcgtggttattgggcgcgtaagttttgttttgcatccgtgccttttatactcccttttttgccctcctcctcctcattcaccattttgtatgttaatccaataattttgattaaaatacctttaaattggcaatctcttttccattcctttcccatgaaatcaccggccttttccccactctttcccctcaaattgcgcaattcgtcacaaattgatgccatcgttctctcatcgtcttctttcttttggggtcatttttgattgctttccgctgtttttcttggctactaattcacaaatacgtcatatcattcattcattcccaccttccaatgaaaa

SEQ ID NO: 1671 - DNA, 2527 bp, Heterodera glycines
taaaagtttatttccatattatttaattttattgtttttaatttaaataataaaagataaaatatgaataaaagaattttattaaataacagttttcccagttgatttttcaaaaatttgctaatttttcaacttatagattttgaccaataaattaggttttatcataaattttgttcaatgagttattttttaggaaaattgtaatgttgttaacaatatttatggtgaaattcagtagtttttttttgcaaatcagtgcatgtaaagttctaagactgtaatcaatctagcacagtaccaagttaaaaaagaattaagccacctactgctgggaatacagttcaatgggattaaaatgtataattgtttttacggtgatgctcattgaccggctccatagcatgatggtcttggcgcataagtgtacaaattgtccgtgtacgcattgcttagaccatctaaaatgaaaattactttttttcatttaaatttgataaattaatttctaattttaatttacctcggtttaaaacatccgggtcaaggaagggtcgcgatataaatcctagaagatatgttatccgagggttttagaggtcgctgatcatcgaatctgacatgtaattctaggtcttggacccaaagaaccccagggaataatttttcatgactaaatattaaaaaattttgcaaacaaaagggtccccccttttgtttttgctttttgataatttcaaaaggttactctttgcaaatagcgcccaaaacactattaattaatttaggtaattggcaaaagtcatattaaagaatgggcaaaaataaaaaatgtacaagtatgagtcgcacgcactcccaagctcccaacaaatgcttaatgctatcgatcacttatcaaagaaattaattattttacaagcggaaataaaaatttcaaaattgtattattcaaaaacattatgccaaattatgattattactagagcccggaaatttcaaatttgcggatcccgctgcgggactggaactcaaaactttttgcgggacgggatcccgcgggattaatcccgcaaattccgcaatcccgcatttaaaatttgcgggatcccgtgcgggattgcgggattttggaaaattcgaaaaaatttcaattaaattcaaaaaatttccaaaaatcaaaaaatgctgaaaaataaatttttaagggctggcgggatgcattaaaaggggctgatgggtcgactaagatttttcgattggatccgacggtaaaaagttgatcggaaatcaaattattaacggttcataaattgactatttttttcttttcaaacccactttttttgcggtgcaatttttcaaaaaactaggaacagagggtccggcggtccctatcagggatggcattccgaggccccaaaaattttcggaagtcggaaatcggaattccgaccccaaaaacgtcggaaatcggaaatttttcaaaaaatatacaatataataaaaaatttctaaatattttaataggctaaattttttaattcttaaccaagtaaaaggtatttcacaaatgtttttagtatacgcttgaaaaaattattcaatattttatcaaattttttttttgtcatttttcattattttagaacatttttgggaaaaggagtgactatttttacacgttttatacagcgcgattttttcaaaaactttttgggaacttggaggagggtacggcggtgccgataggcgccgccgggaaaattttgttaacagattttgtccaaaaaattacaaaattttgcgattttgagcaaattttgcaagaaaaatagggatttttagggtccggcggtgccgataggcgccgccgggaaatttttaaaaatttcagttcaatttattaacagaaattgtacaaaacttgctagttttttgaaaagaaaaattaaaaaaatttccgacttttcatcaaaaatttcggaagtcggaattcctaccccaaaaatgtcggaaatcggaagtctttccgtgccatacctggtgcctatcgacatctgcgagaaattttatgaaatttaaagcgatttggtaacagattttgtctaaaattgaccaaatgacgcagtttttgactcaatttctacaggattattaagaaaagcctatccggcggtgccgataggcgccgccggggaaatttcacaaattttgaatgaaatttgcgatgaaaaatgagttaactttaattaaatttattatttaatttatttaaaaatatttggcattctgtcttagaaaaattttcaaaaaaatcaataaaatcccgcataatcccgcacaaaaaatcaaatttgcggatcccgctgcgggattggaactcaaaattctttgcgggacgggatcccgcgggattaatcccgcaaatcctacaatcccgcaaatcccgcattttccaaaaaatgcgggattgcggactgggatcccgcaaaatcccgcgccgggctctaattcccgcgccggg

SEQ ID NO: 1672 - DNA, 7351 bp, Heterodera glycines
aaaaaaattcgaaaatgttcgaatcggggttaggggttcgaaattttattgatatgagttcagattcgtgcttagcgaccccgaaaacctctggaggcatctttatgcctcaaaaaaaaatttttcttaatttttttcttatggggtctaaccagggatggagttccgaggcactaaaaattttcggaaatcggaattctgtgccatccctggtataaaccacatagtaccaaaaaatttttttgtcccacataaaattcaaatttatccaaattgtttatgtcattcgcccaccttaagctgttgtttgtcagcaatcaattcattgtttccatcaaattgtccatcattttccaaattaattgcagcgccattcacttctaaaaataccataatttaatcttttggttgaaatattcatttaatttcagttttcaaactcaatttttctcccatttcatttacatacctccattttctgttgctgtgaaatcatctccacaatttattgaattggtcgaaattgaaatttttgagtttgataccgataaaacaagcttggattttaaatttcctcaaaagaattttgttgttgttgaataaatgacagggaataaaaagacaaataaaataaattagagttgagcgggaccgggaattttgggcaaacccgggaccgggaccttttcgggttgaaaacccaggaatttttggctgggaaaaccgggactagtcccggtcaaaaccgggaccttggtactcagttgtccgtgttcaggtcccggtcccgctcaactctaaaataaatgactattcattcatttcattttgtttaggtgtcagtccctttcttttcaaaatttaggtcggtttgatttctcatcaatgttgaaaattaggcatgtgaaggaatagaagaacaaaatcaaaattgagaatttggttagacatttttttggcgagtaagagaaaaaggaaatacaagaggaaaaagagagaaagagagagaaagagaaggaggacagaaaaaaaaactatataatgctttttggcgtaaattttttctaattttcggaattttcttcgctaaaaatcaaattttaccttaaagtaaaaaaagtcatgaaaagcgtcaaaaaattgaaaaaattctgaaaattttttgggcatttggccaagaattttggtgccaaaaaagacattttttcgaaaaatcgctaaaatttatgacaaaaactgccgaaaccccaaaatatgtttttattcccaaaaagtccaaaatatgttatttttgagcttttcatgcgatagcatatgcgcaaaaaaaacatgtaaaaacatataaatccgttccctgcttataattttatttagagagataacgaaaaaatgagttctgttatctctttccccattttatttttccgccaaaagtcatttgaaaaaaattgctttaaaatttcaaaaattatcgaaattttaaaaatgatgttgattttgcctttctctcccctcgagcccattggcaacaatttaaggcgaataaattacgggaggggtcggtttagtctggccgttttagtctggccggtttagtctgaggggtcgttttagtctggcaagctgattttgtgccatatggattctaatcagattttttttcgaaaaatgtttaatttaatactaaaacatacattgaaaaatcattacgggcacatttcataaatttgagataatgtaccaacgagataatcgctgatgatatcgggattaacattgacattgacatgcccgtaagagtcgaagaattctcgcatcggcgacatcaccacctctaaggccaacgaaaagttgcaggcgaaaaattcgcccatctttgacaatcgcttgaggcatacgtgttcaacgcttcacacttgaagtgagaaggcagtacgtaatcaaaatccaaatgaacaaatcaaattttggcataaaaattaggaaaagttgacctttttgtcgcagctttattcggaaaagcagctaacattggtgttgttgtgttctgcaagacttgtacacgaattgtagccggcgctttccacgtctcaactgcacgccgttttagctgggtcacacgtcgctgacactccactgctcggcgctcatgtcgcatgtgtggcttccaataattatgaggagattagcattaatgtcaatgtgtaggctgaatttaaaaaaatattctttgttttatttttgcatacacctttgcatttgttattaggtccgaaaaattcgcaacgcaaacacttctttgtaggtgaacagaaattttaaaaaattatatgccgtcaattttttcaaaaaaacaaacaaaatcgacattgaaagtgctaacaaatgaaaaattcatcgtcatctccgactccatccagctctacatcaccatcatcatcagataagccggcttcttcgtgatcgtttcgtccatctttcaccgtttcattttctctaaactcgcgcaaaaattttgtccctatcggtccaattgctccttccggcttgaagcaagcaattttttcgtctcctgttccgtcgaatggcgtagtcaacccacagacttaaaagtttcggcgtctttcgtaggcatttttattttttaaactgaccctcgaatgatttgatgatcacggctttggaaatttcctgccacgatctgtggatccagtcaagtaccatgtgaagcgctggtgccttcgggttgcctgccggtgtgaactctttttctgcatcattggacatccaagtgttgtagaaatgccgaattcgctccttgaacggcttgttccacgagacatcgggagcctagagaaggaattaactttactgagaaagatgacactccacctgaatgaatttggtgcaaccgccagggacaaaaaccgtttccactcccaatcctttcaccaccttcgtcgttctctcgctcttgtggctgccaaacgcatcccaaaccaagaggcgttcgccaacgaacagctttgccccgattattttgtgcaggtagtcctccgttgtgtcatcgttcatccatatcggcccagcgaaattgataaccaattttccagcaaattgtttgacaatttgcggcaccggtcgctttctgttgaccaacacgtacggcttgagtttttgtccgttattccgtgctgtaagacacaccgtcacccgcattttgtcatgtcctgtggtcacaactgtcacctaatttgttagaataggttcattttatctaaaaaaaacttacatcctttgcgcctttattgtccacacatcggttgtccgggcaatcgaaccaaacggccgtctcgtccattgcaaagatgccgccgggaaaattgttcttcgcctttcgcctttgttcaacaaaattgatgaattttgccaccgcttctgcatagttggacggcggtttctgacaaactgatgtcttcttgcgcagcacgaaattatgccgttaaaagaagaaattgaaattaacacacaacatagggaggacttgaacctgggaccccccttttggtgactaactcacagaccactaagacgaaaaaaccaacttaccgtatttgctctttttatataccatggtatattatttttcaaccttctcagaagggggtatataattggagactggcagactaatggagactggcatataaaaagagcaaatacggcaattgtacttggagcccaaaattgaatcgccgtgtggaacaaagtcaccaatttacgcttgactgttccgtttgcaacagccgatgagcagccagtttggggtgttattatgcgtaaaatttggccaattttttcggcaaacattcgccacttgggcgtttgcaatggcatcctttttgacaaattgcgtcgtctcacttcgccttcaattctcaccgatctcgaccaattgaattcaatctattccggtgatttgttgcccgaggcgattggtgatgatgattttgatgggccaaatgccacaatttctgctggccaaatgttgtcaaaatggttgcacagtccgagaaaagatggcatgccgaagcaattgcatttctttttgaaggagccaccaaatatggaatgggccaacactctcaaaaaggtgtggccatattttcgttagccaactgattttgattgcatttaattaatgtccgtccgttttcccattgtttagcattttctccgtgccaatgccatttcttcggtcagctaccaaattcaatttactgttcagcaaccgtcaacgcaaattgtgccatttgaattagcgaacgaacagaccaaggaaaagctgacactgatcaaagcaagcgcaaatgtttgggaggatcgctgggtaatgaaacggtgccaatattgggagacggcggcggttcaatgggcagcccaaaatttggacggatttagcactgtcgagtttcattattacgtcgaagctggcattgggtgagcaacaaaaaagcatttgattttgtttaaaaattgtgccgaatttttaggcctttgtcgccacgtcgcaaatggtgtccaattatttgaaagtgatttaatgcatttgggaaatggtcgatcattttgaattatggcgatgaataagaggtgatctgaccattttttatgctcgtttttactctctgatttgttgttgttttccgttaaaatataaattttctctctcgtctcgatgcatcccatgggtatgtaccagggatggcatggaattccgacatttttggggtcggaattccgatttttgaaaatttttagggcctcggaatgccatccctggtatgtatcaattaacacgaaaaattcagggtgtgaagtttttcatacgcaatttatagttccaataacagtacagtgcttgtcattaaaatcaggacaccccccattttcagaatttaaccgcttcccgtgaactggtcgaattgattattaattcaataagttatttgtagacacgactaaaaaggcaccaaaaaatcgcgaaaaaaggactatttacatataataggcatcaaaaattgaaaaaaggcacgaaaatggaccgatgggttagacaatgtgccaatgggagacgaaaaattattgccaaaaatggaagggatggaaacatttcgacacaactttgtttttaaaataagaaaattttaaataaaaatctgaaaatgaatcatgatattactagggctggtaattaaatgcacataaaatcttaaactatgcgcataaaagtgaaaaatatgcacataaatttttccaaattgggggcaaaattttcacaaattcttcaaatttgttaaattgaagcataaaaatctcgaaaataactaaatgtagtatgaataatctacaccactaaagatctatgttttggaaataaaaaatacacccctaaaaagagaattttttcgaaattttgaaatttttttagctattttgtccacacttccgaaaattttcgctgcaaacagaatgagattattacaaaaattttgaaagtatttgacttgcaattgtgaagctagaatttaataaaattggaattttttaaatgttaaatccatttttgtgcagtttttcgcttatttttgagtctgttttagcaaatattgaatataaatacattttactgaattttttaggctttaaaagatatattttggcagtttataatccatattttggtccatatatggccatttttgagctttttagtccatatttcgggctttttagtccatattttatgtccatattttgcgttttttagtccatataatttataaccctactgataaattatgatcggccgttcattctcaattaattcatttcgtctgctgctgaatcattgtttttgttcgtttgtccgtcactcatttgtcagaacatccttttgtgatgctttgtcccgtttcttcttccggtggcggagacaatgaccttaattaagcgcaaaattcaaatttgtatatgtacaaaatcaaatgccggtaatagtagggctagtgccacctttttgaagatttttggttttcgaaagtcatgaaaaatttgttaggggcttttcggtgtcgctgatcatgaatctggcatccattttgaccaactccaaacaccggacctgaacaaaaagtcgaaaattatgggaccaatgatgtgaactagggttgcgaccccgaccgtcggggttggaaaagtcggggttcggggttgaccaaatcgttcggggtttttcaatttttttccttatgccatatagtcaaaaaaaattatattattttagcttaaaattttttaataatcataataataattttatgtacttttttatttctttttattataactatttttgtatagaattaattaaaacgataaggcatttttaaaatgaacaattttcagtgaaaatctgtaaaaatagacaaaatttcaaatttttcctccggcgccgggcccccaaaacttatttttttcttaaaaaaatttgactcaaagtggcattgctttcgccacgtttccatcatcacacaccacggatggccatccgattcgggacatttttgttcatgaaatttggccaattttttcggcaaatattcaccatttggacttttcccgtcgtgatcatttggacaatttgcgtcttcgcacttcgccgacaattctcactgatctgaatcagttgaattcaatcaatttatatggtcggttgcccgctgcgattggtgatggttttgatgggccaaattcaacaatttctgctggccaagcattgtccaaatggttgcacattccgagaaaagctggccaacccaagcgattgcgttgttggcaagggaactttgaatggatcaacaatttcaaggaggtgtggccataatctcgaaaaacactgatttttgtttccaaattgtttagcatttgatatttgttcctatcgaattgtttagcattttcgccgtgccaatgccattggataatgaaacgatgcaaaattattggggagaccgcgacggtttattggaaagacggaaattgggacaacaattgcaacaatgtgttcttttggctttttagtggcactaattgcatcgggtgagcaattatttctcccctccttcttgcttcgaatttttcctttttctctctctctctctttctcctcccttccccatgctattttcatccttttcctcctctttctcccctcctctttgctcgaatttttcctttttctctctctttctctttctcctccttccccaatgctattttcatccttttc

SEQ ID NO: 1673 - DNA, 2606 bp, Heterodera glycines
  misc_feature (2598)..(2598): n is a, c, g, or t
tttgattttttcaaaaggggaggggatccaaaaaatcataatgttttttagcttcatcattgagaacaattgaaagggctctgatcagacgaaacatttctgcactttatgccaaactaaagaatgagaaaaggacgggtaaactttcttctttttaaaatttattgcgtaaatgtattttattattttcaaccagctgagagacggaccatccaaaaagccatccgttccgtcactgggcctcgagttgcacacattcgtatgtgattagaatgcgattatacacatttatcacaaaataaaatgtaatttaattaagttggattattataaattgtttttccccaatgcttttcgtcgttcgttttgcgttttcattccattgttttcgaatggccaattcccatcagtgccatttgtgctgcaaaatcggcaccgtcgattagcaatttcgctgtacatgtcggaatcttccctccctccgcgtattgccaacttccacccttttgcagcagcaactccacccggcaatcacttcgcatggccaccttccgcaatgactcgctgataaagtgctgcacctccgcactccaaccacggccttggccatccgtgccgatttcaagctaaatgttcacaatctgcaggtccataaaaattaacacgctttaccttacattttgccagaaaaattttgttgaaagcggtcactgtctaaaatgattttgtttgaatttgctgtgaaggctttaactgacttcagtgagcggcctcagctggttgtgatgtacggcgtggaaatacccttcgtcgacaaccagcacaaccttcagcattttttactctttttaaatttcaatctaatacccaaaaattggggtcggctaacgatggtctgatcatttcaactctttcccatctcccattgacttccgcggccaaaatttcgcctatttttggctctaaattattaattgacggcaaacgcgaaagtgcagcatataaatattcacaatatggaacctaaaaaggaattttattctcaactcgtccttgaaatcccacccaaacagtcaatcgaaaatagatggcgtcagggtcgatggcggaaatcagtctgatcggcactgggtcaccgtttgcctgtggtaaaccgttcaaagggatcgggtcgaattcgtcggaattgaatcggacgacgactgaagaaacggctgattttgaggctttttcctcggcactctccattctgcagagaatggcgtcgtcgtccacggcgtttccattcgaatgttcagtcaccgtgagcctcggttgaagagaaacggacaaaaccgacttaggttttgtcgtttgtacaaggtactggcaaaatcgacgttttaagtgtctcatcctcaatgctcgagaattgatttggatggaaaacggcccgaaggatcgaaagtgccgcgaaaatcctcttcaacggatgacatttgatttgtctgacccaccagcatggtgaaagtggacacgtccttcagctcgaattcttcagttgaccgcattaacgaaagccaatttcttggtaatggtttggccagcctttttgtcacgtatctgaacaataaactcgcttcaattctgagcatctcaaatgcaattattaacctttccatgtacttttgctcaagaaaagtggaagttattcctgtcggaaactccttcagaatctcgtaaatctgtaaattcaatgaattttaagcaatatttttccattttatctaaccagttctctaatctcctcaacctcatcatccaatggctcttattcaaatggcatccactcaaatataaatgacaataatacggggagaatcataaaaacaatccaaatgcgtttattatagagcatataatgaacaatttaatgacaataaggaaatcattttttatttaattatttttaaaaagagtgatggacaaataaattgcaaagtcaaagtgtattaattttcatgtgaataaaattgaaaagaaaatgatttctcgtcgttattcaattatttatccgtcatcattttccgtttccttaatttttcgttatatttatttctaatgcaaatgcttttcttacttctcttgccgtgatcgtttcttatgctctttctccaaatccgccaattttcctttgtatttgtgaaaaatttcactcagttcgcgcattcgactctcgataagacgcacttgctcatccgggtcatccgcacatttctccaattcgtcgtctgaaacagagacatttatttaccaccacacgttttgttttacctaattctgacaatccgacaaatgaatagctgtcgaataaatgctcatcttccattcttaacttcaaaatttgtagttaatgtattttgattaatggatgcttttcaatcgtcacgctttaggaacccacctttgcaggacgcgttgcctcattgaatgcatactgacgctatgcgtaccttaaggttatgagaatcagactcaagtcacagagaaaaacaaaaaagtattaaaatttttgagaatatacttgaacgtaatctcagttatctcttttaccttcanaagcattc

SEQ ID NO: 1674 - DNA, 3261 bp, Heterodera glycines
aaatgttgtgtgtcttttttgcatattcggtagatctttaggttttgacaacaattgaacatggtcccattgtcataagcgaattgcaatcagtcgaatctaattatgctttattttaaaaatagcttaagcaaagtgtcaccgtttttaatggccatcgatgccacgtttaaagaagaagtctgatggtcaattatgacacgttccgagtggaccgaaataaaagtgtgtggcggcgaagaggaagaggatgacgaagggattccgagttcagatgatgaagaagcctacagaaaacaaatcttttaaaaaaataaaaacagtaccaatactttcgttaattgctgtgaaattgtttttggaggcaattgatgagccgaataaacacaacttgggactggagaacgaaaaccgatttccaatggtgcaacatttgtgctcaaaatttggctggagtattgctgttgtgtgggctgtttgtcgggctcacaatcagccaatggtgtcatttcgttatttttgcgtgagttgccatttgtcttggatagtgtggccgaggaaagccggcgagggcgctgttcggacgattgggcgcttaattatttttgtaaaaaaaaataaaacgtatcgaaatgaaaacaaacggtacccgggaagagcggcaagcgaagcgattcctccggcactacgacaccaatccatggcgacagagaacaattccgaaggaaattggtcgggcatcagctgtccaagcgcttttgaacttgacttttcgtccttctcgtccacccgaattttgtgaagcattagccattcctatggaaaaatatttgatcaagttttttttaaagtgaaaatatttcatacgtcatatcgcgaattccagccaaggtaatggacaaatattttggtagacatcataattgaatggagagccctctttaactcagcacccatgttctaaaataaacatatgaaccttaaaataggaaattccaaatacctcatatgacaaatcagttaaattttgcgaaatttgcctcgaaataattgaaagatcgaacgcatcacacaaggatgttgcaatttcttgcagagtcggctgttttaccactaaaaatattgttttcataacacaaacacttttattcaattaaaatgagccggatacttatcacgcgtgcgtcgtaaaagcgaagatggtgccgagctaacaaataagggagaaatgcaatcaaatgaaaggaatctgttgaatttctaaccatgaacattttgtccttgatagaaacgcgtaaatctaaaaaaagtagcatttatcgcatgtaattttctgcacccattgacttttttaagttcactgacatgtgagcgtttgtgaatccaatgtcttcaagaacggcttggtgaccggacggggatttcgttcgttggtcccgtggaattttgggtcttcttccgcgaataccttgcggcttttttaggagggacgaatttttgtctgcttaaaatcagtgagatagcaaataaataataatttattaataataaagcgttgttacgttcgtttaattcctttttgtttgttattggcgactcttccgctgaagttgaccgactttccaattcgtggctgtctgttcgcttcttttccaatttttcgaataaatattgcgaacttccagaaatgtcttcttttacatttaattctgtactaaaaaacagcgaattaaggttgacaataaagcgaaagattatcaaaatacctttctgtattataatcagtttccccaacctctaaataattgatatataaatgaaagttaaaacgtgaaaataatttaccaccattcattgcgttcacactaagtgaagcggcttcaggcaattgctttcccaaattgtgttgtgattcattcgctttggtcgctgtagccaccgcgggggacaagacaatggacgacgaaaaggagcccgaacgagatttgatggcaatgtcggattccttggaaatgcttagacctctatccaaagatcgtcgttccttttgcttttttttcttctgctcgggtgctggctttggcttaaataaataacagatattttaaaaatataattaataataaatacatcaatttgattatatcctctgatcatccgtgtcgtgcgcgaatttgtggacagatttgacgaagagatagtcaaactcgaatacccaagattcttcataaatgcttcgaacttctcaaaataactaaacattttttaaaatgttgttcgttcagggtttatgttaacaaattttcaaaaaaacctcccggcgccggatttccctcctgttcctcaaaatatttttaaaaaatgcgccccaaaaaagcggtgtgaggaaacaaaaatcattgttaatgattgactgcttgttaaccgccttcgttattttttggcattgtcggtttccatagttaaacacgggtttggcccctttataattttaaacacaattcgtagttgatagtgagttaagccctttctaatggaaaaactaaataatattcaagcgaaaatggtattcttaatagaaagtaaaggctttttaattttaaacaattaatacaattgattttttccattcccgtttttactttcccaccgaatatatgtatttttgacgattgttggagagacgcccgtgtcctcaaggtgtaactttcgcaatactttcctccatctcgcctcttgagtaactctcttgtgaccgcccatacgactaacgacgtcgtaaaatcggtaaatgtcaatttcctttcctaaatttttcaaaattcactgaaaattctaaagttatttgaaaatgttgacctcccaacaacggcactttgttcagctggttgcctgattcgtcttggaatttataaaaatgagcaacacaaaggtcccttctctcgttgtatttagaatcgtcgtcctcggaactcgacgacgaatcgctaaaaaaattttgttataattgttttagaaaattgattaaccgatataaaatacattctcggttttctgacctcactttctcagcctttttcttctttttctttaccaaatcgacagaatcatctttcctggtccaactttgtggtaattctccttaattttaaagtaacgaaaagacaaagatacaaaccaaacctcgtgagaggtaattatttgcacggtcgatgccactttcagtccattgagccaaatcagtgagttttgagcatctac

SEQ ID NO: 1675 - DNA, 9813 bp, Heterodera glycines
  misc_feature (46)..(46): n is a, c, g, or t
  misc_feature (4943)..(4943): n is a, c, g, or t
  misc_feature (4957)..(4957): n is a, c, g, or t
  misc_feature (4962)..(4962): n is a, c, g, or t
  misc_feature (5097)..(5097): n is a, c, g, or t
gcatattttttaaattttaaggtgtataacaaaacgggaaaattancgagaaattgaaagggggttgataaaaaaataacgcttaaaaattttttttcttagaattttgttataaaaaactttgtagctttccctgtgtaaagcaaaagaaaaaaaacgctggagaaatggaccgccataagtaaaattggtcccgagacacctcctgtctcaatcatccgccttgacctgagacacctcttgtattttgatttaaaatattggaagataatatgttttggattagtgattgcctcgataatttttattttacctgaaattgcaccccgaggagggctcaatgaatttgattttgttggtaaatttaacataattccactagaagaacaatctgcagctgctgatgcactacgttcacaatcaaattcctaaaaatttacagaaaaacaaaggttatgcaattgataggttgaattttagtttacggtgtaaaatttttagtaagcttttggctccaactctttaattttttaattcttcacttcaaattgaagatgtgcaattgctctggtggccgaacgcgtagaagcaattcctttcagcggcgtaacagaagagctgcggaaatagcgaggcgaacgttgagagcttggactattaaacgttgaggaattcttttcagcttcttccttcttctttttcgaccttttgtccgggtgatacagctaaaagctgtcgtcacacacaaattattttaatagtcataccggcaatttgtcaagtgtttctgcatccttaaaatgctttgcgcctttttgacaaagttgagtccgctttaaaatacgttcatcgccatcattgaagataacggtgtaagaagaacagtcctaattttaattcaattcattgttatgattagtagaggttttatgtgaaagagtcacctttatacagattatttgccctttatgtatttgtttcatgtaaatgacttcgacattttggttaatctccattcgcccattttggattgcggactcgtcaactgcaataatattagagttcttgagctgaacctaaaaataaataaataagagttaatggataaaaaagagactaaccttgattttcactgattttacgagtttagtgattcgcgcctcacaaaaagcgcctttgaatttggcgctaacctcagtaccaacaggtaaatatataggcggcaattcgttcgattcatactccataaaagtttctaaaaattaaaatttgttttaatgaggggtaagggtttgatgttagacgttcgaccttcgattcagttttgttgctagtaaatatttaaaattaataaattggcgttttgcaatctttttttattagaagtaaattgaaaattttgaaaaatataaaattttttgaaaactttctattgtataggttgtggagtaaaattgaaaattttgaaaaatataaaaaaaaatttttgaaatagttgtcttgtacatttcgggtcataaaaaaaccccgagttcttttaaaacaggaatttgtccgggaacctgtcgggttcaactcggaattctgattctgctacagaccttggggttttttttcttcaagattacgtcctcatctatgtaaatgacaagggtttaattaataaatattctataacaaaaatatctgtttttaataaaaaggatttgtcttgatagagaatatggacttgttttcaaacaacaacaataatagtgccaaaaaagctatttccattttccccgaagaaaatgtcaatgaggatgttattaacaaaagttctggcagttcaagcaactcttccgatggtgtgcctaccgaagaagatgtctttgaggttttataagattttattacattaagcagtacttaatgctaacacatcttaaggtggagaaaattattgcgcataaagtatgcgaagggaaagattattggaaagtgcgctgggttggttatggaccaagtgatgacacgtgggagccgcgggagaattttttggacaaaaaagtgttgaaaatgttgaaggactttgagactgaacagcatgccaaaaaggaaaagcgtaaagaaatcagccgtaaagtaatctttactagtctttcatttgttttaataaacttttagagcattgaatatactcgaagcaaacaggaagaagacgatcaggaggatgcaacagacgaaaagaacgaaagttggtttggcattaagccggatgaaggcacgctcgaacagaggcgactttttgtacctgaccgacgtctctccaagacagaaaaggtcgaatcattatatttttgacaattctgaagaaatgggtttctattttttggttaaaatttgcatatgatagttttccgggatgcttaactaaaaaatgaattcagatttgtgttcgatactccggaaaaagttgtatgccaatctttaacccaaaataaaattttaaattagaaactcatattctttggcgtattttattataattttccttttattatacagttattgaccgaaattggttcatcaccaggagtgcgaatattgcgaagacatttgaaagaacattctgttgaacgtttaatttcacctaaaattgaggaatcgtctccgcaaaaatgggaaattcataaaccaagaaagagtaaaaaattgaattattttatgaaacaatattatatcatttaggaagacgtaacgatgagatttttacatctgagtcgtcagcacaagaagtcttcgaaacaaatgaaaagggtgcagttgctatcccggaaaagcccaaaggaatatcccaaaaaatgccaaatgacaagcggattaaagaagaagtgggaactcatgagatgaaaatggtatttcacaaaaggccaaggcttggcgaggaggaaactcacaattccgaattgggcatcagtaaaagtctgaagccgaagaaattagccaaactcggtcaaaaattgaagttaaaagccgcttcaaaaagagaagacattattcacatgaagaagaccaaagaagagaaaaatgcatcaaaaaaacacgaattgtcgaaggaatcagtgccacacaaaaccaaggacaaacaattgagtaaattagccgtggtgagacttgaagagacagggctggtggttccgtttgcttccgagggagtaaatattgccgcggcattcgaacgtttggcagtggaaagacagacctctctttccctcattgataatccgtttttgatttctcaagaggtacaatgtctgtttatcatcaaaaaacaaagccgattttaggagtttgaggaaatggtaatggatggaaaggtcgagaaagtgcaacaattgctttatggccaagcagcgaacaacttcagcctgaaccgtgtagacgaatttggaaaaactttacttcacaaagttggtctatgtttactcttactgatttcggcttatttctttcagctttgcgagattaaatgtggcgtttctcacacgcaatgtgaattgattcatttgttggtcgcatgcggcggtcgtttaaacattatcgaaggtggaaacagtcaaattcctctccacgtaatatatttctgcaataaatattccttatatttaggcgaaaaattgaaggtaataattagggactggatttgtatggatttccatatttttttttgcacacttatttcggcctaaaaaaccacgtaaatagtatttttagcttggtttaatgcttctaggacacatttttatttccatatttcagatttttgtccatatttgacatccatatttcggcattttcacaaaaaatacacccctaaagatggacaatttttggaaatacaccctaaaatcgaaaaattttgggaaaatttacaaaattttgcttttttgttctaagaaaattcaattttttagtaaagaataaataggaggtcacaattatcaaaatctatacttcatgtattaaatgactttttgctttcttgaccgaaaaaattatggatttatgaatttttcagaaattttttgtccatattttcgttgtttttttttgtccatataaatccggtccctagtaataatttcatattaaacaattgtagtgaattcaatcagctttttgcgtatcacttattgtgtttcactcaccgttccctttagattgcaatcgctaatcgacgtctttgtcatgttcgtcagctgctcaatttgcattcgcccgtaaatttatttgatagaagcggcaaatcgccactgattctggcgttggattgcagtgattccgaatttacgaaatgtcttttgagggccggtgcttcgttccagtcgggtttgtggctctattgcaataggcgttcgatcaaatgaccatctacttgctttggccataatttttaaaaagactaaaattacgatctaatttttaaaaattaaagatgatcattgagtcaatgcttttttctgtgtaggaatattatactcaatcgttttttcctttaagcactcgaaaaactgtacgatgacaaagacagaaataaacgacagtttcgcattattactgaccatgaagctcaattgcgaaaggcgctgaacgctgctcgtgatgccgtatcaatgttcacccgatgggaaaaggcaattaaatcgcaattttttttagggatttaagtatcaaatgcatttcgccaatttttgtaaatccggtccacgagagtgagtcggtgcactgctttcacttgaagagtcaacctcagcttcccatcggagactttgcctatctgttgttgtcgtgtgttgctgaattcactcgggatgaccacgaagtcgaagtttttttaaataattttaaagttgtttttagaaagattttgaacattctgttgaggctcgtatgtggggccntaaatcccaatccnaaagncgtgatgatgaatggtttttgtgagatttaatttgaattataatctattattaaggaaaagtttgtcagcagctgaagcagggaaacaaatttgcctttctctgttctccatgtcaaggagaaaatcaaatcaanattgaatcttgatgttgtcgtgcgcaaatcaagaaatcttttgctcactcaggtattaattaattttttgacttttagtgcattttcaataagggtccatcttttcaggttgtgttggctcagtttttccgtcaaactcgtcctgctgctggtcattcggctgtgtcttctttcaattgcagatgacttttttctaaatctatagttttgctgcaccgactttaattattttctgttttttgaatactttttattttgtaaatctgctaagataaatacttttattcttcctttttaataataatttacttatattttgaattaaaaatatattttccccaacatttacgaagttacaatattttataagaataaggaaatggcgatagataaaaagggccacgtgactgttagttgtgcccgtgtgaaaatacaggtagaataacatgttcaatttgttgggtgaccttttttaaacaaaattgcagtttcccagttacgcttttttcggccgaagggtgagagaagttaacgctaaaatcaagagtttgcagaacgaatgtgacatgattgaggggaatgtccaaaagctgcgaagtaactttcgaccgaattccgcgaattgacacaaacgctgtactctgatgctgcttatttatatttattatgcataaactttaagcatctttagtcgcattttgaaatggttttgtcggccatcttttcctttgattttgtgaagctgtttaatattaaaatttccactgatttgcctttgctatgggtcgaatgccttcgctttacccttcttggttacttaattatttgcctgacactgtatgtacattaaaaaacgcacatttttttgcataattcgttagattttacatcgaatccgacgcgaagagaatgtccaacggacggaattggcgctcccaacggaggagacgacgcttcccgaagatgccgacggtccgatgcgctctcaacttttggctctccttcacggcgcttcgcttcccctgaacacagtttcccacgcgttcgcttacggttcgggtgcaatccctcaacgagaagaggacccaaatacgaaaatggtaacaaaatgcacatttaaaatgatgccattttcgattggtacaggtggattttctcattgtgtgcaacgattcattgctttttcaccagcaaaatttgcttcagtatgtgagcattgcgttgttgggattgtcctcacttcacccaattcaatttgcaaagaaacccaagccattactctcttcccttccgatggttcgatgcgaattgggtaaaccaaatgcagcgactctccggtgcacggctttactacaacacacgaatatctacccaaggtgaagtttattcgtatccatttccaaatctaagtacctttattacgaccttttaattcaaattgtttcaggacgtttaatcaaatatggtattatccaagaggacgacttggagacggacttgctcgactggacatggctgtacgcggccggtcgactgcaaaaacccgtgttggaggtgtacaatgggaggggtgaaacttccgatgttcaaagaacgggacgaaacattggtagggcgctctttgacaattaccgagcggctgctcacgccgcactgctccaactcgacgggtggtttacgatggatgtgagttagttgcatttctctcccaatttattgtctttacttttgtccctatttcagcaatttctcaacaaagttgtgtcaatttcatatggtggagacgtgagacggtatttcggagcggaagacccgcagaaggaggaaaaattggtggccggcgcgagcagacaattgagggcgttgtacaaaccaatcctcgaggcgttcgtattcccgtgattttggataagaaaatgttttattatttttatagtgatcgcgaagtgcacctacacgcggatgacaaaattgaacaggactggtaaataataatggggacaattgggcgattaattaggggacacactgagaagggttgacctaattaaggggggtgcaccccaaattttggcgcgccgaaatttcgccggacggaatttcgccggccgaaatttcgccgggacataatttcgccaaaatttttttttaaaaaatttggaaattttcaagaaaaaattcttagaatttttttatatggaaattccaatgaaaaatttttgaaaaaattttttagtgattttttggaaaatttttcgaaaaaacttattaatttatcataaatttcaaaaaaaatcccgaaaattttttctaatttttttttgaaattttcttataagaaattctatgattttttcttaaaaaatttcaaagtctaattttttgattttatttttttgcggcgaaattttgtcccggcgaaatttcggccggcgaaattacggcggcgaaattccgtccggcgaaatttcggcggcgtaatttcggcggcgaaattttgtcccgtccccattaagggaggataagaatggagggaattgggcagtcattggcatttttcatcaaccaaaatgttttttgaagctcaactccaattgtgttcttccgactgacacaaatgccacgggcggtcctcgaaagaataagcaaaacttactaccctcagaggaaagcggccgacacggaggttcggtgcaccccaaaacgtcgtcggccgaaacgtcgtcggaagactttttgaaccataactttgttcactgtcaatcaaattaagaattgttggtgttgttcgatagctctatgtgtttattattaatttgcaaaatctcaaaaattttcgttaagtttcaaaaaagttatgaccagaaggaactcaaaaacccagtaattcgaactttttttgctctgatttttttgtgcataaataaaaatttttgaaaatttgcaggctaatagcattttttgaatgctttcgaataataccaagaatggttaatttggttgagaaagaaaaaagttatggtcgaaaaattcgttcgacgacgtttcggctgacgacgttttgtcctactccgacggaggttattgcgtaatctgacgtacaatatttttctcctccagggacgggcctaggattcggcttggggtccccccccgggcgacgatctttaaatgacaaattttgcatatttttagcagactttcatcaaaattaataatgtttacggaaaaaagcgaatgacgaggtaggtcttggagatgtaacaacaaatcggtgtcgaattgaaataatattttgattttttggttataaactttttctggttatgggctaggtaccaagaagcactaccaaatagtaactttcatccatctgagttatcgaaattaacttgctaaaattttttgtacacaacagatagttttgttcctgtagtgtcccagttttccggaagtctcgaatttcctaccccctccacaaaaagactggtcctgctaattaaccccgtcctcccaacttaaggaattgctctaccccatcgcacatcgtcatgatctcaaccagcgtttctcgggtgttcttcaaagcatcgtttacgaagccagtttgcgccaaagtgccaaaaattttttgaccgcggggataacaaagtcgctacaatacgttgggcctaaactcaggaaaggattattgagaagattctgaacagccatttgcagatttgttttttgtttgtttttgcaaaaattatgccgcaaaataaaaaattatccgtgtctttcatttgcgattcccttttttaagttccgattcggttgtgattgaacgcctgggaaaagtgtcttccgcttggccatttactttttctgttggtgaatttgccaatttacttttggttcgctgtgatcaaatgcgaaattgtttcaccctttctgtccgaatcgaacggcgacgacagcagcagcaacggatggtcagccaaacattcggcgactgtcgtcggtcgctttcgttggcattttcgcagcatcggccctcagcaacagaacaattgctgcatgggcattcattctgctgatcagcgccgcagcagcaacattttttaggggaaggacaattaaagccggcggaacttttgtcgcagtcgcaacgactggcggcggtgctttgtgatttttgtgggcattgcccgcagggcattgggccgactgtcgctgttttcgttctcgtgccaatttcaaaagagtcgatcactgctaattttggaactgtcgtcgagaagacattgtccgttttcaatacctacgcaataaacaaaaacatttttggcgttttctcaatgccaaccaatttttgctgttgggggcctttttcggcactttcactgattgtgagacggtcatcggcatttgcttgtcccctcccctttttcttctcagtttctatcggttgcgcgtctctcaaatccgtcggttcgatcaaaggaatgtccgcgtcgattacggtgccgtgccgtgtaatttgccgttgttttattccacttgggccattagtagcagaaaaagaagacgaagcgggcacaattagtgccagcggggacaaatttgattttgaatcctttgaactggtttttggacggtggtaaaagcggaggaattgcttcattgtttgacggaaaatgggaggaattggccatgacgacgtggccaaaggga

SEQ ID NO: 1676 - DNA, 3496 bp, Heterodera glycines
gcattatttaattcatttttttcctttcattcatcaaagtcaacagagtgtcatgaacctttccagtggccaagtccgatatgattaagtaaattttttattttaaattaaaatttttatatttgatatatattttttaatttgagaaaaagagctggacaattttttgcgatttaatccatattgaaaaatgcaagcagaaaatagaaattagaataatatttatatctttttttcaataggaaacgaaaattcaaaaaatttatggaaatttcagtttttgtagaattggatatatcatttattttggttttttaaagcatacattttgtgtggcgccataaaaattcgtacaattggcaaacgaatatttttttaaacaatttttaaataattttttagaataaaataaattttcaaataatttttttctaatttttagtttttcttttttaaaaaattttttttcaaaatttcaaatgtaaattttcaacattttttatatttttaaattttcttataaaaatatttttataaatttaaaaataactaatggtcattcacctttttttaatttgaaaaatgctcaaaaattgaaaaaatccttttttcaacttccaattctacaaaatgcacacaaacaataccgtattttgtattattatgatgtaccgtaatagcattaaatgaataaacaacatgtcttatcaattaaaatattcgaattaaaaataaactaatttataataatttaatgaaaattgaaaaataatatttatttttaaagaaatgcattaaaatgattaattatcccataaaaatttttcttctccttaattattttcaaattttaatcaaaaaattttaaccaaattttttataaaaaattgcaaaaaattcgcatgatcacttccgtccgtcgtctctccgttctcggacaaaatttccgccgattttcattgctctccgatcgatctgagaagaatttaatttaaaaaaagtgatcggacggccgttgttctgtgcagtcaaattgcgataattaccattttaattgattgtcgggacttgcgatttgatggtgaaaaataatttaatttaggaaaaaaaataatttgtttcaaaaaatgtgatgacgaaacaaataatttattatttttggaaaattgaccacaaaattgcaaaaaaattgtcattttttgacgtaaaactgctacaaatgcctgcttttctccctccgatgctgaaaattttgaaaaataacaatcagaaaaaaattttgggcctaagagcaaaaaaaaaaaatttctcaccgaaaattttttctacggcctgaattctggataaaagaaaatcaaaaaaaaaattttcaaattaataagttaagcaaacaatatattaatttattttctaatttacataccaattgatacattcattatgcatgagaaattgaataaaattattgggaaaaaaattctgactgaaaaatttcctatcagtgatcacttttgatcagtttaaatcattcaattaattaagctaaaattattgcaactttttttgcgataaaatataatcgaataacaaatttttgaccaattgtcggaaagtttaaatttttattgcatttgataaagattttattctttgattgaatagcgtccttgaaaaatggcctccaaaatcaacgaacatcataaattattcccttagaaaagtgtcaaagattgaaaaaaggaaaatgaaaagcaaaatttaaaaacaattaaaattttattaatttaaaatcttttatttttttcggtaataattaaaattattatttaattttgacaaattatatgattaaaaaaaattaaaataagaaaaaatattaatttaattagataaggatggaagatggaaaaaaaagaaaatgaatgcaaaattaaaatacatataataaaataattaaaattcttttgttttcaataatttttaattaaaaaataattttcatttagacaaaattatatttgagaaaaaatatatatatgaaaagtaaatttcaaatattgtaaattcttttttttttcttttttaatttaagctacttaaaaatttcttttttaaaaaatttttctttttttttaatttgaagcatagactttacacaagaaattcttgaaattttttaaatttctgcgcgcaagtttgcattttaaatacctttaaataatcttaagtacctaaattgaaaaatgaaattccaatttgtttaattgcattttgaagcataaaaattttgctttcatgttaaatagatggggataattagcatcaaattgtattttatataaataattaacataaaattatatatcatatgaattattattataaaattgtatattatatgaatattaaaataaaaccatattttatatcaatgatttcgctatttttcactttcaaaactaaaaattatcaacttttttcgcaactttgaacacataaaattcaaattagctaatttccccccaccttaaaaaaaaattgaatttcgcaacttttaattggaattcagtgtttgctttttttaaaaattgaatttcgcaacttttaattggaattcagtgtttgctttttttaaaaattgaatttcgcaacttttaattggaattcagtgtttgctttttttaaaaattgaatttcgcaacttttaattggaattcagtgtttgctttttttaaaaattgaatttcgcaacttttaaaatttaaatttgcttttttcccatttttttcgtttaattgtgtaactttcacattccgtcctccaaccaattcattcattctgctgaaccgctgattctactaaccacattaacacatcaacattatcagtgattggttggaattgtgcaaataaatggctgatttttgctctttcaacgaaacgaaatgcccaaattagggaaaaagtaatggaattttaactgccatcaatttaaaatgttgcgaatttcgaaatttaaaataattctaccaaattcgaagtttgaaatgcgtaatgaagtagtctttttaaatgttttgttggaatttgaaaaaatgttctaaaattttcaagtttcgtcaatgcccaattgatttgtgaaaaatttaaaggaaacaaaaaatatatttaatatatttttgtataaaattattaattaatataaattgtattattacattaaaaatttatcgaatataatttcggagtctaaacatttttttaaaaatagttattaattaataaactatttttaaattaataaaaaaaatattaaataaaattgtcggacataatcctcatcatctccaattgtagaagctttatatgatgctacgcataatgcaaaaccaacagattgataaatgacgcaataaaaaattcttatacaaaaaatgaaaatttttaatgtaaaaataaaaataaataaataaataaatccgcaaaaaatcaaaaa

SEQ ID NO: 1677 - DNA, 1401 bp, Heterodera glycines
tttcaggccacgggaagctcaggaaaaaataggcttttgcctaaaaatattagccctaattattagcatagttggaaattatcaattttttggacaaaaattcttagaaaagtgtgaataagcaaaaaatgccataaaatcacctaattaggcttaggataacatcctacatttaaaataaaatttgattttaatatttctgattgttgtggtaagctaagaggtccacgattattatctaaatttaaatttttggatttggaattttcaatattcaataaaaaattctgtcattagttaagcctgtggctgggactcaaacctgcccggggactcagttgaccgagctcaattggtgggttcgtgaaatttgcaaaaaaatcggtgtggcggtagaggcacagattaatttactgccaattctgtgctgcccccccccccctccctcccccctgctggtgttgggaggtgcgcaactcattcaagcggcggaacattgggttttgttggacacgcccccaatttgtccggtgatcggtcggggagtgaaaagtgtccccaccatccatccaccatccccccgggggacgtacgggacgaccttgacgagacgcggccggcgatataagacgctgttcctgcgcaccccggggggtcattattcatcattcagcagcagtttgtgggaacagctaattgactgacttcacgcaactctcattcatttgggcaccaaaaaaatttttttggtaatttttctttggaaagtttcattttgaacaagcccatttttttgtaaaaaaaaaaaattggtttgtgaacaggtagtaagttggtttaagcctcattttttttgggggaggggggtcaaatttaaatctgtctgatcactgttcaaagcgaccaaaacgaagcattttttgtagcctaaatttgatgaaaaagtgttgatcagtgatgtttaagcctaatttcttgggacaaaatttatggctgatcagtgagtgatcagagcgattaaaagaagaatttttttagaacgatggagcgattagtagccctttcttagtcaaaaaagtgtgtgttttcactgatcagaatgcagaattaaatcatctgatcaaattacgcttgatcagtgatcagaccgtttatggcatctttttttaaataaatctcaaataaataaaatttatacaaattaatcaggcaaaacgatttgccatgcattttgtataattttttcaaaatttaacagagtcaaatttcaattttctaaaatttcagccaaattccattgaatttcattcaaagcgaatctctctctctctgttttgttcaacaatgtcttcttcacaagttttacaattcgcagcagcacagcacaggttgctgtccaca

SEQ ID NO: 1678 - DNA, 9531 bp, Heterodera glycines
  misc_feature (3527)..(3527): n is a, c, g, or t
  misc_feature (9333)..(9333): n is a, c, g, or t
  misc_feature (9352)..(9352): n is a, c, g, or t
  misc_feature (9404)..(9404): n is a, c, g, or t
ttcatatatatatatatatatatatcttttcatatatatctatagatatatatgtatatatagatatagaatttattaagattagagtagagtggatcgttgatgatacattttatgtcttaaaatttttcacaaaaaattataatataatttaataaagatatattggtgggaaatctttatgcatgcgatttgactaggcacccatctatggacggatccgggtattggattttcaaataatattccccgggctcttgaacataataaaacgggtatctcgctctgtgtgcgaggcgcgcacctgccttacattggagatcattttatatgggacacaacttacatatgttcttgtcattttatttcatgaagacattgtaattgctaatcttgatgatcgacacatgttgtgtgctcaccgtaaatggcaagccaaccccattgggcacaaatgatggtggtaaggaagaaatgggataattaatgaaattataaaataatattggcaaatatcgctcaatttaataatttcaaaacaaattttcaattttttgtatatattaattaatcaaataattaggcaatttggagcattaaaacacaatgattcatcagagtttctgtttcctaaggagataatgggtaatttatattgtacaaggacataacggaaaaatttaagaaattcaaggaaaatctaataactttttttcaatatttccataaacaaattcatttttttacatcagtttttcgattttcaaggacgtccttaatccaaggacagcgggagaaagccctggacacaaaacttaaaaaaaaaataaattcattttagttaaaatttcattttttttagtatgggtatcgcacagtgggccaaccaacgcattgtggggccatgaaaaattggtgcccgaggaggaagtgtggcacgagaaaaacgacgagtaaaaaaaagatccaaattttacaaaattttaaaatattttatatgttttacagtcttcttactatccgtcatcataccgttatggttatgggtacggctacaacaactacggtagcagttacagtggctacagtggcggatatgcgccggatgtgtaccagcaaaactggatcaccagtgagcacaatcgctacagacgaatggtgggttcgatgtgataatttatttaaatgtttttaaattaatataaaaaaggtactaaaaaattttcaatttaaataattaaattttttttttaattttaataaaataaatttttttcactttaattataaaacgaaaaagttgaaagcatttttaaatcaattaattgattgtcttaatattttgggaaaaagcattattattttaaatttattttaattaattctagaaaaaaattttaattttaattaaaattttaatttttttttaaatttatttcttatattaattgaaactaatttagcctttgatcttttcttgggtttctataaatttagaacttttaaaacccaaaaaagttttttctccccaaattttacgcctttttctttgtcactccgcgcaattttcgcgcccaattagtgttcccaatttgtgcaattcatcaaataaatcaccgccccgctgtgacgtgaacacaatttcacgcattttgtgctctgatctttcccctcagtgttaatacaaatttatatttttcacgtgtcaaatttttgcaaaatttgtcacaaaataacaaaaaaaaagaaagaaagaaaaccagggaatttaaaattgaaatttagaaaataaatataactttttttttgtttaataaatacaataatttaaaaaattcaattaaaaaaaaaccaaaatatgttttattaatattaaaaaaaattaaattaatttaacagtgccattttcacaattttcattaattctttttttttaaattaataaaattaattaattgttagcaaaactttaaaatttaaaattttttattataaattatgaaataaaatttaataaatcaaacatatttatattaatttaaaattgatgttttcactgcttacaataagttttttcttggaaaacaaaataaaataaattatttgaataataattatgagcaaaattttatgacaaaaaaaattattaaataaaaaatttaaatgaaaataaattttaatcaggttccagcaacggacatgagaatggtgtattggaatcagcagttggccgcaagtgcgcaagcacatgccaacacctgcgattttcggtgactaattaaaagcaattaaaaagaaattaaaatttggtaaattattatttttagacactctcgaaaccgggcaaacatggcgaaaatatttggtgagtgaaacagaaagactaatttttgcggaaacttttaattaaaattttccatttttatagggccgctccctactacaattacacggacgcaattggacgatggtataatgaggtaaaaaccaaagcatattaattatgctaattaattaatttataaaatttggaaaaataaaaaatttattccaacggaaaatgttgttttatatttttacgaaatgccaaaacaggactaaaattggtaaggaagttcgaacctggcaaaaaggaagtctttttctaaacaaaatcattacaagaaataaaaataaaaacatcaaaaaatttatttttattttaataaattaaaaataaaaatgcatctagaatttcgtaggtgaaaatttatttttaatatttacgacatgccaaaatagacaaaaaaagggtataaaagttcgaacaaaaaatgaaaaaataaaaatcccaaaatgaaaaacaaatgcctgcctatttttcaggtgaacgacccgtggtgtggttgtggcaccgggtacaagcactgctgtggacattacactcaggtcaataaaattaaaatttaaaatgccataattaaatggaattaaataattaattggattcggaattatgtggaaatccaactattcttaaactgaggcctgaaaaccacgaatgatttcttcaaaaaataactgcattcctcgattaaagcggcccttttgagctctaaggatcggaataaatttaaaaaaaaaactttttttggggggattttatcttaaatattataagaaatataactttctaaaaaatttgaaatatatgccaaaaataatcaaaaaatgaaaattttcgaattttaactcaatattcatgaaaattaataaattttagctttattttgtattaatagatggtatgggccgagacaaatctgatcggctgtggatatgcgcaatgtaacggtgtgacgggcgtcggcggttatgcgaaagctgtgtaatgatggattttgaatttttattattttaaatatattttaattaaatagtatggtaaaaataatattgggcaaataattaattataaaaattgaaaaaaatgattatacaagaattaatagataaatgaattggctaggcaaaaataaatgaatatntaattgaaaacaaaattaaatttcattagaaagttatataattaatcgaattttaattagttttatgaaaaacattattttttaaagagatgaattaataaaatattttaaataaaatttactaaaaataatttaattactatgaataatttaaataagaaagtttcaaaaatttaataaaaatgtattaattgcttaaatgaatgtcttaaaatcaaattataaaattctaatttttatcttttcagatttgtctgccattacaacccccaaggcaacaaagtaatgtattacttcaatggaggggattatgcggtcagtagctatgctttttttgcaatttttaaaattttttttgaattttttgtaacccaattttttcaataggaattttttttttgctttattaattcgcatgagttgcttacaacacaatagtgtgaaatgaagtgcgcttttatactaataaataattttaaaaatattattaattattattaaatttaattggcacaaaaagtttaaatcttaattggcttccttttttaaaaagccattgaattgaaataattattaaaaattaaacaaaaagaccatttatttgatttaaatttattattgctgactgtttggcttttccttgctttttctttcgcttttatgtgtcataatttttctccctttattttgtaatttttaacaattaactaatgaggggcttaggtttttcagttcagtctggacctggctccaggccttgatattcctggacctggattttcctagttttttgtccggaaatccaggccgggtaaatatgaaataaaatccatatcccccaagcctgtatttggaacgaaaaacctggacttcctggacatcattttagatttgttgatacaatagtctatgaatagttgtcaattcatcaaaaaagattattacattaaaatatattttaattatattctattcgataattttaaattttccgagcaattaaatgattttttggaatttttggttgctttttaaaacacattccaaaaaaatgcgcttgacagcctgggtttttccaggatttggattttccagatttttgtccacaaaattcaggtccaaccaagtccaacagggaatccaggtccacgtccagacttttttttaaatacccagctctaattaacataattaattaactaattaattacccccccccccccccaccggtccatccctcgggtgattgtgtcgtgatgtgaaatgccaatgtttcattgttgtatcttccagttacagatgcccgccttcacctgggcacgctctgagtccgaccgatgctcccaatgtccgtccgatcagccaagctggtaccaaggcctatgctacatgccattgaactacaggtgggactttttcgaaaaaataattttctaaatttattaaaataattttttatgataactcgttaaaaaaaatgctggaaaaccttgtcgacatttttgcactttttacgaccatttgtccaatattttttttttaatgagaccatttgtcacacaacatatagtagttatattatcgacattttgtcgctttttcggcccttgcttttttttaaatgagacaattcgtaaacagcaatttgtgatttagtgtcgacattttgtcatttttcgagcatttaatatatttttacagacattttgtcactatttaggcgatttgtccaaataaatatattaatttttcccccattttcagaggataaagaaagggttgttatgctgtttgatgtgtgttgagctgcagcatgttcagtcaactgaatgcgtttatggttgacgaaactttgaccctctcaggacccaactctttatcaacacgacaataaaaacacgatcttgcgccaatttaaatcattttttttaatgcaatggattttttaatttaaaatgaaattttaaagatttaaaaaaacgaaaaaaaattcattgcatttctttggcacatttattagacatggacaaaaagcatagatttttaattgaaaaatttaaaaatttgaatgaattttaaccaaaacccatagctttttggcacatttattagccatggacaaaaatgtgccgtgccgtttattatccgtcaattaaaaatccaattaattaattaataatttaattttttatttctctaaattattttggacgacaaaaacaaacaaataataatatttcaccaattttctcttttctcatttgtgcccagagaaatattttgttgttttgtttattttcctgctcatgccatcaaattcctcaatgttgtttgtgcttaatttaaattcaaatattgacaaaaagtggcattttaatttaatttgattttttttttaatttaaaaattgttcctcataaattgtgtttggggaaatggccaaatttaatttcatttaaaatttcaagtaaaaccaaaatatctgaaagatatgtagtttttaggaccctaaaaatccaaattataaaatctaaaattgaaaaaaatggttatgggccaaactccgtctgagagaacaactcttcgtcaatttaacttttgaaatttctgacaaaacccatcaaacattgggatataaaattcgaagctctttacaggtactaataatgtaaaattttaataaagcctgtcaaactttaaataaaaaaattgcaatttttatttctgttttttttagtgttttcaggcaataatttctttgtgagagttgcttaattgacttacaaattagcactagatgttagaaatagaaaatttgatcaactaaggaaaaatttatgaattttttaacttggatgagacggagttagttgccaacatcagcagggatgagccaaagatcccgtgggattttctcagagtcgcgcgagattaaatctgagactctaccttaaaatccgtttagatcggtttttcaaaattttcgggattgatcgtgatccctccgacacattatgccaatgttttatctgttttgaaaaattctttcacatttgtgattattttttttttaccaaaaaacacatccaaattcattcaaccgagaaaatttcagattaaataaaaaacaatttatggtaaacactatgcccaatattctaggtatttaaaaactttgtcactttttaatcaaaaactcaaaaaaatccttcaaatttattccaacggagaaaattttcaatttttacaaaaaaaaacagccataatttatccccctcataaataaaatataaacataacacatgactaaacaccatctctatcgttttctttctactatatctcaacgacatgcaaataaattctcaatgctcctccgccatttgacgactaatttcggcacgcttaaaaaaggcaccaattaattaatttttaatggcataatttataaataaataaattcataacttttaatgtcataattaattaattaatttttaatggtataattaataaattaaatggcattcttttaattacataacgttcctgggtctgtagcgtttgtggaaggtgcggcttattttcatcgctgagatttttctgaaaaaaataaaataaaaaatttcccataaaaaaacagcagacctccgtaattttaagtgctggaagattttcttggatgtaatggaggtcttgaatggcttcgaattctttactgcttaactgatgcactaactaaatacacaaaatagaaattttggaactctattacaacttaatgagtgcaattaacttaatgagtccaatcaaaaattcgaagagtccgaccaaaattttaagggtccaaatcaaattttaagagtccgtaaaattttaagggtccaaatcaaattttaagagtccgtaaaattttaagggtccaaatcaaattttaagagtccgtaaaattttaagggtccaaatcaaattttaagagtccgtaaaattttaagggtccaaatcaaaattttaataattcggcctaaaaatttaagagtccgatcaaattttattttttagtgcatttttttcaaaattttcataaaaagggctggaagagaagatattctgacatacagtgctaatagagtactgtgattacagtaatacttggcacaattattattattatttttttaaaatcttatttacaatgcttttgcttcgtctgtgcaaagtccgtttccttttttcaacagaatcagatcccacccattttacgtcagcagctttttcaccggtgcccattagatcagcactttttggggatgagcactgttggtttttgtcgaaaatctttaaataaaataaaaatatttttaaaaattacatatttaaactggtaattagggctggtaataaatattagatgtgatgccagaaggaacggagtgtgggagaaagtgggataaaggacctgagagaacctctaaaagaggcgcccgtagctcagttggttagagcacggcacggattgctggggtcgtgggttcgagtcccaccgggcgagttaccttttatgttctacatagatgcacataaaaatcaagctttttgaaaaattttcggtctttagagttgccgctttaatagaggattttttgaaaaaatgccaaaaaattcactaaaatatgcatttaaaacgcgaaatttacgatttacctaagttaggcgctcacggtttggctccagcatgtttttttcgctataactttctataacttttttcattgtcatccaaatccaacatagttggtatcatttgaaagcttatcatgtttaaaaatttttctaaaatattgcttcgtgatttgacaattaccaaaaaagttatattcgaaaattacaaaaaaaaatcaaaaattttgaaattttttcttaaaaactttttatatgcaaggaattttttgttttgtttttttgtaagccctgatagagcatatgaagagctttcgaatgataccaagattgttggatttggttgacaaataaaaaagttatagtggaaaagcatggtggcgccgcccaaccgtgcgcgcccaactgcgcgatttcggaaatttatgcataatgaatgaatttaataattaaaaaatcatttagggccctgattcatatttcttaaaactttttttttttgcaaatattttatcacatgaaaagctcaaaaatagcttctttttttaccaatttcttttcaatcagaacgagtttttgcataaaaaacatttcggaatttggctgataaatttttttttttgcgatttttagtaaatatttttggtgttttttttgcaaaaataaatgttttgaaaattcaataaccatagcttgaataaatcttataaaatttaaaaataaattcaaataaatttttaatacttcttttccagacggttgacggattattatcggcgggagctttctttccttaattatatttaattgaaatgaattaaaaaagttttaaattaaattatttacttcttcaatttttgtcccattttccatcgcgttaatggctgtgaacattaaaaaagctgacaacacaataataattttgttcattttttaagaatcaagcaattaattaatctaaattttttaaatgcgttttaatttaaataacaatttttaaattaaataaataaattttactataaaatctttacatataagattataaaataaacatttggattgtctaatctaaaaaaataaagcaattaattaattatcgaagtattttaaaaattttcattanaaaaaattttacaatttanatataaataaattttttatcaaaattgtataaaattataaaaaatgaagcanatttttgcgtttgatatgtttaagtaagataaaaaaattaataaattgatttcctatacaattcatatgcatttcattcataatatgtatgcataaaatatatttttttataaatcggaatttaaaa

SEQ ID NO: 1679 - DNA, 2006 bp, Heterodera glycines
  misc_feature (21)..(21): n is a, c, g, or t
  misc_feature (26)..(26): n is a, c, g, or t
  misc_feature (61)..(61): n is a, c, g, or t
ggatggggtggggtggaaganttgancaatggaggggccggaaaggaaaattcagggatgntgggaagggattttgcgtgccagggagtgccatttgtgtaaattgtcaattctcgactgcgggatggggtggggtggaagatttgaacaaaatttgtgggcatgctgtaataaccaattacagacggcaccaatattgccgtatataaagcgccaccaaatcattcaccatatcactccatccagccaatctctccaacaaatcttccactccgcccaccatgaacatttacatagtctcttccatttcgtaggcctaatcaaatttattttttaaatttattaaattatttcaaattttattcccccaattaaaaatatttcatgttttaattctcaaattaattagttatttcaaattttatttcccaaatcagtagtaatatgtatgtagtatatggacaaaaattatttttaaattttatttcccaatttaaattcctttttaaattaatttaaataatttcaaatttattttcaaaaattaattaattatattgttttaaacttatttattaaattattttcagatttttttcaaaatacttttgtcaaatatattttttcagaaatcaaaaatttattatccataattttttcaaaaattttctttcagattttcataaactataattttccaaaataattttgcaaattaatttaaataatttttcaaatttattttcaaaaattaattaattatattgttttaacttatttattaaaatattttcagaattatttcaaaatactttttcaaaatttttattctaaatttgtcaaatatatttttccgaaatccttgcagtaattttctttcagaaaattttttcagagattttcaaaaaatataatttttcaaaataatttttcaaaaagtattatttcataaaaaattttcaaaaatttttttcagaaatcttcagaaatttagtttatccataattttttcaaaattttttcagaacttttgcagaattttatttcatattttttcagaaatcttcagaaactatttcataaattttttgaaatttttttcagaaatcttcagaaatttagtttatccataattttttcaaaaaaattttttcagaacttttgcagaattttatttcatattttttcagaaatcttcagatactatttcataaattttttgaaattttttcagaaaatttatccataattttttcaaaaaaatttttcagaacttttgcagaattttatttcataatttttcagaaatcttcagaaactttatttcataaattttttgaaattttttcagaaaatttatccgtaatttttctaaaaatttttttcagatttttttttgcagaaattttatttcataaaatttttcagaaatccagaaattttatttcctaaattttttcgaacttttttcagaaattataatttttccaaaattaaaaaaatgtcttcaactagtcccaagcgtccaaacttccttaatgagaagtgtcgtcaccccagatgcatttcctccaatgaacgggaagggcgcggcaatgagctgactccgcgcgcatttttcggctgcgtttggttttcctcctaaaaattgggcaaaaattacaaatgaatcagaaaaactcaaaacattaattgaaactgctaatgactgactgtttgttgcacttcgaatcggcgacggaggcgccgattttctcgtcgcaatttgccaatttcgccgattaatgtgcacagagtgtctaacaaattgcatgacgtgttattgtactaattaattagtgccaatggtccagtcaatcagtttcctcccctaattaccgagcattgtcggggcttcgctcgtcgcttcgccgccgtcgcgcgacttttgcccttcggcgtatgaactcgtcggcgtccctggggagtaataaagtgccttcccctttccctctcttcccatttcc

SEQ ID NO: 1680 - DNA, 2909 bp, Heterodera glycines
tcgcgtggcgacatttctcattcagaaagcgtggacgtgttggttcatcatcggttgcctttcgcttcatcccaaaatattggcgcgccgcttcccgttcattggaggaaatgcagctggggtgacgacacttctcattaaggatcgcttgaaggcattttttcagttagatttttggaaaatgtgccttataaaataaaaggaaaaacgaaatgcggcgcgaggtttgcattgtgaaaataaaattgacgacttaaatttttaaaactaaaagattgtacaaattttttaccagtttttctttagctacgaatcgaagcaaattgaacggatcgaaatgctaccacagtctattaccgaaatgatttttgataaagttggcaaagatggatcatcaaaaatagacaaagatggattgcaaactattctttcaaacggcacaggccgtgcttttaatccggacacgtgtaggcttctcattgccctgtttgacttcaaccgcaacggcgtgattgatcggaatgaatttggtccgctttggaaggtaggttattcttatagtttttacctttggcttatcgtgtagcttactgctaacacatttctttatctgttcattttagtacgttgaggaatggaaggcctcttttaaaaaaatagcaggcgataatgagctgtcaattggcgttgaacgacttgaaattgctctaagggaatacggtaggtatttgtcaccgatattattatttcagatgttagtttataggctaccgattttctgccgacgtttattgtgaattgttgcgcaagtatgatcgcacaatttcaggtaaaagaccagagctgctgtttttaaaataatcttgtatttaaattaagctcggttgcactttgacgattttatacatctttgtattgtactgcagcaattgactacaccctttcgtgatcgggactttggccaaaaaggacggattagtgttggtaagtattattcatcaaaaaataatttttctaattttttctttaaggttttggagactacatcgctatgtttttatccacaatattataagatttttgcatttgatattaaaatttgctcccatctgtatttttattgttcattggcgtgacattacgcatcattctttactctcggttcagctgtcgctataatcgactttgagctcattttcagcatcccagtccgcttttccctgtcgctattctttccactcagtgtacgaagatgaacagaaacaacctgaaacgattccaaatcaagcctctttcggcagagtccaaaggctccgaggagcagccaacttcacgcacgaaaacgcttagcgaagtcaaggagttcgactcggctggcactttttttctgcgtgcaaagcttgtaagcgtgttgttttgcatttacaaggtgagatggacaataaatccctgcgaatatactcttacatcattatgcttcgaatttagtcctgcccaatgagaagtaagggtattccatgtcgtaagaaactcgacagtgaagacttttgtgtttcgtgcgtccaccgtgcgaaaaagcccagccgcaatttgtacctccgtgttgtactccaagattgtgatgacgaggaatgcgagcaggaaacaacagcattttcctatgcagccatcaactttttgagcattgccagcgtggaagctttttacaacctgtcagagaacgcacctaataagttggaatcgattttgcagtcaaaaatagatcaacccgtgctcgtcaaagtcaacatcaaggtgggttcattttttttttgctatgtgtttatcccaccttagctagtccattgtgttccatgcaaaaattatgtcagctaaaagaggcatattttaaggaaaataatgatacggcgaagcttgactggattatttcctccatatctgtggaaaaaccggtgtcggtgaagcttttggatgacaaaaacaacgatgatggagttgaggaagaggcatcttcaagcgagccgcctaagaagcgaaccaaaaacaatcaagtcgagcgtgctattgatgaagatgctgacgacatccatacgattgaatgacgagtgcttgcagatgtcaccaaagtggccagagaaaaaactgaatggattgctgagctcagcaataattgattggaaacataataaaaaaatttttaaacagaaaacgtccaatttatacgttaatgtagattttttaaatactggttaatatgtagagaatcttaaaaatttttgagggaaatcacgttaaggaaatcttgttttccgcccatatacatatatgtatccccgttcaatcggtgtacctatggatggttatacattatttatacataaatataggtcccatacagacacaaaaaattatcagactgttggagtgctaaacaattgttgcatcaatgaagaggactgcatctgttactgcatcaaaggagatggaaagttgtaaaaaggaagagtcgattgggactggatgccgcaaaggggtgaaacgacgatacccttatccgttgctgtcagctcgatctcaggatgcctggtaagtttgcagacccaaaaaaaaaatcacgtgacaataactcaggtctgcaaaacttgatcagttggaggagaaatattcaaaaatgcaagaagaactttcggaagacagcgatgatgcaattaatttcttcgaagatagcattgaggatattgtggaaaagtgagtaaacctttcaacactttaaatactgcttttattttaaggataaattgttctgaagctaaaataaaaaagtgggcagcacagcgagtcaatgtggcagacgccaaaacacggttggttgcgtagaatcagaaagcaccacatattattcagctgaa

SEQ ID NO: 1681 - DNA, 5149 bp, Heterodera glycines
cgctggcgaaaattgcgatgatgccaatgatggtgctccaacatcgactacttatctgaatttgcgcagtggcgagcagaccaaaaaaaagtttaaaaatgttcaccactgatatagtttatactacactatgataatcattatcttgttaataaaaaaataaaaaacttcgatatatatatataaaccggttgttttccgagtattattactctaatcatattatcaaaaaacatttccgatatcttgtaattgatattcagtgacatgtcatccaatagaaaaagaacagcagcggaaaacaattgcaagcaaagcaagcctaaacagccaaaatgggatttccgctcaatggtgtacttcgaacagtacccaactgaaccacaattggaagaggagactacccagcaacaacaatcatcatcagaagcgacaaatcaaactggaatgggcgatcgatcatcggattccgatggtggacagcaacagctaccgttgtacaaagaaatcaccaatcattcacataccatcgagcggttctctgtgcagcgccatgtcacggaatttgtgctcaacgcccagcatgagcaacctgatgaagcactacgtcaagccttcgatgaactcatcgccagagctatacaaaatgcggaaaaaggaagtgggcgcactgtttcaaaattgggcataatggtaaccggaaaaggcttaaacgatccggtagttcttcctatacggtctcctctgcaaaacaatgtcgacgttgtgatggccgagcttgacaagctgggtcagagcgagggcgacgaaggaggggctaacaaaaaaacgttactactaagcgagccagtggagatcgtcgtcacatgcttgactcctccggcagggtccgccccacgcttgcacaaataccaaaattggggatacgacgaagcgcaaagaatacgtatacacaacgtggacaactactgcttatttcatgcacttgctgcaggccgggcatatcacgaccacgatattttttgttccaatcccaattcgacaaattctccatttttttcaaacataaagaaaagaagggatttttgcaaaaactacgaagcgttcaatcgcctggtatcaaacaatgaacgaatgcgaactgtagctgaagagttgatgaatgcatctggcatccagattggtcaaacttcttatggaattgaacatctacagcatgttcaacaatactgggtaagtgttatacgattttagtcataaattgctgaaaatatgtttcaggataatgtttttcctgggacgtatcgcattgtgttgtttgaagaccggccagaagagctacctcggcctatatggaaaggagcgggaggacatcgttttaacgtcacgctttttctgtccgacaatcattatgatgcgatcaaaaaaattcattgcttcttcaaacttggtcggaaatattgcgtagactgcgagtgtacgtacactcttgacgctaaacatacatttcattgtaagagcagatgtccgcaatgtgctaaaggttttaaaatttgttaaaattttgctatactgaaatttttcagttgggccagaacaaccatgctcaaaacagcaaggcatccaaattttgtgcccggaatgtaaccgatactttttttcacaaacgtgttatgaaaaccaccgtgggtcaacatgcagagtgattaaacgttgttctctctgtaatcgtactcattggtcagataccggcgagatacacaaatgctatacaagctattgcaaacgatgcaaggtagaatattctatttgaaaaatagaaacacgcgcatcatttcaggtttatcacgcggaaaagacgagttgtttcatcaaaaggatccagataccaaaagaaaaacagcgctatcgtatcatcgtctgggatactgaaacacgacttgaacaacttgaggacgaatgccagcgtatacatcgggtcaattttctttcggcacgtattacgtgcaccgattgctgtgaatcgtcagagtcaaacaatgactgtgaaatttgctgtcaaaacaatagagtgctggagcgagaaaaagaatggtgggatgtgattgagaaaataaacttaaattcagataataggagtgaagcctatggcaatgagcagcctgttgcagcgtttgttgagtggattctgagagcgtggaacaaaaaattcaaaacatacatatgggtaagcgattcatgaacaaatttgtcttacaataaaatttataggctcacaacgcatcgagatttgacgggcattttgctctcaaccatctttgcaaaaccgcaagacgccctgatgtcgtgatgaacggactaaaaattttcgaatttcgcgtccaatatagccgaaagcattcaatgctcatatggcgtgactcctgtctgattatgccgattgcgctcgctgaattaaagaagactttcaatcttgactgcgaggacaagccgttcttcccttatgcatttaacagaagggagaactacaccataagactggaaaatcttccggacgaaagcgagtatgagcccggcacgatgaaggctgacaagtacgaaaagtttaaaaaatggtacaacgacaacaaagagacgccattcttcttgcccgatgagctaagggcatactgtctgaatgacaccgaaattctgctcaaagctttggttaaattccgccagattttgatgaatgaaattacggacggatttgacgtgctgccaattagctgtaccatagcgaggtttaaaacataaattgctcttttatcattttcattttacagcgcttgcatgaacatcttcaaggttcaattcatgcaagaggatcaaattgcaatggtccccgagctgggctatgaacgaaacgacagagccagcgtcatcgcaatcaaatatttagactggcgggcaaaaagtgaaggcattgaaatccagcatgcgggcaatggacgcgaaaaacgatggaaacaattcaaacttgatggatggattgagagacaacaacggtgcatcgaagtgttaggatgttattggcatggatgtgagaaatgtttcaaacctaatgaggagctcgtcgatggaaaaacgtgtcgtgagctgaatgaaacaacacatgaccgtcttcgccaacttcgcgagcctgacgataatgggatctgtttacaagttgaagaagtctgggaatgtgaaataaatgaccagctaaagaaaaacgacgagatgaaagagttttttgatgacttggggaatgaacgtggacctcttgaccctcgacttgcatattgcggcggacgaactggcccattgcgactatttgctgaaccagcagaggatgagaagatatccgtcttcgacattgtctcactatatccatgggtcaactatgacaccgattatcccgttggcgttcctaccgttgttcatcctagcgcagaggagatgattgtcaattggacaaaacctgagcatttaagctaccgaggtctttaccgtgttcgcgtcatccctcctcgtggactacaaataccagtacttccgatgaagattgacgaaagattgctattcagctgctgtcatcgatgtgcagctttgttccgtaaaagtttgacacggtgttcacacaagtgcaaccacacagatcagcagagggccttcactggcaacttcactcacattgaactcgaaaaagcgttagagatgggttatattgtcgaccgattttggagggcctggcattacacagaatggagtgatcagattttcaaaggatatgtgcggcaatttatcaggctcaaggtagtataattaaaaaaaatttgtatccaacttttttttcataggtggaatcaagcggctttccggaggggatcgaaacattggaacaaaaacaggagtacattgatgaatatcgacgaatttatggagttgacttggattttgggcatatcaaaaaaaatccaggactccgattcatcgccaaattgatgctcaacagcctatggtttgttcaattaagcgctcttgttagtctgtatgattcttttttcaggggaaaattcagcatgaggaatcagtttgggtcgaataaagtgatgacgagaccacaggagttttacgatctcgttttcgaccacaaaacggtattgagttttgggtatgagaataattttttcttttaaggaaatctcttcaataataccaatctctgacgcagctattcgtgtgatgtataagccaaagaaaaacttcataaccgagcatacatccagcaacattgtgctcagcttgtggacgaccagtcgagctagactgaaattgtttgactacatgcaacaatgctacaacacacctggcgccgagttgctgtacactgacacagacagtgtaattgtgcggcacaagcgcgaccttgttccggtacagacgggcgaatttttgggccagatgagcgaggaatacgcggattacgacatcttgacttttgcatgtggtggagcaaagcagtatgcgctgaagatggtccataaacaaacgaaggagataacatatgtgcagaagattcgaggcatcaccttcgacgtcaacaactctcaagcgctacagtttgaacgatttgtgcacaaagtgctcaactatggaaaagaggatgaacagaatgatgccgcagtgttcaactacaaaaaaatccagcctacaaaggacagtcggataattacaaggaagcaaaataaaagatatttgcctgtttgccaaaaaggaattatcactgaaaatctcgatgttttaccttttggatatgaatgaaattttgttgctgcataattttacttgaaaaaaaaacattacattacattgatgatattttcaaaagttcaattgggaaataactttgatgaccgttgccaccaatgtttacaatacatggaaggttaggaaactttaggcgagcacgatgtcttgcgtataaatgctgctctaccgtgattcctagaagaccacgataggcgtacattcgatttgcaccaaacatggtaaatgattcggggtaaacttgtaaattctttcttaggtgtacagtttcaattttttgatcgcatgagaaatttga

SEQ ID NO: 1682 - DNA, 1862 bp, Heterodera glycines
tagatcaatttcactgatctgactctcatgtctatcagaaatgtacaaacgttctgtcatataatcaaatattggtctgttggcgttcgcaaaaaaacccctgacaattttttgctgatgaccacaataaatgtgcatctcgtccgcctcacggtcctcaaagaacacatagctctttccgttatactcaaaacacgccgtcggtttaattggtcgaatactttgaatagttacaggagaagagagaatcagtttattatagctttgcaaactgattgtccattggctattgttattttttcttaccaaacatgcattatttttgtcatatccaaaaaacagctgatcaccacctgtatctttagaaaaagtccggtaattgttgtcaaaataattaggatgatcaaccgccacttcaagtgtaagcaattcgccttctgcgctggagttaaaacagaaaacggcaaaaaataggagaaaaaatgtactcatggccggtaacaatgaaggcgatttttatgccttttatactcgtaaaagtgtacgaacaaacccctttacaagcaaatctgctatagtacgtgtacgatggagagtgccaatcacctcacaatatgggacgccagagcaacgcgcgactagaaaataaatgcaaaaatgcccacaagtgtctgctgttgacgattgaatttgatgtttattgatttttatgtcactaaaagtgtttaaatacgcgcctaagtctttgttgggcgctttgcctaaactgtcaaaatattcaacccttgatgcattaggaacgaaacaggcaacccaatgctcgccccgtgttcctgacttgtctgtatttatgatcatacaataagggtattttcttctccactttggttgtggaattttatccgatgggaagacgccaataaacttagttctggtagcctgcacgcccttcagaattgttttcagctgaaccgaattcattattatttttctttcatacacttccgtcagtgctcaacacacgatcagcgttaatggaaaggactgaatcgaattcacctaatataagcatttcataaccgtccgcttttataggctgctcaaattggactttgacggtgcaagtgccttgccggatcagctcgaagccaggtgtgtcatccagtgtggatgtcattgggattacaaaaaaggcccatccgctgagaaatcgtgccatcgaaatggacaccgttttgttgtccgaatcgtcaaggccaagccctgcatacatgtccacaaatgcgcgcacaaattttttctgattgccaaacgataacagatagggtgtgcttgggaatgtcaaaccatttgcttcggcactgattgaccgtacgttcgcgtgctcaaaattgaagggtgacagatgccgggcgcccgagtatgcatccgttgacacaaacgcacaaatcagacgacgcggaagggttgaggtgaacacgttgtgtgacagctcagtacgacccatgcctaagaagatggaacgcatctctaccttacgaagcgcatatttggccggcgtgctttccaactgtttactaatcgcaatattaaggcttgaagttacgtctacagtgcgtacgtaaagtcttatatcatgtagacggatacggtattcggctgtgttatcatgccatgtcacacgcgctgctgtaattatattaccttgtgcatctttgaccgcatctgtaacggttttccattttggtgtaagcagaaggaaaggatcgctgttccgatggattgtgaacacaacatcctgattgttcagcaaaagtgatgttttgacgagccaaatcaaagttgagttttacccattgttt

SEQ ID NO: 1683 - DNA, 863 bp, Heterodera glycines
tttatgaccgactatttttatgaggtacaaagagaaccctagcaatcaaaggcagaaggactccgcgtttgacaatgtgtggaatccattgaagagcatggcatagcgtgtgggggttttggagcttcaaatttatgaccgactatttttatgaggtacaaagagaaccctagcaatcaaaggcagaaggactccgcgtttgacaatgtgtggaatccattgaagagcatggcatagcgtgtggggggtttggagcttcaaatttatgaccgactatttttatgaggtacaaagagaaccctatcaatcataggcagaaggactccgcgtttgacaatgtgtggaatccattgaagagcatggcatagcgtgtggggggtttggagcttcaaatttatgaccgactatttttatgaggtacaaagagaaccctagcaatcaaaggcagaaggactccgcgtttgacaatgtgtggaatccattgaagagcatggcatagcgtgtgggggatttggagcttcaaattgatgaccgactatttttatgaggtacaaagagaaccctatcaatcataggcagaaggactccgcgtttgacaatgtgtggaatccattgaagagcatggcatagcgtgtggggggtttggagcttcaaatttatgaccgactatttttatgaggtacaaagagaaccctagcaatcataggcagaaggactccgcgtttgacaatgtgtggaatccattgaagagcatggcatagcgtgtgggggatttggagcttcaaatttatgaccgactatttttatgaggtacaaagagaaccctagcaatcaaaggcagaaggactccgcgtttgacaatg

SEQ ID NO: 1684 - DNA, 1260 bp, Heterodera glycines
tttggagcttcaatttgatgaccgactattttatgaggtacaaagagaaccctagcaatcaagggcagaaggactccgcgtttgacaatgtgtggaatccattgaagagcatggcatagcgtgtgggggatttggagcttcaaatttatgaccgactatttttatgaggtacaaagagaaccctagcaatcaaaggcagaaggactccgcgtttgacaatgtgtggaatccattgaagagcatggcatagcgtgtgggggatttggagcttcaaattgatgaccgactatttttatgaggtacaaagagaaccctagcaatcaaaggcagaaggactccgcgtttgacaatgtgtggaatccattgaagagcatggcatagcgtgtggggggtttggagcttcaaatttatgaccgactatttttatgaggtacaaagagaaccctagcaatcaaaggcagaaggactccgcgtttgacaatgtgtggaatccattgaagagcatggcatagcgtgtggggggtttggagcttcaaatttatgaccgactatttttatgaggtacaaagagaaccctagcaatcaaaggcagaaggactccgcgtttgacaatgtgtggaatccattgaagagcatggcatagcgtgtgggggatttggagcttcaaatttatgaccgactatttttatgaggtacaaagagaaccctagcaatcaaaggcagaaggactccgcgtttgacaatgtgtggaatccattgaagagcatggcatagcgtgtggggggtttggagcttcaaatttatgaccgactatttttatgaggtacaaagagaaccctagcaatcaaaggcagaaggactccgcgtttgacaatgtgtggaatccattgaagagcatggcatagcgtgtgggggatttggagcttcaaattgatgaccgactatttttatgaggtacaaagagaaccctagcaatcaaaggcagaaggactccgcgtttgacaatgtgtggaatccattgaagagcatggcatagcgtgtgggggatttggagcttcaaatttatgaccgactatttttatgaggtacaaagagaaccctagcaatcaaaggcagaaggactccgcgtttgacaatgtgtggaatccattgaagagcatggcatagcgtgtggggggatttggagcttcaaattgatgaccgactattttttatgaggtacaaaggagaaacctatcaatccaagggaagaaggactcc

SEQ ID NO: 1685 - DNA, 1119 bp, Heterodera glycines
aaatttatgaccgactattttttatgaggtacaaagagacccctatcaatcataggcagaaggactccgcgtttgacaatgtgtggaatccattgaagagcatggcatagcgtgtgggggatttggagcttcaaatttatgaccgactatttttatcaggtacaaagagaaccctatcaatcacaggcagaaggactccgcttttgacaatgtgtggaatccattgaagagcatggcatagcgtgtgggggatttggagcttcaaatttatgaccgactatttttatgaggtacaaagagaaccctagcaatcaaaggcagaaggactccgcttttgacaatgtgtggaatccattgaagagcatggcatagcgtgtgggggatttggagtttcaaatttatgaccgactatttttatgaggtacaaagagaaccctagcaatcaaaggcagaaggactccgcttttgacaatgtgtggaatccattgaagagcatggcatagcgtgtgggggatttggagcttcaaatttatgaccgactatttttatgaggtacaaagagaaccctagcaatcaaaggcagaaggactccgcgtttgacaatgtgtggaatccattgaagagcatggcatagcgtgtgggggatttggagcttcaaatttatgaccgactatttttatgaggtacaaagagaaccctagcaatcaaaggcagaaggactccgcgtttgacaatgtgtggaatccattgaagagcatggcatagcgtgtgggggatttggagcttcaaatttatgaccgactatttttatgaggtacaaagagaaccctatcaatcaaaggcagaaggactccgcttttgacaatgtgtggaatccattgaagagcatggcatagcgtgtgggggatttggagtttcaaatttatgaccgactatttttatgaggtacaaagagaaccctagcaatcaaaggcagaaggactccgcttttgacaatgtgtggaatccattgaagagcatggcatagcgtgtgggggatttggagcttcaatttatgaccgactattttatgaggtacaaagagaaccctatcaatcaaaggcagaaggactccgcgtt

SEQ ID NO: 1686 - DNA, 1227 bp, Heterodera glycines
ttttatgaggtcaaaagagacccttagcaatcagagcagaaaggactccgcgtttgacaatgtgtggaatccattgaagagcatggcatagcgtgtgggggatttggagcttcaaatttatgaccgactatttttatgaggtacaaagagaaccctagcaatcaaaggcagaaggactccgcgtttgacaatgtgtggaatccattgaagagcatggcatagcgtgtgggggatttggagcttcaaatttatgaccgactatttttatgaggtacaaagagaaccctagcaatcaaaggcagaaggactccgcgtttgacaatgtgtggaatccattgaagagcatggcatagcgtgtgggggatttggagcttcaaatttatgaccgactatttttatgaggtacaaagagaaccctatcaatcaaaggcagaaggactccgcgtttgacaatgtgtggaatccattgaagagcatggcatagcgtgtgggggatttggagcttcaaatttatgaccgactatttttatgaggtacaaagagaaccctagcaatcaaaggcagaaggactccgcgtttgacaatgtgtggaatccattgaagagcatggcatagcgtgtgggggatttggagcttcaaatttatgaccgactatttttatgaggtacaaagagaaccctagcaatcaaaggcagaaggactccgcgtttgacaatgtgtggaatccattgaagagcatggcatagcgtgtgggggatttggagcttcaaatttatgaccgactatttttatgaggtacaaagagaaccctagcaatcaaaggcagaaggactccgcgtttgacaatgtgtggaatccattgaagagcatggcatagcgtgtgggggatttggagcttcaaatttatgaccgactatttttatgaggtacaaagagaaccctacaatcaaagaaccctatcaatcaaaggcagaaggactccgcgtttgacaatgtgtggaatccattgaagagcatggcatagcgtgtgggggatttggagcttcaaatttatgaacgactatttttatgaggtacaaagagaaccctagcaatcaaaggcagaaggactccgcgtttgacatgtgtggaatccattgaagagcatggcatagcgtgtggggggatttggagcttcaaaattatgaacgactatttttatgaggtacaaagagaaccctatcaatc

SEQ ID NO: 1687 - DNA, 1398 bp, Heterodera glycines
caatcaaaggcagaaggactccgcgtttgacaatgtgtggaatccattgaagagcatggcatagcgtgtgggtgattggagcttcaaatttatgcccgactatttttatgaggtacaaagagaaccctatcaatcataggcagaaggactccgcgtttgacaatgtgtggaatccattgaagagcatggcatagcgtgtgggggatttggagcttcaaatttatgaccgactatttttatgaggtacaaagagaaccctagcaatcaaaggcagaaggactccgcgtttgacaatgtgtggaatccattgaagagcatggcatagcgtgtgggggatttggagcttcaaatttatgaccgactatttttatgaggtacaaagagaaccctatcaatcataggcagaaggactccgcgtttgacaatgtgtggaatccattgaagagcatggcatagcgtgtgggggatttggagcttcaaatttatgaccgactatttttatgaggtacaaagagaaccctatcaatcaaaggcagaaggactccgcgtttgacaatgtgtggaatccattgaagagcatggcatagcgtgtgggggatttggagcttcaaatttatgaccgactatttttatgaggtacaaagagaaccctagcaatcaaaggcagaaggactccgcgtttgacaatgtgtggaatccattgaagagcatggcatagcgtgtgggggatttggagcttcaaatttatgaccgactatttttatgaggtacaaagagaaccctatcaatcataggcagaaggactccgcgtttgacaatgtgtggaatccattgaagagcatggcatagcgtgtgggggatttggagcttcaaatttatgaccgactatttttatgaggtacaaagagaaccctagcaatcaaaggcagaaggactccgcgtttgacaatgtgtggaatccattgaagagcatggcatagcgtgtgggggatttggagcttcaaatttatgaccgactatttttatgaggtacaaagagaaccctatcaatcaaaggcagaaggactccgcgtttgacaatgtgtggaatccattgaagagcatggcatagcgtgtgggggatttggagcttcaaatttatgaccgactatttttatgaggtacaaagagaaccctatcaatcataggcagaaggactccgcgtttgacaatgtgtggaatccattgaagagcaaggcatagcgtgtgggggatttggagcttcaaatttatgaccgactatttttatgaggtacaaagagaaccctatcaatcataggcagaaggactccgcgtttgacaatgtgtggaatccattgaagagcatggcatagcgtgtgggggatttggagcttcaaa

SEQ ID NO: 1688 - DNA, 1444 bp, Heterodera glycines
atcaaaggcagaaggactccgcttttgacaatgtgtgctttcattgaagagcatggcatagcgtggaaataactgtaaaaaaaatttggggcgatttgaatgagaatagaaagagccaggttcgatgaagttttggtaagcctaaaaaaaatccaaacatttaaaaatctataaaaaatttaaaaatgagaattcatgcgagattttctggaaataagcttaatagggcctagttaagctgtaaaaaaaaatttggggcgatttgaaagagaatagaaagaaccaggttcgatgaagttttggtaagactaaaaaaaatccaaacatttaaaaatctataaaaaatttaaaaatgagaattcatgcgagattttctggaaataagcttaattgggcctagttaagctgtaaaaaaaatttggggcgatttgaatgagaatagaaagagccaggttcgatgaagttttggtaagcctaaaaaaaatccaaacatttaaaaatctataaaaaatttaaaaatgagaattcattcgagattttttgcgaatgctatctaattaaaggtagcgattagcagcagaaaaggttcgtaaatactgataggctaattttgccaaggattatcgtcctattttggccattggacttaaaagggttacggtgtacaatcaaaaaatttcggtctcccacatgaaaattatttattgaactttatgcacaattttaatcataaattaggatttaattgtacctcattactcggacgctaaggttctaaaaccaacaaaatcacttttctagtgtcgaattgccacaaatgccggcgaaatatttcgaaatgtttgcgtaaggctagaaaaacaaatctatttgattctttagtggttaaaatattgcgagtttttactccaagacgttagagggcaatttgaataacgaactcataatctaattgcgaatgctatctaattaaaggtagcgattagcagcagaaaaggttcgtaaatactgataggctaattttgccaaggattatcgtcctattttggacattggacttaaaagggttacggtgtacaatcaaaaaatttcggtctcccagaggaaaattatttattgacctttatgcacaattttaatcataaattaggatttaattgtacctcattactcggacgctaaggttctaaaaccaacaaaatcacttttctagtgtcgaattgccacaaatgccggcgaaatatttcgaaatgtttgcgtaaggctagaaaaacaaatctatttgattctttagtggttaaaatattgcgagtttttactccaagacgttagagggcaatttgaataacgaactcataatctaattgcgaatgctatctaattaaaggtagcgattagcagcagaaaaggttcgtaaatactgataggctaatttgccaaggat

SEQ ID NO: 1689 - DNA, 3537 bp, Heterodera glycines
ccgagaaaaagaaacttttttcagcatcaaggctggtgaaccctttaattattttaaaagctgttgttaaatcattgatttttcttctttcttctaatttgtgtaaatcagtgatttttagtctttccccataatttttgtacacaaagccacattttctaaatgcttttctcgtgaaaaacttttgaacgcgttcaattttatctatatctttttttaagttatggttccaaacttctgtcgcatattctaattgaggtcgtacacatgttttataggctgctgttagagtctttatttccctgctttttaacactctcaaaatttggaaattctaagatatgcatttcgtacaattttgctaatatgttctgaaaaattaagttttgagtcaattataattcccaagtcacgtacattatcagattctgaaaatcatttttgagttaataaaatattctgttttatcatcattttcatgggcataatataatttaacatcatcggcatacatttttatgccaactgatgatgcttcatttgcaataaaggacggcagatcatttataaaaattaaaaagagtaatggccctaagacacttccctggggcactcccgaaaatatgctgaaactttctgacaatacttcgccaattttaactttaaaactccgattttttaaaaagttagttaaaaaattttgaatttttccttcaattccaatctttttgattttttgaagtaataaatcaattggaacagaatcaaacgccttgacaaaatcaatatagataatgtcaatttgttgatccttttgtagagaattatatatatcgtccattgtttttaatatttgggttgtagtcgacctattttttaaaaacccaaattgttctttatcaaaaaatcttataccgttcagaaattctaaaattttgctacttaaaattcgttcaaaaattctatagacagtgctggttaatgacaccggcctgtaatttaatggatcagttttttcgccttttttgaaaattggtaccactaatgatgttcgccatatttccggaatttgaccggaatccaaagcaagtcgaaatatgtcagctaatatttttgtaattggctctgcacaattttttaataaaatgtaaggaatgttatccggtgaagtggaatttcgcctgggaagctttcttaatatattccaaattatgccagcatttaattcaatatccgaaagtttagtcttattctgtgctgattgagtcagtgaaccattgacaactgaattttctaaaaaagatttttggaatatttctgctaatatttcgcatttttgctcattactggaaaacatatttccagcactatcaattaacgtaggaatttcattaacttttgatatacagacaatttattgtaagttccgcttctaccgtatttctggagtttaaccaggtctcactgattaggagtatagacggattgtattttttagctaaatgttctaaatcagctattttatttgatattgatcgggcatttattaaaaggcaagaaatccagggattgaccgtttttctatttttttcggttggtttgttcgcgtgtccctagcgagttctgagcgggtgggggtttttcagggacctgatttccaaatcaaccacaaaatatttatattcaccagcagcaatattggcctgataggcttgttgccgaaaggaatataaaattttgagttcgttttgggtcatgtctgcatttttcgagacacatggcatcttgaggatcattgaatatttagctgttcttaaattagatcattggagctttggaattactgtctttttgttgttctaaatataatttaaaaattttgaattttctcaattttcagccatttcctgcgctatttctcatgttctggacactcaacctttccatgggattaaattataattattggttcatttcattttttttaatagttcatatatttaatttataatatatttgtttttataatattgaaataagcaattgatttttttactacatatatcaacaaataagctagttttttgtaaatgtaaaagatttttttaatttcaagtaattatttttctttaatgtacagaaattttcttttatgggaaaattgggttgcttccgtaattttaacggaatattttttattttatttttaaattttcataagaatatatatgaaatgaaaattgttttatcatattaattatataatatctcatgagctatattgcacttacggagcaaaaaagttgatgattatttttgtataaatattatgaaaatcaatatgtataagtttcatagttaaagatctaagtttcattttttcggcatctcaagttttcactagcaataaagattttctcttaacatcttgtcgtctacattcatttatttcacatcctcagggttttttaatcacctgttgtcatacagtgatttatttattatataaatgggactattttatcgtttcaatgaaattttaaatgaatgtgaaaggtaattcatatgtttttcaaataaatttttagtcgcacttttcttaataaccttcactttttttaacaaacaggttctcttgtcatgatttttaaatttgaaattataatatcatattatttttgatatacttcaaagaaaacagaatattttttagtttttatctgctgatcactttatttttcaaattttatattgaaaaaatatgtagttgaccactttttttcatttcgctgaaatggaggtcaatatattttaattgtatatgcaaaaaattattataataaaaattaaaattcatccatgattcaaaaacattgaaaaaacgaattttaaaacctttagttaagctttttgaaattttataggctaatataaaaatataattattccatgataaaaagatgaatattttttaatgatttcatatgatttcttacattagacaaatttagcatttcgctaaatatttgcacttttttgttgtttaatatataaaattattctcttttgttaattaataagaaaaatgattgtttttggaaatttgatcgaaggtcttcttgaatgcctcatgcttattgaagttgttcttaaaattttacaaatctttttcataagcttttctaagtagtttattttcggtttaacaatagatattgtttaaattacatatatttttaatattacaaatttataatcatttcggttataacttggcaaattttcttttgtcaatttatgtgttattttctaattcatttaattttgtgttttcttgccatttgtttttacaatagaaagttttccaattgccttaatttatttacactttttcaaatttgtaaaatatacatcttttatatattggtattcttttttttataatttttcattgcatgcatccggatgatgctttcttacaggttcagcagccgttccttaattgttaattatttgcctttttatttaattaataat

SEQ ID NO: 1690 - DNA, 1559 bp, Heterodera glycines
  misc_feature (53)..(53): n is a, c, g, or t
  misc_feature (94)..(94): n is a, c, g, or t
  misc_feature (328)..(328): n is a, c, g, or t
  misc_feature (1528)..(1528): n is a, c, g, or t
attaaatatattttaatttccatctgccaacgtcaagtctgcatgtatttttngatgaatggtattatagacaaatgttataatttaatttgtntagttaatgaatgtataaaaggatattatattaaaattctgtttgtattttacttgctgtgaagaacgaatccattcatgactaaataaaaaaaattaaaaattatatttactttctattttttcattattttctaattaaattattttgtcctccttgcataaattttgggcttaagtaaattaatgtttttcattttttaaatttcaatatttgttagaatgtattaaaatntaatgataaattccttttgatcaattgcatttaaattgaagattattctctaatattcatttttgaaaataaaaatattcttgatcgactattccaattatgtataacaacaaatttatcaattttttttctcctcagtacttcaatttctttgttctcttcctcatcttgttctaatccagcggacagtcaggtcgtgatttgactaaaaaagaattaaatataataaatttccatttttttctatttatcgatattataatgagattatcaaaaataaaactaaattagttattttttcaattcagacaaaaaattattgtattgtaggcgacacgtacggagatatgggacagtttggtgaaatcgggctgccagcatcttaatttaacttactgttgagaaaattttccgaaatttaattcattttatttttaatttacaaagatcagttatttttcaattaatttgcatttatctacccccccccccctccttttttccctaccggaaatcgtttccaaattttcaccagtaaatagtgaaaatgggtgtggtgtaggacatctcttcttacaactacgtaatggtgcacaatgatctgaatgaaaacatgaaaattaccagcgacaatttttgatcggatcggtgagatagcacactgacgattcaatgccgagtgatctagaaatttaagaccatttgttaaaaacattgaaaaaacagtattaattaaaacatgaaaattaccagcgatgatcggatcggtgagatagcacgctgacgattcggtgccgactgatctagaaaatttataattaacaataaactcaaatatgaataaagcacaatcgaatataccattcaatttcataccgtagtatgatttaaaaattttcatttattttttctgaagctgcatttttatgaattatgcaaaatttcgtcaaaaaatgggggtttggtcttttaattattggctaataattacccaaaatttgatttgaaatccaaaagtggtaacttttcatatgaaatttattttttagttttaaatttacctaccagaaaatgttcggtctttgtccgaccgctcatctttcgagttgtcggttctgcgtttgcttttgacatcctcgtgccgaaaagagcgccgatcacgattattgttgtttcagaaactgttgtcatggacaatcnggcgttggtcgcggtagatagtttgtttgtc

SEQ ID NO: 1691 - DNA, 1637 bp, Heterodera glycines
gaatttttttgcaatatttcagctcaaatattttttcactcaaattaccatataaatgccatcaatttcgttaattcatggaaaaatcctatggagaaatgaaagagttacaactcaaaaaatttttggatttattttcattattaccacaataaatctgcaattatccattttgatatttattagcaataggaatattatcacttgaatgaaaaaagtgtgattataattgttaacaatgatgttaagaatgttgtccttacactacttgaatgttctaattgaggaaaatttttaaaaaataataattcaatattgaattttttcagtgttgccataaacataacgaccaaacgcacgaaaacaagttgaaagaatactctaattgaaacaaggataccaaaattaacattttacaataaaaaataaaaaattataaatcttaaataaaataaagctgtaataaatgtatgaaaaatgaaaaactaaaaaaaatcattttaaaattaattataacagctctaataaaattagcaatacaaaaaaagaaaatacaataaacttgaaaaataaaatgacatgaaaattactgtggtccaaattgtgcaggagcacaagataaattttcaagagaatctacaacataaaaccgaaaaaacaatattgttcatagagagcatagagagtccatggataagaagaaaaaccactgctgttatatttgtattaaaaataaaattaaaaatattgtgaataaaagtaaaaactctgagttttagaagaagaacaacgttgttgtcctcagaaataatacaaaagtaatctaaaaatcatgattttaaattcatatcagataaatgagataaaaagatttgaataaatattctaatattctaattaaaaaataataattagatcaaatttataaaaaagtaaaataatttttaatcaaaaataaagaatttaccgtatttcctcgattataagccccggggcttctattgttcaacccccctccaaagggggcttatattcgagggggggcttccaatcgagggggggcttttattgttcaacccctttccctatataaattcttaaaattttttgctttctgcataatggtacaatttaaatcttaatctgaaatttttgaattgaaaagatttttcattttttggcccttggaaatttaggcgaatgtttgaaaattcataattcacttctaaatgaatcaattaaagtgcaaaaaagcattaaaaatagagaaaaatctggagcattttatacttttttagaattttctatcttcaaaatgaagaagttattacataaattttggaaaaattcgttttttttagaaaaaaaaattaatagcactgttctgaaaaggttttttgaaaaacacgaaattcttcctctataagcttctgtttattctatatttttataagacttttaaaaaaaagtacaaaaataaactgattttggaattcgggatcatagatggaagcaaggggtttttttggggccttgggttcagaatccacttgcctgaaaaaatgtttttttaagggttttttggaccactaatccaaaaacttggcatccatttttgcccaaattccaaagccttg

SEQ ID NO: 1692 - DNA, 3428 bp, Heterodera glycines
  misc_feature (3404)..(3404): n is a, c, g, or t
aaatttaaataaacaaaatttcattcatttacttactcaatttagtaacttttaaacaggaccaggcaacggggaaaatattcaatgccggaaaaaggaacgatgtctgaagttatttacatgtaaaaatatttttattgaattaataaaataaaaattaaaaaggatgctattcgagatttactttgtctaaaaaataaatttcatgtctaaagggagagtaaaagaaaagaataattaaataaccaaaataaagtaaattttataaatttttaattggtaataatatgacttaattatattttttatttactaaaaatgaaattaacattctaaattttaaggaaatccgtttaaccttatctctgctagaataaatcgcaagtttttatttattttgtgaatatacctattatttatatatatttcatagataatgttactaagaaaaataaaggaaaaaaattgaatctttcagttatccagaaaagaatgaaaaacaaaattattcataatttataataaaaaagaaaatttaaataatattaacaaatttcttactaagctccagtaaaaagtaataaaatgcataaaggaataaaaagttttgaaaagtgaccttgaaaattgtaaccttgacgattccgctataacttaaattaattctaaataataaaaatcaataaatgtgaaatagtaagcttaaaaacatattaattgtattttctcgttaaaaatgaaaaaaagaaagccttaatctaatactaatttggtgctagagaaaacaaaatcaaaccaatggttagccgacttttgcgccgcggacatttgcgccgcgccatttgcgccgcgacatttgcgccgctcagcaataaagactcttgcgccgcggacatttgcgccgtgccatttgcgccgcgacacttgcgccgcttaataaaaacgacatttgcgccgcaaaagcgaaaaatgtaaattacgccgcttatttaaaaaatttatgtgattgatccatcaatttctaatttaacatactttgacaagcattactaattccattcttcgaagcctttcatgccaagacggtactggagtgcatgtatgtgacttatcaaatcttcgtcatttttgttttctttggcatcatatgcgacaacaagtctccttattgcctgatcgttttccaggtattttttgagccgtggacggtcagaaaatccgcgagtgtgatcaatttcatacggtctcagtctgttgacttggtattcttcttcatttttcatctctttgatgaacctatttatgtcaaaatttttaataaattgagccccaactaggcgtgtgcgaaaaccaaaaaataataattttagaaaatgaaacgaaaattaaaattttaaaactcgaaaatgaaaacgaagcgaaaattttttgacagacgaaaacgaaactcataaagtgacgaagaaaggggacgacacgaaaatgacatgaaatttcgcacacccctgacaatagaattttttaagaatggaaactttttcgaaaatgtcgattactttgaaaaagctgggtgaggggcgtaaatctttttcggaaactgctgtgccacctgagattttttacattaaatcattaaatttattttaaattaatatttttatttgccactcgatgccattatttgtgcgttgttcttcaagcaacacagaattatgttggttccaccgatctggacgaaacaatggaaatcgctgttcaccattcacgatccgaaataaataagtgcttaaaattattgattttaaaattaatattaattaatatactttttaaaataattgtaaatcggttccgcttccggtggggcaatctcattaaaaacattaaagccggtatcattcttcttcgagtaaaaaagcaagactcggtaaagctcggattgcttttctaaagacttcattttgtccgtaaatgtttgccaagccatctttttgaattttacggtgcaccgcttgacaaagatggaataagcaatgttttataggcatttcttgaccaaatgctgtttggaacccattttttgcacctttcataaaaattattttaaatttactaaattatttttataactttcttcaaaatccattaaaaaggataacggtattgaattgtccaaatggttgcgtaaaacagtgaaagcccgtccatacgtgttggaattacgattttccattaaaatatatgctgacggtacagaaacatgcccaatcagcacatttacagtatacaacagtaagaaattagccggacaaacttaaatattttaatagataaaaatttaagatcatttaaacctttaaatgtcccatcaccagaccaatttttgtattttttcaaccttgataatccattttctgtagaaaaaataaaaaatttagctaattccggttcagtaatgcgcgaatcaaatagtaaaaatctgttgccatttttgtccaacgtaaattccccctttaaaaaaaattaattttaaatcttaatgaatactcagagggctggcagtttcggcaaaaaatttttcgaaataggctaccaaaaggctaaaaattccataaaaatacaagaaaaatgaaccagaatggcaataactaaaaaacggaacggaaaggcatcaaatttcctgtcgctctaaaatgtcagccccctactctcgaatgtacttcaaggattatattttctattccacttcgatcaacccctgcagcgcccgggattactctttggcgctgaattgttttttgaatcgaactgtacgtcggcatccttaaaagagctgattcgtccaaattttcccgcgtttctccgattatttcgcgaggagcaaaatttgtgtttttggcagtctcctttgcctgctcaattcgctgtcgaacctttttttaatttctattactttttttttataactttttatacaattgctgaatccgcatttggaagatgattgtgttggatcttctcaacaagctcagtggatcccaaagcagaatgtgcgcgaccaggacaactttttttaacacagccccataccttttaattagcaaaaaatgcaaaattacagtatataataacataaaaacaatattttttacttgtattaaaccatttgcgattagctcctttttcctcatctcaaatccattaaaaacaattaaatctcggcccttggttgtccgttcattcggagcaggcgaatgagcaaaggcaaacaatgaaattaggagcaacaaacggttcatgtttgaagaatcaaaatgaatgcatttctccataatttgttatctatttgaaagagcacctcattccttagaatttaatttgtggggcgcatttttttgcaggantttgtgcaaatcgacaattaaata

SEQ ID NO: 1693 - DNA, 3153 bp, Heterodera glycines
  misc_feature (31)..(31): n is a, c, g, or t
caggatttgtgcaaatcgacaattaaataanaattaacggtaattttgataaaataaaaattaacgagaatttttgatcagaccataaaattctttgataattctttatttttccatgtataaaagatgcagaacattgaagtcgagatcacaacaaaaaaaaatcaaaaatgaaaatttatctgttttatttcctgctactctctacggtgaacgccggacccgtagcaattctcgggggaactgcgcgactaataaattcgctaaaaagtttaaaaacagcacaagcagttgtgtcggggcgatcggaacagcaggcggcgcttcaatggctgtgattatcgaccagataattgacagtcttacaaataaaggttccgtaaaatggaataaattattttaataaactattataatattttgaattaattaaggcgaatttatcaatcaatcagttaaattaaataaattaaagtaacaataaaataatttttagtgaaataattaaattaattatatctaaatgaattgaaatgaatcccaaaaattgaattaagataaggttgatttgttggctccattttttccaatcaatttcgtcgtcgcaggcggcgaaatcttggtcgaaagagaaaatttttctctcgagtatatcttcgatttgttcgaacatctaactgaccgacgatcattgaacgaaatctgtttctacaacaatgacggagagatgataaccgtgcacaaagaaaagaatctttctttgttgttgatgtacgcattgacaaaaacaaaaaattagaagtctatctttgtgattagtaatttttcatattttccacttagttatttttttatcgttgactcatagttttaataaaatatgttgataatattgagtaattttgactgcgcggcgcaaatgtccatttttgctgtgcggcgcaaatgtcgcggcgcaaatggcgcggcgcaaatatctgcggcgcaagtgtctgcggcgcaaatggcacggcgcaaatgtcgattctgctgagcggcgcaaatgtcgcggcgcaaatggcgcggcgcaaatatctgcggcgcaagtgtctgcggcgcaaatggcacggcgcaaatgtcgattctgctgagcggcgcaaatgtccatttttgctgtgcggcacaaatggcgcggcgcaaatgtcgcatcacccaaaccaattagaaaaaaacgaaataataaattgcaaaaaaatatattaaaaatgctacatcgcaagaaaataaaacaaattgaaaattaaaatttctaaattactcctaaatgagcccgaaattgagtgtatgtaaagcctacatagactggaagaataactataatatcaatttttaattgagtaaatttatagttataaactctcgagttgcgaccaatgaatggttaaaatttagcatgaaggttattgaacattgatgacaataaacatttttgggtatttattatgctttatggtggcactatgggagtaccataaataattataattaagttatcgtgtacaataaaaaatattctgcttttggaccaattgcgagtgttttctttatatagttataaaatattaaaaattgttaattttttatacttaaatttccatagttaacaaaatttgggaatatattttcttttaaaatttattaataaatttcatacataatataattaatttttaggttaaatattcaaataatttatttcagtctatataaaatcattttttattattttattattagaataataaaaaatgaacttttattgaaaattttaatttatcaaaatgatgactacacaaataattgatttttgttattttccaataaatagtctttatttttctttgatagcgtttatttatttatttttgcctttacttttatactatttattttatatagaagttttccttggttgtattttttaattttgtgtcaacagaaaaaaaatttattaaaaattttacttttttcttatttatttatttaactttttaattccatttattgtgctcctctcaagactcctaatacttgattggttccaaccattttgtttaaatttcttgtacagcagtcgcaccagtaacaataataacagtaacaccttttttggcgttccgatcgtgtataaatatttattatgtcatttacttgtataattaattatggataaaaatctcagacattcatcagtttatttcttgttaaactattatttacataaatttagcgaaagtgaaaatttttctttaagtaaaatttatgttttttcatcttactatttcttttattcaacaatttttagatttttattattttattaattaaaagttttatctaatttcatttagcaatcaaaatgcttcaaattttaagtttattttgttatgcatttaagaacaacaggtatttatagcattagagatcatttatgccgttttttggtacttatatgttatctgtgtaccagggatgggccaaattgaaaaataaaaagcgaaatgcgaaaagctaaaatatgcgaaatgcgaaagcgaaattttttctacaactttttaatagttaaaatcataaagcaaaaatcattttttaaaattttattccaaatttaaaaatcaataaaacgcttttttgaggtgcgctttttccaaaaaaactttttgggaagagggggcaggcgccgcctggaaaatttgattaaaatttgttgacagattttcactaaaaaatgatcaaattttgtgatttttatcatttttctaatgaaataagagttttagggcgccgctgataaatataaacaggttttcactgaaaattagccaatttataggtaaaattttgaaaaattttatgggaatttaatccaattcttaggggtgtaaaagtcgcgtttcgcgccaaaaagcgaaatgcgaaacgccaaaaaatgcgaataatgcgaaaggcgaaatgcgaaaagcgaaacctaggcacatccctggagtggggggcggaagtttgggcaccgggaagtttgggcaccaggaagtttgggcaccagaaatttgggcaccgggaagtttgggcactaaatttaggatttaaaaaataaaattatttttaattgtctat

SEQ ID NO: 1694 - DNA, 1304 bp, Heterodera glycines
tccaccattttctattcattctcaaaggtcaatataaacagggccggcggcgagtagaagcacgaatatgggtgggacggcgggtaataatttgccagatcgcatgactcatttggggtatggtgatgagaatatcgttgggcatagtgaatgttcaacccatatctagatatgaaatgtcatctgctatcgacgtccaataccatttccaactcccacggcattccgcctctttaggcgatgttccgtcctcatagaaattcaagatctcctctcttgcgatacttcctcgtccctcatgagtcacattacccgctatatatttatctccatctccagttccgcaatccccccgtgtggatctcaagcttaaccggcgcccaaatctctggtgcggcgaacttcctgctcccaagcttcccggtgcccaaacttcatgtcgcccctggagtggatcctcgtggtattttgccccgttcattgcaacggctcaaccatggacttccgatttggcggttcaattctgtaaagatataagtattatgaaatcaaagcttctacaaataagaaaataataattaaatagaagcaatgcgagaagaaaaaattattataaattaaatagttttttaatgaataaatacatgacaaaatgacaaaaaaccaaaagattatataattgaaataaaaaatgatcaaattatgtaagaaatgaatggatcaacagctagaaaaaatttgacttgaactgacaaaataaagcaaaaatattttactttttgaacgcgtgataactaaatcaaataattactgagaaaataaaaaaattttcatagataaataaaaatacggctatcaataattaatattaataactgaacagaagaaaattgttgaaatatctgataataacgaacaagatgttatctaactttaatttattatcgacaaagtcattaaaatggacaaaaaagtagagaaaaagtaagaaaaaatgaatctgataaatttgggcgatttcttttttctcaacttatttaatttatgtaattaaaagcttaaattttgattcttttgacatcagcattttgtgacaactgattaaaatgtaaataattaatattttaattttcttttttagaatttatgtccccaaatgatataagttggaaaaattttattatttaaaatatttattttttttattttaattaacacaattattttcttttagtttttgatttaaatagtattcattgatttaaagattatctgtaaactctaatcgtattgtgaatgtatct

SEQ ID NO: 1695 - DNA, 2613 bp, Heterodera glycines
aagcgagaaaactactgcataaaaatttaagaacgaaaatttttgactagaaaatttcaaacattttcctccaccttcttttaagtcccacccgagggcgagacagttccaaaatttgggtgccacataaatgtggatgtaatagtaccttaattggactatcactagctcaatttaggtggaggattttgggctcatttcttacaaatttcaggggattttaatggaactgaaaattgcaaaaattagatggggtggtccctttgtaaggaattccctcgtcgtctaacccgccccttttcatgcactatttcagggtctaaaaaatgaaaaaaaacaaatgattttttttgttaaaaatcatagaaacttttcggcttttaaattttaaacccgcacgattccgcgattcgaaaaccgtgaaaaaaagcgagaaaactattgcattaaatttaagaacgaaaattttgacttgaaaatttcaaacattttcctccaccttcttttaagtcccacccgagggcgagacagttccaaaatttgggtgccacataaatgtggatgtaatagtaccttaattggactatcactagtcaatttaggtgggggattttgggctctaatggaactgaaaattgcaaaaattagatggggtgcgtccctttgtaaggaattccctcggcgtctaacccgccccttttcatgcactatttcagggtctaaaaaatgaaaaaaaacaaatgattttttttgttaaaaatcatagaaacttttcggcttttaaattttaaacccgcacgattccgcgattcgaaaaccgtgaaaaaaagcgagaaaactattgcataaaaatttaagaacgaaaattttgacttgaaaatttcaaacattttcctccaccttcttttaagtcccacccgagggcgagacagttccaaaatttgggtgccacataaatgtggatgtaatagtaccttaattggactatcactagtcaatttaggtgggggattttgggctctaatggaactgaaaattgcaaaaattagatggggtgcgtccctttgtaaggaattccctcggcgtctaacccgccccttttcatgcactatttcagggtctaaaaaatgaaaaaaaacaaatgattttttttgttaaaaatcatagaaacttttcggcttttaaattttaaacccgcacgattccgcgattcgaaaaccgtgaaaaaaagcgagaaaactattgcattaaatttaagaacgaaaattttgacttgaaaatttcaaacattttcctccaccttcttttaagtcccacccgagggcgagacagttccaaaatttgggtgccacataaatgtggatgtaatagtaccttaattggactatcactagtcaatttaggtgggggattttgggctctaatggaactgaaaattgcaaaaattagatggggtgcgtccctttgtaaggaattccctcgtcgtctaacccgccccttttcatgcactatttcagggtctaaaaaatgaaaaaaaacaaatgattttttttgttaaaaatcatagaaacttttcggcttttaaattttaaacccgcacgattccgcgattcgaaaaccgtgaaaaaaagcgagaaaactattgcataaaaatttaagaacgaaaattttgacttgaaaatttcaaacattttcctccaccttcttttaagtcccacccgagggcgagacagttccaaaatttgggtgccacataaatgtggatgtaatagtaccttaattggactatcactagtcaatttaggtggaggattttgggctctaatggaactgaaaattgcaaaaattagatggggtggtccctttgtaaggaattccctcgtcgtctaacccgccccttttcatgcactatttcagggtctaaaaaatgaaaaaaaacaaatgatttttttgttaaaaatcatagaaacttttcggcttttaaattttaaactcgcacgattccgcgattcgaaaaccgtgaaaaaaagcgagaaaactattgcattaaatttaagaacgaaaattttgacttgaaaatttcaaacattttcctccaccttcttttaagtcccacccgagggcgagacagttccaaaatttgggtgccacataaacgtggatgtaatagtaccttaattggactatcactagtcaatttaggtgggggattttgggctctaatggaactgaaaattgcaaaaattagatggggtgcgtccctttgtaaggaattccctcggcgtctaacccgccccttttcatgcactatttcagggtctaaaaaatgaaaaaaaacaaatgattttttttgttaaaaatcatagaaacttttcggcttttaaattttaaacccgcacgattccgcgattcgaaaaccgtgaaaaaaagcgagaaaactattgcattaaatttaagaacgaaaattttgacttgaaaatttcaaacattttcctccaccttcttttaagtcccacccgagggcgagacagttccaaaatttgggtgccacataaatgtggatgtaataggaaccttaattggactatcactagtcaatttaggtggaggatt

SEQ ID NO: 1696 - DNA, 1860 bp, Heterodera glycines
  misc_feature (1841)..(1841): n is a, c, g, or t
ttgaaaatttcaacattttactccaccttcttttaagtcccacccgagggcgagacagttccaaaatttgggtgccacataaacgtggatgtaatagtaccttaattggactatcactagtcaatttaggtgggggattttgggctctaatggaactgaaaattgcaaaaattagatggggtgcgtccctttgtaaggaattccctcgtcgtctaacccgccccttttcatgcactatttcagggtctaaaaaatgaaaaaaaacaaatgattttttttgttaaaaatcatagaaacttttcggcttttaaattttaaacccgcacgattccgcgattcgaaaaccgtgaaaaaaagcgagaaaactattgcattaaatttaagaacgaaaattttgacttgaaaatttcaaacattttactccaccttcttttaagtcccacccgagggcgagacagttccaaaatttgggtgccacataaatgtggatgtaatagtaccttaattggactatcactagtcaatttaggtgggggattttgggctctaatggaactgaaaattgcaaaaattagatggggtgcgtccctttgtaaggaattccctcgtcgtctaacccgccccttttcatgcactatttcagggtctaaaaaatgaaaaaaaacaaatgattttttttgttaaaaatcatagaaacttttcggcttttaaattttaaacccgcacgattccgcgattcgaaaaccgtgaaaaaaagcgagaaaactattgcattaaatttaagaacgaaaattttgacttgaaaatttcaaacattttcctccaccttcttttaagtcccacccgagggcgagacagttccaaaatttgggtgccacataaatgtggatgtaatagtaccttaattggactatcactagtcaatttaggtggaggattttgggctctaatggaactgaaaattgcaaaaattagatggggtggtccctttgtaaggaattccctcgtcgtctaacccgccccttttcatgcactatttcagggtctaaaaaatgaaaaaaacaaatgatttttttgttaaaaatcatagaaacttttcggcttttaaattttaaacccgcacgattccgcgattcgaaaaccgtgaaaaaaagcgagaaaactattgcattaaatttaagaacgaaaattttgacttgaaaatttcaaacattttcctccaccttcttttaagtcccacccgagggcgagacagttccaaaatttgggtgccacataaacgtggatgtaatagtaccttaattggactatcactagtcaatttaggtgggggattttgggctctaatggaactgaaaattgcaaaaattagatggggtggtccctttgtaaggaattccctcgtcgtctaacccgccccttttcatgcactatttcagggtctaaaaaatgaaaaaaaacaaatgattttttttgttaaaaatcatagaaacttttcggcttttaaattttaaacccgcacgattccgcgattcgaaaaccgtgaaaaaaagcgagaaaactattgcattaaatttaagaacgaaaattttgacttgaaaatttcaaacattttcctccaccttcttttaagtcccacccgagggcgagacagttccaaaatttgggtgccacataaatgtggatgtaatagtaccttaattggactatcactagtcaatttaggtggaggattttgggctctaatggaactgaaaattgcaaaaattagatggggtggaccctttgtaaggaattccctcgtcgtctaacccgccccttatcggcactatttcagggtnaaaaaagaaaaaaacaaat

SEQ ID NO: 1697 - DNA, 1470 bp, Heterodera glycines
aaaattggcgggggggcgtccctttgtaaaggaatcccctcgttcttctaccccccccctttttcatccattatttcagggtataaaaaaagaaaaaaaaacaaatgattttttttgtaaaaaatcatagaaacttttcggcttttaaattttaaactcgcacgatttcgcgattcgaaaaccgtgaaaaaaagcgagaaaactattgcattaaatttaagaacgaaaattttgacttgaaaatttcaaacatttttctccaccttcttttaagtcccccccgagggcgagacagttccaaaatttgggtgccacataaatgtggatgtaatagtaccttaattggactatcactagtcaatttaggtgggggattttgggctctaatggaactgaaaattgcaaaaattagatggggtgcgtccctttgtaaggaattccctcgtcgtctaacccgccccttttcatgcactatttcagggtctaaaaaatgaaaaaaaacaaatgattttttttgttaaaaatcatagaaacttttcggcttttaaattttaaactcgcacgattccgcgattcgaaaaccgtgaaaaaaagcgagaaaactattgcattaaatttaagaacgaaaattttgacttgaaaatttcaaacattttcctccaccttcttttaagtcccacccgagggcgagacagttccaaaatttgggtgccacataaatgtggatgtaatagtaccttaattggactatcactagtcaatttaggtgggggattttgggctctaatggaactgaaaattgcaaaaattagatggggtgcgtccctttgtaaggaattccctcgtcgtctaacccgccccttttcatgcactatttcagggtctaaaaaatgaaaaaaaacaaatgattttttttgttaaaaatcatagaaacttttcggcttttaaattttaaacccgcacgattccgcgattcgaaaaccgtgaaaaaaagcgagaaaactattgcattaaatttaagaacgaaaattttgacttgaaaatttcaaacattttcctccaccttcttttaagtcccacccgagggcgagacagttccaaaatttgggtgccacataaatgtgtattaatagtaccttaattggactatcactagtcaatttaggtgggggattttgggctctaatggaactgaaaattgcaaaaattagatggggtgcgtccctttgtaaggaattccctcgtcgtctaacccgccccttttcatgcactatttcagggtctaaaaaatgaaaaaaaacaaatgatttttttgttaaaaatcatagaaacttttcggcttttaaattttaaactcgcacgattccgcgattcgaaaaccgtgaaaaaaagcgagaaaactattgcaaaaaatttaagaacgaaaattttgactgaaaattcaaacattttttccccccccttttttta

SEQ ID NO: 1698 - DNA, 1256 bp, Heterodera glycines
  misc_feature (1245)..(1245): n is a, c, g, or t
attctttatttccagaggagaacgatttgtcttctttcaattcaattgaacagcactaaatggtgccagaactgtactcgataatgtagagtgccacgggaccgggacctggaagcggacaactgagtaccccaaagtcccgggttttgaccgttttgaccgggaatttacacccctcagtttcatgttttttatgcatatttggtgcatattttgtgattttgtgcatatttggtgcatatttcacgagtttatttgcatattttgaccacttttcgtgcatattttttgcagccctgtttattatattgtaaaattttaaaaagttttgttaaatttaaaaaaaaaattagtttttgatctgagaaattcaaaaaccaacccttttttgaacatttttcgtcataactttctttaaacttaatgaattttttgagtaacaacccggcaccaaatgaagaagctgggctggctggttaaaatgcagaaagcggggattaataaaattcataaaagggttttaggacattcgacggttcaggcaaaaaatccgtgctttttaacacaaaaattttcatccctaatccatatttaaaatcactagggcgtagaattatatggatataaaatcccaaaatctggccataaaaaattgacaataaaccacgaaaatatggacataaaattgcgaaaatctctaaatatggacataaaatggcaaaaatatggatataaatttttccaaattgaggatgtaatttaatttaatttaatttaattcgcttaatgtaaagtaaaactttcaaaaatggctgaatatataatattaaaaatcaaatttaagaaaaaaacaacaactataaaactcaaatttattcattgctagcgaaaaatcaatctgaaaagtaaaattttcgctaaatttatcaaattttaagaaaatttaaattcattcaatattttcgagaaaattttgctaattatgatctttttgaaaatttttcggtctttggagtcaaaagggccaaattagctgatgagggccgttcaaatagaaatttttggaaaatgccaaaatatggacataaaatatggacttaaatttgccaaaaatagacaaatatggatattgaaaacccatcctagaatcttcaaaccaggttaaaaccatgtttttcgtgcgtttcaggctttcaacagtccaggaaaaaaaatatggaaatttcatataattcaatgccctanagatcacgata

SEQ ID NO: 1699 - DNA, 2324 bp, Heterodera glycines
ccccccccccccccctaaagggagcttaatttcagggggaattctaatctaagaggagggtgtttaattcaaaaaatatttatatatgtgtggtttttctgagttaaacatttaagacgaattaaaaatgaaaaatttatataaatttccaaaaattcagtttttataagtccacttgggttgcaaaaatttttggctatttcataacatccttaattagtgaactgatcatattatgcaaccaacatctgaagttttaaatcctgaatttttttcagaattatctttattatattgattaatatgtatttattcattaaaatcaaattttgtatagtttttatgagtatgaatgataaaaatttaagcttggttagcctgctgaggggataggtaaaatacgtaaaaaaaaaattctggatattaattggaaagatatttacagtatttcacaaacaaaattctatggtatttacactataattacagaatttcttaaacaaattctgtagcatttagtattgttgacaaaaggttaaaaatgtaaattattttgaatgtatacaaaaataattgaactcgcaaaaaagaaaatatactgtaattggatattgtaagtttattcccatatactaaattcacgcttaaaatttcaaaaatcattcatacaatttattatgatcatttttcatgtcaaaaaaaaagatcaaaacttcaaatattctcaaaattaaatttaaacattggtccaaaattggcctcaattttttcaccaacggcaaacaaagtgacgaaaggaaacaataggccgacagaagatggcacgcggtaatcatcatcatcatctaattgaataaaatattttatttttttattaaaaaaaaaataattagggaagcggttcttaggtgctaatgactgccaaaatagtttgatttttctaaaaaaacccactgaaaattggtgttaaaaatgggaaaatttcaaaatttactggatgtaaaagcgtaaaattttatctaaaaagcaaaaaaattaagccaaatcagtattgctgagacaaataatttttaaaggcaaaaattcttgccaagaaaataaataaataaattttgcgacgatttttgagaaaattttcatttctgaggggcatatttttaaaaaaaaattttgtattttaaattttattgcatttttttttgtttataaatttttggcatagcgtcaaaatagagtttttcagcaatttttaggtgtttagttctaaaaataaaaacctagaaaagaggtaggtgctagcttaacaaccactaccaaaaaataaggatgtttttcatgcatttcagcccatagggagctcacgaaaaaatagacaaaaactctaaaaatcgtatcccaaataataatataataattaaattaattaattatccaacccaatatgtgtccatttcttgtgaaaatcatctgccgattgttcagattaatgccgcatccctccacagaaccagcaacaaatttagtgcatggtacaccagagccacttgtccaaagtacgccatcactttggtatccaaaaatgccataggcgtgccgaacatgtccatccaattcgccatgcttctgtttggtggtgaatccgaagaaaacacctcttgaatatttttttaattaattactggaagattattatttgggctgctaattttatgtaacaaaatttgggaattatgtaaataaaatatgtataaaaaatgctaaaatatgtatgaaatatgtacaaaaagccccaaatatgtactaaaatatgtaaataaaattatttaaatggtaattttttgggtaaaaattcttcgtaaaaagtgcaacaggcacaaaatgccataaaaatgaccaaaataggcttaaatcacattttagtacattaaataataatttttgctatctcattaaaaaaaatcgttttttagagatacattttcaaattttattttttatttttcacaaaaaatttctataaattctcaaaatatgaaaaaaatgaaaatgtgtacgaaaaaattgcaattttttttgggacatctaaaaattttccttaaaaaatcctcaaaaattgcaaaatatgtacaaaaaatgcgaaaaagtccaaaatatgtacatatgtaatatgtagaaaaactccgaaatatgcaaaaatatgtaaataaaagtcccaactttttgttcgcaaacacaaaaaagaaagtgtttttcccactaattaggctatggagaagccaggaaaaaaatatgtatttacataaaattagcagccctaattatta

SEQ ID NO: 1700 - DNA, 2867 bp, Heterodera glycines
  misc_feature (1022)..(1022): n is a, c, g, or t
  misc_feature (2013)..(2013): n is a, c, g, or t
gatataattaaaatactaaaacagttaattaaaattactttgcttaaaaacttaaaaaatgataaaaaacagaaatattagcatatttgaaacaaaatgaaatgtttagactaataatatagaaaatgaagctgacttcatacaaggacgaaactcctacggatgagcacatgaaaagaataataaaattattcgaaaaaaagatcattaaattaaatagtccaaactgctacttttaaaaaaggagatccgacttcgagtttatatttgaaaaatcgtaatttatcattaaaatttgataaaataaaataacttataaaataatataagaagtgtcccattattatgtaccaaatttcggcacatttaatcaaatatttttcagcaatctttttatcaaaaacgaaaaaattagccaaatttccaaaattgctaataattattcaatttcacaaagaaattgaaataatatacataagaattaacaccacaagaaaataaaatattgataaaatttttgaacaataaaaaagacaaaaatataagtaacacgcaacgagaccaggggtgcgcgaaacttcgacttcgaaaacttcgaaaacttcgggtttttgagcttcgaattttcgtgcttcggcttcgggtaatttacccgaagtttcgggaacacccctaaagatcgagttttcagtgtgaaaaatgcacccctaattgagtcaaaaaccgtcaatgctttactaatttataaaacttccaaatttctaaatacattttcatcaaaaaaatcatatatttattttattaaaagggttagttgttctctaggtgttctgtcaattggttgaatttgatatttaaccgaaattttgtgatgaaaaaatttttggaattaaaaaaattttttgaaaaacttcggcttcgaaaacttcggggttatttgggcttcgagcttcggacttcgccttcgaataaaaattgggcttcgccttcggcttttgcttcgagtgctaagccgtcttttntacgaaacgcgtcagcacgaatttatttaatataattataaatttttttctgtttttttgtaatctaattgtatattaaaaaaaacgaatcacgaaaataaaacatttgcaaatagctcaaagttttaattttcataaattatgatttctatttaaacgaatatatggtcatattaatttgtcaattttttgtcttctttatcttagttgcttaatttttggaattttaaatttatttaaataatattttaaagtaataaacctttaaaactgtaattatttttacattttaaatgattttttttactggatgtaaaaagttaatatttgtttatatttccatttaaaaaatttgatataattattttttgtattctatcgttttattaattcatacaaaaatattcaacaagtacgctggtgctacatggcaaattgttcatcaatttcgactttggccctgattatttatcttttcctttattgctcttttttcaatagcaattaattttgtgatataatttcaatttttccaaacacactaaatttctttaattctttgatttatataaaaatgattatcttgtagcttttttattttaatatttttcatatttaattgtaaattgttatttgaacttttttaatattcaaaaatattttttgtatctgctcaatgttataaaaaggggtcagaaatacgcctttcaaatccaagtaaattgtgctaggacgactattataattttttttaaatttcacaaaattcacaaaagttgtaagcaaaaagctcgaaaaattttagacttaacaattttgaccctaacttttttgatttaatatttttcaaaatttattttttaaatgaataaaaagtgtgctcagatcaatttgatgtaatgtacattttattcagtacagaaattataattcaaataaacacatttcgaggccggcaatttcactcctttcagtttgataaattgtatanaaatatattagcaattcaatcaataatttgtaattaaaatacaattttaaaaaattaattgaaaaaattataaaaatagcctaatataaataatttttatgattgttgaccaacaattattaattaatacattcatggtcatatgtttatgatcactctttatttgggtaaaagatttatctgatcagtataaaaagtttgattagcatgaattttttcagaatttttggcccacaaataaagtgatcatacacatatgaaatgactatatataattaaaaaatttcttttttttcattctaaataaattaaattaaaaacaaaacaaaaaacaacttaaaaatttatattaaaaaattaaaacattcccgcaccttacttaaaatagcgaaaaaaaatttatttaattgtatttcaaaaatttatgattttaaaaatttgggaaattattataacggaattatttatttatttaaatatatcacagttaattaaaagcatattttttaattacgaatttaaattattctgacatgataaatattacacctctttaaattatttttctattatttatgaaatttcaaatattttatcatttccattctaaaatattttctataagtaaattaaactgataaataacgaaatggcgcggcggcacaggtaacttgttaaacaaataattaatacaagttacactataaaatgtggaaagtaattaaaatgattttgttaaacatttattcattcatcccaattgttcgtttaaaatagtaattatcatttattgcctattttattcattttcattttaattcgtgcattatataaataataataataaatacatt

SEQ ID NO: 1701 - DNA, 6061 bp, Heterodera glycines
  misc_feature (3755)..(3755): n is a, c, g, or t
gcacggcggccattatttcttttgctgtctgtctaacttgaaataagtactatttcttcagttctgaaatttctttggctaatttctagaatgttcaagtgtgttttaaaacagttctggtaatttctgcaataattctggtattttattgattttttataacagttctgaaattattctggttaattctgcgaattctggtttttcatgttctgatttgttataattacacggcggccattatttctttgctgtctgtctaacttgaaataagtactatttcttcagttctgaaattttttggattaatttcagaatgtctagtgtgctttaaaacagttctggtattattggttatttctgcaataattctgatattttattgatttttttaacagttctgaaattaatctggtttattctgcgaattctggtttttcatgttctgatttgttataattacacggcggccattatttcttttgctgtctgtctaacttgaaataaatactatttcttcagttccgaaattttttggattaatttcagaatgttgtagtgtgctttaaaacagttctggtatttttctggtaatttctacaataattctggtattttattgattttttataacagttctgaacccctgcccctgtaccgcaggaggggacacttccccttcatgacatatacttggacaggggcaggggtcctggacccctgaccctgaactaaatggaggaaggccttgcgaaatttatataaatagagcaaaaaaattaaaggataaaaaaaaaagatgtttaacgctccatttactctaattctttctggggccacaggcagtggcaaaacacaatggcttatgaggttgttgagacactatccggaaatgatcgaaccgcctcctaaaaaaatactctattgctattccgaaatgaatcagtcggttgttgatctgatgaaaatgggaatagaaacacataatggggtacctgatcagacactcattcaacatcaaccaaaaccacttttgctcatcctggacgatctaatgttgaacatgaagaacgattttcttgatttactattcacccgagtgtcccataattggaatgtaagtgttattttcgtcacccaaagtctgtacggaagggacattcgaaccgctagggcaaacagccattatatggtgctgacccggaacccttcaggacagctgcaggtaagaactgttggttcacaactttttcctaaacgggtaaattatttcatggaggcttataatgatgcaacaagtcagccattcagttatttggtgataaacatgcaccctaatgcgcaggaaacggaccgtttgacttcaaaaattttccctgacgagcaacgccaaatctacctccccattgattaattttcatgagtagtgtctctatataaaggtgtaattcgcacaaatttggcaaaatgtgttaccaattcaccccatacataagtgaaaattccgagttttttaaacgtttggcctccacaaagtcagatcagcgtaagaacaagctgctcagagaggcgagtgcagaacagatactcggattagtagaaatttgcgcgaacattttgaaatttaattttcgcctaaatacgcgtcaacggcgacgcttaattcaatacgcggactactacagggcaattgctcgttcacgaagtgagagcacggcaagaaagagacttcaagagggaaccggtgttgctctaggcgcaattattgcaccaataatcagtgtgcttgctcaacatttgctggagaaggcagcaacaacaacaactgctgtagcgtcatgaagtacacaaaaaagatgataatggttcccgagagtgaatatctcactttgataaatctgctgaagaggggaacaacaacttctggcccctatgaaagtgagagagctgaactggacacagacatccaaaaaaatttggccgatcataaacgcggagcagatgtgcaaatgaagcgccattcctggctgtataagcaaagacggcagctaaaagatttagcagaaaatagaccccaaaaggtggtcattgaaaacctggcagccataccgcccaatattgctccttatatgggaattcaggctccttccgccaaagctaagttagagacaaaagttaaaaaagcatcggataatgagcagcagaaaacgaattctttttataataggcttactgcagcaggtgatgaacggaaaagaaggagtcgtaaaaggaagttaggcaaaaaaatggtaatgaacactggcgatgagtctgatgccgacaacaatagtggagataatgccgatggctccttttattcttcagcgaaggatgatgagctcgagcagacatcttatcataaaagaaaacgagcaccttctttgttgacacaaatagaccaaacagaccctgaacactatgaagaattgaagaagattgtggaagcaaggctcataaaatatggaattgatgccaaaacgggcgcaattttgaccaatttcaataaaccggtcgccggatcacattacctgaacgcaattaagtacatgacaggccagctgaacaacaagccgaaaggacatagatttttaatccaacgcttgaacagggaaaaagaaattttaaaattcttcccacatctaaaccaatcgcagcagtccggagagggaatcaagagatttagagccaagaagaaaaaattcttagcccttgttcgcatgcaaccccctataaaaacaccgggactacaccgaactgcctatgccgaaaaactacatgcaaaatttcctccaaaacatcaacaacaaaaatttacgtttaagccagcaatatgggcaaaactgtagagaagctactagagcaaatctattatgaccttcgctccccggcaagctacgcaggggttcttaaggtctggcaagaagcaaaaaaacataacaaatcaattggtattagcgatgttcaaaaatttttgcatgatcagcgaacctacactctgtttaaaccgcgtcggaataaatttccgcgcctaaagactattccaagcggtcttcacactgactggcaatgcgatttgtgcataatggatacactgaaagatgaaaacgatgggtatcgttacttattggtttgtattgatgtgcttagtcgacgcatttttaccgccgaatctgagtctaaaaagagtgaacatatgatagaagcgtttgaaaaggtgtttaaaaaggcaaatgttctgcccaataaactgtatagtgatgctgggctagaatttcaagcaaagcgtatgttagactattggaaaaagaaggacattataaagcatgtgatgtattccccacatctgcatgccggtgtggttgaaagggctaaccgtacaatcaaggagcgtctttatcgctactttagtgaaaataatacaactaggtgggtggatgtgattgataaaattgtggaaaatttgaataattctgtaaatcggaccacgggggtgaaaccaagtgcagtgacattcaaaaatgcaccaccactatggcacaggttatataaggaagcggatatgccaattcatcaactacctcttcaattaaacgagcaaaaaataataacacaaaaaatataaactgggcgacactgtgcgcataagcaaggagaaaggagagtttacaaaaggctattatccaaactttactgacgagctattcaaaattgcncaggttaaaccaatcaatcctccctcatatagaattcgcgatttacaagatgaagagattaagggtgtcttttacgaacaggagttggtaaaaaccagtgcgaaggacacaacccaccgggttgaagtgttaaaatcgcggacccgaaaaggagttaaagaacaccttgtccgctggataggcattccgatcagcataacaagtggattcgggacgctgatcatgtaaaagagcgcgaagctaaataaaaaaaatggatgaattttatgtggtactaccatccaattcacctggaccagggaacacgacctcaaaattcactgtcaggcttccacacacgcttgagctggacgcgaactggatggtggcactttcatcaattatctacccctattcattcccatcagtcggaattgacgatgacgacttcatcagcattaaacttgtaaatccaaattttacattcgcggatgacaaacgttttgtggatattgagctaaaaataccgagcatgcaattctctagtgttggccatttaaggaaaacattaaatgacataatcaatgatgcgtataaacaacggtttgggctctcgtcacagagggccaccaaagcgaaacgccaaattgacgttacggagcttttttttcacgatcaccctgttgattattgggaaaaaattgaagagttggaaaaaaggttggttgaattgagagaggagattgcgacgaatgagagggaacatggtgccgaggtacagagcagaaaagaaaaaaggaacttgaaggtgcgttgacaattttaaggcttcgcctcaagagaaaagatgatgagctggaggagcttaagcgggcagcgaagcgtcgcgatgacgacacccctgagaatcagcagaaaaaaatacgggaattcttccatcaccatccggatgatcatgaaaaaaagttgaacgagtctcgactgatcttcacaaaatatttgtccggtttgcaagaaaaaatgagtgaatatatcggtgaaagggatgcagcaaaaattgctaaacttaatgaacagacaggaaagctgagagaaaaaatcaaatacttgctgcgcaatcttaatttgtttgagagcgccgtgctacagcgcggcgacgccaacggtgatgacacttcccgaaaaacaagagaggaatatgaaaaaagcagtcatgaacagaatagcgcatatgttcaagatttttttcaaagacacccgaccaattatttgcaaataattcataacaactatgacggtatccgggaacagttcgacaagatagaagaactccaacaaaaaaggacacagaagcagctaaaggacgacgagcactcatcgttccagcagcaaatcgaccgagcaaaataactgctggaatacagacgtaagagatttgccgcaatggaatttgaggcaaagaaacgtgatgaacagcaacaacagtcctccccgttctcttcaccaatctcagctgcattgaacgccggagaggcgttaaaggagcgattaggtgccgatcaagtgaaggagacagaaaagtcgaatcaggataataataattcgatggacaaaccaaaaacccacgctgaggttctcaaagaaaaaatacagcaacaacaagacataaccacggcgactccaacagaattgcaaaatgacggtgacaaagcggcaacagactcaaaaacccatgctgaggttctaaaggagaagatagagcaaaagaaaggcagcaccagcgcatcggttgaaagggatgatgatcgcagcgatacagtagctttactatcgcgaggtcataaattggtgagtatgatagaaaagagaagggatggtggtgctgaaagtctcgctggctcaacaattacagttgagctgacacatggagaacagttaaagaaaatgttatcgatagcagataaagagcctgttcatgatgtgacgccgaacagtggagaaggtcacacaagaggccagattctcaaagaactgatcgaaaatattgtaaaggaggacaagctgaggccgcctcctcatggttcatccgactcggatcggcaacttacaagaggtgaagctctgaaggagatgattgaaaagaaaaaggatgagcaacagcatcaatattattctgcagccaaaacgagaggagaaatttttaagctgatcttagagcatcataaatataccggagaagctgatgcgagcttcaaaggctttgttgagagcagagtaagggaaactgccgccgaactagatttcatgcgcttgctcacgatttgtgt

SEQ ID NO: 1702 - DNA, 1050 bp, Heterodera glycines
  misc_feature (31)..(31): n is a, c, g, or t
tatgagaaaaaaatgctgcagaaaaataacnctgaaaacttttagagaacattattaaatatgtaaaatcaaaaaatgataggttttgaagacatatttacaattttcatattggcttttttgtagacctttttaggtcatttctagagatttatagttccttttacgtctgattccacgaaaaggtcagcttagtttcgttgtcttcattggtggagtttcttcaggatctgctcagtccccaccacaccaattatcgggttagaaataattcttcatagctaatcattctgttgcattggctttgtttgtcacaaaaaggcctttcaatgtttagattggcccttacatggactccctataagattatggaacttggtaatatgagaaaaaaatgctgcagaaaaataacctgaaaatttaggagaacattattaaatatgtaaaatcaaaaaatgataggttttgaagacatatttacaattttcatattggcttttttgtagaccattttaggtcatttctagagatttatagttccttttacgcctgattccatgaaaaggtcagcttcatttcgttgtcttcattggtggagtttcttcaggatctgctcagtccccaccacaccaattatcgggttagaaataattcttcatagctaatcattggctctgttgcattggctttgtttgtcacaaaaaggcctttcaatgtttagattggcccttacatggactccctataagattatggaacttggtaatatgagaaaaaaatgctgcagaaaaataacctgaaaatttaggagaacattattaaatatgtaaaaaaaaatgataggttttgaagacatatttacaattttcatattggcttttttgtagaccattttaggtcatttctagagatttatagttccttttacgtctgtttccacgaaaaggtcagcttcatttcgttgtcttcattggtggagtttcttcaggatctgctcagtccccacgacaccaagtatcgggttagaaataattcttcatagctaatcat

SEQ ID NO: 1703 - DNA, 1845 bp, Heterodera glycines
  misc_feature (36)..(36): n is a, c, g, or t
  misc_feature (1839)..(1840): n is a, c, g, or t
aaatcaaaaaatgataggttttgaggacatattacnaattttcattattggcttttttgtagaccattttaggtcatttctagagatttatagttctttcacgtctgattccacgaaaaggtcagcttagtttcgttgtcttcattggtggagtttcttcaggatctgctcagtccccaccacaccaattatcgggttagaaataattcttcatagctaatcattggctctgttgcattggctttgtttgtcacaaaaaggcctttcaatgtttagattggcccttacatggactccctataagattatggaacttggtaatatgagaaaaaaatgctgcagaaaaataacctgaaaatttaggagaacattattaaatatgtaaaaaaaaatgataggttttgaagacatatttacaattttcatattggcttttttgtagaccattttaggtcatttctagagatttatagttccttttacgtctgattccacgaaaaggtcagcttcatttcgttgtcttcattggtggagtttcttcaggatctgctcagtccccaccacaccaattatcgggttagaaataattcttcatagctaatcattggctctgttgcattggctttgtttgtcacaaaaaggcctttcaatgtttagattggcccttacatggactccctataagattatggaacttggtaatatgagaaaaaaatgctgcagaaaaataacctgaaaatttaggagaacattattaaatatgtaaaatcaaaaaatgataggttttgaagacatatttacaattttcatattggcttttttgtagaccattttaggtcatttctagagatttatagttccttttacgtctgattccacgaaaaggtcagcttagtttcgttgtcttcattggtggagtttcttcaggatctgctcagtccccaccacaccaattatcgggttagaaataattcttcatagctaatcattggctctgttgcattggctttgtttgtcacaaaaaggcctttcaatgtttagattggcccttacatggactccctataagattatggaacttggtaatatgagaaaaaaatgctgcagaaaaataacctgaaaatttaggagaacattattaaatatgtaaaatcaaaaaatgataggttttgaagacatatttacaattttcatattggcttttttgtagaccattttaggtcatttctagagatttatagttccttttacgtctgattccacgaaaaggtcagcttagtttcgttgtcttcattggtggagtttcttcaggatctgctcagtccccaccacaccaattatcgggttagaaataattcttcatagctaatcattggctctgttgcattggctttgtttgtcacaaaaaggcctttcaatgtttagattggcccttacatggactccctataagattatggaacttggtaatatgagaaaaaaatgctgcagaaaaataacctgaaaatttaggagaacattattaaatatgtaaaatcaaaaaatgataggttttgaagacatatttacaattttcatattggcttttttgtagaccattttaggtcatttctagagatttatagttccttttacgtctgattccacgaaaaggtcagcttagtttcgttgtcttcattggtggagtttcttcaggatctgctcagtccccaccacaccaattatcgggttagaaataattcttcatagctaatcattggctctgttgcattggctttgtttgtcacaaaaaggcctttcaatgtttagattggcccttacatggactccctataagannttatg

SEQ ID NO: 1704 - DNA, 1332 bp, Heterodera glycines
gttagaaataatctttcatagctaatcattggctcggtttcatttggtttgtttgtcacaaaaaggccctttcaatgtttagatggcccttacatggactccctataagattatggacttgggtaatatgagaaaaaaatgctgcagaaaaataacctgaaaatttaggagaacattattaaatatgtaaaatcaaaaaatgataggttttgaagacatatttacaattttcatattggcttttttgtagaccattttaggtaatttctagagatttatagttccttttacgtctgattccacgaaaaggtcagctttatttcgttgttttcattggtggagtttcttcaggatctgcttagtccccaccacaccaattatcgtgttagaaataattcttcatagctaatcattggctctgttgcattggctttgtttgtcacaaaaaggcctttcaatgtttagattggcccttacatggactccctataagattatggaacttggtaatatgagaaaaaaatgctgcagaaaaataacctgaaaatttaggagaacattattaaatatgtaaaatcaaaaaatgataggttttgaagacatatttacaattttgatattggcttttttgtagaccattttaggtaatttctagagatttatagttccttttacgtctgattccacgaaaaggtcagcttcatttcgttgttttcattggtggagcttcttcaggatctgcttagtccccaccacaccaattatcgggttagaaataattcttcatagctaatcattggctcggtttcattggtttgtttgtcacaaaaaggcctttcaatgtttagattggcccttacatggactccctataagattatggaacttggtaatatgagaaaaaaatgctgcagaaaaataacctgaaaatttaggagaacattattaaatatgtaaaatcaaaaaatgataggttttgaagacatatttacaattttgatattggcttttttgtagaccattttaggtcatttctagagatttatagttccttttacgtctgattccacgaaaaggtcagctttatttcgttgttttcattggtggagcttcttcaggatctgcttagtccccaccacaccaattatcgtgttagaaataattcttcatagctaatcattggctctgttgcattggctttgtttgtcacaaaaaggcctttcaatgtttagattggcccttacatggactccctataagattatggaacttggtaatatgagaaaaaaatgctgcagaaaaataacctgaaaatttaggagaacattatta

SEQ ID NO: 1705 - DNA, 5429 bp, Heterodera glycines
  misc_feature (5383)..(5383): n is a, c, g, or t
ataaagaggtaccgaagttggaattaacaaatgctttttaaaatggcaaacccccaaaatatgttgatgatttttgcttaattcaaaattaggcggagaaattaaaaacttaataaactggccctaattaaataatctctatttttggatcagctttagtgaactcctcgcttagaaaagagttaaattcttataaatcaatcgattcgtctcgaggggttaagcaacgccatctgatgacagacaaggagaggttcttgtaccggttcaaaaccaaagaaaatttggtgcaactaatgttaaatttgaaaaaacaattattttgcttattgcgctaaaaaccagcgcactctcgactacggcggccaataggtggggcgagactacgggctccggaagaaatccgcgcgtgatccgcagcaggttcgacttcatccccaattattagacttaacttgtcaagagctttcgaatcatgccaaaattgctgaaaatttttatttaaaatgtttttatggttgattttggttcaatttttcgtgatttaaaccggttaaaaaaccgtttttttattttccgcgcctagggactattattataatgcttagaggtcattagagattgattgcaactagttttaggcggtttttagcggaccaattctatttgtttagaaattatttgcggcaaaaagaagtgtaaataaaaaagtgaagaatttattacattaaaaaaataacagaaaaaaggattcacaaaatatgaattacaaacagtataaaacaaaaaaaggcaggtactgtaattgtgctactatcgactgtattcccaaagtcaaagggcattatttgaacgcgtttgctgccgttctgctgatctattctacggtgtctcagtgctttacgttagtgtatacggtaataaatggtcgtttggcatactgtaactctctctctctctctctcattctctttctctctctctcatttggcgtttcgtcctccccacatttcttcactatgcttcgactttgcttttggaaatggacttcttgtcctcctcctcgtccttcaccagcggaatgccatatcgaatcaattcgcagcccaactcaaacaaatattcgtaacactccaacctgtgcagaatgccaatgtttccaaatttaaataaaaatccaattttaaaaaggcattcccacatcattttggtgcgttgccaagtgttgctgccgaacgcaaaaaagccatggccgcggacaagaacaccactcgcctcggggaacttttgcagaactttcatcagctgaggctgaaaaagcttaatcaacggctaattaagctaacattaaaaaacaatgaaataatgctaacaataaaattaaatttgaatttccaattgaattgaaattggcacggcttacacaaagaacgaattcgctgatttcagtctcgatgatcggcaccacaacagtgtcaatgttttccattctgcgctttgtctgacgattctcaatgccctgaaacctttcaattatgctaatttgactcccttttcatcacttggatcatttcttggcccgaaatcataaacacgtcgccggtgatcagttgcgtgatcaaattggcccattttgtgtgcgtgtgaatgatgcagaccaaatctgaatgaaaagtacgaatttacttttggataggtggacggtgaacttaaacgttggcattttgaatgagaatttgtgccgttctgtttccaacccaccggggttatcgcgcagcaaataaaacggtgccgtcggcgttctgtccgggtctgacgggcgctttacaactgtgccgctggccttcatcacaaaatgctcatttcttgaggagggtttaattaggattaaagcctaagcatttgagatactcggcgaatatctccttggccaacgagttggacgtgttcaaaatcagactttcgcccgtcttccgacagcgaaagcgcgcggccatgccggcgccgttgtcgcgcatccatcccaaggcgtagaagtggcggatcagctgtgccattcgtgccacatttatcggcacattgtcctgaattttaatttgctttcatttctcattttaatcgctttacttaccgaccacccctcgccatcgttgtcctttgccacctttttcgcttcctcttcctcctccttcttctgctgccttcgcacttcgtccttcagtttttcgttggagcacggcgaaatgccacgcaaagctttgaaagtcatttcaattttaattctcttaaataaaaatgaaaaataaaatactaattctctgtttggccttctctttccctctttcttcgtcttaaatacgcctctttcggtgcccttttcttcatttaattaaatttcacaatgtcctctcattttgcactttcttttgcgcttttttagtcctgaaaatgagttcgctttttgctcaagtgcaattttcatgctgcgattggtgcgccgccaccgccaaaaaccaattaggcaaataatttcataaatggtccgttcatttcttcctaatttctgaaggagcaaaagggaatgcggcaaagcaataaatacattggttaattagttaatgaattggtcggttcggagagtgccgagatggactgggccaagaatggctgttgatgatcagtcgcggcgaacaaccaaaaacattggcaacaaaaccattggaggagataaagggacggacggacagacgaagccaaaagcgaaacacgcaaaaaatggggtggccataaatggtaccattttcttggctatttgatttaaactatttattttcatttcaacataaatttaaaaattaattttaactattgaacaacttcggattttcgggctcggccctcggtctgaaatatgcaaaaagggcatctttttatagggcgataaaatggtatcaaaaagttttcgttcattatgattttgatacaatgtttgcatttcttttcttttttaaatttatattctttatttacccagaaaaaatattaaatatcgcaaaaaataaataaatgattgaaaacaaattcgaattttggtcacaaaaaaaagatgaaaagtccaaacgaaaagcataacattttggactaaacttattagtaaattcaacatattttaaattaaattaatcatttttaatgatttcaactcaaattcgagtgtcccgtcccttcccccccattcattggccattcattcctttcccttttcagaaaatcgttcgaaatcccatcgagtaaatttcgaattcgatttgttcttcaatctcttcggtttttaaacagttcgtaatttcatcgtgctcttcatagtcctcgctggtgattgtgttgttcgccacaattccctgctgcattatccgtcccaattgttccaattttttctttaccatttcctttgggtactgtaagtctaccatatccaacgcgttgtgtacaatcataaacacattttgcgtttccttcaacaattcgaacgtatttcgcagttttggcttgccattgaagagtttgtgccgtttcgatatgtgtctctcgaggcccttgtccaattctaaatttgtaatttaatattcaatctcattcgaatttttctaccaattctaaattgtgccatttccgttttcaacatttttccaatgcttttgaattgtgcgcaaatgtccgtttttcgtctttcaaacatttcgttcgcttcctttcgcacgccatcaaacaagcggaccatcagctgcccatttggcacttctgaagtgccaattaatccttggcattgtctttccgtttcattggtagtattcgaaaacacaattaaaaaattagtgccgtaaaatgtggcgccgttcgcttccaaagtgtccgttgctatgtttcgtagcatttcctgcgtggctcccactatcaattcgagcacaattttgaagagtatgaccaattttgccgcttcgtcttcgcttctgtccctttccacttcggccaattggctaattgccttcgtaaatggcattttcccataataactcccgttgctttggcgaatcattgtgccaattctctgttccaaactctttgccaattggtccacccctcccattgggccttcggttgggctgaaattgcgcagcaattgccaaatgtcgttccattcgaccaaattggcgtccatcagtcgctgcacttggcaaacccgcgcctttacgaggccaattccgtgccgtagccttttcccgactctttctccgctctcgctttctccgccgattagaaaattgtcgcagaaatggcaaattttgagcgcgtgttcaagaagcagtgggtctatcagtttggcctctccccgcgcgaactttgcttgtgtgaatttggccaattgctgcgcgatggctttcaaatgtaaaattttattggccatcgcttgcgccgtggcattttccgggaaacgctccaactcaagaatttgatcgcgcataattttcccaaaagtctcaggagggatttcgcgttgcttatctaattaaacggaattaaaaatgttaaccattttttgaaagcttttattgcacttactgttgttggaccgacataatcggccgtaaatgaaggaaaaaattattagaaaattaaaaaagaaattaaaatatttcattttttcaaaaacccttatgagtgaagaatggacggaagtaaagtcactaataaattgctttctttaagaaatggccaaatttgttgaaattttttataaaattggccacgtttccaagcgaaaatttgccaattggaaaaaagcattgattttaatttgttgacaattcaaattatttttagatgaaaatgtataaattatacaaaatatccgttaataaattgcagcaacgcccacacaatgccaatgcttaaaaattccatttcattttgcagttttcctgcgaccccagcagttcaggcgccgcatgtggagaaattttgagaaaatttcgttttttgacatcattaaattaatcgtatagttaaataaattttcttcacaaatgtacatgccaaatgtttgtccccaaaataccgcccgtagtcgcggaacacgcaaagtttgatgcccccccccccctcatttgtatttttaaaaataataataaaaaaaatccctttctaaataaaaaataaataaaaaaaaatttttcaccaaaatttttgtctgctttcgccaaagtcaatttaaaaatataaaagggctatcgttgtccccaaatattttaatgaaaacataatataaaacaatagtttttaatccgtttttatattgtctgtcaatccggaattatttatttgnggtaacacattttaatcctttttttacatttttctcgcgagtcttt

SEQ ID NO: 1706 - DNA, 11202 bp, Heterodera glycines
ttcatttatgaatatctttcggatttcaccccttcggagattccctcccttctccgctgcttctcctccctcattcaattagcctttgcccttaaatgctttgtagagaagtgccgcgccgagtcctgccgcggcaccgcctgccattgccttcagtttggtgccgcgtcgtctccgtctgagcatttttaaaagcatttagcaatttctcatttttaaattcgttttacattttcatgccattcccttcggccggcaccgcacttttgtcgaccaaattcgcctcggggggcccctctctcttttgaattcgtttgactttttcatcggtttggccaacggccaaaagaacaggcgccagcaaaagctgaacaagcagtgccaaatggagaagctgaacgagtcgcatttgagcagagaaaggccaaaaatgaattaacaaatattagcggaattatttaaaacctaaaataataaacatttgaataaaatcaaattaaaaaaacgaaagaaaaattgagataaaacagaagtaaatcaaagtaagtacagtttgtggaaatatttttattacgaattacacatcttcgagaacttaaacgacgaaatcgatggtccttcccttcttcgtcagtctgtgaaatgggccgcgaagttcgttgatcccgtgatcattcattcattcattctccatttatttcattttatttggggttgcgctccaaaatatgatcggacaaacagagcgcatttgataaacaatggacaaaggggagaaaagaaaagggaaaatgggcgggagagaggggcgggtgagtcatcgtcgcccgccgcgacactttcgagactcccgcggagagaaattgggaaatgttttattagtaagaatttggaaataaaaatttacacaacacaaagggaattagatattaataatgaaatgtaaaaatataattattttaaatatttaaaatcaaattatgctttaatttgtgcatttttcgcattttctctccgccgcttccgaatgattaacttcccaaaaacagccacaaaaaaggcaccgatcgcaacaccagcagcaaatgttagcacgtggaaaagtgcgattggcatgggagaaaaaagctaaaaataaaaaacaaatttaaaaaataaaataatttaagaaatataaaaataaaaatgggaagcgatgacagaacgaatgaatgaattctgctgaagcaaaggatgaattcttttgataatgctttctccaaatttgggggatgtattgtcggcactgaaacattttccgattatttggcgaataaacggcgacgaacgaaagaatggataatgaatgagtcattattaatgactcattcattcattgaccaacgaatggacaaatgtgaaaagctaaagaaaaagacaaacgaagtgaaaataattaatttgaaaaagaataaaaattaaaattaaagaatcgctgttggtttgtgtttggtgccgtgccattttattttgcctaaattaacaatttaatttaaaaaaaattattgtttcaaaaattcactccactttttgattatttcttatcagaaaggaatttaattgataaaacgacaatttcttggcctttggcaattgtaaaaaaggcaattaacaaattaacagagtcacttataccatttaattatttaattaatgaacgaagtaaaaacaataaaaaataatttaagaaatgaaattaggctgctatttttcactttacattttaattatttttttttgctgcaatttttgctcaatccgtgccgaagaaataattgtggaaacaatttatggaaaattgaaaggacaaattcacactttggcaaacgaattgggacaaattgacactttctttggcattccttttgcacaagcaaaacgatttgaggttttaagggaaaatgaaaatttcaaaatgaaaaaataaatttaaaaaaaaaagttgatattcattgaaagaagccaatcgcaccaccaaaatgggaaggggtccgatcggcggtcgaccaaccgcccgcctgtgtgccacacgcaaggccaacggaggaaggcatggctgatcagcagccgatcagcgaggactgtctctttttgaatgtcttcgcgccacaccgatcggttatttaattcaaaattaacaataaaaaaaataatttaaattttttgattaaaaaagacgtggcttttgtacttattaagccttctgctgagcagaacaaaacgttccctgtgcttgtggtgatccatggcggtgcttatgaaattggctcttcggcacgttacacaaagtacgaagtgatcggccaacgatttgtgacagacgcaaattcgcggggcattgtttttgtgagcattcagtatcgattgggagtgatgggtcggtagaaaatttaacaattttaaagaaatattttttaaattctgtgtaggatttgccaccaccggagatgaggaacttcccggttgtttgctgaacattttaatcatttttaaattcattttcaaatctgtcatttttaaaggcaatttgggcatttgggaccaaatttcggcacttcaatttgtcaaggacaacatcgcggagtttggcggcgacccgagccgagtcactgtgtttgggtacagtgccggctcgggaagcacggctttgctgagcatttcgccgaaaagccgaggcaaggaaattgaaaagagaaaagcaaaattaaagaagaagggaaagtgccgaatgatttggctaaatgacacccttggcacatttcaaatttaaccatggattggtaaatttcgtccacaggtctcttccagcaagcgattcgcatgagcggcacaccgttttcggtgtccggcagcggcacttttgtggcggaagagaccaaaaagttggccaaagcgatgggatgcgcagcgaatcggacaaagcaatgcctaagcgagaaaagcgtggagcaaattttcgatgggatagacaaaattgtaaaacattccaaacccaccgtattttactctattttattatttttatgggcctgctccgctttcggtttacattgccaagttcagtccacatcgcttggaccgggaactcttcccgcaggattatcccgaaatgatcgccactgcccctcccaagaaaatgattatgggttttgccgaattggactttttgctcttcagtaatcaatcaaaatgcatttaacagcagcagttataaataaattgtttttaggcttaatttcgagcaaaaacaacagcatttccatgttggcacttacggacgaacaaattgccaattacgaccaaaaagcatttgaggcatctgtcagtgaattcgtcgtcaaggaaaaatattttggcaatcagacaaatgaagtcaaagcagaaattgtgcacttttatgtgaacgaatatttgccagcggagacagtcaaagaccaaaaattctttgtgttgctttacacaacggttaattacataattaatcggacggagggaaaatgggggaaatgccaaaaacaaataaaacggaaaaatcaagtgccaactaactgatcagaaaccaacttttttgatcagcatgccgagcaggcattcgaagaatcgagcccaacaaatttgggcatctgatgaaatccaaaagaaagggcgttaaaacattagttttttggggtttcacatggtcgggaaaaaaatcgggtcgtcaaaagccaattattcacggggggagggagcataatgtataatttctttaagttttagttgctttctgatctgatggacgttgtgcctaccttatgggaggcgcaaattcgcctcgcttccaattggccaatttatctgtatgaaaatgtgtactttaacccggcacagttcccaaagcgtgccataatccaaggcaaattaattaaaatttgaaaaaataaaataaatttaaaacatttcagcagcttatcatggctttgatcactctctgattttttatgatgaattcactaaaaagagcgaagaagaccgaaaaatgtccgaatatttggtgacggccatcaaaaactttgtcattaacgggtgggtgttctaatatgataacataaatttaattaagtattttagtgatccgagcaccgaaacaattcgatgggaccaattgacagattttccatctattgaacgcgttgaaaaggttcaacacatgcgaatggaggcaaaaaagacggggatggtggacggaatgaaagccgaactgagaagagcgcgtttctggcgagaattggccaaaaagtacacaaactttgatttagtccgtggcactttcccagaaaaaagtggacagtcggcggcatttgtcccttcggcacaatttgctcaaatattttccattttcgctattgtcgcaatcatttcgctgaacaatggcatttattgataaactaaaatggcgtgcattttgcaaatttaaatcagagagaaaaaatgaaccaattttccaatgggaaagggaagaaataaattaaaaaaccactttttgcctttgcgaggcacttttccaattggtcaaattagagctcgatttttgagaaaaggactaataattgggtagcaaaaatatgtaaatacatattttttcctgtaggttttatacctattgtgcatattaccctttacgaagaattttttccctaaaaaaaccatttaaaaatttatttatatatttggtacataatttacagggctttcaaaaatatgcatgaaaagtggccaattaaaaattttattcctcataatttgatcgattgtttttgcaattgcaaatcaaaatttctcaagattttcgccagcgaagctcatgaagctcactgttgacccactcgcgcatccattcagatttgatttattttttagcataatcaaattttttcctaagggatattcaaatcggaaaatatttgacaaaaatggcaaaataatatgcatttgcatatttttgacagccctgataatttgtttttttttgtgcatattcttacatatttcgggatttttttaaatatttatgtgcgcattttgaccacttattatatatattttttaccagccctaatgactaaaataatcagattaaattacaaaaacagtccagtattttggcaagtttaccaaaaatcgacatttttaattggattataaaaaatgatgcttgaaaacaaatacacccctgacttagaaccccctgaaataaagccaccctttagagtggagttgaaaaatatatacccgggggttctaaattcagtaaatacggtttgattcctttagattggacgcctaaaacgcacttaagcaattctcttttcctctttattttttcttattaagaacagagctcaaaaataaaaattaatttggccagctttcctaatgaggtcttaaatttttaccgaccttttctctttattttgcgctgctaattatcattaaatagttcagtgataatcgtttttcagtcaatgcgccctttggcggatctaaaaataaggaaccaaaagaggcgagtttttgacccccttcgcccgcacaaccgaataaaagttggttttttagggatccgcgcaccaggcggcttgagtggagggtccccccccccccacgggtgagtgattaatttgtagaataaaatttcttttctcattttcagatgattcggaccaggaggagaagcacggacaaaaggaggagaaggccacaaaaagagaggcaaattttcgaaaaaaataagacgactcgatttaaaattttacgcgatgaattttattgaatttttaaaccgcacattcgtcaactttggccgcatatttcactcaccgcaacagactcagcgaaatcaaaggctgcttgctcatgggcgactgagtcgtgatcccagccaaactacgacagcgcatcctcaccacactacatttcacccatcctggaattgtcgaatgaaaaatttggccaaacaatttatgtactggcccaaaattgatctcgacattgataggtgggttagaaattgtgaagagtgtgccttagcagccaaagcgccacccaaagtgccgcttcaaccttggccagcatcaactcaagtctatgaaaggcttcacatggatttcgctggtccatgtgcagatggtaacaaatatctggtagtggtggattcattcagcaaatggccggaaatcattaaaatgaagtcaaccgaacaccttttgatcgaacagtttgtttggttattttcgcggtatggtttcccaaaagaaattgtcacagacaatggccccccattcaaatcgcacgaaattttcacgttttgcagttcgcatggcattcagcaaacattcgcaccaccttttcacccacaaagcaatggccgtgccgaacgattcgtcgacacactgaagaggcaaatgaagaaatgtgcgcgtgacgatccacattgggtacaaaattcactgctcgcgtaccgcaccacgccgaacgcaagtttaaatggtcgtacgcctgccgaattgttcttagggcggcccgttcgaactgttctatcgttaattaaaccaaattcccaaaaacaaaaacagggacccgtgttaaacgagcagaacagcaaaatggcgaaacaattcaacaaacaccatggagcacgaaatcggaacttttccatcggtgacattgtccacttcatcaattatcgcggcccttcaaaaatgtggctgcgagggacaattgtgtcaggaaaaggtgtagtttggcgaattgagtcgccacaattgcatgccgttgtaacccgtcatgcaaaccaaatccagaaattcgatcccattccatacaaggaaaattcggacattgacaatcaggcacaaggcgaacagcaaccggagacaccaaaccgatcacctcgtagagttcggttcgctgacgaacagaacgaaccgctcgaacagatacaaccgattgagccgagacggtccacgcgccaaagaaaagccccacaacagttggacatggacgtgaccaaacccaaatatgattatgtcaaacaggggaagacaaattaaagggggagatgttgggatgttgtcagcaattattattttctctcgctctcttccctttagtcatttctctcttatttttccacactctctctcttgcctgaggcgcataaatagcgaccgttcccttccctttctgtccgtctcccagtattttccaaattcagtccgtttttgccattcagctttctctgtctattttattattatgtttattcgcttctgacttattttattgtgttcaataaatattggtgtttgtgttctcccaaccaaagaacacaacacttgcttatgtgtctagagatagaattcggatcaccggaacaggacgattcattgccgcgtttcattgcccgccgtttctgtataaatgtcatattcgtcgtattcagcgaccccgaaaacactacaatagactcattttcgggcttttatatgcttataaaatttttgacgtttcgtggcttggacactgttgtgatgccactgattgcaattataatacacatcatcccaaaaaacgagattttttgcattttgaggcacttttcccattggtctcaataataaatcactcctccgctgatgagttgggtcggtcattagtcccttcttaattgggctcacatgaccatgagcaaagcatagtgaattacatttcaaatcagcagcaaaaactcattttgtactgctgaacagaggcaaattccattgaaaatggacatggatggcattgattttgttctctcatttttcggcacaacatttttaaaggcggtgaaagaaagtcaaatattttcattacttaattaataatttgtcatttccaattctttttaattatgatttcaatattttttttgttcgtataaattcggtctctaatgaggcccaccattctctgcagattttgcttaattcactcattacatttcacttcaccaaaatgtccgtctcttttcccgaagagattatgccgccatcctcaagtgataacccaaaacaaaatccattcaccggcaacaatttttcgtcaaaatattggcaattgctctctgaacgcaccaaactgccagtttggcgtcacagagacgaattcatttctgcgttggcaacgcaccgatgcattcttttggaggcggagacgggcagtgggaagaccacacaggtggacgacgagagaaaacaaatcccagaaattatttaatgcattttaaaatgtgtgcaatggttcatttaagagtgatgtccaaatccccctcccccacagattccccagtggtgcgtccaatggctccgaacccgcgacccccacaacaaatccatggtctgttgcacccaaccgcggcgattggccaccgtttgcgttgcgcagagagtggcggaagaaatggacgttatggtgaaaaaacacaaaaaatattatataaatattataaatagtataacatttgtaacattttgtttcagttgggcgaggaggtgggctattccattcgttttgaagaggccctggccacagcacacttttgaagtgggtattttcacaaaagtattaatgattgaattataattcaattattagttttattttatttgctaaataatacatcataatttagcttaaacttagtcaaattaattaaatttggtattgaaggaagttcttcgtaccctctactatataataactttttgaaataaaatttacaaaaagttgtttaagctaaattatgttgtattatttttaaacaaaataaaaataattattattttaaatatttctatcagtcacccttctcaggtattgcaccgacggaatgcttttggccgagtcgtcccgtgacgaattgctgaagagttacggcgtcattctgctggacgaagtgcacgaacggacgatgatcaccgacgtggtcatgggactcatcaaagtcagtttgccggatccaataatttgttgtgccaaaattgccagattaatttttgagattcttttccatttcgtttctcccttttctcgaccttttcaccatctccttccgttcgctaattatgccttttttagcgtatttccgaatttcgtcccgaattgcgtgtcgttgtgatgagtgcgacactgaaaaccggcaacttcgagcagtacttttacgggtgccatctcatgaaaatcagaggccggtcttaccccgtcgacataattgtaacaattgctgcgctttcccattttggtccattcattaagtaattgaaatgtccgtttagcattcagaaatcaacgcagtgatcgacggcgacaattacatcacaaaatccgtctccaaagccatcgaaattctccaaaagacggaaaggggcgacatattaatatttctttcgggattagaggtgcaaaaaacaacaaaaaataaacgaaaatggccatttaggacattgaaaaatgctgtgaaatggtggaaaatgaggcagagaaatgcggcggaagtggccgattggtaattcacagggaaattgggcgaaagttcaattagaatatatttatttttgttttcgattgtgattcctctctatggctcaatgcaaaacgaacaacaacaaattctgatggaaacacagcaaaaagacggtgggagagagtgaagatttggagagtgaagggggggggggcgattgaagaggtccgattgccgacagattttacattaatagtaaggctcaattttatgggtttatatgtgactgtaaatgccgacaatccgctgggagaatttcttaaagtattgtgatccaacggaatgaatcagccaatgtctcaatttaaacgacaattttccacatttaaacaaattccaatcgaaaaacaccgtttttcacaaatgtttaaggccctcgtcggtgtattgtggccacaaatgttgccgagacttccatggtaattctctttcgcgggaatgtccgaatttaccgctttcccgcgtcagaccatcgatggcgttgtgttcgtcatcgactcgggcttctgcaagcgcaaaatgtacaatgcgcggtccaagttggagtctctgctcgtccagcgcatttcgcgcgcctccgccacccaaagggcggggagggcgggccgaacgcaacccggcaaatgctttcggctgtacacggagcaatgctttagggaaacgatgaaggaaattgtgccggaggtgaaattgccgtgatttttgggggtttaatttgtgcctttctttgctcagataaaacacaccaatttggacagtgtgattctccgactcaaaaagtgcggcatcgacgacatttaccaattccatctgatcgacgcgccttcgcccgactccattcaccactccatccgacttttgacagacctcggagcattggaccgtaagtttaaggaaatagagaaatatttattgtccccacaaagattacccaaaaacggtgtgaatgaaatttaattaataaaattaagaaacagttataaaaaatgattgttccgcaggaattctacaatcgacagaaaattcgtctttgagccgctcaacccgacgaaattttatattttttgctaagttcacatttgataacgttggacaaagcgttttaatcactttttgaacaaatttaaaatcagaattatataaaatataaaataagcttcgtttaacaaagcagctagtcctatgagaattcttcccctgaacggggttaacacttcctctgaccttttaaaacggtcaaacccgaacatatttggtatcgttcgggtgctcttgatgagctatgtctataaattcgagaataaagtcgaacaacgccgtttgagcaccaattaactcgatgggcttttccaaattaaaaccgtttcaaattatgatgatgttctctaataattacatttgtctctcaatgtgtcagatttgggccgtatcactccgttgggtgaacacattaacattttgccggtcgacccgccgttggcccgaatgatgttggagtcggtcaaattgcgctgtaccaaagaggtgatttgcatttgcgcaatgctttccgcgccgaa

SEQ ID NO: 1707 - DNA, 616 bp, Heterodera glycines
cgcaagtgcggacaaaaccgtgaagatttggagcaccgttgacgggaaattggagaagactatccaaggcatgagtttttgagtttttcttgcattaatgtgatctgttcccataaattttccgggtgatgggggggggaggggggaacgttatgacccggtccatcggtccgataggcgactcctaggaaaatttttggaatttttaatgcattttgttaatttatctttaaggaaaatcactgcttctttttattctacatttgtttaggtcataaattgggaatcagcgacgtttgttggtcgtacgacaaccgaatgattgtcagttgttctgatgacaaaacattgaagttgttcgatgtgcaacaggtcttttggtgtaaatcagagttgccgagttaaatatcgggtttttaatttccggtttcttgtttaacaaagaattcatatgaaaatgggttttggcagctgtgtcagaatttatactactaaaaaattaatccatttttcataagaattacagggaaaaacattgaaaactttccgtggtcatcggaattatgtattctgttgcaatttcaaccctcaatcgactcttttggtctctggctca

SEQ ID NO: 1708 - DNA, 1192 bp, Heterodera glycines
cctggattttcctggacaaaattttagaatttattattccaagtgaccgatgttttttaatttttcaaaaaaagattaaattaatttaaaaatacattattattattatcagatatttttaggtgtttctaagaattaattaattttttcaaacatttttttgatttttaagatgagttccaaaaaatccaggtccaggcctggatccaggtctcgaggagcctggagttttcctggacctggatttttgtccaggaaatcaaggtccaggtccaacatgtagtccaggtccaggcttttttcaaaatatcgagctctattagtaattttagttttgtatgaataactaattgccagtactttattataattgcatgtcgttgttcagctcagacttttttccctttcttttcgcccattgccgctgcaaaggccgcttcgatcgctttttcgtaatttacaccgggcacaaaaaagtcagggaaaagttcagccgctgaattttaacgaatattttcaagactaagttttgttttagaaaactgtaattacccaatggaaattgacttactcggatcgttggcgtattgcgaaaagtctttgactccgacttcctttagcacttcttcgtcaattgcgaaatttcccgtgtaatcgcgcgagtttttggaaagaatcacataagccgcgtcggcaataatttcaggcttaaacaaaagcattttaacaatcctatcaatatatgccattgttttcaaaacgacacttaaaaaccggcttttcggctaacataaaattaaaaacacgaattaattggtatttttatattttaaatttggggggggggggaaccaaagggaggacccttttgaaagggaattatttcttacccaattttcggtttcatcattttttttgtcgcatcagtttgcttccccctcctttcgctcacttttctcgaattgcgctgccctctgcccgaagtgagcatttgtgtggctgccgtccaaatggtcgtccgtggccaaagtgcgttcactgcgatgccatctttgcggaactcttcgtgcattcccaacacacacattgacatgccgtacttggacatggtatacgcttaattggcctttggcgacagaatggcacaacggatgactcaccgacgtgaggagcgaaccattgtttatccatc

SEQ ID NO: 1709 - DNA, 2322 bp, Heterodera glycines
taaataaaatatgtataaaaagccaaaatgtgtatgactcacaaggaaatccagaaatgtgtacgaaaatatttaaatactttttgaaatggttatttttggaaaaaaattcctcgtaaaggtttcagagcatggagaatccaagaagcaaaaaaaacaatccctataattaggacctttttatagcatttttttgcttattcacaactttctaatatttttgattaaaaaaataaacaatttaaaaattttattttcatattttggttttacatttttcttacatgttatttacatattttgtcactttttgtgcatatttttgacattcctaatatgttagttattttttatttaacaaaaaaattttcacatttttatttctatattcaaaagtgattaaaaaaagagaaatcttttaaatttggtcgctattaaattttcagaatggaattttgagtaaaatatttcattagaaagcaatgttgaaaaattgaaggctcgcttcgtagggggtgcatttttaaaagtttttatcgaaatatgcaaaaatgtgtccccaaaccccaaaccaaccgtcataattggccattaacgcgaccactgagtctctgccgctcaaattgcctttttgagatattttttcgacttcaacgaccaaaaagcgtaaataggcgaccaggaaaaaggagctttcggcctcaatggaaagctttgcccactgattgatgaaatcgatgacaattttttggcgtttgtcggccgagtgatagtcaatgccttccccaccgttctgtgccgattgtccctcgtcattattgccatttgcgttgctcaattcttccgctttgtatttgcgcattgtttgcgccgccacaaagttagcattgttatttgtatcagtattattattgttattgttaacggagggaattggtttctaaaaagtgcgcaaataaatatgatgactaaggctgggatttttaagcacaaaaatcgcaaaacaggcactaaagattgccgttaaaaaattgaccaaaattataaactgattttgtgtattggcgcaaatgggactgggtcgttttggcgccgacgttttggcgccagcatcagtttttttattataactttttttcttgttgaccaaatctaacaatcttggtatcattcgaaagcccttcacaagctctattagccttacaaaaaacaaacaaaaattttagcttctaaaaaaagttattaagaaaaaacttgaaaaatttcgacttttttgcaatttcatgatataacttttttggtaattgtctaatcgcgaagcaatagcttagaaatatcttctaaacatgttaagctttcgattgataccaagattgctggatttggttaacaacaaaaaaaagttataccccaaaaacttgggctggcgccaaaaccgtcggggccaaaaaaaaaaaacggggcctttgagtgtcatcccattatacggtttaattactaaacattccgctaatcccccccccaaaaaaaatggcactttttcaatttcctccgctgcactgtaaattgtccctggcaactttgggttgccctgagttgtcttcgcgcaaatgactatattcgcgccgtctttggccaatttaagtgcaatttccttgccaatgccacgcgatgcccccgttatgacaaaagttttgccgagaaattttctaaacatgaaattattttgtttcataacagcaagggaatgaccaaccccgtgttgagcatgactaatgggactcagaaaggtgttgacaaatgaaaaacaagtgcttttaaaagtaaataaatatgtaaaaaacaatttaactgtaaaaaattaatttattagtttattatcactgattaggtacttaacatcatatcattgataagttattcaattgtttacgaatcaaaaaataaataaacaaaaatgtgttacataggatattgattgtttgttttcgtataatttcaatttgtcggttgcatcactttggcaatttcaacctcctcttttgtaatgtccaaaaatgacaaaataaatgcatcaaactttgctaaaaaattcattgtcagatgaattaggtaattaagcaagagcaaataagcgagaatggttaatatgaaacgaatgggttaaggaaattgattgtacagctcgagggataccaacaggagctcaacgacatccgagtcaaggctgacgccgtggtcaaagagaaggaagtgttggagtatcagctgaccggccagaaaaggaggggaagcaaacaacgggtgagtgaatcgcggaaa

SEQ ID NO: 1710 - DNA, 3011 bp, Heterodera glycines
ctgcatttctgttataacttttttggtaattgtctaatctcgaagcaatagcttagaaatatcttctaaacatgttaagctttcgattgataccaagattgctggatttggttagcaacaaaaaaagttatagtccgaaaacgccaaaacgtcggcgccaaaacgataagaacccggcgcaaatgtccgagccgaaaaaggctggacacgaggccaaaataatttttgcaagattgagacacaccaacccctttagaattgagtggaagtatctgaagttgaacaattctgagtggatcgtcatcgtcaattttttgccgtttttctcctcggccaaaccataatttactgagccaatctgccgagctgaaaatgttacaccaaatgccatcattagccgcattttctgtcaataaattgtgccgtaattcaaattggccattcgcatcggagcgggccatgtaaaaatgcttaaaacatttggccaactgatcagtcgcattcaacacattggtgaagaaatgcagcttttccacgcttttggttggcagcacaaatttttgttggcattcattgtcctcttcattcaaaatgccgtcccaggcaatcacggcatatcggccaggcggagaaatctgatttaggcgatgataaaaatatttaatttcaaaaaaaaatttacctgcttctgagagaaattattttaatgtttacaattaaccataaacaatttttatacaatatatttgttcgaataaccctatctttttggtatcattcgaaagcacaaagtctaaagcagctaagctatataaaatctcagcgtttaggcaattgccaaaatattataattaagtaattgttggaaattttcgtttgtaactttctttaagtgttagcattttctcgttttcacaaattattaatttgtactttgtgtttcgaaaaaaccaaaaaatagggtttattcgaacatgaagaaatgttgcgtaaaaaaaccatgaattgttaattgagtggactcataaagaagtgcattagaaccattcctagaataggaacgataccaagaatgttagattgggtttttaagaatgtttaggattttttttaaattttatttccctttgggatttaggaaaagttgcggaattgaagaaacgaccaagcacaacttatccatttttaagaggaatggaacgccaaatttcatcgaattctcgggcgttttcttttaaaattttaagcattttttgtgtcgatattttcgcttttacactgtcaaacaattaggtaattcactctgtgctttacggtaattaccgtcgctcggtatcgtatcttttcgcctccgttttgctggtgttcctcaaaagtagtaccgtttgaatttgggcagttgttgttgctggaagaagctgtcatggggttgttttgtttgtgctgaaattcagcaaacctttcaaaaatggcatcaaaattaaacaaaatattctccggttctttcttggcgaaacagaacgccaaaaacgggagcataaaaaggccaacaaaaaaagggaaacgcatttattttattactgtcgtagaataaaaaggaaaagattattactaattacacctaaaaaacagtgaaaagtaattatggcattttttcaacagtttaattttaatgagaatggacgaaagacaacatttttagccggaaatagattgttttgacgtttttaacgttaatatccataaatgtaaaaaatatttttttaatttcataaataaaatatttacgaatatgtttttttaactatttcaatattttgagaatatttcggcaattttaacaaaaatacaataaaacataaatttaacgaaaaccatttcccaaatcgcacccaattgtccccttttacaaatatggcctttggggttttttcgtaaatatttatttaaatgtttcggaatttttcataaatatttataaatctcagcttcagtgataagcaaataaaaattgccgaataaattaatttaagaataattacaactgaataattcatttttatttttgcgaaaaataatattcattttaatatgccataaaatcaatttttctattgattgcttttttatatatataaaaaaagttatctacgagaatgaagcgtgcaaaccaattacatgttcgctgaaaaataaggctaatatacaaggattcctttttatgtaagaaaaaaagcaaatatgtaaataaaaaatgtaaaaactatgtatgaattatgtacaaaaacccaggaatatgtacgaaacaaaattttaaaatggttattttttggaaaaaaattattcataaagggtgaaacaggcacaaaatgcataaaaatgacctaactaggcctagaacgaattaaagttcaatataaaaaatgaaaatatgtacgaaatattgcgaaagtttggatttttgtcgtgctgctgttgatgttgcggcggccgaactggcgatggcgtaccctccgatggagtgtagatgacaagatgtttacgctgctgttgttttggcgcaggagtacgatgtccttgttgcggtggccccaacgggtgctgatgcaaagttgcgtttggcgatggtggtgcaacaggagtgtctggttgctgacccacaagcggcgactgcaccaacggtctttgctgacgcagtagcggagaaggtgtatcaaagttcagcctgtcgtcacgcctgtggtgttgttgtgccggcggtgactgctgacgcaaaacgatgttcggcgccggaggagcgtcttgttgttccggtggcgctataattgttatgataaaagttctatgtatgacccttggtgtccaaacacaacccaaaaccaggtggggccatttagcacacaaataggcaagtgtacattattgtaacatgtactcgtttctcgtcttataacaatgcttacactaggctatatttctgctaaactgtcttctttctcgcctatgtatct

SEQ ID NO: 1711 - DNA, 3362 bp, Heterodera glycines
gagttctgttctcatttccacttcctcaatccgtctgcgcagttggtccgcaaagtcaccagccttttgcgcaaaagcgtcgaatgctgacgcaatttcatctgtcggctgttggccgatgatggcctcacgatcagcaggtccaaacaaaggctaaatttattagtcaaaactgaagacataaaaaattgctaacatcttgcaatgcctttgcaagagtgacaggttggtcgtccgcgttgagtccaggctgttctggtggcacatacccgtccttgtcggcaggaatgggtgggcagtcctcgattgggtagtaaactccacgggtggcgtaccacgcggctgacgccaaccgtgcggtcgacgatcccaagaagtttgcgcggaagcggccagcgatggttgctgctttttggaattggtgatcggtgcctcggccgtaggctttacatgaaatttattgattagcctgtgtgtacgcatgctcatatgtaaaaattcttccaacttagtaagtttcaagcgtagtgtaactatttgttacacatagggcaaaatcaatcacatgtaaggaatccttacataataggaaaacttgcgacatatcaatagaacactaatttagagcttgtaaagttgcttatataccttgtttgatgtaaggattgtcgaaggcttttgcaggaggccatttcaccatttcaaggcttttcaacttgaacgcgatgtccttcttttgcgcattccttttgaggcgtccacaagcttttaccagtgcagctacttctccttccagctgctgacgcctttgctcaacctcaagacgttgatcttgctttcccttgcaccaaatggccacatgtttgatgattgtgttgcgattttgattagagagctttgtttattggccatgccaattcaattgattttccattgcccgaccgtccgctgcccgacaaaattcgctttcgtctccttcatattttgtaaattcaaatattctatgtacaaaaaaaacaacaatttatttgtcactttcaggtacattgactattttgtgctcgcttttctccgtgccaattagcaaatttttgacaaaattggcaccgaattgtatttgttggtttctctttcacctgacattgttgcccagccgatttgggatgtttttgtccgtgaaatttggcccattttcgtgacaaacgtccgccaattggactttcccgacggggaacatttggacaatttgcgtcgccacacttcgccgacaattctcactgatctcaaccagttgacttcaatacaatctggtgaccccgatgggaatgatgatccaaatgcaattccaactgctggccaagcgctgtccaaatggttgcacactccgacaaaagatggccaacccaagcgattgatatatagaaattacggatcagaaaacatctacgaatggatcgacaatttcaaagcggtcaacgggactaatcatttttatgatttaaattaaaatatttggattaattgtcatttgatttcgattcccaattgtttagccatttctccgtgccaccacttctgcctgctacaaaattcaacttgaactttttgatttaatggaatttgagccatttgaattggtgaacgaacggactaaagaaatgctgatactggagaaagaagccgattatgaacaattcattagtggtgattggctgttgaaacgatgccaaattggggagacggcggcgattcagtgggagtataaaagtcggcacaatttgaactatgtcaacttttggctttttaaggattgcattgggtgagtttgatgggagaaacagtttttgctttgataatcaaatttaaatcacacttcctcaagaccgttatctccaccaaaggcgagtcaactgaatgcaaaaagtgatctgaaaatgattctcgggcccagcgaaagaaaaagtgaatgaattagtgggaaatgacaaatgatcgatcattatgaatggaaagtgatcggataattgctcctcacatttatttgttgcttctttcgttcgaatagagttaatgttcgggtttttttccagcagttgtgggtttaaaagatgattctcaaatgatgggttgccgacttttgagtaggcgcgcatgccggtggggtcgacaggcccaattttaaaaatttagaaaaccctggtattattttcataaaaaaaattaaaaaaacctcaaacaatttccaaaaatttattttaccatttaaatgactacgataaaacacacacactcatgcgctgagataaatacataaaacaacacttatttacagtatgagacaccatgcaaaccgataatacagtacccatacactacagtgtataagaatagggcggaaaaagtttaatatttttgcgaaaaacggctaaaattttgtaaaatacaccctctaattcgggatttcaaaaaacgaaaaatatacccataaaaatcgaatttttcgttaaaattctgaaaaattttcctcggcggcgcttatcggcactgcccgcccccaaaactccaaattatttttaaatattaactccaaatcttagtcatttttagacaaaatcttatagcaaattgcataaaattttcaaaaatttttccggcggcgccgcctgacaacccccttatcttccccagttttttggaaaaagcacaccgcgaaataagctgttttaaaaatcaaaaaaatgatcgtcaattaacatagctgggacgggaccccttcacaaatcattcccaaaatcaatcctcaaaattcaaaaagaatgaatttttacgtcacaaattataatttatttgcctttcggcaccgccaaaccaggacaatctttttaattttgttttaaaatggcttctaaaagggtgagatattgataattaatgcaaaaattttgaaatttgcgaccacagctctgaatctgccatttttacccctatttttcattagccctaattaatttgcaattaattgcccattctaaacggaacatgacaaaagattagtctgtgccccaatgccgattaatccactaggtttttatgatggcattattgacgaaaattcattttcttagttagaggtcattgcaaatggcacagtcacagattatcaaacgaattgtggtccccctgattaacttaagctgaaatagcacctataatttattaaatgagtaaacaaaaaaaacggttgacaaatatctgactttaatttaacgaagaaaagccatgttgttaaagttatgcttaacaaattcttccgttaggctaaattattattttaatgggatcgcccgtcaaaaatttgaaaa

SEQ ID NO: 1712 - DNA, 1705 bp, Heterodera glycines
  misc_feature (1671)..(1671): n is a, c, g, or t
aaaaagttttctcaacttagcctgtcaacaagtcctaatattaattttttaatttgctgttttattaatttgcaaattgaattagagcttaatttgcaacataaaaatatctctttcagggtttttgtatccttgatcagatcatcactctttcatagtgatctggaatgtcaaaagcgacttgaaaccgggaaaattattgaaaaaaattcatagggggctgcgaaaatttttctggaaattttgtatagggctgccagaaagacgacaaaactctaccgaattgcgttttgagtggtaggggcaacgacttgtaaacaaaaaattatgattggttgaatttgatgattataaaaatcactactttataccgtagtaattcaaatggagaaaacataacaacaaattatcgatattttaagtctgagttgcttccttagaacaaaacattgttcttttcaattttgaagattaaaattttaataaatttccattttacaatgttaaacttcgcattaaattaaatttcaaaatttatttctttgtcattttaatggaattttcagaatttttactttggaccggtttttacaatatatacaaggaataataattatatgaaaatattataattattaattcaaacaattctattaaaaactgaattttactatcaatttaaaaaagaaatataaagtgaaaacataaaacaaataacaaacagtcagtattcgaaaaggttgagtaagtttcgagaaactattaaaaaagcgaatttaattagacgagttggtttcacacaatggtgatacaaattaaataaatttaaaataacaaagtaaatacagttttaaatgcagtatatcaatattacaatattaaatctggtcttatgcttatataatatctatttcaagaacccgagtatactttttcatactatttgctaaagcatggaataataaaaaaaaagttaaaaatttaataaatataaaaaagtaatcattgattaatattttcaattttgttcaatgaggataaaaaaatatagaaagaaaattgaaaaaaacatcccctaatatcaactttcttgttattacaacttattttttcaaattttgtaattgctaatgtattcaacacgcccaacatcagtgatgtcgacgagttaatttagataacaaaaaataattttcataaaaataatgaaaaatactattaagggaatgcaacagcatgacaaacaaattattattaattacttacattaatatatcgaaaatgatgagaatttattttcatcttcacaataatccctaaaagcaaaaatttttggtaaattttaaaataaacaaaaaaaaatttttgtagactgaataaaaagatttcatataatcacaaaacaattctcaaaatgctaacaacaaaagtgttaatttacaaaaaattgacaaaacccccaaaatattaaaaaaaaatttggcaaataagttaaaaattgtgtgctgtcaaactggatagaacctaagacaataaaaaaatgaattttagtgatagtgtaattttaaataaaattaaatggaaaatataaataattaaaatatgaaatataaaaataattaaacaataaagtaatttttacaatgattataaataagtattataattccnaactaaaaattataaaaccaaatatgagaaaatc

SEQ ID NO: 1713 - DNA, 6481 bp, Heterodera glycines
gagtagtattgggacagaaatcttggcccccccctgggcagagagatgcgcattcactataggagagaggagagaaacagagaaaaagagtaatttctaaaagaaggaaaaacgattaaattgtaaagggacagcggcaactctaaagccccagcctaatggtattctcgagtacgcttcgcaccactgcgcgagttccagccgttttttttgtgtccccagttaatagatatcaacggaaattatcgatttgtaaatgcaacaataatcgaaaaaataaaaatttttttcaagaaaaatgatttggaataaaccccctcggttgttttgtccaacataatttttagtgcgggaaataaatgactatgaaaatgcgcgaaataatgattttgtattaataattttttttcgcaaataatttttaaacacgaaatattagaaataattttattgggatattttttttagttctgtaataaaaatttttttctcacatatccgttttttcatgtgatgaataaacaattaaaaggctagtatttttgcctctccctctaaataataaaccatttgggaactgtacagataaaaaaactttattgggaatttaacagaaaaattattatttaaattagaaaagataattcatatattttaaaagtggaacataaaaaaaatcgaagagagtgcgcgaaaaaaatgctaaacaaaatttatatgaaaaatgctcggatttttttagtttttagagcgggaaataaaattatttaatttttaaaaccttgatgactacagataatttttaaaaaaagttgtggggaatggaagatataatatgataaaaaatgtaaaatccgcgcggatagggggaggtggtgcgctgccatcgtctttttggagatggtccctttaatcctccacatggaaattgattggaaatatttaattttaaaaaaattgaaatttaaggacagaatcaaaagtaatgaaaaataattaaaaattaaggaatataataaatataaaaaaattgaatttataaaatcttataagaaaagagaaaataacaataattcgaaataattgtttaaatagtttaattagattgaatatttgaaagattgttgtgttcggaacacattatttttgcagttattattttactttaatttttttaatttgaacgtgaataatgatatatttaaaataataagtattagcacgtaatttacaaccatttgtgctactaaatttcaaatttactttatttagagttttttaaggaattaagattttttttaaattttaatccctcctatatagactataaaatatttcatttaattgcgatgtaaattatagtgtgtataatatatttcataagccttatttattttggactgccccctacggtggggtgtaaagaatatttctcgctgagaaaataacaataattcgaaataaatgtttaaatatttttaatgagaatgtgagaaaaaataaatatttggaaaataggtatgaattttcggaaaactgttttattttcaaccatctgtttcaggattccaaactttgttctcatttcctccaaagatttgtcctcttttcgaggcctaaaaatcaaaaaaaatttttggaaaggaatctcaccaataaaatattgatcacctcaaatgaattagtgaaaaaattgaaaatggaaaaattcgataactaaatgacaaactgacagcgcacaatttttgggcaaaagcaactgaagtgaagagcttttatctccgttttaaatcaggctaagaaaaaaaagttttgcggtaatgaaaataaatgaattacaaaaaaaatgaaaaataatggaaaacagacagggatttttagggggttgagttaactgaaaaaacaatttttttgtattcaaaattcaaatttggcgcgctaaatgacccacttatttccccaaatcctgccagtgctgactcagctgtcatttataaaatgattgatggccaaaaatgctcattttggacctaaaaaatgacacgtgactggtcatgtgaccgaattatttcgtaatgcaatgcaccgcgctgaaaatgagtcagctgtcaaggaaaaatgccccaactgtcaatgaaatatgcggacaacagctggaccccgtccatcccgtgccaggcgttccgcctatcacattagccctccgaggccgctataaaagccacaattgcgcaaaaaaattttcttttttcgagaaaaaatattgctttggaaaatatttcgcaaattgaattttaattcaaatttaccaataaaatatttattttatatacaaaaaaaagtccaataaaaaaaaacaaaaaatgtctcaggcgcaaaaaaaattcctgaccatccccgttgaaaaaagaaaagaaagaaatgtaaaaaattatttcaaaaaaaatattaatgaaataaatttaaatgaaaataattacgttgagatttcgtcaactgaaaaaaacatgcctgactatgggatatatgaaaatacgataagatttatatttaaaaatccaaaaaaagaaaatagaaaagaaacatcggaaaattttaaaaaaataattgaaaatttgattaaaaaagccacattaaaaaagagaaaggggtggaaaattcagagaatctctattgatttatattgtgaactgcttaatgaccctatcatattgccggcccgggaccccaaaatcaacaacgccgacactgtactgcatgaaatatttcgaatcaaccaatcctataatgaatttgacttgttgcacgagcctatttcgtgtattataaccagttatagcaccccgatagggacaggtaaaaatgaataaatttaaaaatttaaaataaatttaggttttaacccgctggatttttgtgaaattaaagaactaggtagaattactgttaaaaattcggattgtttttgtaagtcaaattaaaatattattttttcaatcaaaaatttttaggtttattttactccttaattttgagcaaattttaccagttaatcaacaaagatgatgaggaaagtatctcaatggatcaatttcgaaaaattattaagaatgaaacaaggcaatgggaaacaacaaaacaattaattatggatgctaaaatcaatatgaacggaaatatatatgggcttaagcatttgcaaattattcaggatttttgggtaagtaaaacttaaaattttaaggattaatgagaaattaatttaattaggactctaaatttccgggaaaataccggattgttgctttttcaagggatgttggattgcgtccgatttttaaagggaatggcccacgtaaatataacgtttgcatttttcacgaaaataatcactgggatggttagttttaaaactgtttttttttgtaagaaaaaaaatttattaaggaataaaaagtataggacaattttttcaaattaaaaataaatattgtattagctgtgaaaaaacatatcaaagagaagaaaaacatagcttggaatgcgaggaaaggtgtaaaaaatgttgtagaataggtaatttattagcgtaaattttattataacacttaattaaggatttgggtttccttgtcccccggaacggaggacatttaattgtgataaatgtaatagaaccttttttaatgagaattgttttgagtaccataaaaagaaaatatgcatactgtaccaaaaatgtacaaaatgccaaggagaatttaggacagatacaaaacatatttgcggtaggttttataaacattaaaatgtcttaaataaattttttttagaccaaaaacattgtagaaaatgccgcttgtttcatgaccctaaaaaattatgttttatgcaaaaattgaaaattaaaaaaatgactccttatagaatagtggcatacgacttggaatgcacggtaattaaagattttttttgcaacaaattacggtttcttatttagacgaacactgttttggatgaaaaatcattgaaaaaagagactattcataagcccgattttattagcgcccgatttacttgttcaatatgtttgggagaaattaaaaattgtgaaatttgcggtgatggcccacggcatttaaaagggtgtagtaaggatggagttgacccgttaaactgttttgttaaatggattattagttttgaaaaatatgaaacgtatgcgtatgcacattttagcggtaaggattaacaaataatttaaaaaagctaaaattttatttagggcgttatgattcacattttgttttgagggaacttgctaatttgggatataaacagccggaattaacgatagcggatttaaaaatttacgaattaaaatttaaaagaggggaaaaattcccgaaaattcattttcgggacagttggcttttaatgcagaataaattagctcatttaccaaaaacatttggattggattgtgaatcaaaaatgtactttccccaccaatttaacaaagaagaaaattacggtaaaaaaaatacaaaaataatagaaatataaatttttaggcataattttgagtaccctccctccttttgaggattatttccccgatgaaatgagcgaagaagaatatgagaaatttaaaaaatggtattatgcaaattatcataatgggtttatattaggtaaaaaaactttttgaagaccataaaattggaaaattttttagaagaaaaattggatgaatattgctcaaacgatacggatattttaatgaacgctctattaaaactgagaaaaatatttattgaaataacaaaagatgaggaaacaccaaatgggatagatgtaatgagattatcgacaacgattgcatcttcgtgcatgaagtaagttttaaaaaaatgaaaataaataagtaattttttttagcatttttcgtgccaaatttttaaaaaatagtgagaccttacccatcattcctgagagtggctttgaaccaaaagacagccagagcaatattgcgattaaatattttgaatggattatgcatcgggacggagttaaagggaggcacgccgcaaatgggggagaaatatcgcttttgggcgacaaaaaattaaaaatcgattgcataattggggcgcaaaagagaataattgaatttcaggtaataatggaaatgaaataaatattaaaaaaatttaagggttgcgcttttcatgggtgccaaaattgttataaggggtatatgattcaagcgaatggatttacggcagagcaaaattatgaaagaacacaaaataaaatggagagattaagaagtgtagggaaaaagatggggtatactgtagaagaagtttgggtaagtgttattaaaaatagaaataaaataaccaaatttttaggaatgtgacgttaggaaaatgttaaatagaaagagtgaattttatgatgagcaaatgtcaaaattttttaataatttaccggaaataggaccaattatcccgaggaatggctttgcgggaggccgtacaggtagatttaaacattttttctggtttaatgattaattttaggcccattatgtctttttgctaaggcctctgaaaatattgaaatttcaatttatgatattgttagtctgtacccttgggtgaattattccaccccctatccggttggtatcccaaaaataatcattccgaagcaatatatagtaaaatggtaatttttcggtaaaaaaatacaatttaaatggaattttaggacaacccccgacgatatcccttacgatggacttttaaaagtacgagtcattccccccaaaaatcaattgttgcctgtgttaccgttccatactgtaggttaagaaactttttgattaaatggtgatcttttttaggatgatttattattatttacaaattgtacttcgtgtgccaaaaaatcaaaatgtgattttgtttttgccaaaaattctaaaaaatgtagacatagtgccgaacagcgggcactaaccggggaattttgttctttagaattaagaaaaggtgaaataaataattaaaatgaatcatgctcgttttttgcagcattagaatatggggcagtcatcgatcggttttatcgcggttaccattacgaaaattttgatggaaatttgtttaagaattatgtgagaaaatttttaaaattgaaggttgaggctaccgggtggcctcaggatgttaaaactgaagaagaaaaaatagaatttgtgaaaacatatagagaaacatatgaaattgaattggacccaaaaaaatatgaattttaatcctggattaagacatattgccaaattagcattaaactcattatggtaagaaaaaataaaaataataattaaaaagttattttaaggggaagtttagcatgagaaataaaattgagtttcacaaaaatgataagcaaaccgtcggaacttttt

SEQ ID NO: 1714 - DNA, 961 bp, Heterodera glycines
tcttaatttttttttgcaagaaaaactcaaaataaaataaataacgatttttcatattttctgattttaatttttgtaacttttctcattttctcacgatctttctttctgaattgtaaactacaaaaaattcatcagcaggttttgaaactaatgtttatagatgctttatattgtttgtatacgaaatatttttaaaatattaaatattatatgaaataagtactgaaaacaaagaaattattctttaatttaacaatttcaatgcactcaaaaatctttataaatcatgctatttatgcaacaggagataaattcttattaaattttgttcttataatatataaatgaaaggataaaaaattaaactcatctggcaattaattgtaaaaataattcaactatttcagaaatatcgcttcaaggacgttatgttttggatgaggaggaagcaattggcctgggaaagagaatgagggtaattaaataagaaaataaaaaatcatgagagttaaaataaaaagtaatataacaaattaaataaatctagaaaataaaattcattagaaaacagaataaaatggaccaaaccgaatcaaatacttaaaggtctacaaggtaggaaattattgcaaattgttaattaataaattcattttccaaattaaatacgaagaatagtagaataatgtaaatttacaaattgaaagtatgtaagaaggacaaaataagacaaaatgattgaattataaaaaaaaactaaaataattttagcatttataaaaataaatagatgaaaaagacttataaaataactgtaatattagtaaaaaaaaagtttatatttatttacgaaaaagctaagtgcttgaaagtttacaaataataaattaaaagaacagataaaaatttaatgaatgaaatattatccaaatccactcagtgggaaatacatgcacgt

SEQ ID NO: 1715 - DNA, 2245 bp, Heterodera glycines
ttagtatgcggaataagttatgttcaacaaaaatgattagcaaaccgtcggaattttttgaattaattaatgattatactattgaaatggctaaacctatacgctttaatgacaacactttacgggtgatattttgcaaaaaagacgagtatattaaggagcataaatgctcaaacgttatgatttcgatatggtaggaaaataaatattttttaaaaacaactatttttaggaccaccgcccaggcgcggcttaaactttactcttatatggaaaaaataaataattcagaaaattgcaaattaatttatacggatacaggtggactaaaaaacaataaacttttattttcgatttttagacagtgtattttttatgcatccaaagggaacgtctcctattaaggaagggagttttttagggtatgaaaataaccaagatccttttaatttccaattttagtgaaatgtcaaaagaatatgaggattcagaaatattagaagttgtctgtgcgggtaatgaatgaaaaagagataaaaataaatgagaattttagggcctaaacaatacgctttgaaattacaaaaagaaaatggagaaatttggtacaaaacaaaaattagagggatgacgcaaaataaaaacaacaaaattgattatgaagagtttaaggacatggttttgaattatgaggaggaaaagaaaatacagtttaaacatccaaataaattcgggtatgttttcaaatacttagctaaaattatgaattttatttagacctacgagggaaagttatgtgattagcagaaatattacaaaggattatagaccgattcaaaagaaggggttagtttgacagttttattaacgaaataatatttcaatttaggattattttgaacgatgaaaatttaagtgttttgccttttggttgttggtgattttttttgaataaattttcaaatgttgtctcttttttatttatttctttggttttttgtccttaatattttttaacgtataaaagaaataaaaataattaaaaataaaattaaaaatggataatcaaaataagccaagaggaaggcctccgaaaaaagttgagaaaaaggaaactcctcaaaacctggagaaaaaagaaattcatcaaaaagcaaaaattaaaattctaaggcccaaaatacagcttaaaggaagaaaaatagaattggacacagaaaatggtacaaattccgttccaactaaaataaaacttcctcctatttatgtaagattgtaatttgcttgtttaataattaaaaactttagaaatgatgaaaaatattctgatcagtaaagttttaaaaaatatatttaaaacaaaacttgaaaagtatagtcatattttatcatgctcaaaatacatacagatctttgtagttgtaatagtgagagaccaatagatgactaaaaaatgagagatcgggattaacatatgctcaaacagtgaaaaagttaggtgaaaaatcgttgatctgtgtgtacctatgggggcatgtgatcgagtgactacgaacaagtgcatgatcaaaagtgattagaaatgtaaagagagagagagagagagagattgattagagttcgagggaggatgttcgaaataatgattagagtaagtatgtgagtgttttggtatgacaataaaatgatcatggtgtgtatatgagcgatcaggaagtactcagattgagcatatgagtgatcagagtgaatacgtaagtggattattgatagaaaatgatcagagtgtacatgtttgatgtaaagtgatcagagagagtgatcggagtaactagtcatagagagaagagatagatcggagtgagtatgtgatgaaagagagagagagagtatcagtgatcagagtgagaaaatgtgtgatcaatcagaataagagtaagtgatcacaaggtgatcaaactgggactgagtgatcaaaagtgatcagaatgagaatgagtgatcaaaaaatatcagaatgaaaaaaataagcatgtgaatgcgtgagttaaattagagtgattgagtgaaagaatgataagtgatcagaaagagagagagtaatcggtgcgaatgggtgagcattggtgagtgcgtgcgcatgtggtgtgagtatgtataggtataagtacatgtgtgtgaatattggcatgtgtatgtgtagatagaggtagggtgcaagagcaaaggttttgtgtgtgcattg

SEQ ID NO: 1716 - DNA, 11058 bp, Heterodera glycines
tctgttgaacggtcactgtgaatgtgctcgtcacgaaagccgtcgccacttgtcacgtcacttccatcactaccaccaccaccaccaccagtttgtgcagcggacacgatcatcggaatcgcaaccgaggcggtcaacacgctgcgcattggctccggaattgctgttgccgcagctatttgggacgtcacacggttggcctcccgtatgacggcagcggtatgttgttgctgcagtcgcccgctctccccaccatcactgaacatgctccggattttgttgtgttcgttgttgttgttgttgatctgacgtcgagacgatgttggcgtcgacgagtgtggcgacggcggtggcatgagaccggagtgacgaagccagcgtacaaccgacaaccaacaaatgatgaacaacggcagtatgatggcgtagttggtgaacaggagcagtgcggaccaaatctgcacagacatgactggggctgctgctgctgttgggtccacaccatctgcgctcatcgtaacgttcatctcaacggcagatggcacacttttgctcgtcagtgcaatttcttaaatttacaaatgtctttgctgggggtggcggtagacataatgcttgaaggtaatttcacgctgaccgctgtgcaatggcgaaatgagtggcgcactgtcaatcacccgtgctggcacttcaggtctggcattgaacaggggatgtggcgccaccagtccgtcccctcgtggctcatacaaaatcacccagcttaggtttggcatgtttatcgtgggcagacaatatatgtttatgtttgtgtgagctttatgaataagacactttgttgataggtacaaatttgaagcgttgagcaatgtgttgttaattataatatgggctcctttttatgcaatttttgagtcggatacaatatggcggttgtagtcaatcatgatcaactgatcgaattccccgagcacgaccatctcaacgccgcctgccggtatcgcttcgttgaacgcgagccgaatgctggtggtgccggagcggagcagttcaaagccgcaactgtcgtccagcgtcgatgtcattggcaccacgaagatggtccatccgtcgtggaactgctccagcgtgatgtccatagagcgctccgagttggccatgcccagcgcctcgtacatgtcaacaaatggtcgaatgtaggcacagccggagaagtccatgcggtgtggcactgccggatacacatgaccggcagcgtgcacgctgatctcacggatcgcgtagggcttgaagttgaacggtgacaatgccagctggccgttgaatgctccgttcgccaccaatgcaattgtcagccggcgcgggatggcggcggaaaatatgttgtggtccatctcggtacggccagcggtcagaaacacggacttcacctccgtcttccgtaccgcgtaggtggccggctgcttttccagcgtcttgtagatggacaggttcagcgatggttgcacctcaaccatcttcacgtacagctttatgtcgtgtaggtacagcgcgtaatgttgggctgccgctgctgctgctgccgccgccgctagactttgtaacaggaacgcatcctttgcccgatagatggtgaacaggacgtccatgttgttcaacagatacagctcctggttgcccaggtcgaagtccagccgggaaaggaagcgtgctttacggccgcccgcgaagcgcgcacagcgtgccagaaaaccggcgtccgtcgcgtcgtcgtgctttcttgatgggtggtagcccgcgctggccataaagtgtccctttgcactgttcggaaaggacagttcgttggtcaagtacgccttgtaggggtagagggttccgctgtcgtataactccgtgttttggacctcaacctagtcaaatttggtgattattatagtcaaacggactgtgtgacggacacccaccttgagttgttgtacaaatgtctgtccaacgcactgggcaggcgcgacgagttgatcggcggccactgcagcttcaatgggcacccaacgtccgccgccatcctccttttggatggacagctcgaggaacaggtagacgcgcgacatgtccgcccacaggttgtcattgaacaagcggaacaggtagggcccctcctggctgatagtggacaatggcaacagttctcggaagaaggaacgcgacaccgacacatttgtgggcggaacggtgaacacgttcagcgcactgttgaacgcaagcgcactctgctcgctgatcttttttggacaactcattattggtgttgttgtttgtttttgtttgtttgccacttcgttttgatgtttattgtggctattgtctagtaggtgcccaaggtatcaaaacggagtcgtttgctgctgctgctgttgatattgctgctagcacctggtttgctcactgacagtgggccaactgttgattgcaatggttttcgcttgcgcagatgcctttttatgcttttctcgttgccgcccagtgtgggctgattatgatttctgttgccgcttttttgtcccctttttgtcgctgtagttgttgttgaacagcagctgtcattgttgttcaccatttgctttcgatagcgcttaaaatcaaagttgccaccggcgccgccccgttgtctgctcagattaacggccgccttctcgagcaaattttttagccccgcgcgtccctcgtccaccattgcatctttcacattgcgcccctctaacacttgggagagcatgcgcgagccgctctccaatccttggcgcccgatcgcagcaccggcttgccgaccgattggaaccaagaagcgcaaaaagctgcgaaacatggacccaattccgcccgctccccgttgatagggcagtcctgtaaacactgggtatgacgcacccgctcctccgccaccgccgccacccattgcgctcccgccgccgctcattcctatcgccatcatcgccgagtccaaacgctgggccggccctgtgaagtgggaccagtccaccgacagagggtcaaagtcaacgtgcatttaaaaaacaaaaaagttatgctgctatcttttttttgtttacttatttatgctttttttattctcacatgctcaatttgcttcatccccaaacacatgggcacgtacaaaagcgctgaccaatcggtcgggctccgtcttttgggcatcaatatggtcaacaatttgccgcaggctccagccctggcaacgatggtacaagaagtagaccacgtgctttccacaactgatggaccgttccgattgtaggcagcgacggttgtgctgcacggtgttgaaatggcgctccaaaaaaatgtgaatgggctccgacacgggtggccagtcggcgaacgagtcaaagtagtcggcgctgtgctccgacttaacatagatggccacccagtgtgttccaccgcctgtcgcccggtccgtgttcaccaccatgcagtgcggcatcggcgcggacagagagggaattcggtcggacggaaagcagtcaacgtactgcccgcgcgtcgcatcacaccgtgtcaaaattttgtttatctcgtcactattcatattttattaatacaaaaataggaataaacaacaaaacaacaataacaaatagcaccacaatatatgcactcagaaatagtgtgattttctaaaatgcagtgtgagtgtacaggtgccatactggaagggcataagggcgccggtgggggtccgtatctcgatgaaaatctcggcaatctcttttgtgatcagctgatggtattgtacagtggtgtatgcctcttcgatcatgtcatccggttgggcgccacgaatgcagaccatgcgcagcactggggcgcacacgttgccgatgatcaccggctcaatgagtcccggcgcgtacacgtaaaaggatgagacaccgcctttcatgtccggctggtagcgcgccacgttcagcggtgcagacaggtggcgcttgtggaagccaaggatgtaggcctgttgatccgacagctccacctgtctgatccgtgactggtcaagctccaggcggaagcgctgctgctccacgtcaaagctgaagcggcaagacaggcgtgccttgcggtaggactgaacccacagctccagccccactggcaggtgtcgttgaagctgcacatgctccgcctcactcattcggtccacaaccaatttgtagagcgattgacggtaaagactgttgtacgcggcacgcttccattcctcttcctctttatcatcatcatcatcttttcctttctcgttaggcttgggttttgcactttcacgcttttccaattgcttcttctccgtcgcattctcctgttgttgtttttgttgttgctgttgctgctgttttttacggtcacgtattgccgcttccagttgtgttttggcgcttgactcggcttcgctgatcagctggtggtaggtgagctggatttggcgcagctcagtggccaatttctcactgccttcgcccaatgcgagatgcaaactggtgagcagttcgctggggtttcgcactgtgctggccgggacggggatgcgcacctgttccccggtctgccattcgacccggacaaattgctcctccgtggtgcccagagagggccaagagtgcgggtacagcagcactgccaaccccacgctccactgcgagccgaactgtagcttgcgtggcaaacgtacgcggaaggagttggtccggttgccctcaacctgtgtgtttgacggtaagacaatgtagaaggaggatgatgaggacatttgtgctctccatttctacctttttttttgttgctgtgccctcggtttccctccccctttttatatgattgatgtggcagggatccagctgttgtgcgctgcggagtagcccttccacttgacaagacaatgctcaccaccgtttcgtccttgccgtcgtcttttcagcacccgttcaatgtcataaacgggaccgacgacggcggcggcggcagcagcagcagatgcctctgccccttgttgtgttgggcgctgtggtggggctgggggcgggagcacaaggcacaagtcttgtgcgtagaaccagccggtgagcagctccccggtgtcgtcgcgcaatttatacgtggtaggcgtacgtgagcctcgcacctctgccacagtgaacacctcatcgttgaagcgtggcaagtagccctttttgaacacatgcttgtgcttctcaattcgcacacggtctccagcgtggaagcgaggaggctgcggattcagccgacgcacatgcttgctactctccagttgctggcgtcgaatttgctccgcgttggcaaaattgacgtcccggggccgtagcccagacagggcacgatgcggtgatgcattcagcgccgacaccaactgctgtatcacaccggtccagcactgggtgccacggtgggtgaagtagcgatacagtcgctcctatgaatagtaaaagtaaataacaattctttttttgtctagtctataccaccttgatgctgcggattgcccgttccgcaatcccggcgtgccattggggtgaggtgtgcatgcaatggtgttgaacctcttttttgttgaaaaagcgctgcactggggcggcggtgaactctttgccctggtccgtcatcagcttccatggcacgtagccggcccgtttgaatatgtggtcaaaagcgcggatcatgtccactgactgcttgctcttcaccggctccacaaacagctggcggctcagcgtgtcggcacacaccagcagataggcattgccacggttgttgcgccgaagcgagacgaaatcggccaggtcagcctgccagtctgtgtgaaggccggacgccagcgtgggcaggcgacggaaccgacgaacggcacgccggtgcagcgtgtacactcgctgtcgcgccagatagcgacgcacctccgcccgtcgtatgccccttgttggatgtactcgctgtgcctcacgcagtagcggctccacactggtgaaggcggcggccgaccttgtgtccttgtacagcgggtccagcagttgttcaaccacaatttcgcgcacttcttgggtgttgttgttgttgttgctgtagtcgtcgcatcaccataacatgggtttaaacaaaaaagttttgttgttggtagtgctgttggaccgtttcgcgtaatcagcagcaacagcagcagttggctttccattctttttaaatgcatgcaagagggtagcagcggtggagcagcagccgccaccacccatcttcttctttttcccactttccgcgccgctgttgccgaacaggatccgtaccatgcgcgggtcttgccgagcattgccaataaatgttttgtacccaggcggtgccttctccggtttgggctcagcaaaatgaaaagtgagtaaagcatccaaatcgctgttcttgatcggacggtacgcgccttgcatcagccggtacacctgctgtccatctccgatgcccagcgtgcccgcgttgcgtaacgcatagtcaatggcttgtcgtttcctctgctcagtgtcacgtaagactgctgctgctgctggtgctgtcgatgttgatggatgcagttgcacgtccgcttcttcccgctgtcctttccttgcggggtcaactgccgcaacattttggggtcggtcgtcgttggagctgtcttcacgctcagtcgtctcagctcctccttttcctccattatcagtgcgtgtcaacaatgagacggcagatgacgatgacgggaagcggctagcttcggcgccatccgtagaggctgatgtcgtacggtgtgtccttttggctggtcgttgtctgcgacgtggaggctgcctcattgttgacgaatcagactgcgacgactgctgttgttgttggtgcagcgccggctgttttggttgaggttgttgttgaattgttcgcgccacctcggaaagtgcctcgcgcagcaggcccttagaggcttcgtcggtgggcagttgggtgagacgaactggtgctggacgctcctgctcatcctccagaaattttttgaaccgtttgaactcctgttggtaatggatcaaccgttcgtcatcgttcagaaggtgtttaggttgttgccccgatgacggcgatacgccgtccgtgctccgggtgacgttgctgcgtgcagcacgcgccatgcgctttgccgtgtgctcaattggcgtggtgtgctgcggtaagccgcccctcgcagaggatgcgtcggcaacaggagccgagctcctggccaacaaggagcggtacagttcctccggcactagcagcatgcgggttgtgtgcttcatgtttggatgatgctgtctttgcggctcatgagcttatccgccagcagtggaagcacaacgctggccaccaagccagccaaggccgggacgccgcgcccggtctgctgtctcagcaacagtcgacgtgccccgtggccgcttctcgcacggcccaacgcacgcacgtgttgggcctgagcgcgcaagtgctgaagatgagtgctcctgagcgggacacgtgcacggagaatgttcaacgcactttccaccagacacaacagctgctcactgctcgcccccctcaccagctgacgataggcacgtgcgcgtgccgagcgacagttgctcagctgcttgaaaaagctggtgttttgttgaatgtattgacttggtgttggcccttttttcttcgcttgcttttgttgttgttgttgttgttgtctcttttcttgttgtattgtttctggtctgtcagtgttgctgttaccgttgttgtttccactcttatgcttcttccgcattgaacattgctgcccggtctcgtggtgcgtacacaacggtcagctcgcccggatatatatgagttttgaggcgcatctgtggccgggtggtcgggtgcatgtccaccaacagataaccaaacgggtccgctgtcgcgtcatcgtaagcctcgaggaagtggcggagcgcatccgggaacagctgaacgcccaacgagcgtacctgaagtgcgcccgacggattgcgcagcagcaccagatagtgcgcattgttgtgtgcaatgcgcagctcgcggacgaacaaatgctgcgtgatcaataccacactgacgccccagttgtgtgagccacgtgtgaacaacgtgtccaggaagggagcgcgcatgccaaccatcagatcgtccaacaccagcagcagtcgaccattgcactcgcttgccgcccgcttcactccctcctcgtcaggcagcgcgtggcagacacgaacccatcgattaccaccactgctgctgttgctgctgctgctgctttttttgacaccattagttgaggttgttgttgttgctggagtgctgtcaacgctttccagctgttgcaagcgcagcacgtcctcattcacttccccgaaacagtaaagcactccatcaatgtgggcggggccaaccagtgcgtccaggttggccagcagacggagcacccatttagtcttcccactgcccgtacacccggacacacacattgtgaacggatgtacaaacacgggttttgcgtgcgcaagctgctctgactgtgccatctccaacctccttttcatttagccccgatgacccacttttttatatatgctctcaaatttagtatcacattttaacaatttttgagccacacaaatttaatataaataagtttatgttgaaactgtttattgttcattctctaattattttgtcaatggacacgtcgtcacacgaatctgatcgcaaggccggcgatggtgctgataatgctgatgcacctgcagcatgccaacagcagcagcagccgagtttggccgcggacgaaccgctgttggtccgacagccaaaggaagcacctgcgcaccagctaatgaagaaagaggaggaggagaaaccgcgacaggaaagcgcgccacttcctcagcccacacacaatgatgacgtcagcaaatcggtcagtcagtctgttgccgtccaccacaatgcacagaacaagaaattgtcaaaacaaaacaaaaaatcagtcgctcgtttgttaagatgacgaagctgagcagcgatagtaatgatgaacatggcggtggcggtggtggtgatgatggacacgcgttgccgaccgaggatgacggggtgggcggtgctcatctcccgcccctcttgttcatcgatgaggaggaggaggaggagagcgccgagtcgcgcactggggatgacgtgggccgagacggtgacggtcaaatttacactgaaaaagtgacccaggaaggggaggaggaatcagacgacggcaacgctgacatggattctgtcagcaatgacacgtacagaagcagcagcaacagcagtagcagcaccatgagttcgtcgttgttcttgctgcatgactgtcatatgcgccaccactaccaccacgacaacaacaactgcaacagcccgccacgaaaacaagcggcgacagagctgctcaagcttccgctcatcgactatttgtgtgggcttaacaacgggtgcagtgtgagggagcttcacacgctgctccagaccaagggcccacgtgcacacatgttggcccatctgcaacagcgctgtctgctgcgcaccgtccatttgcggcccgccgagcgcaacattgcgctacatgcgcatgccctaagtgccctaagtacaaacctgacctttgcatgcggtggttatctcaacctcacagtaataattttgtttaaagaagcgccgcccgcattctgtttgttttttttgcctaggtgcgtcagtacttctatgccaaacacggtgtccgtttgcgccacccaaacctgccggcgctggttgagcgcggtggtggtgcacacatgtcctattatccgctagagtgtgtgcaggtgcacgtcatggtggcatcgcccacggaccccaacgagacggaggacaataaagaggagagcgcgggctgcgcagatgatgagtgaaaatagacaagcatccatttttctcattttttattgcgtcaatcacactgagataaaactataattcgtattgattttaagcaagcctgtttcaaaatgacatatttggtgcaaaatagtaccagcacattttctcttttcaaatcatgtggcgctcaagcggcctcatctccacggcagcaacaacaactacgctttacccgcgaccaattcttggcattggcacgcaacggtgcgtgcaccgaatatgcccctcgccgttttcacgccattgtgatgcgtctgcgcaccggttcaaccagcaccatcagcaccggcgccgtcaccatcaccaccacaaccaccgccaccacaactcccactggcaccacaactgcgcttattttccaaagcgggcgtgtggtgctaactggcattggtggtggtggtggtgtagcagtgcagcaaattcacgcactctgtcgacacgaagcgcaccgagtgtgccgccgtgtcgccgatgcactccggcgaggtggctttccgacgctcggccgctcgcttcgcgtcaatggggtgcagttgcgcaacctggtctccacacttcatatgccctaccgcttgaacattgaggtgatggcgcagcatcttttgcggcggatgaccatccatgggaagcagcgacccaatgacaaagacaacaacaacagcaaccacaataacttggccgggcagattgtgcgggtggcacgcgcgtgccttgatctgtgcacattcccaggccttcgctgcgccttgcggattggtggccaacaaaagggcgggacggaggaggggagcatgggggaggcggagtttgtggtgacagcccttttcttcatctccggcaccgtgattgtgacgggagtgcgcgaccctctgctgctgaaacgcgccgttgacactattcaacatttatgtgctcaatacattcgagcctagtccgtccctctcccttccccgcccgttctcg

SEQ ID NO: 1717 - DNA, 2054 bp, Heterodera glycines
aacatggcggtggtggtggtggtgatgatggacaagcgttgccgaccgaggatgagggggtgggcggtgctcatctcccgccccttttgttcatcgatgaggaggaggaggagcagagcaccgagtcgcgcactggggatgacgtgggccgagacggtgacggtcagattttcactgaaaaagtgaagcaggaaggggaggaggaatcaaccgacggtgacgttgacatggattctgtcagccatgacacgtgcagaagcagcagcaacagcagtagccagcaccatgagttcgtcgttgttcttgctgcatgactgtcatatgcgccaccactacaaccgccaccaccaccacgactacaacaactgcaacagcccaccacgaaaacaagcggggacagagctgctcaagcttccgctcatcgactatttgtgtgggctgaacaacgggtgcagtgtgagagagctccacacgctgcttcagaccaagggcccacgtgcacacatgttggcccatctgcaacagcgctgtctgctgcgcaccgtccatttgcggcccgccgagcgcaagatttcgctacacgcgcatgccctaagtgccctaagtacaaacctgacctttgcatgcggcggttacctcaacctcacagtaataattttgtttaaagaagcgccgcccgcattctgtttgtttttttttttgcttaggtgcgtcagtacttctatgccaaacacggtgtccgtttgcgccacccaaacctgccggcgctggttgagcgcggtggtggcgcacatatgtcctattatccgctagagtgtgtgcaggtgcacgtcatggtggcatcgcccacggaccccaacgagacggaggacaataaagaggaaagcgcgggctgcgcagatgatgagtgaaaattgacatgcatacaaatttttttctctcatttttgatgcgtcaatcacattgagataaaattctaatttcttgttgattttaagcaaggttatttcaaaatgaaatattttgtgcaaaatagtaccagcacattttctcttttcaaatcgtgtggcgctcaagcggcctcatctccacgacagcaacaagaacaacaacaacaacagcgctttacccgcgaccaattcttggcattggcacgcaacggtgcgtgcaccgaatatgtccctcgccgttttcacgtcattgtgatgcgtctgcgcaccggttcaaccagcaccacgagcaccgccgccgtcaccaccaccaacaccataaccaacatcatcactggcaccacaactgcgcttattttccaaagcgggcgtgtggtgctaactggcattggtggtggcggtggtggtggtgatggtggtggtggtggtggtgttgcggtgcagaaaattcacgtactctgtcggcacgaagcgcaccgagtgtgccgtcgtgtcgccgatgcactccggcgaggtggctttccgacgctcggccgctcgcttcgcgtcaatggggtgcagttgcgcaacctggtctccacacttcatatgccctaccgcttgaacattgaggggatggcgcagcatcttttgcggtgtatgaccatcagtgggaagcgaccaaatgacaatgacaacaacaacaacaacaacaacaatttggccgggcagattgtgggggtggcacgcgcgtgccttgatctgtgcacattcccaggccttcgctgcgccttgcggattggtggccaacaaaagggcgggacggaggaggggagcatgggtgaggcggagtttgtggtgacagcccttttcttcatctccggcaccgtgattgtgacgggagtgcgcgaccctctgctgctgaaacgcgccgttgacactattcaacatttatgtgctcaatacattcgagcctagtccgtccctctccctcccccgcccgttctcgcccactccccctgcccaccccctgcccaccccatgtccacctaatttgttgcattatttttttatgaataaacaaataaaaatgtgaaatgaaaaacaaaatcaatttcgaaaaat

SEQ ID NO: 1718 - DNA, 2119 bp, Heterodera glycines
  misc_feature (2066)..(2066): n is a, c, g, or t
ttctttagtgaccaaaaagtctaaaatagtgctttctagtgcgagtagtgacattcaaacgaaggattttagtgctaaaaaggtgtttttgtgcattcctcatcgaaacaaagctgcagaaaaaatagttaaaaaacttaaaaatccgttccccagtcattaatttaataaatgtttatataagcatgaaatttaataatttgccaaaatattaatagccgaaatttttatacaaaacattcgttcgttctttttatggccatggcatgcgcggtaaacaccgcttttttgcgtccaaaaagcatagattgacttcataagaatcgcatttgtcagtcggttgattttcacatatgccactccaatattggtccactgaatttaataaattaattagtgcttataattttagttaataattgtagacaaataataattatgtgttaattgcccaattaattaccgggtggcgcattgaacacgtaaatgggaaggcacgaggttggcgacagctcgctgtcgctgtcatccgtcacatcgctgtcatccaacccacacggtttaattcgcaacgagtcgcaacactttgccattgcattgcaatagtcgtgccaatcttcattcactttaattttgcccaattaaaacaaaacgacaaataattgtgggaatggctaaccaaaataaaaataaatataaatttaataatagtgtaaggaagaagcgggctgggcgattaaaacgcggaaagcttaaaatccataaaagaaagggcggatgtgcctcggtagctcaatggaatagcttcccatggaaagggtgcacgagtgggttcgattcccacccgaggtttaaagcattttgcttatttcttattatatagttatttaaagaaaaaaaaaacatactacgaacacagcttagacatggtccactggtgaccagcagcagccgattgaagccaaacacgaggaaaaggacactcaatgggaatgatttgatcatcttgtgtaaagcgggatcagcagcagaacaccgaccagtactggtccagcaatgctcggttattcagcacctgtccgatcctgatctcagttttaaaagctgaagtcaatggccgcagatttttaagtagtgacgggatcgggccaagaataatcactgcttgaaaatgtatttgaaactatttttttcttccatttttaccataaagaaaagaaatatttaatttaaattattacttttaaaattggctggtaatgagcatttgtataaatttagttatgtgtaatgatagcatttttctttagttattcaaaatcgatgtttattgatgaaaatatattgggcacaaaattaaaagctaaaaaagaaaaggaaaagaaatatccagctttacgttgaaaattttgaaataaggagattttttaaatgttttattttgaaatattttgtcaatgtagtcgagaaaagtcggtttttcaaactctaaggaaatgattgacgaattcagaacgattttcttatgcaattatgagctttttgtattgcttaatgctacaaaatttttatcactgacgcattttgcggcagcactctgacaggttccgagtagcggcttgtcattttgttggtacaaaaccagttaagaaaatttattgaaatttcattcaattaaaaaaagacccaccaaaataaaatttaattttgacgttttttaatttaaattccggtttcagagttctgtagaattaaaataagtcgattcaaaaattcttttctgaatttatagtttgaaatttgttttataagaagagaacaaattgactaatttttcgttaattccgctgaatgaaaagaaaatttttgaattgtagtttgaatatttgtgtgtgtttgatcatgtgtctatttaatcattcactttttcaattactttactatatgtataagaaaataacgaaacagttgtttgattatttttcattaattttcaccgataaaaaattttcagttaaaaaataacaattaatttttaattagatttataattctatttgaagtanatttgcttcaaattctcaagttagtattcttcctctattcataatttattaat

SEQ ID NO: 1719 - DNA, 3074 bp, Heterodera glycines
  misc_feature (41)..(41): n is a, c, g, or t
taagtaaatagaaataatttttttcttaaaatattttgaanttgaatttgcctttttaagtttttggctttaccgtgccacctattggaaacgacgcggcattccatgcccggatgggaagctgttcagtggcaatttggacaaaatgttttgggaggagcttcgcctgtttcagatggccaaatggacggaacagtacggaaaggtgcacaattaaaatataatttttattaaataatataaaagtattttttgatttggtttgttaggtgtacggtttgctcacgggcttccagccgatgttggtgatctccgacccgacaatggtccacgaattgctcacctccaaatttgaatatttccattcaagaatggtgctttctttatcaattcattaattattatcaaaaacgtaactacgaagtgaaaattaataaattgtttttttgtgtctttttgacttttcttttttttctttttttatttcttttaatatttaattattgatttctattacaaattttaatgatcatttaattatgctaatatcaaacttgaaaacatgaaaatctcatcaaattttcttaagccgtgccttctgtttccgtccacactgttcaaaaataagcacatattttccattttttttattaggtttcctccttggaaggcgatgttgacaagaatccccgaatgaatttggtcaatgcgcgcggcgcgcgatggaaacgcctcagagccatcgcaaatccggcattttcaattagcaatttgaaaaaggcaagtttaatcaaaaagaatcatttttatttttaattaaaaagaaataaatcagaacacattttcaagttaatgccaacaattgatgattcgatcaaagtggcaatcgaactgattgagaaagagcgccaagcgcagccaaatgcgccaataaatttacaccggtaaggccttcatttattggcatttcgatgaaatagttttgattaattatatttgagaggaatttttaaataaatttgttatgacaaattacgctttaaaataatatttcatatttaatttttagtttttttgtggagatgacttacgatgtgattgcacgcgtcgccatgggccagcgcgagtcgcgacaattccaatcggaggacgccaaattggccgtgcatgcgtttcaacgactacaaaacaattggtataattgcagagccgggattttattgtaaaaattcgaaggttcacatatccgtcccttaattctgcagcgatcagtttttctgtgggattaatgggaggaaatggggcgggcttgcccagattagagatgtttataaattaatagaaaaaatggcaaaaatgagtgcccttaattaatcgccaaaaattgtgttgctaaatgtttgagtgttgtctaaaaatgtcaaaatttttctcggcggcgcctatcggcactgccgccccccccccctttttccagtttttttagaaaaagcgcgccgaaaaagctcggttgaaaagcaaaaaaaaaaaaaaggtcatcgcgacggccgacgccccttcgcaaaaactttttcctgccctccctctatttaaaatatggtctaatccccacatttaattttaaaaaatatcgaatacatccggattcgagttaaaaagtgaaaaatttgaaccaaggtttgaatatttggccatgttgttcccatggcttggccccactgtgctccggcccatccttttgctgaccgtcaaaatgcgtcgcgatccgttacttctgctgacactcaaaatcagagagcaagtggcggaacgacggcgccaaaaacagcaacaacaacagaatgccaagcatagaaatgctgatcaaaccgaaagtgatcagcagcagcaacagagggtgcccgtcgatttcattgatatgtttttggactctgtgacggatgaggggagcattgagtacagggacgagttgggcgtgttcaacaaagctggcacaaaggtgggccagggagggttggccaaacactcaaaatcattggaaattagctccatttcagttaatgcatccaattatgaccttcctctgttcctaagccatgtttttttttgttaatgcgtacattcttggcatcaccgaaaccttaaagtctttagcttatacaatttaattctgggctaaagttaacaaacaaaaaattattcttgattgaaaaaagcagaattttcttgtttttcaatgtagttttttaggaatatctttatttgctcttttttcttacatttacaaattcatgagactttaagctttcgtttggtaccaagaatgtatggattaacgaagtaataacaaagttatggccaaagaaactgaggatagtcattgttggacgcataaacttaaatagagccgaaaaagttgtattcattattatttaggttttataaattaatgaatttgaaattgttttaagtttaaaaatggaatgccaacattaaggttgatcgaaccaacactgttgacgaaattgaaatgcaattgcaagtgtttcttttggctgggtaataataattaataataataataaaattttctgtttttaatttaattctttttaatttaattttcgcttcgacaccaccgccaattccctgggctttgtcagtttcaatttggcctgtcaccctgaagtacagttgcacctccaagaagagattgctaccgtatgcataagcgaagtgagtgccaaatataattattagctcatgggggattggctcccggtaaattggacaccagtgatcaatcgtcacccatttttggtgcattttgtggcacattgatcatcatttaacccatttattctactcaaatttattttcacctaattcttgattttttttaaaaaggaaatcttagtgtccaattttcctttagtgtccaaaattccggcggtgtccatttttccgcttggtgtccaattttctggtgtccaatttaccggtccccggaggattagaggtcgggaaaaagaatctgaggtcgggcatgcgcccgatttgccatattaaaaaag

SEQ ID NO: 1720 - DNA, 1476 bp, Heterodera glycines
atcaaagagacactccgactgatgccaatcgctgaagcgtgagcacaattaaaatagaaaaataggcacaaaaataggcaaataaaattttttgttaaggattttttgggagcaaaaaacccataaaaacttattcaatattttggttagtattaaatattttaaagttttttttcgaacaaggaccaaaaatttttatgaaaaaaaaaataattttagggaaaatttttcatttataggggagtattttctgaatttttttcggatcatttcataagggtttattttttgttttattgcatttttgtcgaggatttttccgcaatttttaaataggaacaaaaataggcaataaaagtcatcttagacaacacaaactaagctgaaaacgcgtttcgtgcttatctgagcgtattaaatgcgcagaaattttaggcatttgccttaaaatagaagcccaggtaattaattaagacggactgtgacggggctgcaaaccttcgttctgttaaatgatgtggcatttttaatttctgagtatttgtcttgattttgtatattttaaagagtcaaaaagattttttaccaatgaattttgtggtttttgagaattttcatttggtttttttaccaaaatttcaaaatataaatttttggggtaaactctgttgtaaatttccttcttttttgatgattcttataaaaattatatttttagtttacccaatttttaaatttaacttaattttatattgcagtggtgaaacgcgtctttgttcacagacgacgaaattgggcgaatttttggtggaaaaagggaccggagtggccgttgatgtgtacagttttcatcgaaacaaggagttatggggcgaagatgcagacgaattccggccggaaaggtgcaaattttgctattaaaaatataaattaattaattaataattttaattattaaaaaataagagacttaaaagttgaacgggatttaaataaacataaaataataagtcatttatttattctccatatttcttttcttgatattcgcttgtatttaaattatgccaaattaggcataaatacacacgtattagccaaatagggatcagtaacaaatataatatttttattatatagactcagagccaaacttcaaattcatagtctgtaaaatttccatgctaattgtaagaagattcatatactttactacatttatggcataaaaaattgttttaaatttaattatattttaattttttggaagcatactaaaactaacttagcttaaatttaatcaaatcaaaaaaaaccttggcattgagcgatagaacgcctttaaatttttgtatgaccataaaaatatgatacatttttaatttcttcataatatgtttcagaaacagccaacttcaacttttacattatatgattagacagacgaaagatgatttttctattctttaattgaat

SEQ ID NO: 1721 - DNA, 1401 bp, Heterodera glycines
cttgacatgactttcccccggcctcggcccatttttatgcgtttggcggcggccctcgcatttgcattggcatgcgatttgcacttttggaggagaaaatggcacttgtgcgactgttgcggcgttattcgctggtcaaaactgagcagacggaggtggtgaaggggggggggggggggaaattgtcaaatttaataattatggcattttatttttaaaatatttcccattttttagaaattgctcaatttcaattcgcaagtcgtactgaatcatggcgctgttatggtcaaattgagtcaaagagaagagaatttctaggagaaacagaaagaatttgaaaactttttaactgaattttggtttaatttaatacaaaaaaaaaattaattttttaatcaattaattaattaatggtgatgctctgatcatttctttatatgctaatcattacattcagctcaaaaactttaattagtttttggcaattatatagttgaatcaaaattaaggcacacatgatttcaaaaaaacacaacaagaaacattgatttttaaattttaaattttttatctgagttttaagaaatttttgaaagaaggatcggtcccgggttcatttttctcggtctcaaatagcgaaaaaaagtactgaaaagataggcgaaagttaaaaaaatcatattttaaattttttataaaataacattttgatcggatttttaggcacttaatttttttaataggtacctaaaacaggcataaaaaagtgtttcttccaacaattacgaaaaatttcatccaggtttaattgccttttcaccgatcgaaattttaatttcggaatttgctttgtatttttcggcattttctttggtgaatttcaaattttttttttcaaaaatttttaagctttttaggctctaaaaaataaaacctagaaaataggctctaataaggcgaaaaagtagcttaacaacccccctcctcccaaaaaaaaaaacttgtttttcgtttgtttcaggccactaggatattagccctaatcatcaccttccatatttaacttttaattttttctttagaaaatgctaaaaattggtaaatgcttttaataattaacaaaaagagaattttcattgttttcgccggttgcgtatcaatttgggctttattgctgccagtgtttttttttggcaacttacatgaatacgctgaacacaatattgtgatgatgacaacgcatttttctcttccgcccaaaaggggtcaattcgcgtttggatcaatgcttgggaaaaacgcacgtaaacaaaatccaatgcagaaaattttgagttttgatcaaatgatgcaaaaaccgaagagaaacaggtgccaattctagaagtattgtaatta

SEQ ID NO: 1722 - DNA, 5635 bp, Heterodera glycines
  misc_feature (125)..(125): n is a, c, g, or t
tgtccataattgtgatgctactggcgccaaattgctttaccattctactgttcattactagaaaaatttctaacaaattaattaaaaaataaacatttttctggcggcgtcttccgctactaatnggactcttgaaaatattcaaatttattttagaaaaagaaattgctcactcatatttgttataaaatcccagcgaattcaaaaatttcctgccctaaaagccgatttttaggggagaatgttctaattttgaaaattttgagatgctcaagtccagctgtcctgatgcttccaaagacttaacacctgattatataaattcaaaacaattagaaaaactgaaagattcaagcatggtgaacagccgaaggataaaattcattttttattttttgattaaaaataaatgaaaatttaaaaaataaatgaaataaagtaaattgataataggaagctaacattctttttttgttttatttattttgaaaattttgaaaaatgaatttccgatattttaattagttttttgtttttgttcgagatttgattttttgtacaaattttcactttgacgcttgacctaataatttcttccgaagtattcagcattttatattggtcaatttagctaattaatgtcaacaaaaaccatattaatttcagactaattaattgttaggaataaatttcatagttcaagattaattatttactttaagtaatttactttttccgaaaaattttggataatttagaaattattatttaaaagtaaaaataatgaaacagtgagaaaaataatagacaagagcaaatttaatacttgaattattttccaactgattgtgctgaggcgtgggttcgatgtcctaacattttgctcatttttaataaattcaacttttttacattttttaattttaagaaaagtaagcaattgatcaacacattgtaaatttgccgttttatcattgtcatgggttttttaaaaccaatctttttcaccaaattcctccttatcagctcttaattaccatatcattttaatgagtgcatttctctttggacacgcaatttttcgtcttttcgtcgcgtaataatcccgccacacaatcgcatgagcatgtgcagaacattaaagtgcaaatcctcggtctcgggttgtagcaactcggctcacatcggttgcaactcaattggcccggctgctcattttcggggcacttaaaattattggaaaaaaaacattttgaaatagcaaatttagtaaagtaattaaatgaacatttatggctactcactatgcaatttggtgcataagcggcaataaatggggcaataaaaagaagaaagaaggaaagaattttgaacattattaacctaaaaataaaaattaaaaacatttataataaaaattagaaattaaaaaaaaatttataaagaacctttatcaattattctttatttaatgtattaaataaataaattatcattacaaaaaaaattatatttaaatataattgaaaaactcacataaaaatttatgaaaatagaaaagtgttttataataattttctaaataaaaaaattccacgtcttatgagcaaatattttgttagatttaaatgcgctttatgtattggtaattaaaaacggattgtttaatttgtttgtttacacaaaatcctcgagaaattttaaattcggtaaaaattttcggattggaataaaataaaataataaagcatttttatatgtttataaggttttgtataacgattgtttacccaaccgcctcaattttgcacgtttttccattttaaaactaatctacggagcattacaacaagagataaaaatattggtcttgttttggattacattgattcatcgtccatcggtggttattttgttattaaaattatggaattaatattaaactgtcttttaaccttttaatcccattaaacactacccaataattatcttatataatcctttttagtgaaaagtggtctttgttaattctcattaaaatttgtttattttcattaagcttttctccggaaaattgccaaactattgatccgggagttgcagccatctgcaattttttttggcacattttattctttatcctccgactttataaagataggataaatctattaatattcccttatctgttgtgcacattttgaatatatattttgatcatttttggttgcatttgaaaaaagttacgacaaaaaaaaggtgagacacggcttattgcttcacactttatgttattataacatttgttactagaaatgcacactaaaataaaattatcaattcttgacaaatgaaaagaaggaagtcgaccgttttgtgatgcattttttgcgtcatattttttggcccaaaaattaattttactaaaataaattaataattttcaattgaaattatgattattaagcaaatttgccggcaaactaattataactaatggactagtttgaaaatggctgctactgatttcaactactattatttgtattatttgtagggctgcaaaaaatatgtacaaaaagtggtccaaatatgtacataaatattaaaaattactttttttggtattttaggcaacattttcaaacttattttttctttataaattttcaaaatataaaaaaaatgaaaatatgtacaaaaatatttgccgaaattttggattttttttgaggatttccaaaaatttccgtaaaaaatactcaaaccgaaatatgtaaataaaagtcccggtttttgttcgcaaacacaaaaaagaaagtgtttttcctgctatttagagcaaggagaagccaggaaaaaaatatgtatttacataaaattggcagccctaattatttgtatgaattatcaatgcaaacttttttcccataaatgttttaaataaagcgaataaatttgcgagcctaaaaaagtaacaatgatagtaatatttaaatccaattttactaaatcttattaatttattcctgttttttaaatctcataaaactttttgaaaattagaatcataataaaatttaaatttgcttgtttctgaaaaaagttatgaaggaattaaaattaattaatttgactaagttttgtgctaattatgatttattattaatagagctcgcattttgaggcatatgcctttttttctgcgaagtagtttcgatatattaagcataaaaaacgcattttccacttggtttgaggcttctccgttgacttttattatgccttttttttgcctttttcgggattttcgtgccttaaatgcctttttggcattttgccgttttggtgccttttttggcgtttttttccgaaaaattccataaaaatgcaataaaatcggcaaaatacatccctaagaaatgacatgaaaattttttagaaaatacacccctaagattgaaaaaattttcttaaaaattgatcaccaaaatttattttatttttttcttgtaaaaaattttaggcttaaaaattttccttatttgaaaaacactataagtatttaataatcatttaaaagaccaaaattatgttttttggttaatttttacgtgttttgctccctaaaaatcattaataaaaaaattttaaatgccttttttcatgcctttttcgggattttcgtgccttttcatgccttttttttcaattttttggtgcctattttagtgcctttttcgcgatttttggtgcctttttttgcgagctctaattattaagcaaaataagattttaaaaaattaaatttaattcttattatcattgacacttttttttatgggacatagcaccaaaatgcagcaaaagtgttgctactgagatagagaagaagcttccccgagggaagattaatggatcaattgtggcatatatgatcgagcaacgtggagagctggagagtgcagggtaccggaaagccagagacgccggttcaaagcaggcctgccccattccctcaaaagcttccccagctcgttcatatatttcatggcgacccttggcggcttccagttcacccagcagcagcagagaagcgaaaaagatgagagagaataaagctggcactggaagtgatcgaatctgcaaccttcagccgagcagcagctgacgcagagaagaagaagaaaatggacgaggacgtcacataagagaggcccgggatgagaaagagaagaagaagcttccccgagccagagacgccggttcaaaggcggcccgcccaatatttcccttaaaagcttacccagctcgttcatatatttcacttctatcgagaataaataaataataaatttgtggcgattgattacggaaagggaagaaaggaaatgacaaatgatgataatgaaagataaattcagagaataaaaaattgaaaaaaagttaaattatattatattgtttgaattaactatatttaaaaatcattactaaaaattcattaaatttcagataatcaaaaaccagccaatcactgggggtgtaaaaaagtctcggtatagagtctcgaaagcctcgaagaccgagactgaaaacccgagaccgagaccaaaaaaggatgtgaaccaaaattgagcaaaaatctttcctcttggttccacctttgatctcagatcttttctctgcaaattccttcccgagatttcccaggccattatcatttttccattcttttccattcgatcattcacattttcctttcattttcacatttcataagcaaaggtttaattacccaagtttgagatggaacaataaagatattttttggttagtatttggactactacgatcctgggaatggccagcccgtttcatataggaatttcaggacatttcagcttcattaagattctcaatcgtatcacgcttcaactaaattcagtatagccaaaacattgtctctgtatgttttttccgttctcgaattcttgtcccctcaattgggtccaactcatactgccgcagtcgatcgactgcaaacgctcttctttcttcagaacagtgatgagtccgaaaattgaaaagtataacttgattaattcattttctttcgacaataggggttgtaaactgatagaacccttcttaggcgttgtttgtgcgccccaggtcatgaagaacgctttcgttatgatttcatctgttaatcagaaacaaggggacattccagcatttagttggggcttttacaagatattttccctttgaacttcgtgtagacaacgtgttcgacaattacaacaattctaaggcagatctcggcatcctgatcctatactctgtacgtggcgaagaaatatttgaattattcggctgtcgttgaagactttttgccacatttgctccggtgcccctgggaaaggcattttctttttataatgatataaaataaaatttccatttatttgtgtgaaattgtgtatgtcatcaaatgtcgggatcctcaaatgtcgggtcctcagatgtcgggatcctcgaatgtcgggatcctcaaaagtcgtgtcctcaaatgtcgggatcctcaaatgtcgggtcctcaaatgtcaaatcctcaaatgtcgagtagcca

SEQ ID NO: 1723 - DNA, 918 bp, Heterodera glycines
aaagccaaggaaaatttccataaaaggggaatgttctggttaaaaatattttataagtttttaattttgtaaaaattaaggcaaaaatgtttttgctgttccaaatacaagccatattatgaccaaaaatttaatgatcgattgggttcacaatgtgttggtcccagttttacgccctggagaaaaatcattattgttggtggatagttggaatggttggaatgattttcgactctcggataatgttaaattaaaagtaaagcaaatcccaaaacatgcaactggaatatgccaaccattggatgtttacatttttccggtagttttgttgccaaaaataaaataaaaaaaatagttttaatttattgcgataaaaaaagtttggcacgtcatatctcggcactcagactcatttcgcagaaaataaaaacacttttcttaagaacccatgggtgctctatccacccaccaaatttcattcggaaatcccacggacacccggggaccttcctttgttagccaagccgataagggagcccgcacaatccgttaattttgcttgtgatttcattttttgtgattcgcataattttttggctttgattctcaaaattttgagaaaatataattttttgagtgtcttttgtctgtttttgtgcccggaataattatctctctttaatttgtttcttgcgacgagtaaatttttttaggcaatgacttttaataattaaaaaaggggtttccggaatttcacaaaaaaacttaatccggtcctcccccatggcatatttcttgtgctttaataaaatgaaaattttgtgattcttttgcccaactcccacaaattcctgccaatttggcctcacaaattgtaaaggcaactttgacacgttgccattctcatgcggacgtcat

SEQ ID NO: 1724 - DNA, 1828 bp, Heterodera glycines
taatattttattcatattctacaataaaatctcatagaatatatatcttttattaaataaaataaagttttagcaaaaataaattgattaaaaattggtaacaatttttttagataatttacaaaaatggaaatgccaccaattctcacacaattaatgttaattttatttgtttgttcaacgttcattgaaaaaacaaagtgcggcaaaaaagaagctgctgctactccgatggaaaaagttagccaaaaaagcgacgaaacagcaaaagcatcaaaaccggtggaaaacaaaaacgaggagctaaaaaaagaagtgaacttattttcaattgttaaataaaggatctttttgatttaagtgaaggttgtttcgtataaattgccatattaatgtgatcaaaaattcctaattaaagcaacaatttttatttgaaatttgcatactatagagcagggatggcacggaattccgagttccgacatttttggggtcggaattccgacttccgaaatttttgataaaaagtaagttcgaatttttcggaattctttatgagtttttttttaaattagcaatttttgtacaatttctgttaatacattgcactgaaattatcaattttttcccggcggcgcctatcggcaccgccgcaccttaaaatccttaattttcttgaaaaatttgcttaaaatctctaaatttgttttttctacaaaatctgttaacaaatcgcattataaatcactaaaattttaaccgacacctccggacccctccccccagttccccaaattttcttttaattacgcttaatcaccaataatgtaaaaaatgaacaaattttgggtcaaaagtgcaaataaattggcagtttgtaaaaacgagttcgcatgtgcatgaattttaaattaatattaaattttatttaaagattgaaaatatgaaaaagcaaatggaccaaaagttaaagaaaatattgcaagaaaatattcccgcatttgcacttcaattgaatgaaattgcagcacaaattgacaatgaagaaaagcctttggagaaagaatttattcaaaaattgatagacaaagtacgaccattgtacggtaagtgaatataaaataatttaaaatgaatttaaaacataaattatttaaaaaagttgatgcgaagagggctcatctgcatttctggtcgaaagtgcgcattttgaagaatgacaaacatataaaagaagacgtgacgaccgtggaagtgttggtaagcaatcgaaattaatttacataattaaaataaatgaaactgacattaatatgcaaaaataaataattatttactgattttattagtttaaaataaattctggcaaatgagcccttaattatcactttgttttctcaggatgctgttgaggatcaaatttctgccaattataactgtttcaacagagaactcgaggtgttttttgcattattttaattaaatttaaaattaattcagaagatacatacttatcataatgatcgggcggaattggagcgcaatttgcagcggtaacataatatattttgttttaaagtcatgggtatcatttttatttcgtattaatttatgaaatttagtaaaaataaaggttaaatttctgagaaaaattcaattagaacccatagatttggctaccctggtttttgattttataaaaatttgtttcaatttatccacctaaaataggaaatatttcttatgactatcccattaagaaagattgaatgaacacgttgaatttaatttgaattttcgttttttaaagagccccaaggcaacaaag

SEQ ID NO: 1725 - DNA, 3805 bp, Heterodera glycines
  misc_feature (81)..(81): n is a, c, g, or t
taatgttggtagtgatgggtgagtgtgattcactggtgatgctggacaaaaatcgatcgataagcacggacacccactatntaagctcagcacattgtcatttcatcattttgcaattaaaatgttttcaaaaaaattggtcatcattttgttctttctccgagtttcgcttccagttgtttccacttatcgagaccaaccgcaaaagccaccgctagagaacacctattctgcttatataagaaatttgacattgtctcggcaacacaatgagccggcatattcctacagtgaatatttgagaagactgtctttgtctaaaatttatttttcaaccaaaacaataccactaacgaccagagcattaacaacaacaacaacaattaccccgccgcacataagcacccctctgaaaaacgacaagttaatcgatgaacaagtgtccgcgctgctgccaccgttcattcaattgtgcaaagatagaccggaagagagcagcaatctgtcacggcaagcaatttgctgggcactgttcgctctttatttaatgctcatcatcagtcttgtgctacatcaaatttgctcagtttttatgctaaagaatggacagtctccaaatcacaaagatattgagcgaaaatcagcggacagggcgagtgtttcggggctgcttcgccagtgaccagttgccgcccccctccacgatacagtatcccgctgcgctcattgtgaacagggacccccgccacaaggaaggctctcattggtgcgccatttacgcaaagggagtggaagcgccagcgctctactatgacagccttgcccagcccattccgcccaccattacgtcatcatttttacgctatttcccagggggcgtaatgaagaattcgcgtccataccagtccccccttgtctccacttgtgccgcccattgcattgttttcatttaccacttatccttaggcgacacattccatcaatttctcaatcgattttattcaagtgcaaatcccgatttatatgtcacggttgtactacacaaaattttaaattaaatagttgaaaaaaaagaaaaaataaaagcccgatgatcgggcgtaaatgtctaagtaggcaatttcatcgtcaccaaaatgcggattcttcaaaatatatgcttcatcatcatcattagcggacaaaggctccgttgacacaatcccactttcagccattacgctcggcgctgccttcaaaattgccggaaagttgtcgcggtgcaccagatcgacggacgtgcactttttcattgtgaaaggattcgcgctttttgttaagcagtttagcaccacatcacatagtgcaccattttccttaattttttttatcacaaaattgaaaaagaaaaaatagttcaaaaattttacgcgcgaattgggcgagtcgaccaaaatgcgggtgcaacaaatgcgcccagatttgccgaagcaaatatattgagcgaactcattgaaaaaggccggctcacacagctcattgttgttgtaacggaaatgtaggtagagctgtccgtctgacatccacccttttgaactgatcacatcaaattttgaagccaattccttctaaatgtgtaaaatttaaaatgaaaaaacagaaaattgcattacaattattgcaaatttttggtgacgtttggcccgaaaaacctcaacggttgcgttaagcacaccaatgccggagagtggccggcctttaaattgtgaaggaaatgtgaaacaataattttaaaaacacatgtcctacctggtttgggtgttaccccgccaaataaatacataattggcaatgcgtcgataatttgggagagaagctcggcgggtaagcgcttccccatttttaggcacaaatgaacgaatgagtgcatgattttcgccggtcgcgtcgccgcgatgaacacgcattaataattcagcatgttattttggtggtggtcacaatggaaatttgaatttgccggaaatgagccgagaaattaattagtggccgaagacacgaacaaatttttggcactcaataaaagctcatcccattttccattacattcatttccattctcgctcaaattcactttaataaaaaatagtaataattaaaatttttattattatttatttttgttaggctgttaaccagggcggttgctcaaactattgggcaccgtttatcctggcagcattttttgtgtcttttagggcttggggttgttcaaatttctgttctaattgcccgagccgtttaggtgcactgtcgtcttgtgcttcatgggtggcagtgcgcagctcatcaggccaagattggttttaatttgcaaaaatttaatatatgctaatttcaattgccatttccatgcccaaacgcctagtgctgtaaattgccccattttcacgcattatttgtctcctagataaaatgcaaaatcagtctcccaagcatccctctgacttttcaattgcccacattctttctgttccgagcaaaaagccgcggcgcggcggcttcctcattaatcaattattgggagatgttcaagagggtgcaggcaccgcatcctctgcttcttcaaaatcggcaccggactacgtcaaaaagctggccagcagtgttgagcatgtgccccgcttccagtacagcaaagtgaagtcacagttcagcattgtcgatgtgccagcagccaatcccgaggggctccttgctggcatcttccagtactgcattgatgcggctttgggggagagccgggaacgcggcatggagccaactcacctcggctgtctcatcagcagtccgttgctgactggcggggacatccccatccccatacgacagatcaccgataacaccgtagacaccatactgaatcagttcaccaaagtggcgcagagcaaacagcagcaaaacgtcacgctttggggagagcccttcactgttgtagtgacgacagtcgatcgctccaatcttcccgctcggagaaccctgaagggcggtgctcggcgaagcctagcaccagtgcatcaccgagtgacggaaaattgtttgattaaggtcaggtcgcgccatcaaacccaaacaattcgattgacaatttgttttaagatttgcaacccggacgggcattgcctgttctacgcgttgcaggcaacgatggtggccaaaacgcgcggttggcctcgttggaaattctacgattacttgcacagtcggaggggacagcagggatgtctgaggcgggatgctttacaactgatgcagcaaattcgtgtacggatcgggctgaatgcatacgatgccgaaatttgtgtgccgcgtgtgattgaccactggaacaacagtcagcagcagcatcgctttgcggtgttcatcttcggcgcttcgggacagtacaagccactcttcaaatacgtcaacgaccattacgacactcccattgtgctctacttcaacaaccaacactttgatggagtgcaaaagttgcatgggttgtttggtcgtccttattgccttcaatgtgagaagccctaccagcaaccatcaacacatctaaattcctgcaaagcgcgctgtatgctttgcgcacgcgtcgggcccgcattcccctgtgcccccatggatggctttttccatcaatgcgcgggttgcaacaaaaaaatttccgaaccacgaatgccacccacaccatttggcatcccatttttgtggcaaatcgaaacagtgcaaagaatgcggggtaatttggaatgggcgagacaacgatccaaatggg

SEQ ID NO: 1726 - DNA, 3098 bp, Heterodera glycines
catgacccgtaccgcattgttgccttcgatttggagacgacgcagcaccagccggtgagcccgcagcagcccgaaagaagagagcaccagcccaacttcatcgctgcccaagttgcttgccctgagtgcattgagaatggtacctggcgcagcagaacaacagcaggctgtcgaatttgtgggccgcatcggactgttgcgttctgtcaacgccgctttgtggacacgcacgtggaccatcaggtggtggtggccgacgacaatccattggtggcatttgtgcattggctcgtcttcgaactgccgatgagctacgacacatacgcctactcacactttggcggacggttcgacatggtgctcgtctttcgcgagctcttcagaattggctttaaccctgagatgctgagacgagtaaaagcaacatattttttttatggtgataaaatttcaaatctttagggcaacaaaatgtatgagatgaaagtgcgtaagcagaagaagcgcaacccaaacgtcgtcttccgggactccttcaacctaatgccttgctcactggccgcgctcgtcccttcatatgggctggaggttgaggacaagccgttcttcccccacatggccaatcgaccggaaaactacggcagggaaatccatccgacgcccgacgactacctggccagcggtatgatgcccagcaaaaggcggcaattcgatgcgtggtacgccgagaaccgtcatcacccgttcaagctggatgaggcattagcaaggtggtgtttctaaaaatgttgccaaagcccactcattttggctctctcagctattgcaccattgatgtggaaatcttgatggccgctctcgtcgcgtttcgccgtgaattcttcgacatttcccggcggcaagaatacgtggacggaatagacgatcgggagaaccacaacggaatcgacgttctgcgcgaatgcatgaccatcgcgggtgcatgcatgcgtcacttccgcaccaaccacctgcccgctgagcatctggccattgtccctgagcgaggctatgacaacgcgcagaaccagagcctgctcgcgttcaggttcttccactggtacgcggaggagcacggagtggaagtgcaaactgcccactcagccggaggagagaagagaatcggagcgtattcgctggatggatggattgaggcggaggggtgcgccattgaagtcaacggtgcacaaatttattttttatttttatttttatgaatataattttaggctgcacttggcacgggtgcaaaaagtgctatcccaacgacaacatgttgctccccagtggcaagacagcgggggaggtgcgcgagcgcgacgccaaacgcctggacttcctgcggcggcaagtgaaccgagtggacgtctactgggagtgcgaaatccatcggatgctggagcggagcagagaaatgcgcaagtcgtttgctgattatgtggatgatgggccgttggtgatccgggacgcgttcatgggagggcggacgggaccgctgaaactgctgcgcaaagcgggaccaggagagaaaatctcatattatgacttcacgtccttgtacccgtatattaagtatgtgtggtgctcgtcgtttttaaataataaaattttgaactttagtttcgtcactcgctaccccattggtcgtccaaaagtgcatgtgttgaaccggcaagtggagtggcgcagcgcagcggacaacccctacccattggcactgctcaaagtgtgggttgtgccaccccgtcgcgtcgacgtgcccgttctgccggttaaagttggagagcggctttgttttccgctctgcatcacttgtgccaaagagcatccgactggtggtgtgaattccgactaccactgcgcgcacaatgacagacaacgaggttgggtcagcacatgcacttcgattgagctcaacgcggcgctggacgaaggctacaccgtcacgagggtgttccgcgttctggagtacgagcagagcgacgaccaactgttccgcccgtacattgcggaattcatggctcagaagatccaggccagcggcttcgacaacaacatcagagggaacgccgacaaagaggagcagttcgtgcgggagtgcgcagagcagttcggcatcacaatcgacccgacaaaaatggtgctgaacaaagggaagcggtcgctggccaagctttgcttgaacaatttatgtaagtgtcatttttcagaattattttgatccaaaaaaataggggggcgcttttcgcttcgcaacttcggactgtgtcagacactgatcacggatgacccagcgattttggcagaatatttggacaacaaatcaattgaggtgacatcaatcgaccaattggatgaggagcacatactcatcacctatctccacaaaaaggactgggtggatgagcatgcctgctcaaatattggtgaggcacacacacacacaaaattcctactaattttttgtttcagtcatttctctgtggacaacatctgctgcgcgcctcgtgctgctcaaagccatgcagaaggtggtcagatcgccgggatccgagctgttgtacacgggtaaagcaaacagtgcacaaaaaccgaagatgaaatcagattattttagacactgacagcctcattctggtccacccggaggagcagtgcccactgaaaactggcacccacctgggccagttcacggacgagtacccagaccacgacattgtggaattttgcagtggtggggcaaaacaagtaaagttaccatctgtgcaaattgttttttaatttttccgcgctttagtacggcctgtgtctgcgacgcaagggcgcggaggcgggagcccaaatggaccatgtgctcaaagtgcgtgggctaaccctgaactatgagtgctcaacaaccaggggatgcggtatgacacattcaaagaagaagtggtcccttttgcaacgacgggtgactatgaaccaataatagtcacgtacccaaattccttcgcccgaacatcagggagggaggccgagtcgtttccatgcctatgcaaaagtgttatcgtccgttt

SEQ ID NO: 1727 - DNA, 1880 bp, Heterodera glycines
tgacagggcatttgagcagctggccgcaaaatacgcttacgagaaccatgcagggagaaaaatgaaagtcagatgttcatggatttcacttttatatccggaaaagtggtgccacgcctactccaaactttgcccaggaggcacgcccactctcaaccaacatttttcatctggccaaaactcaaattcatttcgccaattttttccaaaatgaagagacgcgctgctactcttactgatgctactgctgagcaacatcccgagcccaaaccacaggaagagaccctcaaaaatgtcgagccgaaggacgagtcggcaaccaagaaacgcaaagtggaggaccgagagttgtggaagttggaaaagggcaaatttttgctgacgacctatttgtgtccgggtaataaacaataaaaaattattacatttttaattaattaattttgagatgattggaatcgactgttcaacaatcagcagaaggtgaaacgtgtggagggcgatcgtgtttgcttcagctttgatctgtgtgaggagtgcgcattggccaattgccgcgcaacggacctgctggctccgatgaaaaaaagacccaaaaatgacttttgaatttccttttgattcgcatttttatccctaattcagttgaattgttccatatttgggattatgcaataataatgaattttttcggcagtggccgcatttgaatctgtcacactgttaattaatggtcaataggcatgcgaaccgagcgcaggggtgggggaggggattgcatttcctttattcattaccaaatccatcgattccattgaatttccaacaaaaatggcaccaacccatcgcaaaggacaaaacccatcactgttcggaaccgcaagtgaccaaataatttaaatcatttgaaaaaatgggttttcaaggatgccatgagtgtcacggggaccggtgcatgccatgtgccaaattgcgagagcggaacagagaaagggcaaggatggggctgtgtcatgggcgcatgactcttgaatttgggccaatgagcagagaacagcagctcaatgcaacggcagcgcgcaacccaatggaagccgcacttcaagctggcagcgaaacgaaggcagtgtttcgttgggggaaccctttggcacctgtccatttccccgacacattgttgtacccgaatataggggggatgtgtttgtgtgttgtaggggtggcacaattctttggggcctgtgggcacgtaggactatgccgacaatgtttgcttattcatttaaaaatttcgcccagccctgataaatgtccctactgtagagtgagcaccacattttacatgcagcactaaagcaattttcattggctgtgtacgtgtggtgctgctcaccctacagtatccccctcacacaaaaaaaatttttcactccattgtactaatatttgcgtgcaatatttgacatttgtttattgatgagataaaaaataagcaaaattaaatttgatcgagtaaatgtgcaacaacaaatgagaatcagttttttggtggtggtggagggtacgggcaaaaaggcatgaaagggaccatcggcatcatcatcatcatacacgggaatggtgtcatttgagggaaattgttgttgttgttgttgttgtagttgaacggcggcgctgtcattggacgcgggaatgcgaatgactgctgctcaccctacagtatcccacacaaaaagtttccattccattgaactaatatttgcgagcaattattgtaatttgtttattgatgagagaaaaaaataagcaaaattaaatttgatcaagtaaatgtgccaaaacaaataaacaaatgagaatcaatttttgggtggtggtgg

SEQ ID NO: 1728 - DNA, 1902 bp, Heterodera glycines
  misc_feature (1823)..(1823): n is a, c, g, or t
gcccaccctatgggtgagcccctttaaccagggcccaccctatgggtagcccccaaaacctgagcccaccctacgggtgagcccccaaaaccagggcccaccctatgggtgagcccccaaaaccagggcccaccctatgggtgagcccccaaaaccggagccctcccacttggtgagcccctaaatccagggcccaccctatgggtgagcccccaaaaccagagcccacccatagggcgggccccccaaaaccagggctcacccatagggtgagcccccaaaacctgagcccaccctatgggtgagcccccaaaaccagagcccacccatagggcgggccccccaaaaccagagcccacccatagggcgggccccccaaaaccagggctcacccatagggtgagcccccaaaacctgagcccaccctatgggtgagcccccaaaaccagagcccacccaccctacgggtgagccgctaaaccagaacccgcccaaagggtgagcccttaaatccagggcccacagcaaatgcgtgagccctgaaatgcagggcccgcccaaagggtgagccctaaatccagggcccacagcaaatgcgtgagccctgaaatcagggcccacccaatgggtgagcccaaaacaaaaacaaaaaaaaaaataagcgaaacaaacactcacccgctttcgtctcggctctccattttcctcaccgccgtcggacaaatccaccaccacatcagttgtcggtgcttcctgaaacaaaaagaaaaaatgaattttgaaaaaaaaattttaaatattcaacagacctcattacgcctttgttcggcatcgtcgggtgctcgtcgtttgtcaccggtgttcgtcgccgccgccgcctttagggattggggtaaaatttagaaattaattcataaaaatcaaccccccacacatgaaaatagaaaaaagaattattaaatggggaaaaaatttgaaaaaatttttacttgctggccatttgtcgttgtgcccccaatttcattgtcccagcaacgcgcgctcaacacatgaaaatttatttgaatttaattattaaatttaaaaagaaattcataccccccgttcaataccagatggagtaaaatactaaacaaaatttatttttattttattttttggaaaaaaggtaaaaaattttacatttttcataaggtcagtggccacatttgccgctgcccgtctgaggtgggatggcgccccacccgaccttttagcaaattgacgtttcattttttaataaaaaattggaaaacaaatctaaaattacaataaatatttgcttaaattgttttggagagttgggtgtttggcgtcgctaaagtgaatgaatgaatgccattcattcgtcccccccccctgccctcttcggtccaatgacctttcccagttagagagcgtatgggcaaaagaagcagagaaaacgacgccttattggcgtggtcatctccaccgaaaaatgaccccccccattcgcttatccgcaccccaattttctctgtctgtctgccacttcacaatttgctctctctctatccgctcttccccccttgccccacaatctgtctctttctctcttcctcccttgccccgcaatctctctctctctcctctatctctctcttcctcccttgcccccgcaccatccctctcctccatctcctcactcttttcttttctctgccccacagcactgtctgcgccccgcgccgccaccaaatgatcattaatcaccgccatcgctgaccaaaagtttttttgccaaaaagttttacatcactgtncgaaaagtttacccccccccataagcaaaagctttgtcccccattccacaaaagttttttaaaaatttccattggccaa

SEQ ID NO: 1729 - DNA, 2036 bp, Heterodera glycines
  misc_feature (1428)..(1428): n is a, c, g, or t
  misc_feature (1430)..(1430): n is a, c, g, or t
  misc_feature (1446)..(1446): n is a, c, g, or t
  misc_feature (1448)..(1448): n is a, c, g, or t
  misc_feature (1486)..(1486): n is a, c, g, or t
  misc_feature (1498)..(1498): n is a, c, g, or t
  misc_feature (1520)..(1520): n is a, c, g, or t
gaaaatgatacatattttatctgttgaatatatttttctttatccacatgatcagttccttgttgagatgatggattttcgtcggatcgtctctttatgaaaaatactttttgcacttttattcataaaccagtttatatatctgaaaacaaaaaattactttatttaatctttgggtttgtaattatttaattatttttaaatatacgtaaaatttgcttttttaaaatgttgtccgattaatgactttcaatttattttcatttattcttttgttaaaatatgactttaaaagctttttcatatcctaaagagaattaaaatttaaatttttgcaaatatattttactttataatttatcactttattataaattaatattttttttgattcatttgcagcagatcatgccgattatatgaaaataataattgatctttgcagtaataaattattttttaattctgtttagacaacttcatgtacaataaaaaaataatacttttataatatttaaaaattattagtcataaaaattcctaaaggatgacttttttttgtatatttaaaataaaataaatttaaatacataaaaataaaattgagtaataaatgtttgaattgataaagcacgtaccattcttaaagagtagaagcccatggcctgttgttgatcttaacctttaaaaatatgacaataaaattaattagaaaataatgttaataatacatatgaacaaccatccattttaataaaattatttctttttaaattaattcgaattgaaaaaataatatttatggcacaatcggtcccttttggcgatggcattttattatgtttttgtgtagtttactgaccatgagaataacaattattaaaaaataataaatattaaaattattatagcacttctacataagttattaaaaaaaaaaaaacttaaatttgatttttatatagaactgattaggaaataattataatacaaattaatataattaatattttaaaaatataatattctatgaaaattatattcaaatgttaaacaaagaaataataaattctataaatttatagagagatattatattattatatgatttctagaatgaacatttattaaaattatgagatgttgaaaacactttatatattaataaaaaagatggattatttgcttttatcaggaaaaaaaggaaacttaaataattaattaacaatgttttaatgcactaccaaaaaaagtatcaataaaatgatttttattattttaaaacaataaatctaaattttaaataagccacaagataatagtaaataaatgaaatgaataaaataataaaataattaatttcaattattatttaataaaattaattatttgaaataaaaatctcctccatcaacaaataattcaaantnaatacataaatacaananattatttattattaattcataataaatttttttttctnttttacaaaatnataaaaaatcattttaaaatanatatagtaatatttaaaaacacttttaaataatataagaaaatttataaaaattctctaatttagtaatgattttccaacaaaataaaacttattcatattttacgatgcaaagcgtatccatctaatattgaagtgaaaacactgaacttttacgagccatgagataaaataattaaaccaaaaaactggtaaaaattattgttttcaaatgaaaaatgaaaaaataatttaccaatttaaaaaaataaataaaaaatatattattatcagcataaaaaagcttaattcttcaaatgagctatttattaaatagaaggaaatatttatttatattattaataatttatgcattaaaaaaagaagaccagaaatattctcatttactatttttgaaagaattttttaaatatttcaaattgtttacgctcactagcgatagcataattaaaaaaaaattattttacaatatatatttttggttttctttttatactttcaattttgtattaatatt

SEQ ID NO: 1730 - DNA, 2999 bp, Heterodera glycines
aagttctcagaaaaaatcggtcaagcggaaatgccctttgaaattagttaatttaattaaccgtatttggggcagcttgtgcaccgacaatccgataaaattaaaaaatgcaataaaattgaattaaatacctgccagaaacaagtgtagaacgcggcggtgccgactttatccagcaattggtccaacaattgaaaggcacgaccatagaattcggtgccctcctcaagtgcgagaagaacggcggtgatgaagccggggagggccggccgaaggtgagtgcccagggggaggaggtactgctcgaagatggacaacagctccgacttcactttgatgccacagtggtcgatcaactgaataaaagaattgatggaaactgcaatttagctatggaaataggacttggagatgggagaggggagggactcaattcataaaagaaatacacaaaataaattttaattttaaaaggtttatcagggttttgtgcaaaaaaaaacaacttattttgataccaatttttacaaatatagtagttaaaattgcacccaaaaattggaaacagtgaaaaatggggggtttggagaggttgggggagggactcgattcataaaacagctacacaacgttttaattttaacggtttatcataaggtcttgcttttgaaaaaattcacttttgatacccaattttactgaattgtcgaaatttcatgaaaagtgcttgaaacgctctcgagaaagataaacaattcagatttgtcgaaaaaatttaaattttgtttttaattactgaactacgtacgacttcagaaacagaaactacccaataaaaaaatttacgggaaagaggccaattgcgtagagaaacagtgatctggccaagttctgattgtgtcctgaatgtccgaggatgttgaacacttgtctgtacgtctccaaagcctttagatggacacctgttgacaaaatattaaacacagaaaaattatgacaaatattagtaccggatggaagtgcggggtgaagacattgggagagacgtttggcaacagtcagaggatttggaatatcgttgaacgactttgaattggacgcaaaaacctagaaaatgagattttaacggaagattttataaaattggcccgattttcataaaagttcgttaaatctatcggtacctcatttcacatccgtcgaaaaatttattaatagatctatgagaattgcattttcccggcatttaaaagccaataaatattcagttattttaattagaaaatcggaattctcggcctaaaaagcgctaacaaactttgccgagttttcccaaagctgcgattagatcggcccattcggtggtcgactcaaacgatttgagcgctttgtccacggcggacgcgtaggcgcggtatttgctgctgttttggtgcgacgaaaaagtgccgagcagaaaattggtgctggtcgaagcttcggaattatgtgcttaaatattgaaaataaaaatgggaaattggagaggaaaacttacagccaaatgaggacatagaataatgacggacgaaaggcgactcctcaacaaaataagctcacaagggacgaacacacaatagaataaaatctcaaaaattatagaaatctgtaaattcatttggtaattcgttgcttgacaaaacttcaaagcactttttcattttaatttggagtgaatggaggcataaaaattgaattaaaatatgcaaattttaatttttaaaaaaatggggtcagatgcacccaaacaaacttagccatacagcggaattgagtattatgggaattgggtgtaattcatttgtcagtagaaatcatagtaaaaatgtggtaagaaaaaacacgataaggggaacaacagttcttgtaaatggaagagagggaaaagaatgaaaaatgctttttgttgtctggcggagtttcctggtgggccgtccgccctcctccttttcagtatcgcgattaatatgtactgcttgccgctgctgcttctgctgttggtgcggtgctggaattcgtcacccacccatcatcatcgccacccttccacacacacaacagccaatcccgtgaactgctgacgggggaaggatcaataaataaacagcaccggcgccaatcgttgcagcagcagcaacagcagcagcagcgtcatggacctctcccccaacgccaccccaccaccttcattcattcaccacaaacataaccaagcaagcagcagcagcaggaataatgctctttggctataaaaatgctctgaatttgggcggaaaggagggaggggggaaatgcacacggacggttccccctttttcccatttctttgctcgtccaatccctcccccccccccccacttcactccctccgctgcgaaatgcgatgccattgatacatatttcgttcatgttcatggttgctatacaacacataaataaaaataatgttaatctatgaaatcaaatttggaggtgaacacaacaataacaaaacctgcaaagtacaataaatgcataataaggattagaataatacataaaaagaggggagggggaaaatgggaggataatcgcgtttataccacggaatttcgtagtgcaagtaaaaataaaatttctaaatttaaatttgacaaaaaggtccataaataaataagattctgctggacaacaaattccatttacgggccgatttttaggggtgtatttttcgttttattgcattttcgttaatatttgggcaaaacaccaaaataggttcaaaatagatttttcaaattttaggctttttagtagagatcggaattttgagaaaatacggatcaggatcgggattacggactaggcacacatacggatttacggaccaaaaatccggaaaatccgtactccgtaaaaatccgtatccaggaaaaatacggcggatccgtatacggatacggattttttataaatttttt

SEQ ID NO: 1731 - DNA, 6161 bp, Heterodera glycines
tcgataaaaactgatttaattaatacaaaccttaaatatttaaagctaaaaacattgtaataaatttattataaattctaagcaacaaaaaatgaaaaaaacaactcgcaataaattggcaacaaatggaagtgagggtaaatatttcagtatttgtaattaatttccggaagtgctttgtttaaaaaaattaacatttcggctgtttccggtttcaactaatacactcagcttttccttcagataatttattaaataaacctatttgccaaattagtgaattcacattttaaatttaaatattttgtgcaaaaaatagaaaaaatatcaatgaccattcccttacactttcaattttttaaatataaaaaaaattatttatgttttggcaaaatgactgcaaaaatttaaaaaatttacacatttgtaccttaaaaaatgtcagataaaaaaatccgtaatccgtgtcttaatttatacggatcgggatcaggattacggacttgacatcgatacggattaaaaaatccgtatcggccgaaaaaaatacggattacggactacggatccgtaaaaatccgtatacggatcttgtccgtatccgatctctactttttaggctctaaaaataaaaacctagaaaataggcgctaataactcgaaaagtagcttaacaaccaccaaaaaaaaaaacttgtttttcgagagtttcaggccactggattttaggaaaaaataagctagaacctgaaaattgcatcgctaatgatcacttttgcttacttttttatttttaaaaatataaatgttttttatgctgattttttgtcagccaaatgatgattttgaaaaattgcatctctggcagccctgctagcgctgtcaagacgccgatgcgttgaaatgccgattaagctaacttctcggaataccgaccattttaaaaccgtacattcagtctccgtaaatatcaaaaacagtaatttttgaaacatataaaaaattaaatttatttattttgcatgaaaatgttcgcacaaaaaaattcagaatatggaatttaccacaaataaattcttagaaaattaaaaattattgaaaaagtcagagacttgatgaaaagccatagacaaaatcaattattttacaaatctgagctcagattagcgaccagcgcattttttagcctagaaaatagtaccttaaatttttacatttatttttcgcagaaacaacaaaactttaccattgcccttcatttggacatggccaattaattattaattaattgaacattctcttgttatcttaaactggttaaaccgaattcccttaaccttcaaaaaaaaatattaaaaattgctttggaattaaaaaaagattaattgaggggggcaaaatttgtgcaacaaatctttctcggtaaattggcaccgattcagccaatcacaaaatcaaaatcaaacaccatccatcatataacaaaaatggaaaaaatgataaagaaaaaagcaatacacaaagataaaaaaaattgtacacttaagaaaggaaccaaggtttaatacgatacaaaaatatgtaattaggggactcatttggtcacaatgtttggtattgagaaatgaatggcttggtcgagattatgggggatggtaatggaggcaattagcaaatgaaagttaatgggtttcggcgggttggagcaagtacaaaaaataaaaaataatgagacgattagatttttatcttgtcacgtcctccatacccaacttatccattatccagctgttccataccaaactcatccgcagcatggcatttgtttggccataaaaagaaactcattatttctcttatcaattaaatgattaaaaagaaagaattgacatcattatcattaaatacaattcaaaaaaagaaaaaaatattttattaattaaactaaacccaaaatacaaacaaattaaagacatttaatgaaaatgaaagaaaaataattcgattttgtgtggggggcaaaaactgaacagaacagagtttaatgtatgtaaagaaatcgaacgcgaaatgagaattgaaatgaaatgaaatgaaatgaaatgttcaaattgctttgaaaataaaatacaatagaaaaaattgaagacaaaaaaagggaataagaaaaacgatcggaatgaatggaaagaatgaaaaaatggaattaatatggggggagggcaattcagcggacggattggacaaataatgtaaatgtttgtcgccgacgacagaaaatggaaatttttgttctaagcgatggtagagtggtctgacaaaaaggttctggaatgttccgttcccgacttttagagttccaacattaaatatttgacacgactgagagcggattgggggggagagatattccgggaaatttatgccgaaaattaggcaaaaaaccgaacaccaaccattaaaactttttgccggaatttcggaattattgtgccaatttaaaaaaatctattactattttaacagaaaaaaaaggtttaaatgacaaaaaattaaagctgtttttgtgcaaaaagcaattcaaaaacagttgggatttgaagagcagctagcgctttttgtggcggtcatttcgcggccgacgacgagcggcggaagggacgaagcaaatgggggaagaggaagaagatttagaggaggagatcaactgggaacatttaatgacggaattttgatcgggatgaacccattttttgaggttcggcggaaggatgacgatgacacggagtgggagcagcacaattcgatcggggattttgatcgggcttttttgttggaggcggggcggaataaaatgaaaatccttgggggaggagggcgggtgtaattcgattgacgaggagggatttatttgatcggaagggagggggcgggcataaatcggatcggattgaccaacacaaaacgcgcacacactgtgcagagacggaccgcgaccgatccatacggcgacccttgacgatgagtcgtcgtgaattgttccatcgacaaatatgggcgcgctgaggattgaccgacccaaaaaaagcgccatcaaatttgggataagtgtgggcagacgggcgaccgaccaatcgcgacgaaatgagtggtcatttggagggaggccgagtcagtacccggctgattcattgtggcaattttgtttgggatgccaccatgattgtggtttcatgatgctttgcttgcggtgctctctgatcagaacccaaaggattcaggcaaaatttgtgtataatccctggcactcttttttttggatttccaaaaaccttttccctcccatctcaaaaagggccatttaatgaattgaaataattcattcctcgccggcgggaaggggggggggagagaatgaattctactcctcctccttcggcggttgctgcagatgaatgctttttcttatgcttctccttatgctgcctccccatctgctgttgggggaacggcgacggatcggcggcggacggatcgtccgtcggttggtcgtcccctccggggcactgcttgcgtgcgtgtgcgctgcagttgtatgccccccaaattttgtctctccgccttcccgcactccattgctcccaccgtctctctctctctcactctctcacctctttcctcaaccgcactttcatatttaggaattttctttaaactctctttttatcttaccgccttcccgctctctttacacccaatgtactcttgcaatcgctctcactgtgtcagcatgtcctttgtcctctctctctctcactgtgttcccgtcaactcctcacatcctctctcaatgatctctctcaatacgaggatatcttacaccttcaattacacacagactctctctctctctctcgctcttctctatccctctctcactgtcttccccggatttacactctctccaccacacttcgtggccctcccggctctcctcccataccacactctctcatccgcatgattgtcgatgatccccttgatgctgcaggtggttgcttggttggggtgagacccgcggaatgagagaacgaaatgctggggaggaatggatgaagaagaagaatttggggctctccgttggggtgactgttgtacacatcatcatcatcgtcatcatcagggcggggcgaactccgtggccaatttttgcatttaattggccctaaaattagtttcggaggaaacgcaaattgcgcaacatttttgtactttttaaaatgcgtcgccgcccgtccgtctttttctctgcgcttgcactgctcctctcgctgtctgcccatggcgccggtgctgaacactccgccttctacgacttgctcggcgtgccaacggacgctgacctgcgctccattcgacgcgcgttcaagcgcttggcgctggagaagcatccggacaaaaatcaggtggcaaaaaattaattaattaaatatttttaaaactatttttcatattttcgcccatttttaaaattttgaatttcctttaaaaataccttaactaattcgttaaattcttttttgacccggcgcacctcctaaccaaaatttaatcaacaaattatcaaaaagtttcattttggtgcaaaatttgttagcaaatctcattaaaagtgaggaatgtaacacttaataaatttatgcattttatacaatttcagtcgaaaaaaacattgtcttttgcgaccatttttaagcatggtgtccctattttgaactgtgatcggtgatcgtatctttgacctttttaaaaatatttttttccttaagaaatatgatcaaaaaattctcagggattttgatcaaatctgaatttaaaaattgccatttattcttaactaaaaatagaaacagcgcaataattttgctctgagctgttcttttcggtacagacaaaatttttaccaaattggaattacaaaaataaatgtccctgatttttgttctaaactccgatttatttataatcccgcatttgtctaaaaaatgtattggatttcttcatcattttccacgctttgttcttccaaaatatgaattcaagtgacttttgccgtttgtttttaacctatggcctcaaaattcgttaaattctcccctttcgtatgactcattttttgatttctgcttttttgagtcaaaattttcaacaaatttttctcttgtccaagaatgacccggaggcacatgacaattttgtgcgcataaatcgggcctacgaagtgctgaaggacgaggagttgcggaagagatacgaccaatttggggagaaagggttggaggagggaaacaacgccgcggggggctgggcacaacgccaacgccaacagcagcagtgggagtcgtgggagttttacaatgacaaatttggtgcaaaaaaacataattactataaattaaagttaatttaggcaataattattattcctgtaattagaccacaagaaaaatttgattaactatattacaattagtgaattaaaaagtgttcctttttgaaaattattaatttagtaaatcaattcttattttataaaaacattaacaggaaaataaattaaatttctgaaaagaataacatttatatattttttttaattaaaattcttttaatcaaattaaaatgcttgctttaccgtatacttttttaaaataaatttaagatttgaattaataaatgagtttttttaaaattaattatccaatttttgcaggaatttatgacgatgaccaggaaattgtcaccttgtccaggtaaatatgtgcgaggaacatagctttttatccacggtaatgggatcccgaccggagggattggtcccggccggaacccggaagcccggctgtttagacccccccccccctgattttgggtcccaattattatggcccctgttttttcagagcccgtttttggtcccgacttacccaagattattctgatccccgtttttcagacgcctttttaattcgactttttcaaaaatctttccgttttaattaaattttttaattttaggagtgaattggaggaagaagtgttcgaatcaggcgaagttgactctaataaaaagcattttgcctcgttaccatcactttttt

SEQ ID NO: 1732 - DNA, 5748 bp, Heterodera glycines
  misc_feature (3930)..(3930): n is a, c, g, or t
  misc_feature (5722)..(5722): n is a, c, g, or t
cattttcagcaacttttttccacggttcgcgcgacttggctcactttccgcttttttgctctccaatttgctttctcagcctctccgatcgctcgaacaattaccagaaaattggcgcccattgcttgtcgaattgaacgacggcgaaagtgaggggatggaggagcaggaaaggtgggcaaaatgccaaaaaagggcggaaaaatggccaaaaaaattagagaccggaaatttcaaatttgcggatcctgttgcacaggattggaattcaaaattttttacgggacatgcaggatccggcaaaaaaattccaactgattcaaagaaaaaatctatagtatttaaaagaccacttataacgtctatttttaaaaaaaatataggtaaagttcaggaaattgttgtgttttgctaacacacaaacaagataaatttattaaatgaataaacaataaaattagaatcacaaaataataataaaataacgacggagtcaaattagagtgtccgaaaataaacaccgaaatgtaaaataacacaaatgcaaagaatgagtcgatgggagaggacccatcaacaaataactaatcaataaaagtattcgtgtcgaaacttaataatattaaatatcaacacatccaacttctccctcttttggaaagaccgtccgtggcaattagccgggcgaatagcgaattggcttcttgcgctgtcgctgcggacgaggagatttgactggttcgggtgtgcggtcacggacaggagtttgatcacggacaggtgtctgatcaatttgaattggcgccattggaggaattggttgttgcggagcggcttgaatctgatcggacacaatcttacttgaaatgtaaggggaaaatgaacgcatttgattgacgtgacgcgttacggtaattccaaggattggaatttcgattttccaaatcaaaccactaccactcacaattttaccttccaaccatgatggtttaccactcctaccataattcaagactaagactgagtctcctgaattgaatgaacggctttttgtgccatgatgttggttgtactgctgtgacatcctcgattggtactgtccacgttggttgttgttctcgttcggcgtgtgctgtctcggttcaagcattgacaagggcgtgcggagtgttctttccaaaaataattctgcgggggaaaaaccattcaaaattggactcggcgaggaccggtacgcaaacaaaaattccgaaatccattgttgatttttggattttgcgtttttctttgcctgccgtttgaatgtgtccaccatccgctcggcttgatcattacagtgcggctgatacggcggggagaacttgtgcttaatgcctttaagcctgcaaaagtccttaaattcatgggaagtaaatggtggtccgttgtcagacactatttcctttggggcaccataccgatgaaataccaaatttaatgcttcgattgtgcccttggctgttgtcgtgcgcatctgcatcacttcaggccattttgaaagtgcatccacgaggatgaggtaaatgtttccaccggcacatgggcctgcaaaatcaatatggacacgtccaaaaacttcaccaggaattggccatggtcgaagtggcgctttcggcggcattttgacggcgaattgacattccgcacaatgctttaccattgcctcaatgtcactgtcaagaccgggccaaaagacatggttgcgagccagcgccttcattcgcacaatgccaggatgagcaaaatgcaacgtcttgagtacacgttaacgaagcggcgcaggaacaatgactcggtttcctgtcaaaattgaaccgcccacaagggtgagcgtatcacgtctcgaatagaaaggcattaattcattagctgggcatttgtttggccacccggaacgtacgaattatgccacctcctgcaacaaatcgtccgaagtcgtcaattcgctcacttcttttgcatcgactggcagctgctccaagttgacaagaagagcatattcgacttcttcagtgctgtccacgtcgtccgatgtgtgggcgacaatgacttcttcgtctgtccggtgctcagaaatcagtcgagacaaaacgtcggcctgtccaaaatttgcagatttaacatattttattgtaaaatcataattggacaaaattagggcccaacgctgcaatcgggaagccgtgtagatcgggatcccatttttattaccgaatatagccaagagaggcttatgatccgttaatagagtaaaattacgaccgtaaatcatcctgtgaaatttttgcacagcgaagatcaaagacaacgcttctcgttcaatttgggcgtaatttcgttcagcgggagtgagcgttcggctggcgtggtcgatgacgcgctccactccgtttggaaacacatggctgatcgtggctccgattccactttggcttgcgtccgcagcgacaatgatcggcaaactaggatcatactgcgtcagcaacaaatccgattgaagaacctgtttggcctgatcaaaagccttctgctgatcaggaccccaaaaccaaggagtgtccttcttcaagagcagatccaaaggtgcacgcaaatcgcgcatttccttgacaaccgaccgtaatagttgagtgcacccaggaaagagcgcaaagtgccaatgtcatgcggtgacggcatattacggatggcatcggatcgagcgggatcgggcttcagaccatcggacgagacaacatgtccgagaaacttcaattcagccttcaaaaagtggcacttgtccaattgaactcgaaatccatagtcctgaattcgggaaaagagttcaatgagagcagcaacatgctgcgagtgatcggccgaagcaatgatgatgtcgtccaaataggcaaacacgcctggaataccggacgtcaattggtccatcgctttctgaaaaatagacggggccaattttatgccaaaaggaagacgctgatattgaaaaagtccgcggtgcgtgttcatgccgactaactgctttgaactttcgtccagttcgacctgcagataagcatcacgcaaatcaagctgcgaaaacactttggctccacgcagagcatgaaaaatgtcttcggtccgcggaaggggatgcctgttcaactccagcgcatcgtttagtcgcgtagaaaagtcaatgcaaatccgcacattaccacttttcttacgaactgccaaaacgggagctgcccagcgcgaaaaatcaatgggcttcagcactcccgagtccaaaagtcggtccaattcttcgtcgactgctgcttggactccatgcggcacaggtcgcgcacggcagaacactggcttcacattttgcttcaaatgcagcgtggccttcgtcttcacacaatgtccgaggccaggttgaaacaccttcgggaaggaagccttgatttgcccttccaatttgaccggatcatttgttggttgcacactgttgacaatgagcgactgttgctccaaagtcgtggcaattggctgttgggtggcacgctcgaaagggatgatccaatccaatcccataatgatcggcgcttcggtgtctgccactgaaagttcaagccgcattgtgactcctctgaacagaacgtcacacttgaaacttcccaacaacttcaatttgtggcccgaaaaggaacccactaatttaccaactttttccaacctcggttcgcccaaacgctcgaaaaagctgttggctcaacaattttgacgctaacttttttgaaactcattaaaatttttagaattttttgcataataatataaatatccattctttggtcgcaccattgctacactgaaattataagagaaatacatgtgattgaacacgtggatgagctgaattgnggcaatatttctcgtgtgcccttgctttcgacatccaaaacatttgacgtccacaggaataaacagtctcgcaccgcgtgtgcttgaccacaccgcttacacttttgactaactggtgcctgttgatatttgcctgtaaatgttttggtaacatttgaatttcccgaatttggttggctaggacgaaaattgttgggtttggaatgcttttttgaagacccatccccaagtttttgtggtcgggttgaaattgcatggacttggcctggatttgcgagcgcagcggacgagtttttgagcgacaggatggcgcggcactcctcgagaagcttttccagcttaatgtcctgaggcggcattgcggctcttgccttttccaactgccggaggcactcctgccgcaagtccttatgtgcgtctgtcaaacctgaaatgaagatcatgcacttgacttcctctttcgacagcgtcatttcggctcgctcgcaacgggcgttgacaatcgcgccaaagtccagcacgttttgagtcggcgcacatgccagctgaaaacactcaaaacggcgcacaaaaattgattttgtgtctgaaaacagagttttcagtttgccgatgcattcctggaaagtcagatcagacgctttttctggaagaatttgttgttcaaaacgaatgtaatccgggggcgacaactttcccaagaccaaccgcactttcatgtcgtcgtccagcacttgaccgtccttctcaatgaagggaccgaagcgttcgtaccacaaggcaaacgtcgaattggcttcggggtcatattcgaaatcgggaatttgaccgtttattttagaaaacaggtcagaattgttggatggcacatttttagacaatatcgttgataacaaatcggtgaattgtttttgttgtgcgtccaaaatagcttttagctcctcctttgtcgtcattttaccagatcagacagaagatgaatgatagatgagacaaagataaagtttaaaagcttgccactagcaaaatttggcaaaaaccgaatccacacttagctttgctcagtcaaaatactgagaaactcttcgggctacgacagatggggaataacttgtttgttatgggttatgtgagggggccgtcagagtcgctttttggtgaattcacggttaagcgcaaaaatgcacgggcgtcgccagttgttgtgttttgctaacacacaaacaagataaatttattaaatgaataaacaataaaattagaatcacaaaataataataaaataacgacggagtcaaattagagagtccgaaaataaacaccgaaatgtaaaataacacaaatgcaaagaatgagtcgatgggagaggacccatcaacaaataactaatcaataaaagtattcgtgtcgaaacttaataatattaaatatcaacacatccaacaggactttcgcagacgttgataacggacgacccggttgtcttcagagagcacttggacaaccgatcaatcgatgtcactgccattgatgagctcgatgaggagcacatcctccttagctagaaaataagaaagagtgggttgaggagcacgactgctccaacataggtatggatcaataaattagagcaaatatataatataaaattttttcactgatatccctgtggacgacctcggcggcacggctcctgctcctaaaggcaatgcagaaggtggtgcgtacgcctgtaagcggactactatacactggtaaaattattattattattatatggcgaataaaaaantttaacatttttcagacactgattca

SEQ ID NO: 1733 - DNA, 1547 bp, Heterodera glycines
tcattccgccccaatgagtcacagcttaaggtttttgtctcttatttttagaacgttcattacagtgttgtttttgtagaaagaagacatgaaaagtctgatagaactgatcgcccgcagacagccccatttagtggtcatcggaggcgaggacattgacgcgttacgcttaaccaccgatgttcggttgagtataaacgaggctgcccaacagaacttgaaaattcctttgcaactttccgtggaaattgcaaattccgacgccgcgagagtttacatgaacagtcgcatggcaatggtgtcgattagccaattaaaacatttggtctgaaagcaaattattgttttagcaagaatttccgaagtatccgccattgctcctcaaagcaatatcgctggccagatttacgcttgatccgttgatcgaaatttgccatctttgcaacgcggacgacgacattatgtacatgaagttccatccgctgcagaatgaagttccaaagcaagaacttcttttcgcgcttcaagttgagtgcatcaaccgtgttaacgaggttgaaaatatataataaattccattcacaaaatcttgaaattattattattattaggttggtgttgatatcaatcgctgtttggagtttccatacaccgccggcctcttacaattcgtgtgcggtcttggaccccgaaaagcatctcatttgttgaagattctaaaacaaaacgaaaacttattggaaagtcggacaaaattggttacatattgtcggatgggaccaaaggtgttcatgaacgcagcaggatttattaaaattgacacaacgaaagtggctgataggacggactcttatgtcgagtgagtccgtaatttcattattgtttagctttaaaagttttccgttaagaatgcctttgttaaatttagagttctggatggttctcgtgttcaccccgaaacctatgaatgggcaagaaaaatggcagtagacgccctcgaattagacgagccatctgaccaaacaatcgcaatcgaagaaattttgaaggcaccggaaagactcaaagaattggacctggacgcatttgcagaggaattgggcagacaggtctgccgaaccgaattctttgttagttagaagaaataaaaatgtttagggatttggaaacaaaagtatcactttgtacgacattcgggctgaactgaattaccggtacaaagaccttcgaaagcctcatcaggcgccgactggcgaagaattggcacaaatcttgctcaaggaggactgcagcaatttgcaaagtttgttttgacgagaaccaaaaaaacgatatgcaccccatgaaatgatagtcggcttttaatacttaagccggaaaaagtagtcaccacggaaggtttctagccacaattttattgacaaagagaatttatggaattgagccaagtgattttaagataagctcgtccatgggcaatggattaatgttttgtaccgacgattgaatgatcaggatgttgagaactcgcaatcaaaaaataacaa

SEQ ID NO: 1734 - DNA, 7002 bp, Heterodera glycines
  misc_feature (66)..(66): n is a, c, g, or t
  misc_feature (87)..(87): n is a, c, g, or t
aaagttcgacccgtatttgaccacgtgcaaatggatctgttcaaaagcgaagaaatcaaaaaggcncaaaaggacgatgaaaacaanaatcgaagaattttccaatatgaatattttgcaaattatacggatgagaaggcagcggctgcaattcgccggatgaaacaggtgttattttcaaattaaaaataatcctttaaaattttaaagggcggaaaaatcatttggccttcagaaaaatctccgaatattttgatgatcgcctggaaagtcactaatgacattcatcaagtgataaaagttgaggagaaggagaagcgacgtgttttcgaaattggcaaaaaactgttgatgaacggagaggtcggagcagggagagagggggggggggtgacacggggtaaagtcaggcggtgctatgactccggtttggagatgtaacgccaaatacgaccttttttgttcttaggacagccaaaaaaaattccgctttgttttaaaacaaaattccaaagaagagaggcttccgattatgccgggtcacttaaatttatagtcatccctcggggtgtctgaatttctcaaattgatacctgctaattgtaagatgactggattcattatttatttgtgttcaggttttcgaggacgtagatgagattgttacacgatgcattgaaccgatggccaattttgcagtcgatattttgcgctatcgttacttcatggagtcgggttacgcccaggaggtggttgacggttacctgcgagatcaaaagcgcgctgctcctcaacggatcccgtaagtcaatttaaacactatttcttatggttttgcctttgtcagttacgttatcactgccctccgggaaaggcccgggcgttttatgctttcttatttggccggttcaacaccacggaacgaatcaatgagcgtgactccggatgggatcaaattccgtggccatacatttgcttctacggaggactgtgtcaactggtttaaagtgagcaaaatttaacaaatacacaacacattcattcgttcatttttgaatttcagaatgaattcgctcgtcggcagcaagagatactgcaccaacaacgatagttttgcattttatttatttatttattcagaagaaataaaaatatccaacgaaggggtgaccacttacacgttagattttagtaaagtaatatcaagtccaaggagctcttttacagactaaatttttgtttaactcaatccatttatttattcgttttttgaaactgtcaacagatggagcatctgttatatctttgttgagtttagaccatattaaggccgttctgttgataaaagaatttgaagttttactggattgtggttttaacacaactttacgtctaagattgtaagggatgtgaccagaaaattgggggaatatgtcttttttaagatgagtgagaccattgatgattttgaatgcctgaactaaatcaattgtttttctcctttcttctaaagtttgaataaatcaagtctttgttcgtaaggtatatacggaagcctacatttaaataaagcaatttttgtaaaatatttttggcatctttccaatttatttatatcttttttgtatgtcggattccaaatttcgggtgcatattctaaaagaggacgaatgtatgtcttgaatactttggtccaaatacgtatagagcgggtttttaaaattttggcaatattgcgaatccttaaataagcagctttaataattttagtataatgatttgaaaatcttaatttattatcaattaaaatgcctaaatcactaatagattcaacctcattaataatattgttgaaaaatttatattgttgttttgaattatttttgccgagaaataatataaatgttttattttgggagatgtttaaaccaaatgcattagcccattttccaatattgtctaaagcaacatttaatttgcttctttcatcacgagttttgtaagaaacataaattttgacatcatcagcaaaaagcttgatgctaactcccggagggattacctgcgggaggtcattaatgtatattaaaaataacagagggccaagaacagaaccctgtggaacaccagactgaatcggatataaattagaaaatttgttgttaattttaactctgtaaaatctatcctttaaaaattcagataaccaacttagcagttttcccctaatgccaatgttatgaagtttatttattaaaatattaataggaagggaatcaaaagctttccgaaagtccacatagatacagtcaatatttttcttaccgtatatgctgtcgtaccaatcttctaatactgtaattagttgagtattagcagatcggtgtttaacaaaaccgaactgatgttcggatattaaattattcagatgaaggaagttataaatgctttttgcaattattttttccataactctacatagacagcaagtaagagaaatgggtctgtaattatgtggatcatttcggtcaccttttttaaagagaggtataacaatagattttttttcaggaattttgcctgtgtccattgatattctgaaaagttcggaaattacaggagaaagagtaaggtggcaattacgtaagattctaaaggaaatttcatcgggggatgtggattctcgattcgataaattttttaaaattttagaaatttcatcggcattaaattcaacatcagaaatagatggttcattgggattggaaggacaactgctaatttgcggaacatctgaatttgaaaaggattcttggaaaatttttgcaaaagtttctgcttttaaataatcatcaaaaataatttggttctcgtaactaagagagtggatttgttcaaaattttttgtaaatttatttatatatttgtagatagcattttttcctttattcagaaaatttttttcatttttagtaacaaagttatttatttgaatttttatatgtaatgaaatgctatcatacaaatgcatatatttatcacggtttattttttgtagtttataaagtctggctttttccttaattgacagtttaagactcaatgggtaattaggctttctggatttttgaccgacagtgattttaggcaagtataattctacatattctctaaaaagaaggtaaaaatgattaaacttatcttcaatggtaaatttttgtagtaatttgtagggtaaaattgaagataagtttaaatttagtagattaagtttagtagaattataattgcgtactgtaaatgtatttgccttactcttattctgaggaaatgacaatgaaaaattagtggaaagatgatcagaactaaaaatgtcctcaattaaaacattattaacaaaatcaggtttagaagagagaatcagatcaagccaagcactaccacgagtgggtccattagtcataaggaataagccatacttattaaaaaattcacaaaaaatatttcctttttccgacttagcataaggcgttccactggtccaagttatgtcctttgcatttaggttaaagtctcccattaatataaaatcttcttcaaaatagttaccaatgaggttcagaatcttttttgtgaaattagcagaagtgttcggtggtctgtaaaagtaatgctattcttaatttttttgctccatttatctgaataatttggatttcacaattgaatttagagcaggataagacagaaaaagaatttacgctcgtttttgtcaaaatcattactccaccaccattttttccgcttctgctagcttcatatattttgtaattgttagtaataaatggttggaaaggtattttttcttttgcccacgtttcagttacaaaaactaattcaaaatcttttagggctataatcgcagtaaattcgttaagcttattatttagggatcgcatattgataaatgttgagtataaaaaattttgttttttatttagtaaagttttcgaattttctatggggtgttcaattttctatatttagtttgtaaaagagctaaattaaggttattgcctcgtgagtggtcacccaaaacacattaagatttgttatgacaaatacatttaaaattgaggtcagatttaaaggcgggaatgtcgtcgcgggcaagcacatgccccgcatagacaatataatcacaggatgggtcattttcacgttgagatttacacagtgtaatgagtcgggcacggtcaatgagatcacttttagatagggaggggcgcaacaaaactttggaaaatttgttaacatgctaaaaaataatctatttatgctaattaataataaacatattttttaaccggattttgtatataattttcttttttctttattaattattgtgcaaattaatttttaaaaattaaaagtcaacacatgctaaaaaataatctatttatgctaattaataataaacatattttttaaccgattttgtatataattttcttttttctttattaattattgtgcaaattaatttttaaaaattaaaagtcaacatatgctaaaaaataatctatttatgctaattaataataaacatattttttaaccgattttgtatataattttcttttttctttattaattattgtgcaaattaatttttaaaattaaaagtcaacacatgctaaaaaataatctatttatgctaattaataataaacatattttttaaccaattttgtatataattttcttttttctttattaattattgtgctaattaatttttaaaaattaaaagtcaacacagctaaaaaataatctattaatgctaattaataataaacatattttttaaccgattttgtatataattttcttttttctttattaattattgtgcaaattaatttttaaaaattaaaagtcaacacatgctaaaaaataatctatttatgctaattaataataaacatattttttaaccgattttgtatataattttcttttttctttattaattattgtgcaaattaatttttaaaaattaaaagtcaacacatgctaaaaaataatctatttatgctaattaataataaacatattttttaaccgattttctatataattttcttttttctttattaattattgtgcaaattaatttttaaaattaaaagtcaacacatgctaaaaaataatctattaatgctaattatataataaacatattttttaaccgaattttgtatataattttcatgttggaagtactataatattgttctaaatcatttttgtaacttaacaaagtggcacagcggggggcatattgttaccaaaaataagggggggtggggggggggggaaggcgaacacaacaaaataatacaaaggcataatgccaaagatttccccaccttatagttagggctgggatttttatgttttaacatattttttttgcggcttagttatggcgagagaagcccaaaaatagcattttctccgaacaatttttgatttggagcgacttataaaaacataaaaacacatattttggcgttttcgcacataaaaacatatcgcacatatttcggagtttcgcacatattttgcacatattttggcatttttgaaaaaaatatctaagaaaaacacaaaaaattcaaaaatgcacccctaaaaatcaactttcttgccatttttataggctctttcaaaattttctttatttatttcgtgtaccgaaaatcgaattcttcattaattcgttactggatatcgaagtttcttgctggcacttactcaactgatggaaaaaaatctttaaaaacaatttatcaaaaaaggactaattttacccccaaacacctccaaatgttttttatttgcaattgtgcgggcgaaaatgataaagaatgagttttttggaatttttatgcaaaaataccattggtttttccaatttttagcacatattttcgcacatattttggcattttttagcacatattttattacatatttcaggatttttagcacataaaaatcccagccctagtaattacaatatacaatatataacgtatttgaaaatgcgccatcctttttcttaattctttcggatatgtataacaataccatatgtaaattttttcaaacctttcccaatgaaaaatatttttgttatataaattccggactttacatgtacaaatttattgcacacatcctgctgaaactgctcgcaaatgcggcggtggtgtgaaagggtcaaaagcgcatacaaaatttgcacaacccataaaaccgaaatgtgtttgaaatggggctgccgtcgccgccgccgcgacgtccaaatggaaatttaagtgcgttttgtgagtgcgcggcgcatcccccgctacttttggcgctccgccgcggtgtccggacacgcccaaggggcggtggcgggccgaaaaagtgggacgacggacggacgaacggacggaaagcgcagcaaattaggcggcaaagtttatagccgacttgcataaaaagcgacaatccatcaagccgatgaggggtttaattttttatcgaaatgaacaacgataatcacccaataaaagtgggacggatgccgaaaacgaatgggatggaagcgaatttaagggctgtctgatctgagcgcatcagtctatgtgggcactgtcctgtctgtcatcaaaatacaaaattcaaaactgcatcgaatttctaattcaaaaatgccgttaatttcggcatggattttttaccaacaatttatgtacaaattttatttttgaattttgactaaatttcttctttttgttattttcaaataatttgttaatccgatatcccatcattaaaagcacacttttgaaaatgcaccccaaactgttcctcgtcactttcgctgttctgcttgcgcttctgtcactggccaatgccattggcttccctccggaggtggag

SEQ ID NO: 1735 - DNA, 7170 bp, Heterodera glycines
gtgtggtgacagggcggtggcattgagcgcttaaatgccatccagcggggctcagagggacagaaatggaagcaattgcgacgaatgaaaactcaattaacttattaaattaaaaagaaaaatttatacgatattttaattactaaaatggttttaactggataatcaaacttaaaaagcagaaacagaaattaaacacaacttccaaagcttcgttatttgtatttcttgcatattaaatgataaaattaattaattaattttttttttttttggagcgagtattaatgacaaactgacacataaatccggtttgaccaactctcttgtgttcatccgctgctaattgctcatttttttcccgacaatgaagatgcgcaatgggttttttttgcagaatcccacccaaatcttcgcagatttttgctgcaacttttttttggcgaattgccgaaggcaatttgttccgctaattgcttttatccttcggaaatgcgtgcaaaaagcaaattagccaagatgagcagaaagtaaataaaggagatttgcgaattaatcactggatgattcctgcattcgtctcactgcccaattcgatgacagatgcgtcggcacttttgatggatggactggacgacttattcgtcttcgggtaatcgcctttttgcggaacagcgccgcgtcattattttactaatgagcagcgtaattgctattgtcatatcatattgttgggtttttgtctcgtaaaaggagcacgatcagcagaccgaaacaggaaatggtcggagggatctatagctcaaaattcgggggatttgatggatgacgtttgagcggatgaaacatgccttaatgttagtgaaacttcaatttgatgagaatcaattaaaaatgatgaaagtaataaagattggggcgtgaatcgtcggcccctaaaaaatgactgtccattgaatttgattgattatttgggttgaatgagcgctaaaaaacaaaaaattaaaaatgaagaagcaatgctcaacttcaaaactgcttataaagcacggctagagcaagcacaaattatcaaacttcgcttttccatcaaattcaaaagtcgccttcgtttgtccgccatgactcgcttcaccaattgtctgatcactttggcttttctgctgatcacgatcgtttccaccattgatggctttggctttccaagtggtggtagcggctgtgggtgcggctgcagcggtggaggcggcggcggaggagggcacggcggatgctgtggaggaagtggaggcggtggacacggtcgcaggaagcgcgatacggacgcggttcaaccacattacatggcggacgaaacgccatgcccacaggcggcgtggaaagccattcttgaggaggtcatacagtcgtaaatcattcgtagggcaactaatgccgccaatttacagtcgattagcccggaagatgccattgtctctgtgggtgccatccaaactgctttgtaccgccgctataccaacgagcagaagttcctggtcacctgctcggcagccgacgtggccaaaaacggcacagcactggcaaccaataaagtgcacttcagttcatccggcaatggttactgtaacatggtcaaagagcgcatttggtgccaggcggtcgcattgcactcatgaacggattcgttgcgaaagattttcaaaattaataattttaaaatgtgagcaatacgtttttgtctagttagtgatcttctctttgtatgtcgcagtgtattattatattatgtatattattattatgtatttagttaaaattacttttaaaatttgataattaatatacattcccttttgttaccattttgatgctaattaaatctttgaaaaatgcatgtatttattacacgaaagttagagatgcttacaaattgattaattgctttgataatgcgaagattgagcattaataaataattatttggtgttgagcctgatgagaaaaaccagatcaaaaaaagacgattgataggtgcgtcagcgatataaaagcaattatgctatcaattaactgtcactttttcacagagcaattactcaccagtgaatttcagctttatacattcccgcatccaaactaacagcaaatatgtctcaacttttaaactgtttaattgcgctgaccattctgtcagttttggtggccatgacagatgccattggcatgccaatgcaacaatgctgttgtcccatgcagcaacagtcatgctgtgggggtggaggaggcggaggtggcggttgctgtggccggaagaagcgtgaagcgacggcattggaagcagttcagccccacttcaaatcggacgaaacgccgtgcccacagacagagtggagacaagtcattgacgaggttggcaaactgatcacttatccaatcattggcatatccctaattgcttgctaattttgtagagcatccgcaccgacgatgccattggctcggtcagtgccattcaaactgcgctgtttcgtcgctatgccgaccagaagttcctggtcacctgctcggcagctgatgaggccaaaactggcaccaacaaagtgcacttcagctcatccggcgacggttactgtaacttggtcaaagaacgcatttggtgccaggcggtcgcgctgagcgcgtgaaaaggattaatccgatgaattttttcttagtcaaagttcaaaaaaaaatagattccattttgtaactgtgcaataacattttaattttcttatataaatttatttagtgtttaataatttttatttttctattgaactattatttggattcataactttgtgcctcacaaattagaaataggtaaatcatttttcaggcaaaaattgacacactttttttcaagagaaacaattttttggagtgcctaaagttttttatattagcttacaaaacccaaaaaattgatataatgcgttttttctgctataatttctgcctaatagagaaatctcaagctcttttgactagggttcggaccccgcccccgtcacccccgcacccgccgggggcgggacaggttttttggcctcacccccgtccccgcgactctgaccccgcccccgcgaccttcgcccccgcgagggcgaaaatacacccctaagaatggcatattcgtgggataaaatgcaaaaatttatacaattttgaattttttaaccatctttgacaatttttatgaaaataaagaaatttgaatttccaagttattttggtttagtggttagtgcttcacaactaacagtattttttattatgggttcaataccggttgacgttttctttttatctgattaatacatggtttctttatattcttatttttaagatatgttctgatttgggggcgtattttcacccaaaagagggaaatttctgaaaatttggctaatttctaacaaaattcataaaaaaaaattcctccggcggcgcctatcggcaccaccggcccccaaaaacttatttctttcatagaaaattgtctcaaaatctaaaaatttggtcattttttggtgaaatcttccaattttgcttgtgcaaacatgaaaaaaaaaatttaccggaaaaatcttaatttttggtgaatatctgttagaaataaatttaaaattcttttttgtgaaattttttggaattaatttaaatcaaacccccgcccccacccccgcgactctgacccccgccatcccccgcccccgcaaaaagccacccccgcccaagggggtccgaaccctagttgggccgaggtttcgcttttcgcatttcgcctttcgcattattcgcattttttggcgtttcgcatttcgcttttcgcatttcgctttttggcgcgaaaagcgacttttacacccctaagaattggataaaattcccataaaatttttcaaaattttacctataaattggctaattttcagtgaaaaactgtttataaatgatcaaaatttccaatttttttccccggcggcgcctatcggcaccgccgcgcccccaaaactcctattttttcttagaaaatggcccaaaatcgcaaaatttggtaatttgatgaaaaactgttctcaacggcgcgccaaaactcttatttctccttagaaaaattatataaaaatcacaaaatttgatcattttttagtgaaaatctgtcaacaaattttaatcaaattttcaaaaattttcccggcggcgcctgccccctcttaccaaaaagtttttttggaaaaagcgcgcctcaaaaaagcgttttattgatttttaaatttggaataaaattttaaaaaatgatttttgctttatgattttaactattaaaaagttgtagaaaaaatttcgcttttagcatttcgcttttcgcattttcgcatattttggcttttcgcatttcgctttttttttcatttcgcgcttttcgcatttcgctttttatttttcaatttggcccatccctggtccgaaccctagtttaaagatgttaaaatagagctcgcattttgaggcatatgcctttttttctgcgcacctgtttcgatatattaagcataaataacgcattttccacttggtttgaggcttctacgttgacttttattatgccttttttttgcctttttcgggattttcgtgccttaaatgcctttttggcattttgccgttttgatgccttttttggcgtttttcacaaaaattacatcaaaaatgcaataaatcgggaaaatacacccctaagaaaggacttgaaaatttttgagaaaatatacccctgtgaattgaaaaattttctcaaaaattgattgacaaaattttattattttttcttgataaaaaattttaggtctaaaaattttcgttattcgaaaaacattataaaataattaataatcatttaaataaccaaaattaagtcttttatttaagttttacagtgtttttctccctaaaaatccttaatacaaaaaatttaaatgccttttttcatgcctttttcgcaatttttggtgccttttttgcgagctctagttataaatgatcgaattgagaacgaaagaatctttcaaaatcaagtgcatcataaacctttaattacgaaataaataatatcgaaaaaataaattaaataaaataaacaaacaaaaaataaaatatattcaacaggcagataaccaccctttttgttcgacagaaaaaagcaaaaacaataaataagtttataaaaaaaagaaattcaaacgtaatgtaaatatgtattaaattaagaaaaatttcaaagtttttaaaattaaattaaaaaataggatttttagttcatcaatgactaacggtcggttcaacgcaataagaaacaaaatatattaaaaaattgaatcctttaaatttatatttaataaaaacaatttaaattaaaaatcagattaatataaatatttacaatttcaatattataaattgcttctataatatattgagttattaaataaaacgactttaaaataaactaaaccgaaaaaaggttagtatgaagaagttcgaaatctcctaagatgctaagattaaaaggaaaaatagaaaataaattaataaaaggtacagagaaaattacaatattaaaacattatataattttaaaataaaaaatgttaaatagatatattattaatatgaagaataatttaatttaatttaataaacaaaagatgaaaaagaaaaaccaaattcctaaaatattttattaaaaacaatagagtgacaactgaattagatcatcttcataaccctacaaaaatgttaagcaatagcgtaccatccatgtaagttctgcgaatgttactgcaacaagatgaattatccaaatgcaatttagagattaacattaaatttttggaaaattattataaaattcattgtgttttgaaatctaaaagtaaataaatagtaaatcaactaaaacattatttccatacattacaataaaaaattaatgatgtataatataagaataattttcggaactaaaaatatttattaaaattaatgattaaaaaatggtaaaattgcaataaaaatctaatttaaatatactaaagtatcatgccctaccaaaatctcgttttcatcagctgagaaaattagcaagagagagaaataatataaaacaattgataatttttctaaaaattaatgtaatatatgaataaaattaataaataaagaaaataatagaaaatctatgagatttctcgacaaatgcatatatttcaattcaaaaatatttatttttaaatttagatattgataaaaatgatattagaaataatattcttcaattcaaccaaaaataatcattaaataatattacaagcatatattgtaaagcttaattgactacaaagacaagcaatgtgtattacaaaaggaaacatgactgtatcatgttggtacatggcataaatttctttttactcgtcaattatttaaattaactaaaataaataatgatatattaaaatcagaaataattgccatatcaaaatagataaaaatatataaatgaagtttcatcagctatcattaaaagttcagcgaaatgtacatcttatgatgagcccataaaaataaaatcttatttattatgcaacctaatcataggccaataaaaagtttttcgattcaaagcatgaaggagaaaaataaaaaattaacaaaattaaaaaatattaaatcaatttattctgtattttttgaattttgccaccgacatacaaaacaaaaagacgagatttgctttaaattaaatttaattgaaaaaggataaattaagcatatgatatctctataattaattgtacattagatatttcttattttctgactctctgattttgttagtgcctctgatcactctgatcaactttaactccgccccttctcgtaatgtggcctatttcctagcgatcacctcaattcattcttataaccgggatcacatttttacccccgatcccctccccttccgtcctgtacggatcggggtccctttcccctttttctactcatacattagcatattgtatttcttggatccgccttcggaataaaggacattattccatg

SEQ ID NO: 1736 - DNA, 10872 bp, Heterodera glycines
  misc_feature (2296)..(2296): n is a, c, g, or t
  misc_feature (2299)..(2299): n is a, c, g, or t
  misc_feature (10797)..(10797): n is a, c, g, or t
  misc_feature (10819)..(10819): n is a, c, g, or t
  misc_feature (10843)..(10843): n is a, c, g, or t
gcgacagaaatgccaattaaaatcacaaaaataagttaataaattgaaaaattgtactaaataatttttaatacctctaaaaattttttatgatgattgaacaaaaatcgaaagttcgaaattttcgacctttcgagttcaggttaggaattggttgaaataaatgacagattcatgatcagcgaccccgaaaacccgccttttatgacaacaaattttgctaaccaaatttgacttggaaaatttctcttgggcgatagaaaagaaaaaaacgtggtgagtcgaagtgacaaaagtgcgaatgagtggtgatcagaagaagcgggtcatttcagtacggaagagttattctaatgattaatatattattttaatctattaattagatttgttcaccatatttataatttcgatttattattttattttcccaaacaaattacatttttatgagaggaatacagtgccccaaaaaagtcttgactcaaacctgaaaaactgtcttatagttcatttaaaattttaaataattcttgcttgcaaaacttttagtgctgatcaaaaaaggctcttacaccaacttgatcagatcactccttcctagtgaccgggacacacccaaaataaactgaaaatcggggaaatttcgaaaaaatccctagggggttggtaaattttttctagagaaaatgggcaagcccactggaaagagcacaaaattctctactgatttgaattttgaataatggggctacgacttttacataaaaagatatacttggttgaataattgatcaccataaaaatgatcaatttttgatcagtgccaaaaccttttgtagaagcatcaaaattaaacaatcttggtatcttttgatagccttaagtgtcctctatttgcctgtaaaatttcaaaaaatttcgttgggttataaaaaagttgtggcttgtaaatttcaaaaattgtttttctaaacatttttggccataacttttttgaaattttacaggaaaataaaggacacttagcgctatctaatgataccaagaacgtaaatttggattcttctagaaaaagttatggcgcattaaatttgtcaaatttttatatggtcgtgttttttttgtggtcgtgtaaactgaaatagaaccaaatatatttattattattagctttttttcaattataaatttaaataattaattaatcattagaataactcttccgtactgaaatgacccgcctcttctgatcactcaatcattcgcacttttgtcacttcgacacagcaccgaaaaaaagatgtgtgacgagagtaactgcggatggcatctgcagataaaaaaatcgtcagctacagatagttagcgctagcattatgaatacggattttatctgcagattattttatctgcagctaccctatccgcaaatccttagctgcagataactaactatccttagcattatgaataccagcaagagagcctttcccatattatttatcccattttctcccacactccgcttccttttgctggcatcacaaaacgacaaagttaaagtggctttttaatgagccttctcattcagagaagcattcattttgtatttattaaagggaaatcgcaaaagtcaaattgaaaaggggggaaagataatatttgttggatggagaaattttttaaaattttctgtaatatttattttcttttttatttcaagcctcgcaatgctttaaattcgaccctggacaacttgaaacggtcccggattctccaatcccgcatggtgtactttttaaatcacaaattcatttttacttcctctcatcgatctctttacgctaattggcaaaaagtgaggcaatttggtcaattttcagtaatctgtgacaaaagtgaattatgggcaggtaatttgttcattttctaacaaagtccttcgtctcgtctttgtgctctcttttttttaaatttcccattaaacacgcaccatttagcatatttcattggagattgatcacttccactaatgtgcaaatttgtgtccagtttctcacaaaacaatttttaatgggcgaatgttacaacgcttttgcaaattaaggggggggaagatttgaatttaaatgaaactaattaaaatcaaaggtcgcataagtttccttttttaaatatgcaatttgatttaactcaattcaattcaattcgacaccaaatgcttcttctctcatcgctctcttcatttgtcacgggtcccttggggcgttccgccgaagtgccggtccccgcnggngccctttctgcccattctccagcaaaagctgtttgccccgtttctgctgttgctgctcccccatcgcttcgtctaatttctcgattcgttttgaaattaattcgattttttttctgcgcaacccttttaaagctttgcaacaaaaggccgtcgtaaatgaaccgagcaaagtgaagctgaaaattgcagggcaaagaaggcagccaaagcctggaaaaatgggacaaattttacgaaattggcaaattaaatttggaatgacaaacaaaaattacaccaataaaataattatattataaaattaaaactcacattggcatgcggttttgacgcaatcgttgttgctacatattcccagttctgtgaatggattttttaattgttaaaagtcaaaaaaataaaaacggtcaactaatttaaataaatgcctttacgccttgattagctacaaaagaaataaataagacatttctgtttgaaagagttgaggaaaagcttttttaaaatgaaaaaattgattttggctttatttttatttatttatatgatatatgtatactattttgttgttacgacaatttcggattatcaattgcagacttggcaattgttaccacaataatatttaaaaaattctaaagtataattattcatacaaaatctattgggaaaatatagcgttaattagggttagaagggatcggtatcccgacggcgtgggtcccggaatcccatcccgcttaaccctggtcttaattatccgctttccatcgtgcccagctgtaaatgtcattcaatcagtcttttgatgtcgtaccgctgaatatttttacaaaaatactgacgaggaattcaacttttgaagagtaatggaaatttccgaaattattgaaactttcaaatgggtttaatttttcaaaagttttttaaaaagaaaaaatgtcattaccatcaacatgactactttcgcagacattgcacaacgaacaagctaacattgaagtggcacaagcgtcgccaaagccaaaggtttccttttcatttgccttttcggcatttgcttttttctttttaaattcttaaaattcatttctcttttatgctttattttcctttttaccttctcttttagaaaaacatttgaaatattctttgtatttcttctgaacaacggcatttgtcaaaaagtgaaacagtgcgatttcttctaattttgttcgaatatttttcaacatttcgtgagaaacaaaatgaataattcttaaagatataaaatttattttttgttttgaaaaatttggtttttcaattttggtctttttgtggtttgtgagaagtatcataaaaaataataaatcatatccgagcgggttcgaacctcagtttacgccaattattgaacaaattaactggttttaaatgcattttaaaaattaaaactattgaatttgagtccgttcggttttaggcaaatctgaggtcagattcgttaccagcccctttttatcccatttgcaaaggaaattctaactttatttttcatcgggacaacaattcttaacaatttcccaaatgcaacagacgctactaggaaaaggaaaatgtcaagcttctgatccgggctttcctaattagtcgcttttggttgtcttttggttccccaaatgattaatagtttgactaattggttacgcttcgttgtccttttgttggtccaacacttcgtttagttctccccattctttgcttttctccctccgcattgcttcgtccagccgtttttcgtctttgtctttgtacgcctccaattcggtgactttctgtcgctgctccgtgtggacagtgaccaaataggcgtcgatttgtgcaaaaattgcctccacttcgctgccctgcacaatctcctcataattcagcttttgggccatcgaattgaatgccgaaattagtctttggaactgttctcgggagggcatttgcgtctgctgttgagattcattctcgagacttagtccggccaaatgcttgtgcaaattctgagcattcccacaaaatgcttcgcgtttctttgtctattggcacatcgttggacaaagccttttgaaaactttgcaaaaaaagaagcaaaaaaagaatatttttataaaagaacatttttattctctgctaaaattaataaaataaaaattttctttaattttgcaaaaatagtaataaatgaatgtgaaataataatatcaaatgaattattcctattcttttatttgggaatttacattgacttcatggatcaataatttaacgtaaaaatagcaaatgcataatgttttagtgttaatagcataattttgccaacatttttattattttcttctattctcaacaaagattattgcattataatgggcccacaaaattttggtcccagccaaaatattataaaactaaaattttgagtaaaatatataaaattggaattttgcgtatgtttattcgtgtaaattcattgagaaataacagactttatttcttctgctcattgtatttatctgctgctgtttgcctttttctttactttttgtactttaatacgctcactgcgcatccgacacgcatttcacgtgccattgcttttgcctttttgcgtgccattggatttgttttcgtctgctttcgttcatctccttcattctcgtcattttgtttttgttcaagataaatgccaaaagaaagcttaaaatcgtaaacaaaatgagacagacaatgtttgatgcttaattgagaagaaaaattcggaaatgtaatttttaaatgaaaactcaaaaatattttgaaaaagggagtgaattgccgaaatagaaaaagaattaagccgactttcccagttcctttctcagtttgcttccgcagttttctgttacctttcccatgccacctgctgctgcttgggagtgcaaatttcttagtgccaccaacacttttgggtccttttcgccgctcttttggtcaatgcaaatcatttggcaacgctggcaaatgccaaccgtctcaagggaaaaatttgcttatttttctttctttttttgcattaactgaaaactccacacttccaattgccaattgctcaatgttttcctcttcaaatggcttcgaatttggtccaaaatcgaccacaaaatttggtcggaatcgcgcgacgacactttcgtaagggagcgaaacgcgggaggcaacgaaaagagccgaagcgcgggaaatcagcagaaaattggccttattggagaaattggaaggagcaactgctgctgaagaggaaaattgccaaaatgaataattaagggcatttgtggcaccttcgtccgtcggacaacacatcaatttgctacccttcagcaaagggtccaattcggagagccaaagggaaaggcattccccgccaaaatccaccaattccatttgccttcgtctaattaaatttaatattttccttttaatgctaattaattttacctgcctatgcattcggcccctttcgacgtgtcattattttttgtcggattggccctttccttccctttttcgcctttttcaatttcaattttgatggccggcagtgcgtcgtgccgttccttcaccaccaattcggttccgttggcatcgatctgagggatggtcatttcgtaaaaatgccaattttgcttcaatcacttccggcacgaccaaacaaagtgccgaacatcgcttttgggtcattggatcaccaccgctggaaacgatcagccaatgcctgtcgaagagaagagtgccgagagagggacaaaggggccagctgaaagtgaagcagtaacagacgatggaaacagcgataatgagcgtaattacatcaagttaattgcaattctaccgtaattagttaccatacgcaaacacagtaacctcttctttgccatggctgcgcacgatttaatgggatagacaaacaaatgagtgagtgtgccaagtccaggtgggaaatggcggttcatttgaccgtcactttcagcgaacattccgttcatttcattaagtatatcagcagaggaggggaaaaagtgtccacaaaaggaacactccaacattcggaggaatgcggccaaatcctatagaaaattcttcaaaatttcttttaattatttttaaattgcattttggcattttacttcctcggaagaagttgggccaaaggaaatccgaaccgagcctaacggtttcccatcgaataaatccacgtcgtccccgcactcttttccactctgaagggaacaattaattactggccatgtttcaattgcttaattagctaattcgtccaacacctgataatgaatggccatcatttgatcttcacttattcccaaatgtaagctgcaggcgcccaaattgcctaaataaacccttaagtcagtcccttttatgtgtcaggaatgttgttttgtttctttgtttcgatgtaattaaatatttttttttgaaaatggtacaatggcatccggtgcgcaactgaatgccaaaaaggtcggccattttatcgacctgaaaacggaaaaaattttagctatagaaagcatgtaagcaatttaaatttgatggacctctacaaaaccaacaaaggaaccgtcgtcacgaagtaaattaaaattgacaattggaccttggacaaattttctagcgaaattatttgagctgtttcttaaagatgattgataatttataaaatacataaatggattaattaatatattttgttaaatggtaacatttttttatgctctgtccaccctttgccgtaagcaatggcaattggcgcgccgttcggatgttttatttggcttaaagcgtcgaaagctctcttagcaaaatgcattgaatgctccaaatcttcaaaatgttattcattaaggaatcaagcagaaagaatgccgaattgaataccaatttgattttgttcactttcctcaaaggcaattaaaagtgccgaaattgcatgaaaattgcaagttccgtcttcaaacctaaacattcatttttgttcaagagttttgggttaatgagtcaaaaagtagcctttcttcgatggtttcgcggaattcgactttggacgaagttggagaaacgaatttgacagttccgccgccaaaataaccgtttttttgaagacaatgggcggaagaacggcggacaatgagagcaccaatgccaaaaatgggaagaaattggcaaaattaacaaaatgccaaaagagcaaataaacaaacaaataaacggaactaccggagggataaccgaacattttgtagaaggaaatgacggcaaagtcgcaaaaggataggccaatgtcggacgaatgcggggccaaagcggcggagtccaaacagacgaaccaatgggagcccaaaactgagcaaaaagcgaattcattttccaacaattcttattttaggaaagttgcataattttgcataatttatttaattttaattatttaattcatttttaattttatattttttgtttaatgatttatttttttatttttgctaattcattagtgagtttttaattaataataatattcccaattattcaaaatgtttattaaacctctctttaatttatgtgccaattccatgtcatagacacgcccacagaaattgctcatcgctgtcattacgaataggcatttcttccgcccaattaactcccctttattgcctccacttattaaatgcttattggcctctgtttcggccaaaaattggcttaactcttcgtaagtgaccacaacaattcgttcgaagctttcagcacttcgcattccgacgacggaagtgtgggaatcgcgcagcatcagaagggtgctcaaaggagcaactgagaaaggggggggggcaatttgagagaaatgggaaaaccagaaaaagaaagtgccaaagcgactgactgaaaagccaattaattaaacggaaagaaataattaccatccgacagacaattcacatcacttgaaaattgtttttttgtcgtgtgacttatgcgagtttcgtctccaaagttttcggcgagcagtttcaatgcgtttgttgcatttgaagtgaaaatcacagcgaattcttccaaattattgccaccaaaatgggcgaggattcttttgtgatatgtacccaattaattaattgaatacttccgttaattgccctccctcactttgcccgtgcgttttgcactttgtcccgcgtcctccgtcccatcatatggccactgtgtgggtttgccaagaggcattcccgcgggtcgtacaacaaattggcgatccgttgtaaaaattgaggcgatgataaagcagctccggcaaagtccaaataatgcaacgaattttgggccaattcttttccactttttaccattgaaataaattggataatttgggaaattgatcggcggtgcgtgaccaattaacacactaattaattacacacaaaacagtcataaaattcccgcaataaacacaaagtgatacgagaaaaggaaccacccacaccagcaggggacgaccagtttttctgctgttcacttataaaaaagataaaataaatgaataaaatattaatttatgagtcaaattttttaatattgagtcaaattttatttattttaaatttaaaaacactaaatatttaatgatcagtagtccttccatatttaaataaatattacttttgctttttgagtaaagaagtgacaaatgccaagagattgaacgtattttgtaaattggttttatttcaaagtgtataaaaaatataattttaaaataaataatatttctttgtcataaaataacaattaatttcgaatgaataaaaatgccctctcatcaccatcctcctcctcccatccctccacccatgcccatgcccattcccattcccatgcccatgcccatgccgccgcccatgcccatgccaccgcccatgcctcctcctccaaatccgccgttgttccaaccgccccatctcgacgactcataaccgccccaacttccgccaccgtaaccgccataaccgtagccataatggcgcttatggcgattactaaagagaaaagtacaagaagtacatttaaattaggaaaaaacgaaaaataatcaaaatttaaagtcgggatttcgagtaatttgggactagccgagaatttccggcttttaaggctttggcccggtcagtttttactccgtctctctgaccttttgctcgcctttccctcaactgctaatggatttggcaaacttttgtctccgtttctgtcgtcagagccatcggcagccgtttttatagccaaaaatgaaatggcgagaagcaaaaaagtaaggaaaaatttcattttggataatcaaataaatcttaattttgttttgcttttttttaattgatttattataaattatataacaaataatattaataataaatgaaaatcaaatgttaaagttttttaattgtaaatttggaaaagggaagagaaattccttcgcctttgaacccatcgccaatttccatttatattcatctctttttttgaccttcgatcattttgcgtcttcgtccaattgttttacactttacctaaattatttgagtgtcttttgcgattgggcggtaatcgccgagaaatcatccaattacttaaaatagttcgccaaattcaaaattggttagggcatggggataaataaatatgcattaaatagagcaattagcgtaattataattgataagtaaaagaagttttgatatatgtaaaagaaaaaaatatataaaacattaatgcaattatttttggaatgttaaaatggaaaatatcaaaaaacaaaggacaaattgtgacatgacaaaagacaactttgcccctcagaatgaacacttcaaaatacaaatgcatcacttttatcaaatgctcaatttggaattaattaataataaaatgcaaattgaaagtgtttctgatttgggtaaagtgacataattttgttatcttttttccacaaactgctaatagaccaatcaatcattcatcattttgtcttttattccgatgtgaccggaaatttcgtcaataaaaaatcaattatgataaagtatctttttaaaacatgatacggtattaagatgttatgaatttaaatgtgagacatatggcagaaatcttttatagttttgactctaggacctatttttaaaaagtttgtgtattttcggtgctaggtcgaaccgaaaatagtctcagtgtgggcgaaccgaaaaatgtatgaaatttatggggaaacgaatgaagaacttaaatttacgaaaatattgagtgaaatttcagtagaaaattagtagatttttttttctaaaaatgaaaaatcctctaataagcttacttgccaatcatttcatggattcaagatttgaaattanaattttcgtttcgatgtaattntttttggtcggagatggaatgctnttatagtattcttttttagtttatttttt

SEQ ID NO: 1737 - DNA, 1864 bp, Heterodera glycines
  misc_feature (1852)..(1852): n is a, c, g, or t
acgaaattgaaatgtataattaaatttaaataatttttattgacacttagactacctattttcggttcgtttcagcgtggtattttctactgacttattttcggagcactccttccagtcctgaagaaatgaaaaaagaaaaaaatcgggcaaattctttaaatttaataaaccggtacttccaaaattccgattttgtcgtgactcccggccccgttcttaggacaaaacaccgggaccgggattccctaaaaacgggagtggaccccgttccggtccaatttccaagttccggttctggtacttccaaaccaatttgccgtgtctcccggtcccgttttttggccaccgggacctacattttcaatccctgcagtgtttttaacctttttcttcgttttcgcaattcccgttcccagaagtttttttaccgggctccaatttatggcacatcattttatattttgtttttcttaactatagtttattttgctatcaccaccaccttattttcttatctgtggttattttctttttttttcgtgcacacaaaccacacacaaaattgacattttaagtactccaaaagccagaaccattaattgaaaagggaaaatatattgtaattaattaatgggatgggtgtgttgttaattccgttgtcccttttattttcccttaatggatttgcatttataatcaatttttagctttctaatgagctcgaacagcagtgaccaccaaaatgaggaggaggaagcgaaagggacaaagtcgaaaagcggcgactcggtcagtcagaaatcatttgaaaaaagcaaagtgccaaatattggccgtaattctccccatttgtcacagtttccgccgcgccattcccacacttttatcggttcgaccttcgccatttggtcactgattttcctgctgttcgccacttttgcctctctgcagtactatttgcccaaggccgcttcctcttgcctttgcccggccgctgaatttgggcgactgaccgcccaaagagcgtacaacgacagcagttttgggaatcccaaggttagttggatgggggaaagggtctggaagcaggacattcaagcgcagaacccaattttctttttttttttgtcagattttgcccgacggtcgaatcgaatacgaattggcggtggtttccgatttggaccatgacagcaaaatggaggacagaaaggagacgtggcgtagttttttccgcaggggtcgcctcctcttccgccccgacattccttccgtgcaagtccaatgggccaaggacaagcaggacaacacactgtactcgcagctttcgtccggaggacgcgcgatggagtaaaaaaaaaataatggggagaggcaggatttgtatgagttgtgatagggcattaccagaggaaatggtgctggtattcttaatgggaaattggctggtcaaatttttgaatttacactatttgccaaaaattgcaattttccgatggcatttaaaggcatcacagaacaccaccgctatttaagaattttattattatttttaattatttaaacactattttctgacactttaacacaaatgttcttttttaagactgtccgaactctgcgtttacgacggacatttgctcaccgtggacgaccggacgggtattgtgtacaggtttttgatttaatttttaaattgttcattaaatatgtaattttttttcaaagattcatactgctgggtccgttttttgcttaccatttttaatggtcatttgtcagaactccagtttttaaaattttttgcaattttgtccggtccgaaagtttgggttttatttttaaaggngtgttaaagtca

SEQ ID NO: 1738 - DNA, 1279 bp, Heterodera glycines
tgatccacggtcagtcagcctcatctgattctgaataaccaaaaaaaagtgaaaattttagagtccggccaatggtccgacattcacaagaaatggtttttcttgccgaggttttccctccaattcccacaataaatactaaacatttttcagaagagcgtcaaacgacacttattccgaaacggaagatgagcacatgggcaccaatttattgctgatagccgacgaggactttgaacatattcaggtggacaaggaagttataacaaaaaatagagggatttaaaatatgtaaaacgttaatatttgaatcattgaaattggtttctgcaaaggtccgtcacattgggccccccggcgatggcttccgcggtttctccgccttccaatttttgccaaacaccgaagatgacatcatcgtcgcgataaagtcggaagagcgaggcggcaagccaatcgcctcctatttgttcgtcttccgtctcagtgatggccatgtgctgttggacgaccaaaagtttgacgggccctacaaattcgaaggggtcgtcgtgtactgacagagcaaattgggcaatattgttgtggagtcagagtttgttatttgtgtatttaaaaaagagcagacaaaacgccgtcggcggaggagaaaaagctgacaataaatattccatgaaattttttaattaaaggcatttggaaccactcgaaaacgcaactatttttttttgcttttttaattattttgcccacctcatttggccgtgttttgtttgttgtcttttatttcatattgtatttatatttcttctgtttgggttttgttccatttgcttgaaatgccggtccttttttctgtttggtcagacgagaatttcttagagtgaattgaatgttcgttcgttattgttataaatgtgcgatcaattgtttttcgctggttacgggatgccctttctcatcagataattggcacttaatcagattgttttttatgttttattatcattacttatttaaacacgcctctgctaaatgtcgagtttaattattattattattatgatttcctaaattattacctaatacttttattattgtttgtctaaaaatgttctaactatttattcaaaaattgttttgcatttgcacttctgtaattagagacatttaaatttcgaaaccattttgttttgtttttccaaatttcacttctcttactccataaaattcctcattgtgtgtattctgttgcacctgactctgtttctcttcttct

SEQ ID NO: 1739 - DNA, 2797 bp, Heterodera glycines
tcactgactgcgtttgctgaactgaaagtgttgtgctaaaatcgcgctgctgagtgatcgccagtgcaatgcgtaagcatttaatccattaattctaaaaatgcctttcccgtttttatgattcctcccgaactccgtggctccatttacggcacgggcggccgtctcgacactgacgaacgattgcaaatattttgcgcaaaaaatactttgaagagaaattcgaatcagaaaatgggcgcattttgactgggcttgtctccactcacagcattgagctggtcaactcgtaagtattgtcacacaaatggcatttcaagttccttaattagttgttttcgggttacatcgagaattgtctcgggattaagcttttgtcttgcgttatcacacccctgcgatactaatgaaattgaaatttaaggctgatcaacgattttctgaaggatcgaaaggcttttgaggaagatttttacgggtttttgctcaagttggttaagtgagttttaatttctaaaataaatttttcatgcattgttttcttaatttttaagatctccgattctaaaccaaattgttgcgtttatgcgcaacaatttcaaagtgttggcaaaaaggtgctaatattttgaaatttaagcaacttttcctgttcagaattcggcatccctcaattatgaaggtgggacaaaaaaaatatgcttttaatatattaatttgtaaaattattcaatcaaacctggcattattaattaattctttccatcggcaaatattcgaattgtcatattttttttttttttggttgttaaggttgtgctaacctacgtcacaaaatggtaattaattcttttttgagaattgaattggtttttccattcttctcctttttcccgttacaggatgcaaagcgaaaaggaactgcgcgaggtgtaactttaaaattaaatttttgaaattgctggatttaattttcatttgtaatgaaggaaaagggaaaaaagaaaatctaaatatccaaaagccgaagcattttttaatggcttatgctttcaataataaaccaaatattcaaaaaaaaagtaaactttcagttggaaatgttcgagcgagaaaatgcggcggaattgcgagacttgcgactgtcggcctatttgaaagagcttcggatggaaattggggctaacattgactttgtcgggcggggggcagtccaaatttttgactatttggggacgcggcacgaaattaatgggcgaaaagcagcgaacggagcgagcgaaaacgaatgccaacggagggaatagggggaaaagcatcggagaaagggcaattaagcattgaatcgtttgaaagttcaatgcccaaattacatattttgtttgatagacatattcacttgtatgtgtacatataatatactccttcctattcaattatttggcgcaattaatatcaaaaattaaaattagagttttaaatttatttgaaataaaaaaaaataattaccttcaattacattcaaaaggtaaaacttaaaaataccagcaaaatacaaaaaaataataaataaaatcaattaaatggtcattttgatcgggcaattgatttattttgcaggacaaatatcccaaaggagattatgtgcttcttcgactttcgcttcgccgttgactttgcgtgccaccaatgttcatttgaccattcgttcccttctcattaagtcgtcctttctttttatttatttatttgtcacaaagaaaaataatccacgaaagggaaaaatccacttacttcggggacatatgaaaacataaaatagtgcacaagcaaatggataataaaataataaaaaatcatcgtcaaaagaaacaaataaataaagtcaatacaatttgtaaaaacgatcaaatcacaatcataagcattactcaagaatttttaattttatttttgaataagttaaaagagtttgttttaatgagctctttatcgagttgattccacaatttggttgccctcccagcaaagggaatgaattttttgcctaatttatattttgtattaaatcggtagaaaggaatattgaatcgtgttgatggtctaaaaatggagaaaagtttcagatctgttcggccataaacaattttatgtgccatgaacagatcgaataagtttcgcctattctcaagtgttggcagctgaaggtactctaatcgattttggtatggaattggtggaaggttgcatttaaaaaaaactcttttagtgaaatatttttgacacttctcaatttttttaatatttttttgaagagacggattccaaacttccggagcgtattccaataaaggtctaatataagttttatataatgtaatccaaattttagaagatttagatttaattattctaaacaaggaacgcatacgtaaatacgcattccttgttatttggttaatatgatcggaaaattgtaatttgttatcaatgtttactcctaagtccctaattgtatccacagcatttattgtatttccatcaaatttatatgtttcttttgggttttttgaacccaaatataatacaaaagttttttgaattgaaacttttatttgccatttatttgcccattcgaataaattatgcaatgctttatgcataatttctgtatctgctcttgctttatagcatatatacaatttaacatcatcagcatataatttaatattcactcctgatggtataacatcaggaaggtcatttatataaattaagaataaaagagggcctagga

SEQ ID NO: 1740 - DNA, 7663 bp, Heterodera glycines
aaatatcaagattttaaaatttaattcatttgggctttctggtaagaataagtaattctctgtcattgcattattccttggtctgaaaaatttttcggaaataagaattacggccccaaaaaatgtcggaaaaatcggaattcagtactatccctggcgagtaattttaaaatatgataaatcgctggaaaaataaaattgaatttcattcaactaacacccaacaatttttttaggctcactaatggaaaataggaaattttcaaaatattcgaaaaattgaacataaatctaatatttgcacattgaataatctgagtaccggtatatgaaatgattaaatgaacaatttgctggcgatggttcacttttaaatattagtgggagaaggcaaaaaatcacttcggcaaaacaatgacctaaaaaatgaaagaataatttttcataattttatttgtgtgcaaaatctatccgataaggttttctcacagagagagagagagagagaaaatttaaattgattgaatttatgacaaaatttttgaaagtttttatatgaattttttgcctaatttatattttgtgttaaatcggtaaaaggggatgttaaagcgtgttgatgggttaaaaattgaaaatagtttcagatctgttcggccataaacaattttatgcgccatgaacagatcaaatagctttcgcctattctcaagtgttggcagttgcaggtactctaatcgtttttggtatggaattggtggaaggttgcatttaaaaatacccttttggtgaaatatttttgacacttttcaatttttttaatatttttttgaagagacggattccaaacttccggagcgtattccaataaaggtctaatataagttttatataatgtaatccaaattttagaagatttagatttaattattctaaacaaggaacgcatacgtaaatacacattccttgttatttgatttacatgatcggaaaattgtagtttgttatcaatgtttactcctaagtccctaattgtatccacagcatttattgtattcccatcaaatttataagtttcttttgggttttttgaacccaaatataatacaaaagttttttgaattgaaacttttatttgccatttatttgcccattcgaataaattatgcaatgttttatgcataatttctgtatcagctcttgctttatagcatatatatattttaacatcatcagcatataatttaatattcgctcctgatggtataacatcaggaaggtcatttatataaattaagaataaaagagggcctaggacagagccctgggggacgccagagccaacttttttaacagaggatagagtatcccctattttaacacgaaaagttctgttacttaaaaatgattttatccaatttaataatttaccctgtataccaatttttttcaatttatcaaaagcaaattatgaggtaccgaatcaaatgctttttgaaagtcaatatataaatacaatcaacattttttccgttaataattgcttcgtaccaatcttcgacaactgttattaattgatttgtcgttgacctatttcttacaaaaccaaattgggattctgaaattttattgttttttaataaaaaattgtaaatatttttgctgagaattctttccataactctgcacagagagcaggttaaagaaataggcctgtaattttcaggattaaatttatccccctttttaaaaagaggaaagacaattgattctttccagatgtctggaagtgaaccactgtctaaggataatctaaacaagtcagtaataacagttgctaaagaagaatggcaattttttaaaattttataggaaatgttatccggagaagttccgtttttgtttggcaattttcttaatagtgtttgagtctcaatgatgttaaaatcaatatctgatataaagcattgattactaccttgggcattgctcaagtttaggtttgggtcagcccaagaaatactaaatgaatttgcaaataagttggcaaataattcacatttttctgcactatcataatagcatttgttttcgaagactaaattcggtatttcaaagggattatctttgtatttatttaaatatttaaaaatagattgttttccctttgaaatagccgttttttcaatttgtgaatggaatttatttgtttgtatttttatgtgtaaactaatgctatcataaagtgttttttttgttgggtcaattttactttgtttatataattttgctttttctttaatggatgccaataaatgcctaggatatttatggaccaaatcatttttggtcaatcgttttattggaatacactcatctaaagtttctaacaatgcattgttaaaggagacatatttttcatttacgctaaaaagtttaaatgataaagctctaagccttgaggcaataactacattgaaaagtgacacatttgatggagtaaatctcctaatatttatgttttttgatttaggaattaattccggaacagttaatataaaaaattgggctaaatgatctgacgaaaaaatgcctccttcgatagaacattgtgttacaattttatcatttgctggtaaaaccaagtctagccaagaatttccccttgagggtccattagtggcattaacataagaaaacctgttaaagaagtcacaaaatatttcaccaaaattactcaaggaaaatggtttgccttccttccatactaggtcttttttagaaaaatttaagtcgcctaaaattatagaatttacacagaaaaaggtttgtaaaaaattaaaaagattttttgtttgcttaaaagtagtccttggcggacgatatattaatataagcctaattgatttagtattttgtaattgtagaaccaaaatttcactattaaatttagtatcagaaaatttaacaaaaaatttaatttcttttctaagaagaataccacagccaccgccacgtaagagatttttagattttcttgaagcaaagatataattaaaattttctttaatccaaggacaaaaaggtatgtcctggttttccattgtccaagtttcagttaatgttaagatttgtatttttttggcttctaaaattagtgaaatctcttccattttgttcattattgacctaatattaattaagcagcaatttaaattttgaaaattttttgagaaatgcttaggtgatttggtctcgagtcaatttttacgagaatcggtagctatcatttgacgccgaaaaatgtgaatttcctcccgtaagataacgcttcctgcatagacaatccaatcctgaccgtctctctgacgcttttcgacacactgtgcatgaagacgacgccgttcatccagctgtgctttggtcaatgactcgcggacgcgaacgttttgaagcgatgggtctttgccgcgaattgtgttcgatttgttccgccattccacaagagcctgtctttgaaaagcacgggaaggcaagagcactttgagtgggcgggcacttttttgtgctgggttgtaaggacggcccattcggtacgatatggtgccgcattcgatccccagcgaatcgaatagacaattgattttggaccggtccatctccccccgcttagatggtgaaatgtcattatgttcaggcaggcctattatcacgacacttctttgtcgttctaactcctctgctgaaatgggcacgtctttttgagttgggtcagcagagcagagatgaacaatcgatgagttcaaaaggtcaaattgagtcgacaaggtggagattaagtgggagagaattggcttttggtcaagggtgaaggaatcttggagtttgtttagggcatcaatggtgtttttggcaaatttcatttgtgagtcaataagttggtgaatgtcgctttgttttgacattggcgaatattcactttgagagcgaggtcgtttagtcattgaatatttttgggagaatgaatatttttgggagaatgaatatttttgggagaatgaatagcacttaatcaaagtggagcccaacgaaattcaatttatccatggaattcagttcaatttgagggtttctcggtggtgccccttggcagagacaaaatgccaaatttatgtggacaatgccaaagggcggacaattcaaaatggcgaattattggcagggaaacatcaacggacaaacaaatttttgatgagtgtttcgacgttgttttgtgtgcaccggccattattggtgccggcgagtgccggaatttgcccacaaattgactatccgatgggcacattcccacgaattccgaagagcggaatattttgccggcaaacgcgtggccatcgtaggggcgaatctaaccggaattgaaattgcacttcaattagtcgaacgcgctcaagaggtgtccgttttttgaatgaatttaaaataaccgtctgattttaaatttataatcaatgcaagcgacgcgattgagaagagtgcgcttccgaatggcacttccgattcgctgatcccaacatccaactgaacggaagccgcgcggtggacgccctcgggggcttttgcttttgtccgatgggcgtgcggttggcccgctggactttgtgcttttcggcaccggctaccgcttcaacttgccgttctttgctcaactttttgcaccattttcttcaaatttgccgcttggcttgagaataagcccacttttacaaacaaacaaatagatttaaaaatgcttccttccctttcttttccgactcattttgcgctcgctttgctcaccgaccgcgtgccaaaggcaaacgaacgctttcactttggaaatggaaaagagatgggaaacggagcgaattaagtggaaaatggcacacaagtgaatttggtccactgcttcttcagacgaatgaatggccaaaacattgccccaaaatatttccatcgcttcggctccgatctgtgggaatttttcgattggcttgccgatttgagtggcgtcaaacgggtgccgaaagtgatggagaaaatgaacaaattcaacattgaacagagacgcaaaaacccattgacctatcgaaacattcgctacctaattgttgatgaaacatttttaaaattgagtgacaaaattaaataattaatgaaaattctttcaaataattattatgcaaaacgattgtttaattgtctccattatggcacatttgcgactaattaattatgctaattggacatcttcaacatttgctttttcttctccacttcctcctcaaaaattgataaagctttgccataagcagcggcaaattcagtgccaagggacttaaaaacattttcatccttctaaattaaaatataaaatgaattttaattcgcttttgtcccaccttttgctgtgccaaaaaagcgctgcaaaaccgaggaaagtgtcgcgttgagttcagcagttcgccgtactcggccaggtccaactccaagtcgtccgtgtagtagcgactgactgtgccgcgcgtgtcgtccgcctcgagcccagcggcacacttttggtcgatcagttgcatcttcaaatatggaaatgattgagatgacaacatttttatttatttttttatctccgcaaaaaaataaaaatttttttgtttcatctaaatcccatcttggcttgctgatcaatcgggctgggagtttcagttttccaaaaattttctgcagcttttttttgatgagaaacccatggaaaacaattttattttcatctaaagccaaaaaaatcattattttggactttttgccaactaaaagaattacgtcacttttttggacttttgcaaatttttttgtcaattttgctttttgaaaaaattcttcaataaaaaggcaccgcttttttgacgaaaaaataataagaaaagtttgacttttcagtgtaaaataaaagtttattaagtttcattcaaaagattaaacttttttttaaaactcgaatgagtgaaaaatagtttttaccgtttaatttatttcatagaaaattattattttaaattttaattatgtaattagtgatgcccccgttccgcttctcctcgcccttaccctggcatgcaaagtgcacgcttggaagcggcaccgcaagtcctgctggtggtaattggccgcctccgttgcgctgaagccgcgcgtctccgccaactcgcggtcaatgtcaatgcttcgcttggccgcctttgagcaggcggcgtggaaatgaaagtgcgaatttgtggcgctgaagtgaaggaacaaagagaaatttagcaaattatttaattcgattcttttttcattattattttcaaagcgatgcaattcattcataaaaaatattaattgaaagcccaattaatttgatcggtttgtgtcttcgattcaaattatcatttgcttttaggcttttcccgggtatttttgcttctctgtccgatttattccaattaaaaatgccctctttattttatactttaggcaattcattgcgcgctcaaagtcctcgcggtgtttaagacaaatgtgcgattggggcgaatgggccatttgctggacgaaacattcgcgctgaacgcagcagcgacggttgtggacaagacgacagaatcgggacaaggcactcggcgaggaggacagcagcgggtcgatgggaaaatcgaagaattgggtaaggtaggagaggccgaactcctcctgaaagtgggggaacaacaaaatgccatgaagagggacattggcactagccaagcttaaattgcgaaaaaaaatgctaacggaagattattacggccgaaaattaaaattacgaaaagaatgccaatgggaaacgtacggattaaaatgctaaaaaagaatgccaaggggacagcatacggattaaaatgccaaaaagaatgccaagaggacatagtaaaaaataatgccaaggggaaaatgccaaaaaaataagaatatcaaggggacactgtacgtccttcgtttaaaacttcggcatgacatccattcagaatcattggcattattaatgaatgagtcacctcaaaatcgcgcgcgaattgtgcgccacaaagagcctcacaatggtactccacgtcataatacaaataattcggcgaatcattgcgggcaaaatttgtggcggaaaccgtcgaccttcgcctcctcagaacgactttctgctggggacgcgactgagctgaacaatttgttaattgcatgcaattattggacggatggataatatgcatttacttcccgaaataataaaaaaaggcatttcatcaaaacagaaattaatttgaagagatacaaatgtaatggcaaaagatgaaaaagcgattaccaaaaatgcaaaaccaaacgaccgaagcaattaacaccgaagtccatctcattaactgtgaaaacattcaaaatagctaaaagcttaaatggtaattaatgtttttcgccttaagatcagtttttactggcgacataaatttaaaattcgaaaaatgcccgcaagtgaaaagaactttttgcccccccaaggaatcgtcggaattaaaaaaagattttatattttaaaaaatggggggaaaaa

SEQ ID NO: 1741 - DNA, 1853 bp, Heterodera glycines
gtgtgggaaaaattccacacacaaacgcatggagagaagtgttgatacaatctgataattattgagagagaaacggacaaatcccgtggacatttgaagaataaagatcaattaaaataactttaattttaaataatttattttttgtaaatttttcaagatttcaatatcttactctaatcttctccgttttattattttgcttaaaattttatttagttaacagtttgttttttatgcaatgcttaattcatacacacaaatttattttatttgagaaggccaaataaatgtaaatgcaaattaattctttataaaatacacgtatttgtattcatatttttcctgtttaatttaacgtttataaattgatttatatgctataataccaaatgattttcatttttacattttttatgaataaattttagtttcattaatatagttttaaattttttataatataatttttcgaatgattcaacaaataaattatggcaaaggacagcgaattttattaattctttttttatacttttatttaaaaataattttcgctgaatttagaggtataaataaattgttccattcataaattttgtttatttttagagaatggtaatgcttttgcctcaccattaaaaagaatcgccacaccgcgccaattaaacggttctgtgccaagttaaatttagcttctttttttttttactctaaagttcattaattcattttgaagttggcgaattaagccgaaaattgtcatctcaaaaaaatgaattgccaaaaagtggtgaaagattgagcaaaaaatggtgccaatgcggacgatcagaaatagagaaaatgaaaccgatggcactgatcaattttgaagacaaaaagccaattgaacttttatatcaaaaaaagagacttggcaaagggtcgtactcagaagttggtaaaatgttgaaagagaaaagagaaatttaataaatttaatgaaaaattaaagttttagcttttaaatgatggcacttttaaggttttgcatgcgaacataagaaaaattggaaataaaatttacaataaatgcgtggcactgaaaatgacaaaaaaagatttgacagtcagtgactggcaaaagcatgtcaaggagtggaaaattcagagatcattcgacactttcaacgaaacgaaacgggcacacattgtcaaattaattgcatagtaatagggggtatttaagactaaatgagcataattatgagctaactttgttaatatttaccaaagtaaatttgataatgtataatatgtattgctagttaaaagctaaataattatatttgctcctccaaaaatgccgtactgacgttgcattcgtttgaattggtcaattaatattttccagcggatttcacaaaataaacggaagagattatgtgttctcatttctcgagttgggcaatggcgatctgatcaaaaggatgaagcaaaagcgaatcgaatggctgcggaacaaagttcaagcgggtgaccgtcgtttggtgccgaccattcggcaactcgtcgagacggtgcgcgacttgcaccaaagtaagtggacgaaaggccacaattattgaaataaattgaaaatttgcaattaatttaaatttagaagtgatgcacttggacatgaaaccacaaaatctggtatttgtgcacgagcgacaaaaatcggtgatgaaagccatcgattttggctccgcccaattcatcgacgaagacgacgaattgggcaaagggacggaaacggcaaacgcatgcaaatggatggtgatcaacgacccggtgaccacaaaagtgtaccaagcaagtgtccaatc

SEQ ID NO: 1742 - DNA, 2342 bp, Heterodera glycines
gggggtggcaaagtgccaatcgaaagcttattgatagtttagagccccgaacatcacaaccaatgcaattggaagtatgagccggagaaagaacgagcaatgcaattgagtgcaaaatcggacatttggagcattggcatcatcatttatgaaatggccttttttggattggaattcggaaatatgcgacaaaacatccaaaaaaattattcatttttagaggtgggcttagttgaaatgataaaatattctattttaaaaatttaactttagaagaatcgacaaaatttcatccgatggctttggattttttacacacaaaacgatgacaaaatgttgaggaaagaaatggagcattgggacgacttctacacacttttcttcacgattttgtgcattcgactgcaatttccacgcattttccatctgatcactgtcactttgaaaacaaaaattatattttaaattttatttaattattttatttatatatttttaccgattattcaatttaattatccgtttctccacaggcaattttggtctatgagcccgagaagaggccgaccgcgaatggcattttggcctttttggacggaaagtgtcatttcgagttaatgcgcagtaaaacttcgcggcttttcccttggcttggcatggacaaattcaaagcccatcttgaggaaaagcgtaaattgttcagagaagaactcgcaaaagcagaagataaaagcaaagaatcagttgaaagaaaaattgacgagacggagagacttttgtggatggcatcgctaaaggaatggaagccgagcgaaaggctttggaaagtgccgtgtgacacgggaaaagccaaaacgaagccgaacagaatgtggacgacgaggataaaggcggagaagggcgaagccaaaaaagccgagggggagaaaaacggtgggaaaaaaataataaaattgacataatccaattgaaacggataattatctcaatttagccaagtcgaacaaaatgttggccaatcttatgaagagcattggcctgactttgtcgccgagcattcaaaacgcaaatgattcaattgaaatgaaatttgaggggacttttgaaaatttgcaagattcattctataaccggagttcaaaggtatgtacaatacttataagataatacaatccaaattattacaattataagcaaatttcttcaattttattgctttggcacttacgaagggggcggggcgacattttcccaaattgtaagtgccaaattcgatttctaaccatgcccaccgtatgcagccaccgttcgtggaactttaaatccgaaaaagacctaaccatgaaaaagtttcatgaatatctactgacaaataagttataaaattttatattaattaaaataaatatttaatctttgttcattttaaaactttaattgcatttttcgccattttgttcaaaaaagcttaaatttatcatcgtaaaaggtgatgccttatgagatgggcatggcaagggatttatgcgaggcaaagctcgaagaaaccgattaagcagaaaaaaattatttaataaattaatgagaaatccaactttcacaattttgccaaaattttcagcagccctttgatcagagtaaccaaattgttagccttttgttagaaataggctacagaaatttattagaacatttgatttccataattgaacgttacgaaagcgatgccgaaatgctgaaaaaggttgtggtcatagtcagcggaaggttggactcggaatggaagaaaataaatgaattggcagccaaatacgaagaggaggaggcggaggaggaagaggaagaagaagaggaggaagaagaagaggaggagaaagaggaagcggaaagtgagaccgaagaagagaaagaagagagcaaaaatgaatcgaatgaggagatggaagaacaagaagcaaagaaagaaggggaggaagtgaaaaaggagcctgaggaagagaaagaagagggccaatttgtgttcaatgagaaggaggaggaggaggaagaggaagaagagaagaaagtggaaaatgagactgggaaaaaggtgagccaaaaggagggtaaagtggaggaggaagaggaggaagaagaagaagaggatgaggaggaggaagaagaagcagaagaggaggaagaagaggaggaggaggaagaagaagaggaggaggaggaagcggttgagaaatgctgttggtacacgaaaaccatcgaacagataaaagcagtgtatttgtatgagctgatttacaaacattttatcgctgaagtggaaaacaatgctacaaataattcagtaa

SEQ ID NO: 1743 - DNA, 1359 bp, Heterodera glycines
attcccgtccattaatttctggtcgtttctaacacctttctctctctctctctttctctccgttttttcctttcgtccatttttctattatttattttaattttacgcccttttctttgcgctgctgttatctttttttattggctggtaattgtgtgacaatttctttttcaaaaattgtctcggatgatggacgcgcaatttgcgaggattttttaacatgaaatgtttttttattaatttcattttttggtgataaaaatttttctccacccttcccaagagaaaaaaactaatgtttttttggattctggttgaggcctgcctgccttccttggtctattcatactctttctgtcttggtgtagaaaatccctaatttttcagtgcattttgtcataaaaatcctcgttttcttcaattatctttgtctctgttgatatatacataaaacgatgtatgaatgactttctaacagcgttttatacattcatgcaaaaagcgctttgttatttttgagcaattggcataaatttttgttgaaatttcaatttttttcaaatgcatttttacccacacaaaaaaaatgttactaaaaaacgacggcacatttttttaaatgcaattttgaaattcacaatttaaatttggttgtaacgtccccttcatcgggatgcgcattttggtcaccggttatggcccgtttggtgcctttacagtcaacccgagtgccattgttgtggaccaattggcacaactgtgccgtgacggcacattgggcacggatgatgccgacgcaattggcattgagctggtgaccagggtggtcgaggtggactacgccggtgcactgggctgcgccaactgggcccgcgatgagctgaacgtggatgtgagtaattaggaagtggcaaattatgcaaacggtggtcattaaggataattaagggggaagtttccaaattcttgcggtatttttatgcgggatacgccagattttggttgattttttgagcggttaaaaaactttgagcgcgaaccttttaaatcccaaaaaattccgtcccaatccaaatttttcgttgccaagaaatcttttattttgttttgttttttgcagtttgccatccatatcggtgtgtacccaggaagtgggttcgtgtttttggaacggcgcgcatttcgggacggatacgtcagcaaggatgtgaaaggttcgctgtttttttcggtttttcgcattgaaaaattttttttattttctagtcataaacaaacttttgagaatttagtggcctaaaactcgacagtttacctaattaagttctcaaaattgtgacctgccaggccatccaaagc

SEQ ID NO: 1744 - DNA, 5465 bp, Heterodera glycines
atattaataaaaaaaataatcaaaatttatcttctttcaccatgaactaatgcaaatttacattgcttaattaataatttcaaaaatatatttatcatgaattatttaatttttaaattgtttgatttaattgtttttgtttacgttttaatatttttaagtcatttttattaaaatcattctgcaattcttttatatttcaaaaatcacttgttttttcccgaaccgacgatttaagaatttatttttttaaaatatttttttgtttttaaacatttctaacctaaaatattttaaatatattaatcatgaattatttatttttttttaaatttgtttacttcaattgtatttgttaatttcaatcttttaaataaattttttttattaataaaagcacttttaccattcatttatatttctaaagtcacttgtgtttttaatttttacgaatcggaagaaaatttaaaaatttaattttttctaaatactttatttttaaaaatgtaataaccggaaatattttcaaataaatttcattccataaattattttgcctcaggggtttttcaattttcccccataaattcatcattatcatcatcatcagcagtgcggttgggcctcgccatgtgttcagttagtcaatttgtgatgcttttctgatcaatgcctcaaatcgctgatgatttccctcccacccacacaaaatatcggcttgcttaaaatagttgtggtgcttttgcggggagtaaaaaatgatggatgatgagctgagggatgagatattatattgatgacgatgacatcggatatggccaaatgtgacgaaatgcggaatttgaaataaaaaagcactttttactaggccctttgcttcaataaatttattataaacaataacaatttaatttttctttaatttttgaaactttcaggacagggattagggatggttccaggatttcggcttggaggggataccttcccggcgggcacgcgatatttttatttttttgcttttcacgccattaatttttgcattaaaaatttttgagacacaggaggggttcaatggtacctgtctcggcaacgccgggaaaatgtttttaattttactatttttaacagattttcaccaaaaatgccaattttgtgggtttttggaaagatttagcgaaatttttggaaaacttggatgcgggaggacttggaggggatacgaataaggaaaaaacgaaattttcagcttttccaaaaatcctcattctatcaacaaaaaaaaaatttccaggattatttgttttaaaatttgcatattttatttagccttgacacaaggggtgtttctctcaacagttgtgtgctcctttgccgctgatttgtttatccacaattcaaaacgcttattctcatgaccttgtgtccttttaaatgctctctctgtaaattattcaatttaaatttaaatttccaaaaattttatatttatattatcagatttaacatacattcatgccaggcccagggacggtcccaggattttggcttgggggggggcacctccccccgtgcgacgacctttttttttttttttgcttttcacacccgttttttatgtggcgcggtttttccaaaaaaaaattttgggggacagggggtccggcggtgccgataggcgccgccgggaaaatttttgcggttttaaatgcggtttgttaacagattttgtccaaaaaatgaccaaattttgtgattttgagccatttttagcagattttcattaaaaatttgtggattttttgaaaaatttagcgacatttcttggaaaggggggggggggtagccagcccagcaaggaaaacctaaaattttcagccaaaatattatttttccttaaaaatttttggacccgggggggtcttgggggggggtgaatatttttcccccttcaaaaaggtttttgtgcggctacatttactactgttccctgctgaatttgtcgggccgttcgctgttcgttcacatccctccgtttgatgaccaaacgcacacgccccaacgcatcacacggctgctttgccaactcgttgtcgaggtggccaaacaaatcagtaacaacaccaacaacatgaacatcggtgccaaaaccggggccaccgccgtcgatgacgcaccaattggtgctgttgcttatggtgctgatccgtcctcgacaccaccgccgcagccgccgccttcgttgtcctcgttgatgatcaacaacgggctgaccgtttcattcccgctgggcggcggtaccaacacttcattattatagggaggctgctactactgttttctgggactgctcgaatatagcgaaaaacttactttttcgctttttggttgtcctggtcggtctcaactctacggactgctcgagattttagatgaaattttcccggttttaagtggaaattttgacttccaccaatttgagttcaattctggttctcgatgtgaaaattgtcggttttttgcgagtcgaaaattttcccgaaatatttttgggttcagtttttttattgactttatcagcagagtcaattctcgggactcttgagcagtccctgagcttcttgtggcttttgcagcgaaattgcggataacggaaattgcacgaggctcggttgacttttgtttttgagatgatacatggattacggatttaatttgtttttctttttttttgtgatttttcattcggcactttttgttcgcttaactctctcatccccaacagaagagatattattcactgttatcgacccaaaatgctcaatatttagacgaattttttgaaaaaaaaacttacaaattgaaaatttcctattatttaattgttccattcatttaatttcaatatgtgtgccgtgctgatgatgtcctcctagcatcaaaccatcattcatattcattaacatttttctttaactgtgattgatttgcctaccaaaaattgatattttttaaccaaaatacataggtatgttatttaattacaataaagcatggatttctaaatatgtacaataattctgattaatgcgtttttatcatttaattgttgcaattaaattatatttttacattttaattaccctcattactgtttttctccttactgttttggattttcctctcaattagcagtgcatatattggatgggcaaacgcaagctcaaggaggagccggtggaagaagccgaccagggcgacgacgaccaattgacggcatcggcacaagcggagacgacgacggcacaacaacaaaatcagtttagggagccgcggttgaagcgcatcaagcgggacgagtaccagcaacaccatcaccacaattcgcggcaacaatttaatgtggacgacgtttccgctgcagcagccgcttcatcttcggcgctttcgttgcccaatgggcatggccatgcgtcctcctccgccaacaatcatcgtctgttgatgaacggcacaacagccgtgccgacgacggatggtggggacaatggtggtggtgaacaacaacactcggtgtggctgatccggaaaccgatcaatgtgaggaggaggaaaagcaacccccggaggggggaatttacatgaaataaatttgattgaaaaatgcgttaatttcatgccattgtaaaacatggcactttctgatgaagttcatggttgctaaatggggtcgacgaaacattttttactgcacttaaaagcgaatttttgcatttttttccgtctttttatttaaccatttttggggggaacagttctcatcgccacctcgccgttccctcaccgcccgaaaaaaaaaagattttctttcaaaaaaaatttcgaaaataaaaggggctaggctaatcgatacggtgggtgtggcttttttggaaaaacggatcggtgcaaaaaatttagatattctgaaaaatgccaataaaaaacaagatggcattcatttttttttgcgccgcacagatgcccatggaagcgctgcacaacatccatttcacacgcaaacaaagtgcacaatgccaaacaatttcgtccacgtcgggtgccaaagttgagtgccatttgaagaagccgatcaggccgttgctgcacgtgatcagcgatcggaagcgcacttttgacgagaaagtgccgatgacgcagggtcagtgagttgtgacgggcggcggaatgaattggtgttggcattttgggtcgatttctttttgagtaaatttgtgccaatgccaaaaacaatgggggaaatagtgaaatttgatgggccgttgaatcaagccccccccccaccccctcaacatttgacactttttcgatgccatttggggaaattgggtcatttttctaaatttattttatttttttctcacgatggtaagcatttttggggaaaattcagtggaaaatccaagaaaaatttattttcacgacggtttcttttttttgaaaattttaattggaattgttaaaccaatttttttttaatttttagaaattcttgaaaaccgaagcatatgcctagcctagaccaatattttcaaaaaaatataatttttgtcattacatcgcttttcatcgtcaggctcaagtctgcgtggcgttgtgtgggtcaacaacattgagccggttcagctgcagcagccgcaacgatcgcggacgacaacaacaacgggtgatgatgacgtggaggaggatgagtccggggccggcaccgaactgctccaacttgacgacgacgacaacgacggaattgacgatgggatttgtgccaccagctcagcagtgccttcttctcgcatccaaattgggtccattcggcgaacaccggtggttgacgaacgcatgctcaaggaacggttgaaagcgttcggcacggcacaaaaaaagggcacgacgacagaagcgcaacggcggcggcgaaaatgaacaaaaatagagaaaaaaaacggatgatcaatgagcaaggccgtaaccaaaaaaatcttataggataaggagtgccgaatttcgtctaaatttttcggcattaatttccgaaatttttcccgtagaaacaaaaaaaattttaccccattgttcgctgactttggttcaaagtgtcaacgcttgaacaaatttaaaaaaaaacaaactaaaatgagtgccaagcagacgcgcgcccccgggaatgccaatcaccggatcaaaatcaccgaaaatttgaaaaaatccgtgacccgtgatccgagatcacggcaccccaaaaaccccgtgatttccgtgatccgtgagccgtgatccgtgatcagggccagccctgatacaaacactaccaaaaaggtactgatctatatttttgaattagcgcgcaaagtgacttttttgaagttttaaccatttttgccaaacactggggttgaccccttatttgt

SEQ ID NO: 1745 - DNA, 3999 bp, Heterodera glycines
ccccccccaaggtatttgaaaaaacgcgctttaaaaaatggtgaaaagaaaaaattagagtagagcgggaccgggaattttgggcttaaccgggaccgggacctattcgggttgaaaaaccgggaatttttggctgggaaaaccgggaaaaaacccgggactggtcccggtcaaaaccgggacctcggtactcagttgtccgtgttttggtcccggtcccgctctactctagaaaaaatcgtcgtaaaaaaggctctgtcaaaaagctgataaatttcatcaaatggatcagcttcttgatgtgaaatggatgtacgtttcggccgacctctttcttatacaccaaagtttaagtttgaaaatttaaggaattaattttgtcaaatttgggttttctcacacccagcatgcttcatttttatacacagcaaaaaaaaaaagtcaggacacataaatatggttctacaatcacgatacaaaataggtaataaagtcagacattatataattccagccatgacggccaattaatcttccgtttcggcctttttcttcgtctccaattgcttcaaatcctccttgttcttcgtgagcatttcattggccaattctgcgaagcgtttcttctggtcctgaattaaacaattaataaatgtgaagacggtacttttcaatgagaaacccaaaaaataccaactgttctgcccttttcacctcgatctgctgaaagtggtcgcaaagtttcgtgactttctccagcaccgccgtcaacaattcgttgtattgtgcgtccaaacgatttttgtagtccaaatactaaacaaattcgaaattgtaatggtctgtaactgcgattattatacatttttgtgcttctcggccaattcgtcatggagtttgcccaatctcaggtcaattttgcccagttcgtcgacggtggcctggtgtttctgcctgatcacatccaaactgtgcttcgcgtcgaccaatgaacgctgattgtccccaaacttgcgcttggcccgttccagttcaagcttgtgctttgacagaagctaaatccgttcaaactggatttaaatattttcggtttcattttaactggcctgctctttgctgaactccaactcgttgatttcgtccaccaatttgctgttggtcactcgcattgattcctctgcttgttgcacagcacggatttggcattccatcatccctttgagctggttgagcaaacgtgtcaatttgttgtcgttacggcatcgctgaaactcgacaattgcctgatcgacgctgcactgttccaattcggccaggtgctgctgcagttggtcctcactgaataacggctcacagatgacgcgaagacggctcatgaacgcgttgtagtcggaacgaatctgaatgatgtgtggttcacaaatttttattgaattttttcataaagaaatttcaagggaaaaatttttcagcgattgctaattgtaattttttcaaaaaaaatttcttatgaaaaaacttcctaaacgttttataatttttttttaatttttcggcgaaggagaaacgacgcgggggaaataagtgcatccaccaaaagtaccttggcggactgcttgaaaatgatgggctgacgttcgtaaatgcgtgcctctgttttgttgaggttttcgcgcagcaacaccaactcttcgcgaacctaaaactcgaaaactgaattttatatacatttaaaaaaaatttgaccgatttacgcttcgcgaccaatgcacgcgcttgttctccggctaattcgctgcgtgctgatcagacgctccctctcccggttttcgttggccaaattctcccgtgccatcaccagttccttgttcgccaatgtgatttcattctgtaattagagggatttggtcaaattttatcaagtattcccctcgaaactgaccaatgtgcgttccttggccgacgcaaccatttggatctcctcaatgtatcggtccatgctggcaatgtcattctcgcagtccacggcttccttttcaagctgttcagaaacgcactgcgcctgtaaaaggggtctcaatggacagcgtcaaaattactggtcattcgcctacctcagcaatggcggcctcgagtttgtgaattttctgctcctgggccacacgccgtgccaccaattcgtcatacgcgttgcagtcgatgcccttctccgccattttctgggctcgatactcctcgaatgcctctttgaatgtttcttcccggtcgtaaggttggccatggcctttggacatgaacttcttaaagcacgagatcagcaggttccattgaggatcatcacgaattttgtccaagttttggtacatttcgttttcaatctaaaaaataaatatttatattattggcatttcttcgaaacctcaatgatatcgataaaccaatccaatgagccgagcaacagaccccacgaagttggcaaagtaatcgtttgcattgtgctctgcttcagcacataaggatagcccaattggttgagaaaattaagggcctaaacagtttcaaatgtgaagatgaaccgaaaagaaaacaaacgtccgtctcgagttttcgcacttggtacgttggctcaatgcattgaaacaaatattggaacacatcctggaaggcgattttgctgggaaagcgcagaaagtcgggctttccgaaggagaacggcggtgccggattcactcggtcttccaaaaagtgtacgatttttctgataatggctgcctgaacttcctaaaaactaaagtatcaaaaatccgtgaatgattttaaaaaacttacacggtcacgaaggttgcgctggtccgggattgtctgcattttcggcaccgaaactaagcgacggcctttgcagcccggaatccactctgacgattggccaacgaaagacgggagggcaaactcgcgcgtgcttcgtctgcccatcttaaagcatttttacaatataagccctgatttgccattaaaggaacatttggaaacaaacgaagtttaccgaatggaacgagggttgggagtcgggtggaaaggctggcggtttgtgagcggagtacgactcggaggaggcatcatactcttccgctcaagaatgctcttccgttcagaattcattgaggaaaacattaacttttaagatttattatatccttaaacttaaacaattaaaaaaaggaaagtgtatttatgaaagttgtgacagtgcacctaggtatttgccgattgccgagtcggcagcaaaccaagccaactctgattcatttaaatcaaaatattcgcaatttgtcatttaaattggcattatgtatagatttcaaataatggtaaaaaaaatgcattttcgcttttcagatttgcctgaattttgaggaattgaaaatcctcgatatgtaaatataaaaaaattatattggaaaaaactgaaaatggctgaaacgctgccagatttattagggatgtcctgcttcttgcattagcattcatatcaaaatactttgttagaaaattcattcatttttatctcgttaatatttcaataatcgcgtaaatttcatccaaattttctttttagcttcattcattctcgaattatgtctatgctcgatttttgcatcaacaaccccttgattcgcatcggcacctatgcgttggccattttcatgttttctcgaacggcgtggagagagttgagcggaaatgaaaaatttgtcaaacacttggaaaatgaggtgactggggtgcgcaagatggacaagaaaaacattgtgacatttgattagcattttgtcgaaatttataaattattttaattatttgttttgaataaattatgtaattaaataattgtgattttgtttctagagtggttgactaatccgcgttttcaaattgaagttgagaaacttattgtcgaacaatcgttataattttttgattcaatgttggtcttacgcc

SEQ ID NO: 1746 - DNA, 1147 bp, Heterodera glycines
acgatgactgtgaacataaccaacagagcattggtacgaataattaagcggaggatgattaattagggctgggcatttagtcaattaccttttttttggtttttatacataccgtaaatccgctatttgaaggctcgtggccttctattgttcaaccgctccaaaaagtggcctttaattggagaggggtcttcaaatagtggatttacggtagtaccttttgggatttttatgactttttagcatttttttttggcaatttttttttatgacttttatgagattttttgtgacttaaactcccggccctaatgattataatataatttttgaaatccaacagaaatttgaacggctgtacagcagtgaggcgtcgctgtgggtcaattggggcggctttcggccaatgaccacgccgttgtgcggctacaacggcacaatgtgcggccaaaatgtgacggtgtacattctggtcggcgcaacgcttatgctgctgatgctggttgccgctttgcttggcatcggatatgcaattaggtaaacaaacagacgacggatagaaaaagcatcggacggtgccgatcagaaattggaaaaagcatcggacggtgccgatcagaaattggaaaaagcatcggacggtgccgatcagaaattggaaaaagcatcggtcggtgccgatcagaaattgaaaaaagcatcggacggtgccgattagaaattggaaaaagcatcggtcggtgccgatcagaaattggaaaaagcatcggacggtgccgattagaaattggaaaaagcatcggtcggtgccgattagaaattggaaaaagcatcggacggtgccgattagaaattggaaaaagcatcggacagtgtcaatccgaaattaaaagcaagtcgataattggaccaatgggaaaggtagtgccaaaatcaatcataattttatgccgcatttctccgaattcggcacaatttgggcgccctttactccgccccgattttaccatttgcagggagaaaatgcgcgagaagcagcgcctgacgcgcgagtgtttgatcccattcgcggagctgcgcaaccccaaagagctgcgcagttcggaggaactgaaggcggacacggagaagagcatgcggagcatgc

SEQ ID NO: 1747 - DNA, 969 bp, Heterodera glycines
atcatcagcagaaacaaatgcgagtgccgcaacgggaaaatgacgaaaaacatcacacggggcattccatctgatcagtgatctcactccaatcattgaccgatttaatgaccattttaaatctctttattaattattactttttaaatccctttttcttaattattaaaatcattattcagtatggctagagactagaagtatcagataaaaattcaaatgcaatgatcgatcaatttattttataatttagtcaaataaaaattcattagaagatttcggatcacaatttttatttgttcaaacggttagacagcgccgaaacatccgtaggacactcactcattttctgtcgtaaaatctgaaatttttgcaaattttaatttaatttcaatttttttttggcttattacccttcaattgatcaatttttccaactcgcgaaaatcgaactgttcattggacatgttggcacccttatgaccaatatgagcaaggcacgtgttattgttgaatgatgatgctctgttgacgagcacttgagtgtcattttgttcttcacaagcccaaaaaacggtgatctgttcagtgcctaagacggaaattaaattcatcaaattgtcttaattaggtaattagtgagtggcccaccgattgcgcaaccaatcgcagaacagaattgttgatcagcagcacattctgatgccacaatagcagcattgcccgacgtgtcgtacattccgactttgcaatggatccctgtgaaatgtaatttaaaaattaattattttttgaattttgaaattttaaaattaccgtagcaaatgcatggaaaggcgaggcagcagaagaaagtaaatgggagaacaaatttcattttccgcttaatgttttgatagacgaaaaacaatcattaagaaattggtgacagatattaaaaatattgatttaaataaaaataatttaaaa

SEQ ID NO: 1748 - DNA, 4465 bp, Heterodera glycines
  misc_feature (26)..(26): n is a, c, g, or t
aaattggtgacagatattaaaaatanttgatttaaatttccttaatttaaaagaaaattaaaagaaaataatttaaatatatattaaaattaaatttggtccaaaattttcattaaattcttctccactttgccttttcttcttcttcttatgcttctaccgttcattgaatacgaaccatcatcattgcccggagaaggaatttggtcaaaaaacctttaaataaaaatataaaaattaattaataatttaacacaaaatttgtcgattaattattattgagcaataaataacaatttggcaaaattcaatgttatttttccataattaattaatcattctcattatcattatgtaccaaatgcaattgttgagcaggtaatgaaaatgttggcattttcacggatggttcggccggtcggaattggaagttcattgaattcaatttgaactgttttataaaaaaaggaaaatataaatttaattttttaataattttcatccatttaataatatattattgttgccaccaaaagacagaaacgcaaaaaaaaaaatttgaaatttatgaaatttttgaggaattttaccaaaacggcacattttttagtcaaaaagcaggcttaacataattaaacaattaagtatcttttctaatattattattattatttaatttttttgcgctcactttttcccttcatcggcaaataattcgggttgtcaaaattaaaattggccatattctctcccttggcaccaaattggcaatggcacttttggccaaatgccaggaatttgctcatctcctcacaatcgttgtccaaggaacaaccccaaaaggtaaaaatttcagagagtgtaaaaaagggtgattgacaatcaattaaacaatcaatcagatcgccgcattgatttatcgatcggtctaactaatcgaacaattgatataaaatcgattattgatcgattgattgatcgagattgatcaaaattatcaaaggctaaaaataaaatcatacataaattggacctatttcgcagctgaccgtgtaacagtactctccgcctcggcattctctggccgctgtagtaccgtatccgtttccacgaaaatagcccgccttgcactggatgccttataatttaaatgtttatttttttaattttcgacgatctatttaaaattcaattctccttttctaacaatttcgatctaatcggggatataaattaattttcatgcaattccaattatggcataatattcgtggcatttttgcaatcttggcgctatttccctcatttttatggcacaattctcgactcattaccatccatttttccctttggcattgttttccctcataatttttgtgccacagttcgctgtcattttttatgcaaaactattttttggcattttgccctcacttttctcaagtgcctccggcgaaatggtcggaatcgggccgggcttctccttttcgggcagtttaacttgctcattggccatgtctttgccctcgtcaccaaattggcactcgcaccactgcttcgtcgagtgcagcgcggagttggccgcgttcacaaagaattgttcgcagcctttttagtccgcgtccccgctgcacccccaagtgatcagtgccgtggaggtgtagttttctgaatttttgaaatacaaaaaatttgctatttcggccggcgcctaagtaggcgctaaaaatggcaagcctgatcaaaacaaaccagcaaacgccagaggatgctttttggaaaaattttaattttcactttgaaaaacaggattttcggcgccggacttgcgcctgtctgatacaaaccctaaaaaccaatgggacaatggcaactcgtataaaaggcaactcatattttatgaaataaagcagatgcctaaggctaggcccaagccaggcacccaagcaggcctaagcctagatttaatccttggcctaacctagcaattgtacgatttgccttttgtacaagttgtcatgacaccaaaccaataggtcaaagaaagataagagatactgtactacttaaaaaaagtgtaaattttacggaaaccggatcggctaaaatagataaaatttcacttttgcgggtcagaaaactggaccaataaataaattgcggtgattttgatgatttaattttattaataattttttttgcacttacgctccatgcacatcacggaaaagcagtgatgggctttgctctcgcatatttcagttgtggcatttcaccagataaatggttggcatagcccgccttgcacgtcaatgctaaattaattaattcattgactaattaacaaactcattaattttaaattgttactcgagcatggattgaacatggcgatcatcagcagcaaggcaattagcggcaaacgaacaaaggaagagatcattttcattatgttcttaaaattttattggaatttaattgaatgatttttatttttgttttggctaataaattgtaaaagaatgcttttcctttttccgtttgccttttttatgagtcattcattcactttccatccaaacaaatgcttctttctgctgcctctattctgatgattaatctgattaatcaaaaattgtcttcatcgtcaataacattttatataattattcactgagaaaatgaaaaatgatttatgttaattaaagcgaaaaattatttgaaaaatagatagtaatattcaaaatagtagaaaatatttaaaatttcgtagttaaaattaaatttccctaattaggtaattagtagagaccggacaagagggtcggtcggtcggtttcggcataaaaaccgaaaaaaaccgaaactgaaaaaaaccgaaaaactcaaaaatttgtcggtcggtcggtttcggttaaaaacccgaaaaaaaccgaagaaaaattttcggtataccgtttcggtttcggtttttttgaattttttatcttttcccaaaaaaactcgggggcgacatgtcgggagtcgggggcaggggggggggagcgcaaatgtctggggttggggaccccgattgagtagtgatcaacaaacttttttaacaaaaaaaagaccaaattttctctttaaatgctcgaaatcttccttttttcactttaatcaaaatggaaatttttgaaaaaccaaaaatgtagtcaagtaaataaataaataaattttgaatatgaatttttgataaaattttccatttctcaggggtgtatttttcgtttttattgcatttttgttaataatttttttcaaaatagcagaaaatattttacaaaaaattcttcaaaatgaaaaagagcacaaaaaagcaataaatttattattattaacaggttatatcgctccaatttgattcggtttttttttcggtttttgaaaaaagtcggtcggttttttcggttttttgattatttcggtcggtcggtttcggtataaaaccgaaaaaaaaccgaaaccgaaaaaaaaatcagcaaaataattttaaaaaagcgtatgcaaaagtcatgaaatgcttctcgttctgctgactaattgaaaatgatcatcatcaaacaaaattaagaatacctttaaattgtgcttcattatggatacatatgtttaatataagttctgattcaaatttatatatttttatttattttttttatgaatttgttttatttggcaatttctgttttccaatttttcactattttcaatatcaattacaaactgttatcaaataaaaaattattcgaatttagatcattttgcaccttcaaaactaaataaaaattcataaataaaaaataataatatcgtgagaaaaaaaatccaattgatcctggtcaaaattaccagatcgggatcaggatagttttgtcatataaaaataacatgaaatttataaaaattattccatcgtgtttttaattgaagacccaattgattaataataaaattaattagctaattaagttttttctcgcgctaatatgatttggcaagggcgatcattgaacactcgatttggtgttttacataatatttttgtttatttattcatctttggatgtttacaatatcctcctcctcatcgcagtgggacatttgcggacggcattttgcgggaccggacatttgcggacggacatttgcggacggacatttgcggacggacatttgcggacggacatttgcggacggacatttgcggacaattcctgagaaaaaattaaatgaaaaaaattttttttgttataaaaatttctaatggaagagtgggcctcgtcagtgcggtgctcttccaaaagaaaacaaaaaaataagaaaaaaagtgtgtttcggccctaccgcagacacacaaaactaaagaagcacacttcaacaaatataaaatacaagccaaaatattttttttaaaagccaaaac

SEQ ID NO: 1749 - DNA, 5744 bp, Heterodera glycines
  misc_feature (3832)..(3833): n is a, c, g, or t
aaaaataggctgttgttggggccttcagcaagcctaataaaaaatttaaataattacgaattaatttgttttggcttttaaaaaaatattttggcttgtattttttaatttgttgaagtgtgcttctttagttttgtgtgtctgcggtagggccgaaacacactttttttcttattttttgttttcttttggaagagcaccgcactgacgaggcccactcttccattagaaatttttataacaaaaaaaatttttttcatttaattttttctcaggaattgtccgcaaatgtccgtccgcaaatgtccgtccgcaaatgtccgtccgcaaatgtccgtccgcaaatgtccgtccgcaaatgtccgtaaggcctcctcatcctttgactaccataaaaaaaaagttttctttcatcattctttacaaacatttattttccccgatgatcacattcaaaacattcctttgttatgctgcatatttttgccacagaaaattagagttcgtcatttttgaaattttattgctaggattcgataattaaatcctggattggattcaaaagaaaaaattatattttcgcggcctcctgtgattttgatgcatttttcgaaaaattgcctgatcagggtcgaaaaatcatttgaaaaattctggcagggtccggcccacaaatccggtctctctaccggaaaaccctaaatcctgaaaagatttgaggcacccatcctaagagaaggggagcgcgatgaatttaagtgtcttgatgaattctttcctcattgtaccgcatgccattttcaaaaggacactgtatcactagcacattttccggttacgatacctacacacaaattttttttaattaaatttctctaattgccactatgtgcattaacaaattttttgatttttaataataattaaaatccatttttccggcatttattttttcctgctaatgccgaagaaaccgacaccgcgtccacttacgaagcctccgccccaaccgccgccaacgccgcgtccgcaaccggcatcgccggctcaacggccggcgccgcgtccgccgccgccgcccaatcttccgtcggcgcgtcccactcacccgccaatgcagctgcccacggcacatccatctcacccgccgatgcagctagccggtgccagaagcagattctgagccattttcaaagataaccgcattttagcgatcacacatattttgaccgatcggttcttttggcacattgccaaaatatggaaattcaatttggtattttgttgccattttaaaattgttcgaattttgccgaataaataaatgcatttttacagactaaaaacatgcgtgtgttcaattcaaaagcattgttttatggatttgttccaacaatttcagtttacaatgacaattcttgcttaaagctcaaactcattgtgtggcaattttgtcgaaataataaacaaatattacccagttacaaataaataataatttaattatttattttttaattattatgcatcactatcaattaaaaaatttattgtcagctgaagagccaattctgttgtgaataatatgcataaatcaccgatgctgagaaccactaattttttgctttcattttcaaccaaacaaattacttaaatttttgaataaaaatcaattttttttttggattcctgagagggttttttagaacctaaagcctacctattttggcagtttaagcacctaaaaatcgcatccctagtaataatactatcgatggtgccccacctttttggaagaaaatttttttgttctaaaaagtcgaaatcatgtttatggggagtttacagggtcgctgatcatgaatctgacattaatttaaccaatttcgaatcccggacccgaattcgaacaaaaagtcgaaattttcaaaaattcactttatcttcgtttctgtacagaaagatcattttttgatgttgcaatgatttttgactaaattcaacttgttttgttaatttatgaacaaaagtgagaattttgaaaatttcgaattttcgacttttgtgttctaattcgtgcccgggattcgaaataggtaggtcgaaatggatgtcagattcgttgtcagcgatcctgaaaaccccccgtattccccgactttttagaaaaggggggggggtaccatcggtagtattaccggggttcgaaatgtgtcgagatggatgtcagaatcggactcttatatcccagaaaacccccaaaaagcattgaattagaaaaaataaaaaatttttttttatttttttcaaaaaatgggacctaccatctgggtcaatacaaagtcaactcgtacaaaaaaaattctaagaattttcaactaaaacttagaatttttagataaaaaaactctaaatgtattttctagctagaaaaactttaaaacacttaaattttcaaaaaatttaagaaattaaaaaatcagctgaaaaatttgtaaaaaaaaactttaatgaattttttatgtttttcttggctagaaatccatttagagttttttttatctaaaaattctaagttttagttgaaaattcttagaatttttttttgtacgagttgccttttgtacgagttgccatgtctagggatacgatttttaggtttttacctatttttttcctgaactccccgtgacctgaaacgcacgaaaaacatatttttgggctgttgttaagctacttttcgagttattagcacctattttctaggtttttatttttagcacctaaaaacctaaaattggcgttttgtcgaaaatttgttaacaaaaatgcaataaaaataaaaatgtttttaatagctaagaattgcaaccatctaatttaaaagcatagttaattttaaattttatgagttataaatttttaagcatgagagttgttaaatttactaaattttaatgatttatataacatttgcatatttatttgccgttttggtgccttttggcttttttaccaaaaattccattaaaatgcaataaaatcgggaaaatacgccccctaagaatttaaaaattttctcaaaaaataatttttttttcttggtaaaaaattttagttttaaaaattttctttttcgaaaacattataaatatttaataatcattaaatgagcaaaattaagttttttggttaagttttacgagttttgctcactaaaaatctttaataaaaaatttttaatgcctttttcgggattttcgtgccttttttcaattttttcatgcctgttatagtgcctttttcgctatttttggtgccttttttttgcgagctctactcattattaatgaggctttttgaccacaacaattggtagttttcatctgcatgttatattctagacataaaattgtcaattaatttgattaattagccaaaacacaaaacaataaattaaaaggaaaaaatatgtgtgcgaaattatttaagcatcatcacttttctgttcatcatcagccatttgatagtggaccaaacgccgcgggtgcaattcagcaaaaaagcggacctaagctcagtgcctctgttccattcctggctgaaaaagggaacattttttgaaaattatttggcatttttatttattggcttaacgtaccgcacaattttgagtgccggaaggaattgccctttttgggcaaatgcgagtgaaatgtaaaggaagcagcgcgaaatcagcaccgggtcaccaatttcgatggccaaacggagctgacgaatggaaatcacaaaggcatgccgaatctgtgggaagaattggggggggggnngggggaaggattttggcgattaaacaattaaaaacaattatgggatcgcttgccgtctcgatttttcgggagaaatcgtttcccccaaaaattttttagaaaatttaataagtaaatccaagaagaaagtcttttaaaattttcagcgtttttctgcaaaattttttgaaaatccagaattctcaaaaattttgaaaatcgcgaaattttttttatttcaaaattcatttttttttgtctgtttttagagaaattttgttttaaaatttttaaaaaattctcgggggggggggacagatagaggggtaaacgtagccctattttttgcgccaggcttttccaccttctcccaccccagctccccttaattggatgatgtaaatgaaaaaagtcgggattttggcaccagtccagccaaatcgcagaatcccgaccacccccaaattaaaaaaaatatataatttattacaaatttccgactaaaaaagcccattgcggacacagcgccgccaagcgttgaaaggcgccaaagctcttaagaaagggtgaaaagacagataatttaagtacataaagataggcgatgctcaagaattacaacggaccggtctcgacatgcagaactgaaaatgagggggaaaattgggaaattgtggcaaaatttgttttgttgcttacccttttgtacgagtgccgagagacgggagtccctgaaaaatgtaattaaaggaaatactttttaataattgcctgtgtgtttgccagtggtgccacccatggccagggatattttacgtattcggagaagggtgccaagcccggtttttattttcggcgattttttgaaaaattttggaaaaatgattacaaattcgtcataataaatttaaaaaaaaattagtttggggggggggatgacccagatatatcaactccaaattccttttctgagcctcgaaatctgatcccgagatttagagaagtggaaatgcgcttccatcctcttccctgtttttaggcaattaaaaaagccaaaagtcattaaacgcgcacataaaaaacagttagaggcacatttttaaatatttttaaacggcgaataaacgcaattatcaccagcgcttgtcaatgtgaaagtccgtcgctttctttgatgtcggccgccgacggcgaagggaaagtcgcacaattgaagcccaaaagtgaggggaggggaaagacattaattgtaattaatcatatcacatccgtcccgttgcatttcaaattttaagcctcaaaatttcggaaattctttcaagggtgtccgaaattctagcagagttccaaaatgtgtgaaaatccgaaatgatatccacacaaatgccatcgaaaaaaactgctcacagatccgtcgacgatggccaaccgtcggcgcaaaagtgtcacccaacggagtcgggtccaaaagttcagtgcctcaaaaattgagcagaagaacagcagagtgcgggacggcacacgccgatgccgaccacaaaccggcaaatccgcagaagacagacgcaaatcaacgcaaattgacatgtgtgttcagcaaaaattgggaaaatgccaaataaaatttgcgttttttaatatcgtttaggccctataatttccaaaagaaggtttgagggtagtctgatcacgaattcggcaattgtgtggaaacaaatgatgtgaattaaaaaaaaatcggatttatggttttttattcgagtttcggggttatggctcgtaatgatgggtcgccatcagggctggacgcaattgaggattacggaaattgcggggtttttggacccccgtaactgcggatttccgcaactgagaaaatcgccgcaattgcggatttccgtaattgttaatccagttgcgtccagccctggt

SEQ ID NO: 1750 - DNA, 982 bp, Heterodera glycines
atttgttaacagatgttctccaaaaatgaccaatttttacgaatttaagccattttcttaagaaaaaaaaaaaaagttttttggggccggcggtgccgaaaggcgccgccggaaaatttttttgaaattgggagttttagtagcatttatatcagcgaaataaataattaagcacaaaaaaaaaattaaaaaagtttggggaagctaaaataaaggacaatctttaaaaaaaggacatttttaatttcaaagatccggcccctccaaaaaaggacaaatctttaaaaaaaggacacttggccgccctgttcaaaagcaatccctttgactcatgtggagtcctataatttgttgtaaaaaaatacaccggacaaaatttttttcaaattaccccattaggtttttccttgtttataggccatggcgaaaggcctaaattttgaacggatgggggggggggggggagggttcaaatttttcttgccacatttagataaaatttttcaaaaattgttagggctgcggcatatattggaacaccttcttaaaaaaacaatttgtttaatatttcgggccaaatattgctgcgaatcaaaatttgagggggctcttgaaaacccaccgtaataaaaatggctgcggacgaggtgggaaatgcctgaaataacagaaaaatcatgtctttgtttctgtacgtgctctccactcttggtggtgcacttaatttttcccccggtaaatggttttttttgcaggaaaatttctaaatttcaatattaaaaaaaaatttaaatttttctggtgatttttttcaatccctttgggagggggggggatgggtgtgctccgtttgctccctccgtcgaatattaaaaaaatacaaatttcgaactaaaagtttttcataagaattcgtagtatattttttaataataaaatttaaagaataatatgtgtcgaaattgttcagctatttttcttg

SEQ ID NO: 1751 - DNA, 2191 bp, Heterodera glycines
aatatttgggttttttcagaatttagcaattttccgtcattgcacagcaaccgctaaacgtacagcaacggcggcacttgcatccggtgcagctcttcaagggctctccaagcctattgttgtttttttttctatctcatctctgaatggagttataacaacttttgtcaactgtttcgcatttaacctacccattataaaaataataattggtacgcaaatccaatcctattctgattattctgatttttttagctagtctctgaatggggttatcacagtttttcgaatccttttttcataacagttacgcacttaacaattggcatcccaaaaatattaattaggtacggtagtcaacttgccgttcgaacatataccattcggtttgtctacgcgtgagatgggagagtgtattcctgataatatttggttttttctgatttagcaattttccgtcattgcacagcaaccgctaaacgtacagcaacggcggcacttgcatccggtgcagctcttcaagggctctccaagcctattgttgtttttttctatctcatctctgaatggagttataacaacttttgtcaactgtttcgcatttaacctacccattataaaaataataattggtacgcaaatccaatcctattctgattattctgatttttttagctagtctctgaatggggttatcacagtttttcgaatccttttttcataacagttacgcacttaacaattggcatcccaaaaatattaattaggtacggtagtcaacttgccgttcgaacatataccattcggtttgtctacgcgtgagatgggagagtgtattcctgataatatttggttttttctgatttagcaattttccgtcattgcacagcaaccgctaaacgtacagcaacggcggcacttgcatccggtgcagctcttcaagggctctccaagcctattgttgttttttttctatctcatctctgaatggagttataacaacttttgtcaactgtttcgcatttaacctacccattataaaaataataattggtacgcaaatccaatcctattctgattattctgatttttttagctagtctctgaatggggttatcacagtttttcgaatccttttttcataacagttacgcacttaacaattggcatcccaaaaatattaattaggtacggtagtcaacttgccgttcgaacatataccattcggtttgtctacgcgtgagatgggagagtgtattcctgataatatttggttttttctgatttagcaattttccgtcattgcacagcaaccgctaaacgtacagcaacggcggcacttgcatccggtgcagctcttcaagggctctccaagcctattgttgttttttttctatctcatctctgaatggagttataacaacttttgtcaactgtttcgcatttaacctacccattataaaaataataattggtacgcaaatccaatcctattctgatttttttagctagtctctgaatggggttatcacagtttttcgaatccttttttcataacagttacgcacttaacaattggcatcccaaaaatattaattaggtacggtagtcaacttgccgttcgaacatataccattcggtttgtctacgcgtgagatgggagagtgtattcctgataatatttggttttttctgatttagcaattttccgtcattgcacagcaaccgctaaacgtacagcaacggcggcacttgcatccggtgcagctcttcaagggctctccaagcctattgttgttttttttctatctcatctctgaatggagttataacaacttttgtcaactgtttcgcatttaacctacccattataaaaataataattggtacgcaaatccaatcctattctgattattctgatttttttagctagtctctgaatggggttatcacagtttttcgaatccttttttcataacagttacgcacttaacaattggcatcccaaaaatattaattaggtacggtagtcaacttgccgttcgaacatataccattcggtttgtctacgcgtgagatgggagagtgtattcctgataatatttggttttttctgatttagcaattttccgtcattgcacagcaaccgctaaacgtacagcaacggcggcacttgccatccggtgcagct

SEQ ID NO: 1752 - DNA, 1156 bp, Heterodera glycines
  misc_feature (1086)..(1086): n is a, c, g, or t
  misc_feature (1147)..(1147): n is a, c, g, or t
ataatggtacgcaaatccaatcctattctgattttttagctagtctctgaatggggttatcacagtttttcgaatccttttttcataacagttacgcacttaacaattggcatcccaaaaatattaattaggtacggtagtcaacttgccgttcgaacatataccattcggtttgtctacgcgtgagatgggagagtgtattcctgataatatttggttttttctgatttagcaattttccgtcattgcacagcaaccgctaaacgtacagcaacggcggcacttgcatccggtgcagctcttcaagggctctccaagcctattgttgttttttttctatctcatctctgaatggagttataacaacttttgtcaactgtttcgcatttaacctacccattataaaaataataattggtacgcaaatccaatcctattctgatttttttagctagtctctgaatggggttatcacagtttttcgaatccttttttcataacagttacgcacttaacaattggcatcccaaaaatattaattaggtacggtagtcaacttgccgttcgaacatataccattcggtttgtctacgggtgagatgggagagtgtattcctgataatatttggttttttctgatttagcaattttccgtcattgcacagcaaccgctaaacgtacagcaacggcggcacttgcatccggtgcagctcttcaagggctctccaagcctattgttgttttttttctatctcatctctgaatggagttataacaacttttgtcaactgtttcgcatttaacctacccattataaaaataataattggtacgcaaatccaatcctattctgatttttttagctagtctctgaatggggttatcacagtttttcgaatccttttttcataacagttacgcacttaacaattggcatcccaaaaatattaattaggtacggtagtcaacttgccgttcgaacatataccattcggtttgtctacgcgtgagatgggagagtgtattcctgataatattggttttttctgatttagcaattttccgtcattgcacagcaaccgctanacgtacagcaacggcggcacttgcatccggtgcagctcttcagggctctgcagcctatggntgttttttt

SEQ ID NO: 1753 - DNA, 3402 bp, Heterodera glycines
caatcatataataagcggagcagaacgacgtcaaatggtacggatttacaaatacaaatgaccacctcttcctcctcctcctccttctacattgtgttaccttccaacacgcaggtggagggcaaccgtacaaactcctttcgggtgcgcctgccacgcaaacttcagttcggctcacaatggagtgtgggtttggcggtgttgttgtacccgcattcatggccctcactgggcacaacggaagagcaatttgtccgtgtcgaatggcaaaccggcgagcaggtgcgcatcccggtgccggccagcaatgtgcgaaatcctacacaactgctgaacagcttgcaccacgcactgggcgagggcagtgaggagctggccagccgattgcgtcaaatccagctcagctaccatcagctgaccggagaggcagagacaagcgccaaaaaggaggtggaacgtctcggttcattggggctacaacaacaaccaagaaatcagaccaaacggattgatgaagaaaaacagcaacaacaacaaaaatctgatgaaatgttgaatcaacagcagaatgaacagcaagaggaatggaaacggacagagttcaatgcccattatcgtcgcacactggacacgcttgtcgctgaacgaatggaggaggcggagcgcaatttgttgaacaaacatttacccttgggtctggagctgtgggtgcagtcatatcgcaaggcacgcctgtcctgccgcttcagcttggacgtggagcagcaacggttccgactacagattgacccagtacggatcaaacaggtggagctgtccgagcagcttgcctacatactcggcttccacacgcgccacctgtcttcaccgatgagtgtggctcgctaccagccggacatgaagggcggcgtctcatccttctacgtttatgcacccggactgattgagccggtgatcatcggtgacgtatgcgtgccggtgctgcgcatggtctgcattcgaagtgcacaaccggacgacatggttgaagaggcgtacaccgctgttcagtaccatcagctgatcaccaaagagattgccgaaattttcattgagatcagaaccccaaccggcgcactgatgccctttcaatacggcacctgcacgttgacacttcattttcggaaaactccatatttttgagcacacacgcacatatattgtttatttgtttttcttgcattcacaccacatttatttatttttttgcgcgtccaataaaaatgaacagcgatgagattaacaaaattttgtcacgttgccacatcactcgccaccagtatgttggctgcttcccatgtgaccgaatcccgtcccattcctctccgatgccacactgtatggtggtgaatatggacaaggcctccggtggagggacccactgggtggccatctatgttcagtcgccacacagcgctgactactttgactcctttgcggactggccacccgcatcggaacatatacgtcgcttcttggaccgacacttcaccaccgttcagcacaatgctcgctgcctgcagtctgagaggtcggccagctgcggaaagcatgttatctacttcctacatcaccgttgtcgggggtggacgctgcgtcagatcattcaacacattgacacgcaacggaccgagcccgaccgtctcgtcagcgcctttgtccgcacacatgtgtttggtgacctttgatgctggaaagagactcaaaagaagaaaaagacaaaaaacataaatagacgaaaaatgttgaaaagaaatatttgctgtgacacacaacacatacacacatgcacgtggatttcgacccattggcggtggactggtcccactttgcggaaccgccgccacgcatggacaccatgttgatgagtggtggagggagttcaatgggtggagggggtggtggtggagcggcgccgtcataccccgtcttcaccggacttccctatcaacgcggagcgggcgggattggctcaatgtttcgcagcttccttcgcttcttggtgccaattggtagacaggcgggcgcggcgatcggtcgccagggacttgagacaggatcacgtgtgctctcacagatgcttgaggggcgtaatgtgaaggaggctatgacggaggagggacgtgccggacttaaaaacttgttggacaaggcggcggacaatctgagtcggcagcgctccgtcgcagctgctgccgcgaccaatcacgggggcgccggcagaagtggtcgtggtggtggtggaggactgtttgactttaaacgttatcgcaagattgtgagcaacaacaacaacaacaacaacaaacgcaagtcgtcgtcatcatcaacaaacaacataaaaaggaataaaaaacggcggacaggcatcttacaatcaactgttggcccctcactgtcaacgccagcagcagcagcgatcgccgccaaaacaaaaggcgttcgttttgacgcattgggttccttctgaccaaagtgtggtagcacataaaaacaacagcaacaacacagcaaaaaaaaacaaaagtaaaaaatgagttgtccaaaaaaaatcagtgagcagagtgcgcttgcgttcaacagcgcactgaacgtgtttgccgttccgcccaccaatgtgtcggtgtcgcgttccttcttccgtgagctgttgccgctgtccaccatcagtcaggagggaccgtatctgttccgcatgttcaatgacaacctgtgggccgacatgtctcgtgtctacctgtttctggagttgtccatccaaaaggaggacgctggcggacgatgggtaccaattgaagcggcagaccaacttgtcggacctatccaatgcattggacaaacgtttattcaacaactcaaggtcacacatacaacatccgaacactcttcacttgcagaaaattaccaatatttaggttgaagtgcaaaacactgagttgtatgacagcggcacattgtacccctacaaggcgtatctgaccaatgagctgtccttcccaaacagtgcaaagggtcatttcatggccagcgcgggctaccatccctcgctgaagcatgacaacccgacggatgccggcttcttggcacgctgtgctcgctttgagggaggacgaaaggctcgcttcctttcccgcctggactttgacctgggcaaccaggagctgtacctattaaacaacatggacgtcctgttcaccatctaccgtgcaaagaacacattcctgttgcaaaacctggcgccagcgccggcggcaggagtagcggccaggcagcagtatgccttgtatctgcacgacataaagctgtacatgaaggtggtggaggtgcaaccctcgctgaacctgtccatctacaaaacgctgg

SEQ ID NO: 1754 - DNA, 3071 bp, Heterodera glycines
catactccatccgtgagatcagcgtgcacgccaggcggtcaaatatacccggcggtgccgcaccgcatggacttttcccgctccgcctacattcgaccctttgttgacatgtacgaggcgctgggcatggccaactctgaacgctccatggacatcacgctggaccagttccgcgacggatggacaatttttgtggtgcccatgacctcgacgctggatgacagttgcggctttgaactgctccgctccggcactaccagcattcggctcgctttcaacgaagagattccggccggcggcgttgagatggttgtgctcggggaatttgatcagttgataatgatagactacaaccgtcacattgtgtctgactcaaaaattgcataaataaagttgccgttgtgcaaaagaccattctgttgtttccaaaaaatcgtaacatcatcatcatcatcatcataaacacattgacatcacttcccaaatgtcaaacctaagctggatgattttgtacgagccacgtgagggtggtcgtatggtaccccatccgctgttcgaccccggtccggaaatgtcggcgcgcgtcattgccaccgcaccgcttttttcgacatcatatttttgtttgttttttattatcttttaccttacatgtcatgacaatgcgcgcatcacaccgctccgtgaataataataatttttaagccacccaacacgctaatgaatcagacgacagcgtggcagatgctgtcatctccggcggcggtagcggtgtagcatacactgtaacagaagctgcgttgctgaacaacaccaccagcacactaataggcacgacgtcagccgccgccgtgacatcaacgacggcgatgaccgcggcgggggcaagagtggatggggctgttcagatttggtccaccctgttccttttcgccaactacgcaatcgtgctgccaatgttcctactgtgttggatgatggttgtacactggctccgccgctccggcctcatgccgccgcctcatcagtcaccgtcgacaccccaacacccccaccgctacggtggccttcacaccatatttgaggacaccgttgagcagaaggcagggcatgagaaagacgtacggcaacaaaaagaacaacgcagtcacacttcatcagctgctactgtcaatacagaggccatggtgcgtgaggctcaccgggtgacctcccaacttgctgccgcaattccggagcctatgcgtagcgctgtgacctcctccgtggccattcccatccttgtgtcggcggcacaaagtggcggtggtcgaaaagaagcaacgcaacacaacagtgaggaagaagaagaaaaggaacgcaattgatatagtgatggaagggcaaactcaaatgtgtttactaatggctcagtgaaataaaattgtgttcgccgacggatcatttcctgtaccgtgtgactaatgtgcgtaaaaattgcggagcaaaaaatggtgatggcaacacggttgctcaatttattgcacacccccaagtcgtgccttatgctaaattgggaacaatgtttccaacaccatttcacaactccattcttctcaaaaaaaacatttttatttttttcattcaaatgtttcgcctagtaaaaaacgttgaacaaatatacacagcaaaaaaaagtggaacagggcccgcaaagtgtcaaagaagacaaacggggcagagaggggcggggggtggcaaacgcttgtgttggtgcggatcggggggtgggcgtaaataggcccagtgaacaccgctgaccaaccaacccccaccctcaaggtccagctaaaaaaagtcaaatacggcccgcaaagtgccaaggaagacaaatgggcagaggtggcggagggggtggggggacacatacgcttatgttgatgcacgcctggcggaggggggcgggggtctggtgggcgcaaataggcccagtgaacaccgctggccaaccaaccccaaggtccagctaaaaaaagtcgaatagggcccgcaaagagtgcgccctatatctactgcttctgaaggatacagcccatgggactgcatctgttccttaacaaataatatgccataaaatgtttttttacagaaaacatgagtaaaaaagacctgttttccgggacattgcgacaaccaagcggacccacaatttgaacatttgtgctggtcacccttccaatatggaaaatcgtccttttttttggtggttgaatgcgaccgaacccgctgcagttccttaatagaaagaactactaaaacatgccgtttacaaaattttttgggttgaaaacacgagttacaacctgtctttcgggacattgggacaaccagtgctcagcggacccacaatttgaacatttgcgctctttcccataagaagaaccatcctcttttcttttggtggttgagtgagaccgcacccgctgtcgcgaggttgtttatgtcctgctaacatgctgtgaaacgctaaatcccatccttgtcgtggtcgtgttccggagtgttgactgtgttgtaaccactttagaccgtacccactctttattgaggctgctgatgaggtcgtcgtacgcgtagcccattagctgatcatattcacgcacgtttcgctcctcttcttccttttcactggccgttcggtttttcttcagcaagcggcaaaccctcggattatttttgtccatgcgcttaaaattttttgtagatgaatcatattgtaaataaattgttaaaattcttacagaaaaatggctttttgtgtccgacatggcatcatcgtaccgactttcgctgctgctgtcgctgcctttgctttcatcgtcgttggacccactgttttgcttgttgccgtccttattatgcttcttagccattgctcccgctaaaaagtttattttaaataaaggaataagtaattagaaatgtaggataataagaaaacgcgaagaagaaaaaagcaatgaaataacaataggcattgggaaataaaaatatattttgcgtctctgcatttattggagtgagagcgtaga

SEQ ID NO: 1755 - DNA, 2499 bp, Heterodera glycines
  misc_feature (2379)..(2379): n is a, c, g, or t
  misc_feature (2454)..(2454): n is a, c, g, or t
tgcccgatcgcccaaagcataagtagtgcacaaagtcggtgaagtatgagaggatccagcagtttatcatcttgaagctgaaaaagatgaagagctccccacatggtagcttccttttcgtgcaagccaattcgaaatctcgagcaatttagatctaaaaatataaatattaaagtcctaaaaatgtgatcacaaaccaattttacgaagaaatagtgtcggttgtttcgaacccacggtttacaaccggtatgccagatggtggacgtgtaactcattcaacatttaattagttaattaaataaaggtgtaaaaaacctggttttttcgcaactcctccaaataggtacatgattgggatagcagctacaatttctcaaacaagttccgatggtaaacgacgtttgttgttgttgttcattttttcagtgaaacagacaatgaatgaataagtattagagttgggtgtaggcgtcaagcaagggcaataaattattattacagtacaccaattcccaaggttaaaggaaaaatttgaattggcttctaaaagtattgatcagcattaccatgcaaacacctggcgttatattgatattcccggggattatcgattgatggaaggagcttgctgatatttgggaggctttataagagctcacttacactcagtttttatttggttaggttatttttatattttcaaatttgctgttaaccagggcggtacctcaacttaaagagctccgtttatcctggcagcaaacttgttaatttgtttttaggccctgaggtcgtgcattgtacgtaactaatttcccgaagtgttttaggtgccctgtcgtcttgtgcgcttcactgacttttctattgactccattctcggcaaaaaaccccggcaaggtttccttatcaacaaaattttgggcatagcccacctgctcggatctgttcaacacggcgaaggttcttccaaaaaacctgtcaacaaatacgtcaagaagttggaagacagtttggaacacaacgaaaagttccgctacacaaaggtcaagagccgattcagcattgaggacgtgcctgcaaatccggaagcactgctcgcagaaatcttcaaacactgcattgacgaatcgattgcagacagtcgcggaaagggaatagagccaactcatcttggttgcctatcagcagcccgttactcaacggcggtgacattccgatccccatccgtcaaatcacggacaacactgtcaacaccatcctgaaccgcttcactcaagtggcacagagcaaaaaacaacaaaacgtcacactctggggtgagccgtttaccgtggttgtgacaacagtggaccggtccgggctccccgccaaacgacaagtgaagggcggtgcccgtcgtcaattggctccagtgcggcatcaaatacatgatcaatctttgatcaaggttttatctcaattggaagcctcttgacatatatcaatgtgttagtttaagatccggaacccggacaggcacaatttctgtctcttctatgcaatgcaggcgacattggttgccaagaccagaggatggccccgatggaagttttacgattatctacaaaaccgacatggacaacggggagaacttcaacatgatgcaattcagcttctgaatcaaattggtgcacctttgaatttgaacgcgtacgatgctgacatatacgtaccgcgcgttatcaactattggaacaccatccaacaacaccatcgattttctgtcttcatcttcagtgcaacaggccactacaagcccatctacaaatatgtggacaacacctacaacacaccactgctcctttatttcaacaaaaaccattttgatggggtgcagaagcagggtggcctcttcggaaagccttactgtttggaatgtgaacaaccatatgagagagcatcaaaacacagcaaagcatgcaaagctcgttgcattcttagcgcgcgctctggccatgcattcccttgtcttgcatttgtaggcttctccagattttgcacctcttgcaataagaactttaacaacaatgactgcttccggcaccatctccagtcaggtttctgcaagaggtccaaaaagtgcaaagactgtggtgttgtttgggacgtgaatgataacaacagaaatggaagaaaagatcacgtgtgtggtgaacgctactgcaacctctgcaaaaacttccacaatcccgaacgtggctgcttcatccaaccgcttgagccaagggaaattgagccttatcggattgttgcatttgatctcgaaacaatgcaacaccagcctgtcagtcctcgtgagccagagaatagagagcatcaaacaaactttatcgnctgcaaaagtgttctgcccctgagtgcattgacaacggccgatgggcgaaacggaactgcgggttgcaaagtgtngtggtcctcatcgcaccgtctccttttgtcagcgccgctttgtca

SEQ ID NO: 1756 - DNA, 6717 bp, Heterodera glycines
  misc_feature (6207)..(6207): n is a, c, g, or t
  misc_feature (6247)..(6247): n is a, c, g, or t
  misc_feature (6251)..(6251): n is a, c, g, or t
  misc_feature (6266)..(6266): n is a, c, g, or t
  misc_feature (6319)..(6319): n is a, c, g, or t
gcctttaaatctataaataaacttgttaattttttctaataaaaaagttttgtttaaaattatttttcctctttattatagtgaacgcggcagaaagttgttgctgcatttcaaaagaagaaaaacagcaattaggtagtacccgacgaacaattgaggccgtatttggagatataattagattaacgaaagaggccaaagattttgctttctcagcacataataacatgatcgaagcacaaaatataaaagatagaaatcctagtgttcacggggtaaaattttggcatgaaaagcttttaagcggggtaagaaaaatccatatgctatttgataaaataaaaaatgaggagaataaccttaaaaatataaaaaaaggtatggaaaaatgccttgacagaaaagatgctgaaatgtgccaagaactggcggatgaggcaaagaaatcaatagaattagcaaaaaactatagacaggaaattgggcaaacatatcggactgcttactcgcagcccgatttaggcattggagacttggccaataaattaaaagaaacaatgcgagaaaagcaaatagatttggaaaggccgagacctcaaacagaatttagagacgaatttattgcatataaaatataaaagaaaaaaaaataaaaaaatttaaaaagatgaattctaataaatcagagaaagctaacaccgttttagtggaagctgctaaaaaagagacagagagagcctggagggatgtagaggcattagcagaagaagttggtgattttgccaaatcttcgcgggaaacacttaatcgtgcaataaaatctagggaaaaagctcctaatgctaatggggttcgggaattgtatcttaaaatgtcagattcaatttgggaaatattcacaatccttgaccaaatcaatttggagtcagaaaaagccgaatctacgtggcgtgatttcgagagatgcaaaacttttgaccaggcaacaaagctcgaggaacaatcgcaaaattcattaattgaagcccgaagattacattttgagtcccgaagggtgcagagccaaatgttaaattatgaaaataggctccaaacaattgtttgggagcatatgggtatataagaacaaaaaataatgatataacaaaatggaaaattgtgccataattgagacatattgtcataaaaacttaaaatttggctttaaaaaacacaaaaccaaattttattttgtcaatccattttttgttaatgctgagcaaaaatttaaactaatactcacatcgctaatcgatgaaatttataaaaaggaacagggaaaatttaaaagcattttgaagctttcttttggttttgaatcattttattgccctcttaaatgccctagcgaaaacacagccgaggctttgttccaacatgtcctattaaaagaagaattatattcgcttttctatcctttggatgatgtcataacactagaagtaactataatcccagatgtcaacaatagaccaagaaattaattttataaaaaataaaattacgagaaattggaaaatttctggaaaaatacttaaacgatcaaataatctcgaaatttttgcaaataaactttttaaactggcgaaaaatttttatattttagcctttagtgccgctgaaatcgaaaatttatatttttcattcttagaaatgctcgataaaattcaaaaattaccaaattttattctgcatgaatatagaaaccaagccttagctatgcaaaaattggaaattggactcagagaaataaacatatttaaatgtcaagaagccgagaatttatcggacctttctttttcaaagatagatgaattcagaaaacgagtgcaaaattatcgatttgacacgagaatgttgtataataaaatcagagtaacagcactaaggcatttatttaaacccgaaaaggaaatatttctctcgccttttagaatttctccagggaaagaacttttttacagcatattccgtacagaacccaaaaaaagaaatttttaattctacattttacaattatatttagcacaaccaatcttgcgtaatttgaagatcatttacaaataatcacaccatattcttttttgaaaattttttaatttctctttagaaggaataagtaatttatttaaaaaaattttccttggttatgtgctcccaacagcgataaaaaagaaaaaaacaatcgttccgcctaatgttatttcggttgataaaaaactaatgattgtcaatgccctaaggcaatttgcgcaaaataaaaaattaattaacgaaaccataatataagtaagaataacatgtttattgaacaaaaaatgttgcggagggtgttattgtatatgaaaaagtaataaaaaaagtgaaaaaaagtaaaaaatttcatcataaatagctgggactagtcagaataaactatcacaaaaatggcatctttgagcgtttcacatcatggttcccatccaaatggtttttattttaatttattttttataaaagtttaataaaatagacatttgcacaaaaacattcgggccaattatccaaaatcatcaattcccaactgtccaatacttcgaagcgaaactcatcggccacgggtgattatttttgctttaatcatttaagttttaatattagcacatatgggatcggctttgcaagccgggaatatgcatcaaatgaattcattggttggagccacgactccatcggttgggactcgatgggggatattcaaggttagatcatttggggtaactgggatacaaattccgggcactattgttaaaataatttagggctggacgcctttggcggccctgaagtgctgaagtggcacacaatgggggctgaagatgtcattggcgctggttttctcgaagggcgcccattttttactctgaaccgggaacttttccgtaaaattttcacccgttttttaaattgaattttttcttaggcattgacgaggtctgcgtggaacccggccgctttgccgcatttccaactgtttcaatgattggcgaggggtcttccgcgggcgtgaatatgggacccatattcatgtttaatttgaaaaaattgttcatgccgtagccaaacaaaccaaaattttttaaaggcgcaaaaattgatgagcataatttccaagaattttgaggtacaatttttcaaaatttgctcccaaaaaaattggaaatcattgtgaattttttaattttaaacatttttctcgagtttttttcattttgtgtgtgagcaaaggatattccctatcccttgcccattagtaccggctacgattttaattatctgttgttgttgattatttttatttgtattgtaaaacattttgttaaaataaaaatatcaagtgtaattgaattatttaataattaggagggagggaaaagccaagtctgattcttccgtaccaaaatctgaatctaattattcaagaaattcattttaactgtggctcaaaaaatggtgaacactactttttccgagaaaaatgttataataattaaatttactcccaaaaattaatgattaatgaataaaaatgttattatgatcatgctgttagtcattaacagatctcatacatcaaagttttgctttgtggcggctgtccctcttttctctccacttctttttttctgcttttttttttcttcctcatttgtcggcgtagccacgttttctttcgacccttaaaaggcacaaaccattctgagtagtgttttaaaaattggaatgtttttgttataggaagcaaaacgccaaaaaatcagtctaaacttggatccgaatcaaaaaccatacttacccggcgttcaacttccgcgccaaaacttagatatgctcggcttctgatagacaaacgccaaaacctttgcaagctcggcatcccgcaccagtgccaaaacataaccaagctcggcattcggccgccaaaaaccaaaacccagcccagtttaggttttgaattttttaattccaaaacagcctaactcggcatcgaccgccaaaactttattttttcatgcacttattttttgtcgctcagaatggtttgtaccttcgcttcctcgtacggttcgctcgcttttccggctgtttcggttgaaccatttttgtattgctcgtttgctttctctcctccccctcctctttcttcctgctttttcccatcatttccctttttttctccatctccccctccaccatcctttgcaccattccctcccgaattccctccagcactgtcatcatcgtctccttcgcctcctcttcgcaaaatcactttgcactggacggcgccatcctcattatcatcatcatcatcatcatcatcgtccccgtcttcttcttccccatcctcttgtctctgtttttcttgtcgctctccttcgggtcgctctccttctggtagctctccttctggtcgatcttcttcttctggtcgctctccttctggtcgctcttgttctggtcgctctccttctggtcgctctccttctggtcgctcttgttctggtcgctcttcttctggccgctcttgttcttgtcgctcttgttctggtcgctctccttctggtcgctcttgttctggtcgctcttcttctggccgctcttgttcttgtcgctcttgttctggtcgctcttcttctggccgctcttgttcttgtcgctcttgttctggtcgttcttcttctggccgctcttgttcttgtcgctcttgttctggtcgctcttcttctggccgctcttgttcttgtcgctcttgttctggtcggtgttcttcttcttcttcttcttccccttgttcttctgcttcttcttcttgtcgatcttgttcttttttcttgcctagactttcgcaccaagctcgatcatagctatagatggcggatttggactgtgcaatgaggaaaacatgatttgttggttttttcactttgttcagggatggtcacagtaacaaagatattcagccccaagacataatttaatgaaaatttttgaaaaaatacggtctggattttggattttattttttaaaacttaaaataaaatagggtaaattaaaaaataccaaaacaacaatttcgagaacaccttcaaaaatggtatgaaaaaaggccttcatcccggaaggctaatcaccccacccccttccaaaatcctggtaccatcccctgctttctagctttataccagctcacaaatatccataacacccagcttttcatttttttgtgctttgataagcgtgctggccaggggggggatacgatccgaaaagaacgagtatccaacaagcaaaattttttaaaagatccggatcgctttgaaaaggggggaaaaaaaaaaggggttcaaaggggggggaaaaatttccaaaattttcccccctcaaaccaaaaaataaaaaaaaaaaaaattttcctttttttttttattttttgtgtgggcacaggggggctttttccccctcgtggtttccctcctcctaaaaaaaaaaaaaaaaccccccccccccccaaaagaaaatttttaaaaaaaaaaaaaaaaaaaaaaaaaaaaaggctttgttttttttttttttttttttttatttcttttttttttttttttttttatataaaaaaaaaaaaaaaaataaaaaaaaacaaccccctctttttgggaaaaaaaaaaaaattttttttttttttttttttttttttttttttttaaaaaaaaaaaaaaggcccttttttttttttttattttttttttaatttaaggccattttttttttaaaaaagaaaaattttttttaaattttttaaaagggaaaaaaaaaaaattttgggcaaaaaaaaaaaaaaatttttttaaaaaaattttttccctttttttttttccgcccaattttcccccttcccacccaaaatttccccccctttttttaaaaaattttttttttaaaattaaaaatttaaatttttggtaaaagtttcctttttattaaaaattaaaagtttcattttgcctttttttataaaagttgttaattttagtttattaggttcagttaaagtgtagacaagggaggcaacccgacccgaaccccgaagttttctcaccccgaacccgaccccgaatttttctcanccgcgggcatcactggtgtagacactcaaaagccatatcncaanttatgtgagcatatnaattaattccctcgtgtctgggtgtgtgctctacgaaaatttatcgcttttanaatccgaaatatggcaaaaatcacacaatgcataattttaacaattaaaattttcttttaggatccaacaatcaaagaacggccaaccgtaagattgaaagttgcactttctcaaataagcataaattgttcttaaagttggttcgcgacccagctggaggaacggcatgtgaaaatcagaaaatagcttacgaagtgaaaaaccaggctttctgcatttggtctgaaggattaaaagcttctgactgttgcagtgaaaattacgctcttgccgatgttgatccgagatatcgtgatcataaaatccaagtcagccggcctattttagttcgatctaataacatgacaatttttcggacagaatggaaaaatcgctttataaacgaaaaattcaatta

SEQ ID NO: 1757 - DNA, 1549 bp, Heterodera glycines
ttaataccagctcacaaatatccaataacacccagcctttcatttttttgtgctttgataggcgtggctgccagggggtgatcagatccgaaagaacggagtatcgaacaaggcaaaatttatgataggatcggcatcgcttgcaagtgtgtgaataggaagtgcgttcaatgtgggtgaattcgcaagttttcccatcgtacatcagatcatacagaagatgatcttcactttctaatttgatttgggtccaatgcctatgctcacatgcttccaccttaaatagaacaaaccccccccaaaaatgcttcaaagcaaaaaaaatctaccttttttgatttatgcacttttacaacacttggtcctgtgcggtaggccaattgttttttcattgggagaatgacaatgggtgagctaaaaagaacgcaaaagatcactgaacaaaaacaaaaaaaaaagttgcaaaattcttcatatttatttttagtgtgctgaaagtgaaaaaacccggtaaaatccaaaaaaatatatacactatgcaagaaagcggcaataatagtttttcctaaaaatagcaagaattatgtaaaaaacgaaaaataaaaacaacggctaaataatcttaaagattgatcgttataaaatatttacgtttttcttgtaaaaatttaccaaaaccgtttcaaaaaacgaaatgcctaccaataaagagagtgctgagaaaaaaacagctctcactttggcgtactatctctgtttttcgacaaaaaaccgaatttacttcactctatagaacttttttcccactaaattttgcacaccgacacagaaaaatattctgcatcgtatattctataaacaatgcaaatctttttggaactgagaggccaaaactgaaacggggtgtaaaatatatgctcaaaaaaaccaaaagattatgcttaaaaatttttggaacattattaattagatatcttatcaaaaattgccaaaaatacccctgaaaatttgaactaccggcgacggaaatccgggaattgatcggcgcacttgagcgaaagtaagcagcaaatgatgctaaaaaaacaaaatttatttgtggaaaatttctgaaatttttcttaaatttatattttgaaatttttttttaatttacgagaaaagagtgccggaagcgaaattggaaagaatagaaaaaaccgccgctaaacaaagaaattattaaattaaaaataaacgaaaaaaattagtgaaaagtctaatatttaatgaaaaaatttaatattatttgtaattgaaaattgatttcaaactacaaaaaaatataattaatcaatgccaattttaagggtttatttttaaatcaaattgttgctgaattggggagttttccttatgaacgaatcgattcttacgcaacttttgggtggaaaaggaagggcagtcgaagcgtaaaagacatttgcgcaaaggaagggagttgtgaatcggctggcttggaaatgaagggcgatgggaggaaaagaaaaggcggggggggggattttgg

SEQ ID NO: 1758 - DNA, 1553 bp, Heterodera glycines
agtgaattatgacgaaatgcaccaattgttgaccatcccgatgccatttattgaacactttctgcaccgacttggcacatttgttgaaaggtcaccagttgggtgattaattaattgatggtcaccaattgtcttaggacaattaaaaaagacgggggacgaggccccgcccacaatataagaaacttctcaatttttttttgaaaaagaaaattataaattcgattacctaattttcttcttaccaatgaattgatcgaaaattttggaaagaattggacttttcagggatttgggaattgagttttgtacaaaactaaatttattggcttcatagaacatgaaattctgaataattgggtaaaattaaactggaacaatttaattcaaattgagatcagttttgtgaaaaaaaaaatttaaatatatttaaagaataaataaaatttattttaaagaaatttggatgaaagcgttaaaacagccgactgggactttataaaaacaattcaattggttgtttcgatggaaaatgatggacaaaaattagtggcacaaaagcggcaaaaggctattgggccggatgttagcattgactgtttcaaattgctctactcattggccattcgtttgtgcttgcaaattggccaaaacgaagttgcgcaaaaatatttgccaacattttcatttgcatggaattttaccgacaaaagggcgacgaaattgtatgtttgtacataattttaaaaaaattgtccaattatatattcaacccaaataaaataaagattgaaaaataatattaaaaagaaatttgtgggttggccttttattatttctttaaaaaatttgtttaatccgaaatttgcctggtgttaaactcaacggattacctattacgattgttgaaattttgaggcctaagttatctagacctaaaattttcaaattacataccaaaatactgttgtgagtataagacgtctccgtcgctatagtttattcataaaaattaaacaattcaattttttctaatttagttatacaaaatcgaatttcttcgaatacaaaatgaatattgcaaatgaaatggttgaaataaatttgccaaattgggatttgccatattttgtgtatttggacaatgaaaaagagtttaaagtggaaaatgttaaaggtaatttgatatttgtacagctaattaataatgaatagcagagcaccaaaattggcaaaacgcaataaaaaaattaaattaatttttgataaatttatgtttttatattttttattattaaatatatattttataaaaaaggaaaaaccttaaaaagtgcaattttttgcgcctttttcttggctgatttattagtggctaatgatgaaattaatttgatttttttttattattaattattatttttttaaaattcaaacagataattttgcttttttgctttatttgtccaacaacaattcaccgacaacatatgaaattgtgaagatggcaaaaatactgtacgaaagttatggtgaccatattttcataagcc

SEQ ID NO: 1759 - DNA, 1073 bp, Heterodera glycines
  misc_feature (1055)..(1055): n is a, c, g, or t
aaaaacaatgcactgatgaacggtcgtattttacattaattaaaattgggttggcaattaaaaatttttaaaccaatgcattaaaaaaagttacattttttgattatgttaatttttcgaaatattctcttgttttcaaaagtcacagaattgttttgaagattagcatccaaactgccaaccacaagaaaattttttttttaagttttatgaattacacaattagaatttaagtcataaaaaattcactaagtttaaaaaaagctgattttcttattctttcgtagttgtctgaatgactagaaaattttcagataaataccttaatataagggctaattacctgctaaatttgataaaattttcatacattaaaaacttttacaaaaatccatatttttgaaaaattttcatataagaatttgatttttcaagttttataagcatgcggattcttgtaaaaaaatttttatcgtgattaagaaagtcatcttttacaaacatcgcaacaagctaatgatttaaattcccttcccttgtcattaataccattttgccatttagaataaaaggtgaaataaccaaaaattttggtgaaaatatagtaaattttgcccaaatgataaaactcgacttcaatcttaacaatggtgagtcagcagcagtcagttctacgtattgcataatatttggcatttcaaaattcaattttattacaaatacttaaaatagatgactcattaattaagttctccatgtctcatatacggtattaggaggagggttattatttttcgagtctatcaaatctgtttgttattttctaaaagttctctatagcctgccaaattaaaaaacgttgtttttcaatttatgtttaaaaatgtcgaaaaatctagttttgttaaattttgtctaaaattttccatatggtgattttttgaatgacgcctgatttttgatggtttttgaataacgaccgagcaccataaaattaatttaaaagaaataaattatgttttgttattatgttctatttcttttcttttttccanaattttgttttttaatta

SEQ ID NO: 1760 - DNA, 3919 bp, Heterodera glycines
  misc_feature (22)..(23): n is a, c, g, or t
  misc_feature (76)..(76): n is a, c, g, or t
  misc_feature (79)..(79): n is a, c, g, or t
  misc_feature (3819)..(3820): n is a, c, g, or t
  misc_feature (3827)..(3827): n is a, c, g, or t
  misc_feature (3843)..(3843): n is a, c, g, or t
  misc_feature (3848)..(3848): n is a, c, g, or t
  misc_feature (3852)..(3852): n is a, c, g, or t
  misc_feature (3861)..(3861): n is a, c, g, or t
  misc_feature (3867)..(3867): n is a, c, g, or t
  misc_feature (3870)..(3870): n is a, c, g, or t
ggaatatgtttcgctgatacannccagaatttagaaaatagtactagacttcgtagagtgtagtcgagagatgttntantaagaaatattgtccggaagttagccagaaagaatagagcatcatctaggattaactgcagtgcatgattgtggagatgaccatgccgaagtggatggtcgaatgacattttgacgcagcaactccttgacttgacgctctatttcgggttgaagtgcgacaggataacgatagggtctctgttggaccggccgtgcgccatcgattaggtcgatgcggtgtatcgtttgtcctttgaagagtccgacttctccaggtttcacaaaagcgttctcgttctgtcggatgatgtttttcagcttttcaattccgtctcgactcagaatggtgtcgtttaatcgaattctttccagtatgggtgcgactgcttcttccttctttggaaattccaaagtctggtccgtccagtccgcctctggcgaaattttgtcactttctaatttgaatttcatccactcctcgtcagtcattatcatttccgggttttctttctcatcttccttcagtgcattaatttcagtgccatcggctattgtttccagccacgcaagtcgcgatccctcatacacttttattacgctgtttccgaaattaagtaatcgtagtggcacaattcgcgttgagcctggacttgttagacatttcccgactcgcagcgggaaataatcgtgctctcgctcaacagtgatgaaaacttcgtctggtcccaaacttcggttaatttttccccaaacgagcgaatcagacagcggtggcaatgtttgggtctcaataagttgtacttcaatcggttgcttctcgatgctgacagcggcgatcattggtagttgcgtgtttccaacacgtacgagtcctcttttgaagttcaatccaatttcttcttcgccttgttcactgatgaaatccatcaaatccgttccaattatggcagtgcatggacagctatcgtcctcactgacgagaattgggaatttgccttcaaaatctcccagttttatgttggcgagtgccgagccgataaaacgaatgggagttgagttcgctgctcttgcttgtggatagtccccttttcggaccatcataaagcatctttgtgccgttgagtggccaatgtacgtgatgtcggctcctgtgtcgaataaggccttcgttttcactccattcatgaaaaaattgacgtaacatcttttcttttttcgtcttgtttgttcaatttggcaaatgttgggaagataattgagcacgtatgctttttggtcgagtaaaggttcctctggtggtgctgatggcttggctcggtcttggagttcgacttccatcacgatcggatatcgaacttgttcggccaatcttcttccggaattaaaacaattcattatggtgttgagcagagattgtagtaaatgaattggcgccaaaaacagagtggaataaattttgattttccacaaaagaactgtgcatccaatcacgattaaaataatagcgattgtgattaggatccatttgatgtatttgatgattccaattgggtcttccatccatgcctttcctttttcaatcgtttcttctgccttttttctgaaactttcgccctctttttgcatcttttccaccagtatttcgccgatggaaaaaatgtctgtgaccgtgcttccgtgaatctcggtctgattaatgtcaactgtccctatgtcagggaagttcaattcaggccgagtgatccgtctcgtcaattccttgagattctgttccaggcgtgcctgttcagattcaaaaattgatccgcgtgtgaagaaaattaatggattttgaaaatttgtctgttgttttgagacaaatcgatgttttgaattggcttgttgaagttcagtgtcattgttgttgaagtcagctgcccaagggttgttaccctgctcatcacagtgagtttcagtcccgttatagctcaagtcgcgcgtccctggcttgacgaaaagtgtgcgccttgccaccagcacgggtagctcgcgaaagcatttttttccaattttctgatcccatagcacatcctcagccttcagttgtttgcaaagagcaatggaccatttttggtcaagttgtgatgatctggtccaaaatgccgttatgtcatctcttttgtagagagagcgggctgcgtcttccggcatctgacgagctaatgcctttgcgatggaaagtgcattatttcgttcgtgacagtcgctcatccatttctctcgcgcattttggatgtttgtccgatgtgtcttccatcccaaataattaagacgagaattttcgtggtcaagattttcttccttccaaagtttttctgattcatcatcatccgggatttccctttttgtaacgacagtggtgggactttcttcatttggttcatttgggagaacaaatggagttggtgtcacttttatcgttggagaaattaaaatgccttcctcatcagcttcttcggccaatcctctaagctcatcaagaatggaatgatacgacgcagtggtcggagcggtgtcatccgcactctttgtggtgtgaggagaaacggtgtttggtgtagccgtggtagagattaatttagttggcgtttgaatagtggttgtcgggattgtcgttgttggtttgattataatagggctatgaatggttgaagtcgggcggattgttgtaggaatattagtagtagtaattggtcgaattgtcggtggaatatgagtagtagcaatcgggcgggttgtgggtggaatatgtgtagtagttatagggcgaatagtcggcggaatattagtcgtagcgattgggcgaatcgtcggaggaatattagtcgtagtaattgggcgaatcgtcggaggaatattagtggtagcgattgggcgaatcgtcggaggaatattagtcgtagtaattgggcgaatcgtcggaggaatattagtggtagcgattgggcggatcgtcggaggaatatgtgtcgttgtgattgggcgggttgtcggtggagtatgagtggcgattgtgggaattatcgatggaatatgtgttgtagaaactggacgaattgtcggtggaatattagtggtagtaatagttgggcgggttgtcatggcgatttcagcaatttggcctcttcgcaaattcggccttcttgttggttcaattctcggcacatttggctttctttgtccaggttttagactcacggtctctcgtctttggcgcgctcgcttggttgagtttactttaccaatgacatgcacaaaaacattgttgtccgttttcaatgcatcgtcgggcactccgaacaccggaaattttctttcctgatttctgcttatcggaaaagtgtattggagctcatccacgatcactgccttttttggccaaatttccgtgattactgggccaatcacaaaatgtgaatgccaaaattcatccgatggaattttccacatgagcaattccacagctcctggcagtctgatccagctgccgtcttcccccaggcttttatcaacttttaaagagtctccccacgaagttatcagtcttttcccatccaaaatccctgcttttccttcttcaatcactgtttgcacattgttgaaacaattcacgccgtaccatccgtactcttttcgaattggcgccaaactttcccatcttgtctcgctcactctgttcatcggtgaatggtgtattgaggcctggcagtcctcgactgnngcttcgncttctttttaaggtcnggagntccngagtcatgnttcggngancccttaaagggacatgtgactgttgtcacattccagcatttaaatgcgg

SEQ ID NO: 1761 - DNA, 3518 bp, Heterodera glycines
  misc_feature (23)..(23): n is a, c, g, or t
  misc_feature (93)..(93): n is a, c, g, or t
  misc_feature (144)..(144): n is a, c, g, or t
ccgtcagcgggtaagaccatcgncgcccccgatgtcatcagacaaataaatggaaattcacttcgttcacgcgccagccagtccgtcctcgantggcatcacttcctccgcgtcctctgtttcggacctgttggtccgcgcccntcgtggccaattttgattttggttgaagttcggttgaaaattgccattgttgtttgttccttggaagttgttgccaagcggtgtgaagttagcgccgcgcggattaaatcctcctcggtatgtgttgagtcccctggggtatcctgtgaatccccttggcgtgaaattccctcggcgaattgtccgaaattcgggattgcctctccaaaaattagattgattttgtccttcggcgttgtttcctctccaagaattgctttgattttgccattctcgttgatctcgtcctggattctctcggctcctttgttgttcacgaatttcatttaattcggttcgcactgcattaacttcggctaaagcaacttcggcttttgcatcttgtgtatttttccacatgtcatcggccaaatttccttgaacttgttccacacgtcttgcctgggccactgcttcctcgagcgtttgcggttcttccatgtacatcactctttccttcagtcgtggtgccatatttgcccgaaaaaagtctcgcgcaatttccgaacggaattgtcgaagtcgggcttcgtttgcatgtttaacatcgttttccaaagcaccgagcaccaaatttccaaagtccatctcgagagaattgtcgggataagcacgtaagacgaggttccggatcgcttgcgcgaattcttccagcgattctccagtctgttgtttccgttgtgccaatttctgtcttgctgtcagactcggagacatttgtttcaacttatcagccatggcatcaattagacttcgccaattatctttaatatccggttcgatgctctcgtaaattgcccttgccgatcctctgaggaacagcgggagaacttgcacacatcgcgcgggtgtccagttgtgggcggtcgcgattaaattaaaggacttcaaataatcctgcaaatctgtcgtcccgtcaaatgtggtcggcatcgggagcccagagcgagttccaccattttcacgcatctcttgctcgagagtcacaattcgacgccgcagggcgtctaaatccatattacgcaactgccttttttgatggatgagccaaagccttttatccctttcggtttgtccttcgtttagtccttcttcctctaaaggattcggtcttctccgcgtgtcggccgtttttgatggaattgtcggaatatgtttcgctgattaacaccagaatttagaaaatagtactagacttcgtagagtgtagtcgagagatgttttattaagaaataatttgtcgaagttcgccagaaagaatagaaaatattgtaggattaactgcagttgatgattgagaattttaagatgagtgaatgaattaaagaatttgtcgttgatcaggcgtaataaaatagtgatgaaacaattggtcgtcggtgattggatgatttgccaatgtgatcgaaatgtgatcgtctaccgtccctctttgatgtgcatttagtgtccattttcgttccctccgaaagcaattaattaattgtccgttttccccgttttcccaattttttcttcgtttttcccgtcagttgttgcctcatttgattcttcgaattcgttttggcaattttgtttcattatttgttagtcttttctcgtgatttgccaaattgtgtttattttcgtcttgtcccgggactggcatttgttagctgaaatttcttttccccaaccctttttcccctgtgattaattaattaatgagctcagatcaaaaactccaaacgtccagggatggggccctgcctggtcgtaggagggggaagggaattgaggcagctgtttaggcaataggcaacaaaattcacaaaatggcgggatgggcaaaacaaggagtgggagggatgggacttgtggtacgggtatacggtagcgacagtaggcaaatgagacaggccaaagttttccttctgccggccaaaagaaaaacatgggagggaaaaaagagagagaaataagaaaagagagagagaaaaagagaaaaattaaattgttattaactaaagcaagttaaacaattaagacatcgaaagtcttgaactgtggcgtgtatcgtgtgcgggccgaaactgtagccgccgttgctttggattcgaagagtgggagaatcccgttttttgtgccgactccatcccgttttgtaccagcggagtggcatggccgatttggatgatcgcttcgtcctttgggctcaattttgtccttattgtccttgtccttgtccatttggctgtggtccgtgtccgccgagtctttccatttgcctcatttggggtctgtgaccaatgtcagcgccgtgttagtgttttgtccagtcgtattgtctcctcaatgtaatttcgggttgatcgttggcacggccttaacacatcacttgttaaaatactttatttgttaatttaataaacaaaattattcaatatttactattcaaagcattttcattaatattactattaattttggttattggttaaacattttagtaatgataaataggaaagaaagaaaaaaaatggtgggagtgattaataaaagaatacaggaaaatcaaacaaaaaaaatataatttttaatgcgaaaaaatagaaattggagggggaaaagtaagaaattgcaaaattaaatcagaaatgtgatgggagaataaatagtataattgcaagggaaattgaaataatttttaattaaatttaattaattagtaatgaaggggggggggggggggtaaaagaaaagcgccgctttgggaagtttaattgtactccccacaaggtccaccataaaatgggtgcgcgcatgaatccgttgggccctgggccaatgccaggggcattggcccaaagcgcggattccccaattgaaggctgttatcaattaacaattggtttattttgcgttgaatgaaaatgtgaggaaaaagttaagaaggcaacaattgatcagatccccgatcgcaaatcccaacagactgatcactccgatctctccccccaaattttatacgggtaacaggtgggcgggtcggtgaaaaaggaaaggccaacaaacagaaattggggtgactggcgacagagaaaaagaaatggtgatagacataggggaaaagaagtcaggaaaaagggaagacataacattcccccacacctgggaaagccgtgccctcacggcttaagctatgcctgggcagaagggaggggaacgaaagagaacatcaaatagagagaagatgagataaagagggagagaaagaaaaagattgtttgaaaatgagaggaagaaagacgatgagagtgagcggtgaaaagagtgttgtcgctgcttttgtgtac

SEQ ID NO: 1762 - DNA, 2705 bp, Heterodera glycines
ctgctgttgttgctgctgaccagtcggatgtgattggtgggcaggggtttccgttgtcgagaaaaaaagggggggggcgagagtcgtgagtgggaaagggtcgtccggcaaacgagagtgggataatgagagagaattatgtgaggaatgggtatgaaagtgattagctaataaattggcacataaatagtgaggcaaattgtgattaattgattatgagttaattgtaaatgtattaagaggggccgagaattgaattatgtcccgggcaatttatttacttatttatttgaaaattgattaaaaatatttttgtatttttgtaaaattttttttttttttttttttaacaaattgcccttacataaaactgcttgaacagcccatccccagattctcttccaccgtctctttctcgtcctttttcgttttctgtccgccttcgtaggggtacagtaagtcggccaattctgacagtcggtcggcggcctccaacagcagcttcctgattttgtagattgtctcctcgggcttttccagggccagtgctcgcttcaggtaggaattgttttttcgaatcgggctcctctccaattgtctttggcccggggttggtgttggccttcttcctcttggggcttcctccgtggcgctttctcttcgtctgagccccagcccttctggcggtatgcacggtttctcatgcaccgcctgcaccgccgacttcagagtgtttctgaacagccgtttcccgctcgtcccgaggctgcttctttcgcggtcacttttttcttctctcggtttgggtgccgagtctaaatcgctttggcattcgaagcgtgccactgtgctggaatagaaaggcatccgatcctttggcggcgccggggggttttcgaatgcctcgcgctctctttccaacgccgctatgtccttttcgcccctttttccatcttcttccctatttaattttgccgtcaatttttcgattttttcccttatttccctcttttttgcatcttcttctgcctgcttcacaatttctcttatttctctgtgtacttcctccattttttccatgttctgttttttctccttttcctcttcggttaagcgcctctttttgattcctctggcaatcattgttttttctcctttttcctccgctcttttttccacattttgttgttgcttctcagacttctttttttcttcttcgtccttttttgccttctcttctgcttccttctgtgctttttcgtccgcttccttcgccgccttctcttccgcttccttccgtgctttttcttccgcttccttccgcgcctcttcttccaattccttccttgctgcctcttccgcttccttcctcgcctcattttccgcttctttcctcgctttttcttccggcgtggctgccggacgtcggagtgcccgtttccattcttctttttcggctttggcctttgctttggccttctcttctgcttcctttcgcttggcctcagacttcgccttcatttgctctttttcctcttttttcctttcttgtttggccttctccgaacgtgctcttcgttcctttatctgttcttcctcttcctcttccgcctggatcttagccttcgcgtccatcattaactgtatttgccgatcaatttcggccaatcggtaatccttcttatacatctcgacttggtccgggtgaatcacttggacttgatccactgagaatggcgtgaggatcggcgcataggggcgaggttcggatttgttgtcacgtttttgttgttgttgttgttgttcgtcggattctccttccgagtcagagtcggaagaaattaaaatggcaggcggtgttggagacgaattttttgatgtagaatgatttgagtgggtaagaagggagtcgaatcgagacattttttgctgtaaatttgtcgaattgattgtgtgagtgtgatggctgattgaatgaaatatccgattaaaagatgaaaatgattgaatattttggggctcgatcgtctcaaaaaaggggttaaatggatttgtttgtcgcgcaggggtgtgatcgcgcagggtgatccaaacatccggtattattggttgtgcgaaaatttggttttgttcatcaataaattgttcgtgataaaatgctttcccgtcttccatcgttaaatttcccgaattttttagaaattctcgaactcccgttccaaaaaacatttcgtcccatccgttggaaattcggagtttgaaattttcatcaaaaatccacattatcacgtatttgtcgtcatcttcaaatatttcccagtcatttttgattaaattttcggaaatggtggaagtttcgggaaaatttgaagtgctgagataagcgaaaaaatttgtgccatccaatcggatctcaatttgatgtggtgtttccatttcttccttgtcttttggttggtccagtggattcccttcacttatacatgccacaattgtttccccatcatgcattacttcgtccgattcttccaattttgaatctcccagctttttgttctcatttttatgttttggtttctcattctccaatgcttcagtgtcctgttccgcttcttcgtttgtgaagtatggcttgcattggtccatatgtacagtgaatggttgtccatcgggttcaagttcaaggatttgcaatttggcttctc

SEQ ID NO: 1763 - DNA, 10519 bp, Heterodera glycines
  misc_feature (10298)..(10298): n is a, c, g, or t
aatttttggtccattcttagggttgtattttgaaaaaaaatatgtcgattttagagatgtattttctgaagcgatcggttttaggggtatatttttcgtttttattgcattttgtttaatatgtttgggaaacgccaaaatacgtaaaatatttttccaaatagttttgagttttaggttctaaaaatagtaacatagaaaatatgttctaaaaacacgaaaagtagcttaacaacgaccgaaaaaaacatattttcatgcttttaagcctattggtaactcaggaaaaaatagataaaaagctaaaaatatcatccctagcgataatcaaataaaaaattttttcattccaaatatcaattttttttaaaagatggaaatatttaaatgtaatttaattatgaatatttaaatataaagcaaaagttaactcaagtaaaaaatatataattcaagtttaaaaaatgttaaatgcttaaaatagataatctgattttttacatattaatgtttcaagaaataaggaaaaatttctaatattcaaattatttgaatttagtaattggtgttttagattttcggaataaaaatacccggcacttcttttcgtcggggagtccttcttcaacaaattttttcaatgccattcggctcaaaacgtagccagctccgccgctcatatagccctaatcgattttaaatttattaattattattaatttcatttaattgcctgttcaacaaagggtttgaatttgcacccataataaatgggttcttctggcgaatgagccatcagaaggaagcgcaaattctcaacaatcacaaaagtgtcgtcgtcagtcttgagaaaccaatcaaagtcattcttaaattaccaatttattatttttaataaaaatggttggtaattaaatttactaaataatggtcatatgcgtatttaaaggctgcctttgttttgccccataagtgattccttaaaaggtttaaaatataaattatttactaaagaaattaacaatttttaataattcgtttttaataatcaattaaaaattagcagtaaggaaaaaatattatattttaggttaaaaaaagttatataaaaaatatgactttaaaaataaaaataatttaagtttaaaataaagtaaaatttttttatttaaaattgatgtaaaattaacattaaattcaaataaatgtaataaagattttttaaaaggcttttactctcagaaagcgacccaatttctttgaaatttttttcaagtcagttcggaaagttttctgtccaattaaaccaaggctgaatttaatataaattgcatctcaagtgagcgccaagaatggcgtttgttttggaggcttgttatgacttgtgttgtcttcagataaaatatttcaaaaaaaatttatttgctgggatgtctttccgagcggtcaatttcccgtagatcaattgccttatctaccaccatcagatgaggactaccaacgaggggcttccacaattaaaaccaaattatcattcatctcctcatcaatgtggttgaaatgagatgctttaaggcggaatatttgattttatgattgatgaagtaatcaagaattttcatcctcaaattcaaagggattatatccaagggagagggacaaacttcgcttccaatcagtttcgtatgaatcaagaatgacccataacagaatgtgaggatgatgtctccccaagttgacaaaccatttctagcacactgataaagcctcaattctcttaaagagaaacagagagaagacaaacttgttccattagtgctgtcgaaactcgaaaatcaaaatttgattttagcattaaaataatgcaaaaagggcgaaaggggaatggtgtgacggctctttttccctccagttgtttgttcatttttaatccctttctccgcccgttccacatcctgttcctgcccgaaattcacatgtttctctccgccgaaaatttgccccacttttttatcccgcgatcacaactgtgcgaaattgtccgtccattctctcccctataaaaaatcatttgtttgccaaatttccccctccaagtacgttgctccctcaatttgtagtgatcggcccatattatttgtaaatttaacaaattcacttttggctccattttttcactttgtccatttcctatttaaatggccccaaactgctcccaattcacattggtaggaagcataactatatgatctgttattatggagtgatccaactgtgatcactcatcaaccgacaagggaaggaaaaactgttcagaagaacagtccatcaaacaaagagaagaacttcctcgttcaaaaaacttttattcaaatcagacacattctcttgagtagagacgaaattatctgaaagcttatttcaacgaaatcaacctatgggctgacagatgcgacaaagaagacacatgcttttttaaccaccgtcatgccttggtcaaactaaagagcgacaattaaatatgatcggaaaaagaggagcattccccaaatgttatacagtgcccatgttgcgaacaatggcttttattataacgttccaccttcttaagtggtgaacaggactgctaatccaacaaattaatgcaacgagtgtaaactcttttgcacaagtaaagatgttttgataaagattccgaatgaaactcggaaaatagttgggtctctctacctttcgccgggcctagcagtttttgattcaaaattggtatcattcgaaagctctacgtgtttataagctatcattatgcagaagctaaacgattaatcatctcaccaaaaacttatgatttataagaattaaaaattcaagaaaaagctattttttgtaaactataaatcataactttttggtgagatgattaatcgcttagcttctgcttaatgatagcttctaaacacgtagagctttcgaattataccaattttcaggaaattaactgacgaacaaaaagttatggccattcccatttgaaattgtacgaaacgccattgtacgaactgccatgacaccactatatcatcattacagtgacaatacagtccagaacagttgtacaaaaacatctttgccgtttttggttaattttcaatttaacaaaacctttttaaattgtcatattttcatggaattcgtttggtttgtgaatttctttccggtaagcaaatcatctcgccctcgcatctttcactccgtcagtgatcgatcaaattccccgggttcaattcggttgttcccattgctgtccatctgggaaaaccaggccatgtttttggccaaatcgtcagctgaagtgccattctttgttttaaccaaaaatgcgatggcctcttctggcgaaattccggcatttttgtccgcatcgatctgtttataaatatggaattgatgtgagtgagtaaatcactcttaattatgctaattaccatttcaaagtgcgcgttaactttttccatcggttccaatgacgaaagagacaactcatttctactgatcgggattctaattaatattattattagatcattaaaacggattctcattgccaaatactgtaaagtcttgaaatggtctgccgatttctgcgagcatcccccttccccgtccttaatgcaatttttgcatccgtccggacacgtcgcggcgtactgtgggtcgcaacagtagtagcagctgcaccgcacctccaccacgtcgcatttctgcgatgtgtagaggtacacacacccaacacaattgcgcccgaaaatgttgcactttgggtggtgctcttgacgacacctaaacacaaaagaaaaagcaacgtgcatctatctatccattattatattttgactaattattagggatattagatttttaaatattagggcgctatctttcccagattaaaaattttggaattttcgtaaaaaaacaagctcagaaatttgttgcatgatggcactaattgctttgaatatttttgcacgggaccgggactggtacttaaaaaaaggtacaaatgagtaccaagtcccggttttcccagctaaaaagtcccggtttttcaacccgaaaagtcccgatcccggtttttgtctaaattcccgattccactcaaatttttaccaacattatacacatacaattataagcagtattggttaagtattttatcaaattaaaaatgttactctaaaaagccaaaaaaggcggagtaactgcagcatccgttcggataaaccattgcgcggcatggaaaagtctgtgcaaattcagagttaattcacatttaaattcggattaattactttatcgacgaaattcaaaagaaaaatgactccgacgaataacaaagaaatggaaaaattcattttaatacaggaaaaaataatttatattatattaaattatggttaacgcatttataaatttaaaaaatatatataaaaggcgcacaaattaaatgctcagaaaacatgtattttttccttttaataaattattcaaagacgaatatcaaaaaatgcttaactataaaattagatgaaagctatgaaataaacaaaattaattcaatgcgggaaaaaagcataaaataacattttgccgaagaattttggaattttaatgattttaggcaaaaatattttaatgttttgttttgttaatataaaatttgaaaaaatgtaattttcttttgtcatttaattaccatttcatttatattatagccgatcagcttttatgtttaatatgtttaactttagtaagaaagatgccacaaaataacaaaaattaaatgatgtttgtagtgttattttattgattaaaattaaaattaatttcttttatttattttcgcaaattttgcatttcatcaaattacttccaatttcgtgaccttaagctcgatttgattttcttttctaaatggtgaccaggacgagaaaagcgggaattcccgttccgcctatttcgagcagtaactgttggcatttgattaagcaattttaatatgctaatgagtcgtcacgtttcccgggcaaccgatggacaaaaagcagaagaatcggcgtaaaaacaacagatgcaatttcataaaagtgaaagaaaatattacattctttaagtttttattaaaatatttttagggttcctttttcttcaaaatgtcaattcacacgaaattttctgaaaatgcaacagaaaatttggagacgaattcgcacatcggcacgtcattgtcggcactgaagaaaagcgaatggaagccaagacacatgcacgaaattgtcggagtcaccttggtaagtgggaaggcattagaagatgattggacaattttccttatgaacaaagctttaaggcttcattttacgctgaatggcttcgtttttaagttttatttgatttacatattttccacgaataaatattaatttatgcatcaattattataatttaactcctattttttgcattttgtgcatatttacgaaaaaaataaaacaatttaaataatatttttcattcttctaacgaaaaataaaattgaagattgtgaatggtgaattttgtggctttgttttggcaataaaaaggctcaattaaacagtctatcccaactcaaaataacttcaacaaaaatgcaaaggttatccaccaatggatgaaagcgaagcagcgaatgttcgagcgacaaagggacgaatcgtcggagttggccattggcgaagtgaacgcgtcgcttgtgtttgaaccaatggtaccaacccattgaggcatttacactaattaagcacattaattcatgctggtaataagcaattaaatcacgacgccttttaggcagtgacaatggaccgactccgtgccattgaacagcagcgcaaccaaacaatgccatcagaaacagaccatcagcaggatcacgcagcacaggcagcagcagaacatccaccagcggcagcagcagagcagatggggaagaaaaacagcgtaagtgccacgggaaagaatttgcggaacggaagtgccggggcgacaattgaaaatggggggcaccacggaacagcgacggcacaaacgcaagggacgacggcacaagtcacaacttccgtttgtcaatgggtgcgcaaactcagaacagaacgccaaggttgggccggtaaagttgggtgagtttaagttcaatttaattcaacaaccttatttatatcataattaacgaaagatcttgcaataactctctactttaaatcccctcagtgattggaaagcaattaatgtgccacaaatttttgtggcacattaacgactcagatttctgttctttcttggctttttattttctgtgtttgccaatcaacagaatgcttcttcgaacggcggttgacccgtccggtcttttctattgctattggactttgcttgtctacgcggtgttcctttacaacgccgtggtgagcgttctgttcgtttttgacgacactcaaagcgaaccgcgaacattcaccgcatggctttcgcttaatggtccggacatttcttcaaattgctttgctcttttattaaaaatataaatttattcaaaatgtaattttattttttagcattcggtgacttcgtaaatttgtgcgacattttcttcaattcaagactttgtaattatttttaaaattattttaccgatttagttcacactttttaaatatttcagcttacatggaagatgggatgacaataggcaatttaaagcgtttagccaaacgttattttcgaaggtatttcgatgttttttacaaatgtattattagtctcgagaaattttctcggaattatatttaagtctcgggattaatcatctcacatcactaaatgcattaattacgtacattttctcatttatttgcccatttccgtggccactttttgttcgatctcttcgctttggtccccaccgactttttgctgctgttatatccaaatgtgtccttagtgcgcttcaacagaatggccaaatgttaccgggccgtgcaattagtgcaagtttgtgttgttatttgttcaaaaatgcctcaattcacggcattttcactcagatgacaaatgtgaggacaaattacccaaatgcctttcgaattttgcatattctcgtcgtttgtacggtaaaataatccaattttttttgttctttttataatttgttcctttttacgattcttttccattggaatgctgctgtgtacttcaaaatttcgctgatcaacggaatattctgtataaaaaaaaaaaaataaagaaatgttttttttaattattcgaaaatttagcgttggatttggctgcttgggaattcaattacgtaaaaaatcaggtcactcaatgctttagcatcattagatgcatcaaaaataaaggtgatgcccttaaggacccagtttgggctgattgcattacggtattaatgagaacggaggacggtgagaacaaatgcctgtttaacgagacgaacagaggcgacccggacattgaacggataaattacacgcccgaattggccgaattttggcaaaacaggtagcataattaacaaatcatgaaagtatttggagtgtcttgggggaaacggaaaacaattgcatgtaaatcaattgtgtacggcattgcttttaaaattgtaattccgaaaaggggtaaaaaaagcatttccggcatttcgttattaaaaatgatcagagatggccttgcccacaggtccacgaaggtgccgttctccaacttttccaagcagtactccctgtccttctattggtcctcgctgactctgaccacgtcgggtcagcagccgtaccccacggcggcgatgcacaattttctagaaatattcgacacaattatcggtgtgctcgtcttcgcagtcattgtcggcagtgtgggcaacgcggtcggtcaccagtaaagacaattggccggtcaaaaacaaaacaaaacccaagaccaaaattaaaagaatttgaccaaagactgttgccggcccaagagtttcctaaaatcttgatgggcatccaaaaatccaagtttattttatcaaatttattgttcttgtttcaaacaagcatgtttgtggcgatttaatctctattttttcgggttttattgcatatttgccattttttaggattcttttcagattttagggtttagtgtctaatttgtaattttaggtgtctacgatgaatttgactcgttctgagcttcaacagttgaatgatggcatcaaattttacatgaattaccgtaacgtaaaagacgcaatgcaaaagcgcgtgttggactgtatccattacatccgacggcacgcgcaaatgcatgacgaaagggtggacaaatcattaagacaaatttgaaaattaaacatgaaattaatgaaacccaggccatccttggctccattttgcccgcccgactgcgcggcgaattggccgttcatcttcactttgaaaccattgtaaaatcacccgaaattgcttacaacaatgaatggtttgaatgattcccttccaattaagagccgagtgcaattgtttgcccattgtgagacttcgcttctctacgaattggtcttacgcttaaaaatgcaaatggtaattaaatcctaccggattataaaattgacataaaattaatcctgaatatcagcaaaacaaaattcaaagattcgtgataaggtcggggtttaattgattgtcagaattgttaatggctaagtccttctgcatttttctggtcgagctcggtctgtttttggtctgaacaccttcagagtgcctgggcccgaccaaagtcgggatttcttatgctgctcaccaattaatcgcaattagagaatggcaaacagaaatgcctaattcggccactgattttagagcgtattgttaaaataaaactaacaacaaacgtaacgggaaatttaaattttttcgatcggcaattacttttccatcattaagttcgcaccaaatgattttctctgtcgtcgcggcgatttagccaaagttagcgtttcactttttcgactgtttaaagagttttgaaatttttgtaggaaatgtttgtgttgaagcgtggtgttcttgagattattgacgagaatgaacgcgtagaacatttggaaagcggcgcaacatttggcgaaatgtcaattttgaaaccgatcgggccgttgggcaaattgttggcacgacgcaggttggccaaccctttttctatttggcatttggaattggccattctttgttaagccattcactgcgatcgttgggctattccgaggtgtatttgcttagccaggaggacgcgctcgaagtgttcgctgattatcccgaacagcgccaaatgcttatccaccacggtggggaagcaaagcaaaaaaacacttaatttggaagctaattaaatatagggaaataattattagcattgaatagccaaataaaattaaaaaatggattcaattaatgtaaattggttgcctctctttcttcttttgtcattccgtctttccattaagacaaaaaaattatatttaaatgaatttttagtcttgaaaattgagctcatttcatttaaaaaaatgaatttcataaagacaataaggaaaaaatataaacaatataaaccttgaaatattacttgtttatgaaaaaaattattattagccacacaattgttgatggagcgtggcgaggtgtgcggtgccgaattggtcgagccgggcccattggaccctttggaactgtgtggtactgaaaattcggccgaactgcttcaattgctcggcaacactctttgcggcttggacgccacactggacgcactctatgacaaatttatggttagtcgtttatttttcattttatggtattaagctggcccactttaggtgaatagttcagagcttaagcaacagctaacagtgctcgagggaacctaccaaaggaaccggcagaagctgcgaaagaaatggcacaaaaaattgtgccaaaaatagggaccaaatataagttatgaagttttaatataatggcatagttgatcagtcaattaaggagcaattaaaacccggcaattccctcggtttaattagccattggccaaattcgcctccctcccccaatccaatttctcctctttcttcctctaaatacatataacaaaaacaacaagtcaagctcaaaacaaaaataacatgntgttaagttaatttgttttcttttgtaatgacattcactaattgagttattatttattacgtaaaaacaattacttttgttttattgttttgtggcgagtccgccgatctcgacaaatctgtcccagtgacatttcctttattatattcatttactaccggaattttgaacaccaaaggaaaatataagacaccggaaaactggaccctcttttaaaaaat

SEQ ID NO: 1764 - DNA, 1871 bp, Heterodera glycines
  misc_feature (20)..(20): n is a, c, g, or t
  misc_feature (39)..(39): n is a, c, g, or t
atcatttcaaaaaattcaantcatagcaagcttgcttanaagcatacattcctaaaaatggactgatctttgaaaaacattagcagtttttcatgatcactgataatacttgtttttttaaacccaaaattcaaaataacaaacttctggcactcatattaatatgtatatttatttcttggcattaattctgcaaaagtttgcatcttttttctgtcactttcatttcaattttcccatttcaaaatttttgtcctttacaaatttaaattcttatgggaaaagccctctttcgagtaccattaatattctttgtcgcctttgtcttctccaataatcccacactttcgtctttttcattttaagcattaattttcctacaaaatcacttctcagtgggtgggtttggtcaaaaatttttattctcattgattttcaaaaatttacttcaatatttttttgggggataattcgcattctcgttgaaaaggtgaaaaggtgcttcttattttaacacaattttcacatttatctaaattcttcaaaattaattatccttttggctaatgacttcatttatgaatgatttttagctgctgaatttgaatttcaaaggcaaatccagtgatgactcactttcctcaaattttattggcaatttctccgctttttctgtttttgcatttttcttttgcttttcctttgtcttctcggccttggcacattcaatggcctgttgggcaaggtaaacaaaatgaaaatgccataggatttcgtttgtcgttcgattcctaccgtatcgcatgtttttacttacagtacccgattatccgccgccgctgggcatggcaatgaatggcgcgacttttacgggacgacgcgcacttttacccttggggcgaccatgtaatatgatgtttttttcattttttcatccaataaatgttatttagccttttttggccccaattttggtccgggccgagtgccgggatttcgagcgccgggaattggccgttccgtcggaaaattcggcccaaacgcatatagaagtcaccttttttaaaataaagttaattagttaattaattttttagccaattcgatcatttcaccaatgcgttttggacgcggaggttttcggtcttcgggaagtgaatttggtgaattgttatgttattttcataattattttaaatagtttcagctaatccgaacagcccatttggcgctggcagacctttgcccgttgttggaccttatggccaatttccagtcgcgagaaggcaaatgccattccgactttaattgtctcaaatgactcattcattgaatggatggaaataactcataaaaacccataaaataattttaataaattcttaagcatttataaaaaaaatattttttagagatgtttccaaatatggtataacaaatctttgatcaaaaaataaatgggaaatatttattattaattattccgatttattaaattcgtccgaacccatccaccgcaaccgcgtattttaggcctttagattggccaatcgggggatgatttttgcgtacagtttgacccgtccagaaaaacgcgttcattcaaaaattcgttatggtcgtgcaaaagtatgggtgtgttgtgttaatcatcggggagaaaccaatcgctggaatgccagcctaatccaaaaaaaatattcaaaaaaacatttaaattaactctggtaataatgaaaatgatatttattttttatttatttcatcaataaatggcaatcctacaaaaaaattttacctgtcgtaataaacgcgagtcggtgccaccgatgaaaatctcagtggaattttgcactttctaaatgaattgt

SEQ ID NO: 1765 - DNA, 7436 bp, Heterodera glycines
ctgctacaggatgttgaacaagcagacattgctcaacgtgtcaccatgttttcgagtgttgccgaagagtttttgggaatgaaagctgctgaattgctcgccaaggagaaggagccggagagccttgcgaaacatttggacgatttgattgctgtgaagataattgcgaaagtcaacattaaggttgtttttttttgcaatttattacatatttgacaaaccacaacataggcgaacagtcagacgtacactggatttgattggattgtcaatttgttcaagaagtgccctggaaaaaatgacagtgatgtgccaaaagaaaaagatgatgatgatggtgacgttgatgagattgctaccaaaaaaacaaagaaaaattgagagagagagagagaaatgattcatttgttgtgagcttcaaaaaaaaaggatttaatgtgtcctttacttttttaaaaatccattaaaaatgcattttattgttgaagatgatgagacacaaactccaaaatggtcttgatgtgattgaaattttgttttttcttcgtgaattcaccatgagacaggattgcacgttgacaatttttcgtaatgagcacagagagatttgcagttggctctatccgagtggtggatcgtcaactctcctcataacaatccaattaacgttgttggaaaagcttggcccatatgcgtttgtcacgtaaccctaatttttcaaaagaaggaaaaagcactcctaaatttagttttgatcttcatcaaggctgaaaggggatcatgtgaaaaaaatttgaatatttgtgcgttaatcatttctttattgataaacttggaaaaataattgatgaattttttggtaattggtaatttcgcaaatcatccatcatctcattggcatcacgctgagaaatatgtcctcttctcttaagaaaatttatcaaagaataccagcataaaatgaaaacgggaaaagcaatgagatagtgggcaaacaatagaagttgcacgaggaggttaggatgaacgcttttgttttcaaatgttagtacttgtatctctggctttaaactggcgttgactgtagtgtttaagaaggccatttttatggtggcattttttcgcattatgcatcttatttatacagttaattaactaagctttgaatcggaaacaatgtgacggttgtagtctatcattatcatttggtcaaattcacccagcactatcatttcaactccgccctcaggaattgcactattaaatgttgcgcgaatgctagttgtcccgcttcttaagagttcataccctgtgctatcgtcgagcgtcgatgtgagtggaattacaaaaaaggtccaaccagatttgaattgctcttttgtgatgtcgaaagaacgctctgaattagccatgccaagtgcctcatacatgtcaacaaaaggacggacaaaaatatctttggcaaagtcaagcttgtatggaacaattgggtaaatcatgccgccagcgtacacggcaatgtctcgtatgtcaaacggtttaaaattaaatggagagagagcataatttccgttaaatgccccgtttgcgacaagtgcgattgtcatacgtcgaggaattgttgcactgaatacattgtagtcaatttcaaacctaccttcacttataaagcatgatttgatttcagtttttcgcactgcatatgtggctggttgtttttcaagcgttttgtagatacttaaattcaaagatgactgaacatcaatcattttagcatacagttttacgtcatggactctaacgcggtatctggtagtatcgtttgctttcaatgtctgcatgataaaagtgtcacgagctttgtaaattgtaaataaaagatccaaattgttcaacaaataaagttcttggtttcccaggtcaaagtccagacgtgaaagaaattgggctcgcttcccaccctcaaaaattttacaccgagctttaaagccctcatcagcgacgctgtcgtgtgtgcgtgtcgcatagtgaccagttgaagcgaggaagctttttttgacgttcatcggaaacgaaagtgtgttcgtaatgtaaaccttatatgggtacaaatttccgctgtcgtaaatttcagtgtttccaactgagacttttagttgttgaacaaatgtttgaccaattccctgaatggtgccgacttgagcatcggtagctgcgattgacacccagttaccgtccacatccggtttttctattgaaaggtcaaggaagagataaatccgggaaagatcggtccaaagattgtcactgtacaggcgaaaaagatacggagattcttgcgttattgtcactagggggaggacttcacggaaatatgagcgcacaaccgacacatttgttgaaggtactgaaaatatgttcaaagcactatttgtggcaaggggactactttcgctaattttttgtgaacaactcatgattgtgcttctgggggggggggggggggtgttttattaataggttccaagtatatcggtacgaaggcgtttgaccgatttctgtttagtgtgttttttcttccgacctgctggggtgtttgctggtaggaaatcgtgtggtcccaaccttgattgtagtttatttataccttttttcgctttaccaaatgcaccaccttctcttgcatcatttctctttgtgtatcgtttaaagtcgaacccttgacctttttgggcatttatgttgttggctgctttctctagcaaatttttgagccccgtttttccctcactgacaagtgactctttgaggtccctaccctctaatacattggatagaactcgatttccagattcaagtccttggcgcccgatggccgtcccgatttctttcccgattggtattaggtaacgcaatagactcctaaaaacagacccgataccactaccgcgctggtatggaacccctctgaacacattataaccaccgtattggacgactacttctggagaaatttgggttaatgctgaccattcaactttaaaaggatcaaaatcaacgtgcatttttctttcttttttttttttgcgctttttaaattgagttttctagttatttatatttgtttaaacacattttttgcataaatttgttcacaaaaaaatctggtgatatttttgcgcgttttagcagttgcaaaattgcttcaaagtgcatccccatacaccgtccaaatataaagaaaatcacatgctttccgcatgagtgtgagtatggtgcttggagcgaaagttgatgaaactgaatttgagcaaaactctttaaaaatttttggatgaaagggcttagcggtggccaaattcctgtcgaatcgtagtattccacccgattttgctgctcgcaatacacggcaacccaatgtgaaccaggtgaaccgctcggatcaacgttaatcaccattgaataaggagctggtgtggctgctactgctggaatttgatctgatggaaaacaccctaaaaaggtcgaacgcgtgactgggtttcgagcaagaattttatttatttgaacactgttcatttttaaaagtaggaactttttctaaagtgtagcgttaatgtacatgtaccgtattgaaatggcattaggctaccaccggatgttctgatttcgatgaaaatttcacttatttctttgactagtacgcgatggtattggacggagagaaactgctcctctataatttcgtcaggttttccccgaatcgtaacgatacgcaaaactggggcaatcacgtcaccaatcatcattggttcaattagatcaggtgcataaacatgaaaagaagcaactcctccactcatgtctggcataaattttgcaatcgtttctttttcagtgaaatcggttgagttaaaacccaaaatgtaggccaattggtctgaaatttttattttctgcacataacgatcgtccagtttcaacgaaaatctgttcgttgcactgtcaaaatgcaggaaacatgcagagtacgctgattggaaaacttttatccatgctgtcatgcctaattctttggtttgatcgagaatcttcctttcttcgtcatccatcagtgcaatttccgcattcaacttttctgttatcagtccctctaagcgttctaaattacggccacgtagacgcaaaaaatatttatcaagcttttcctgatattcctcttcagtgtcatcccaattccgcagggggaccttgcttgttgctgcacgtttttctctctcaagtagaccaccactggttgctccgtaaaggtcaagcaacgtgtcaacccccgctaaaagggcgtttaataattgttcttcgttttcgtcatcatcatcatcatcatcatcattaacatttcttttgtctctttgttgttgttgttgttgtttattgatgtactcggctctgcccaattgacgtgctgtattggccgcttcagtgaattttttctgtacgccttccactttaactgcgaacggtttgttgccttcttcaagcagtttgtaaagtcttttccacagctcaacggggtttgtcacgttagaggatggaattggtatttgaacattctctccaattttccattcaatttgaacaaattggtcctctgatgtgccgagtgagggccacgaatgggggtatatgatcacacctaagcccacatcccattccgaattaaattgaagttttcttggtagtcgaactcgaaaagagtttgtgcgatttccttcaacatttgtgttggaaggaacgatcacatagaatgagtttgatgaaggcattctcatttgaaattttaaaaaaagagcccctttatatatttttccatgtcatcgagcttgcaggaatccagctgttgtgccgttgactgtagcttttccatttcaccaaaacgtattcaacaccttgctttttcctctttcggacgaccttttcaatgtcatataggatatcatcatcatcatcatcatttttgcgcactagcacacgacagagatcgttggcatagaaacggcccttgatcagggaaccgtcgtcatcacgtattcggtacgtgactggaaaacggtcagtgtacacttcggcaacagtgaacacttcgttggtgaagcgtccggtgtagcccttttggaacacgtgtttgtacttctcaatgcgcacacggtcacccaccttaaaacgtggttgtggttgtttccgttttgctgctgctgcttccgctgtcccaccaatagcgttctgcttgagttttttcctgagcttttcggcattcttaaaattcacatcaactgggcgcatttttatgcttgagttgtacgagtggtttattccatgcacaatttgctgtatcacatcaacccatttttgggtaccccgttccgtgaaatagcgataaaggcgttctttgatggttcggttggcccgctctgccatccctgcgtgaattcgcggcgaggtgtacataaaaaagtttttcacgttcttatttttgaaatatttctgaacctcttttgccttaaattcgagcccttggtcggtcaacaatgtccatggtatgtatttggagcgtttaaacaagcgttcaaaagcagcaaccatgtcggagctctttttgcttttcaccggctcaacaaagagctgtctgctcagtgtgtcgatgcagacaagaaggtacttgtagccgtgattctctcgcgacaatttgtcaaagacagacaggtctgcttgccattcgtgtgcagtccagaagcgagtgttggtagttgtttgtagcgcctcttcgcttgtctatgaatggtgtatgtgcgctgtgtggccaaatactcaacaacatcctttctactcatttgattgttcacctttttcgcctcgcgtaaaagcggctcaacgctggtaaagctgaccgatgagttaacatctttgtacagctggtccaacagctgttctttcttccggtcgactaccatagtgtcggtttgaacctgaagacacttttccctcctcccccttcgcacttctttttatgtccttttccatgcttaaagtcagtcaggcctttgccaaattgtagaggctgttccggaaacaaatacttttttagcaacggatcctctctagccttttcagcaaattccttatagcccacaggcggccctttgaattcgcttcgcttgtccctgttcaacaaatggctgacaattgcctccacgttgctcgttttaaactcggacccatctgtgcgcaaaacctttccctgatcactgactcccagactgtgcccctttttttgaatgtgtgtgatcagtgcatttttggtcatctggtagttgtgttttgtttgaaggcgatcagccgtttctcctcctcctccttttcctgcttccccatctcttgctctgagcattctttttggtgcgacaccacctgttgacgccgtggatgatgatgattgtgcgtcgtcccactgttccccatcatctccatcaccctcttctttttccgtttctccatttccactgctgtttggtgtttctgctgctgctgctgcttttctttgttgtttttgggcaggtctgcgatttgataatgcccccgccttttgtgtgtagtggtgtctttgcctcctcaacccaaacgctgatggtacaatgtttttctccaatctttttggcgttgaatgatttatcgtttgcggcggcggcggcggcggcggcggcgttgctgcatttttttctctctccttttcgtgctgaagtcgaacattgatcggctgctcctcctgctcgcgcaccaatttgttgagccgtttgaattcctgatggtattgcgcggccttttgctttcgttcagctccctgctacgctcaatttgttggatgcgtgagcgcaaaagcccaattggtgtaccgtcggcaccgtctgctgctgctgttgctgcttggggttgaacaaataccgactgaaagacgtcctccggaacgagaaacattcgcattgcgtgacgcattttttgcgctcttctaaatgtttaattaaacgagtgctctcttagctgtttcgcttttatatatttattttttatctattaatcaattagtttttggcagtaatttgtccattaacattggtaagagaatgcttgtcagcatactggctaccaccggaaagccagcaccggtttggtgttgttgttgttgttggtcttgacgattcaataatagtactctgcgcgcggtttttgcgcaacgtgcgcgtgctaagcgcctcaactggtgcttcaatgcacccaaccgttgaatttgtcgcttccctaacggaacacgacccttcaacatattgaaacccatctccacaaaacagagcaactgctcatccaaagcgttctctatcatt

SEQ ID NO: 1766 - DNA, 3723 bp, Heterodera glycines
atttacatttatctttaaatgttattaataatcttaaaaaatttaaaaaagttttataaattaaaaacagtgaaaaattcaatttttttaaaatcttgtaaaggaattttcggaattatatgcaaaaatggttaaaattaatttgcgattaattttttttatatttacgctaacctacgcatttcctgtaaaacttaaggttcctcaaattttaaaaattcattttccgaaaaaatttctgccaaacacatcaataattcacggccatttgttattgccggatggggcataacaaaaccaaagtgttcacgtgaacagcacagtacaagtgaccagctgatgtacggtacaatgcgcatggtttccaagaacgaatgtccaattacttatggtatggcataataatatttaagtgcaagaatgggttactgtagggatcgcgtttgtacttattttaaagagacaaaggggaccatggaaatagaaaaaatgtttattaagagataggcgccgaagggaaaagatcttttcttaaaactaatttgtaaaataaattttataagaaattttgtcaaaaatttgcggaattgagtcaattgaaaaaaagattaacgcatccagacatgagaaataagtttgaaccagcctggatttttccttgaccaaggttttcctgggtttttgtccaagaactttttcctggacctgggattttggccagtagctcttggtcaatcttgaaagccaagtccaggtccaacatagaacccaggtcaaggctttttccaatatgtcttagctctaattaagactcatcttcacttccggcggacccaattggtttgattgcaaaggcattaaatgaaatgaatttgttggacaaaatttgccttgttgccgaaccaagtgtcactgaaccggttgttttattataataataaattacaaaaaataaaattaaattatgtaaatttccaaaatacaatcactaatcactagcttaatccttttgaaaattttttacgatattttatgagaatttacccccccccccccacgacgaggatattgctccccgacatttttaaatttctcaagccatttcctacaaattttttccgagaatttcctctccgatccccgtcttttctcttcccaaagatcagagaccaacttcaaaataaataaaacaaaaaaacgtttatttatttttttaaagggcgacagtggcagtccgttgctaagcaaaattggtgacaagaattgggtccaagttggtgttttatttggtggcagcggatgttctgaaaagcatcccttttccacaactcggcgtcgctgtaagaaaagccaattaataataaattaaatttaaaataccaattttatttatttaatagcattatatacaccgatcgattgcgattggatttcgcgggtgacaaatgatgaagtgaaatgtaaaggatggtgaattgaaatgaaaaaattgatgaaattaaatacatttgcattgtgacaaattttagatgcaaaaattggataaaattttacagagacttacagtatttacgtacagaaatataaaattgaaataatttatattattttaatcaaataatttgttgtattaaaaatgttacttttcttttcgctaacacaatttattattccttttattaattaaatttaatgcaaataatgacaatgaaaacattttgaagaatgccgacaaatcacctgtcaattcaatactaataacgaaattactcattttcgtttaataattaaatgattgtttttctgcgttttacgaattacaatacaagaagaatgaacaaatgaacacagcaatttaaatgccatttttttaaattcgaattttacaaaagattcgtctctaaaaatcaaaaaaattagcgaaatttatgagatttaaggacaaataatagactaaaaaacgcatgatcctttacctaatggatgcccattttgtagtggaattacttgattagcatttgaaaaacgtttgaacacaaatggaaacaccgtttggaatgcctgccgatattccgtactaaaaaaataaaaatttaattaatttaaataattattcgaatacattgtgaagtacaaaatggatgcattcgatgccccaccaatgttcagtgaaaatcggtggaaatttagaaaaaatttgtaggtggttggtaaaatgtttctgaaaaaaattacacgcactcttcgataaatttaatggtacaacgcttaagattttccaatatgtcttaactcaaattaaggcccatctttatctccgggaccaattggtcccattggtgccgggtcgttacttaaaaaaccatcaaaatgaaaatttttgacagaaaattattcataacatcgaacaaaatgaatcaaatcttatatgagaagctaaaaaaaccaatgttttttcgacatttttggtcataattttatgagacataacgaagctttttttgaaattttcgtaagctaatagagaattcttagagctatcgaatgatatgaagaattaaaaaattggtacttttgagcaaagctaaattaaaaaaaaaaaaaaattttttccccaactttttctctcgccgagggtcagagaccaactttaaaataaataaaataaaataaaaattttattttttttaaagggtgacagtggcagtcccattctttgcaaaactgaaataaataataaattaaaatgtaatttatatatacaattttattttattttttaaaattcatgtgaaaagcatttttcctatcaataacaaaaaatgattataacaatcaaggtgccaagccaaaaataaaaaatcaccaattaacagaaaagtttaatatttaatttcataaaaattcaaatgtttttaatcaaattaaaaaaaacaaaaaagaaattaagaataaaaaattcactgatttagaagatacaattcaaaataaaacccaaaatatttcgcttttttcattttttatacatattttgaagttttgagaatttataggaatttcttatgaaaaattaaaatatttttaaaaagacagccaaaaaatctcttttttcaataaaaatgagatcataaattaaatgtaaaagtgctcaaatgttattttaatttatttagacttctagggaaacttttagggaagatttagagtgggctttgaaccatcgtctgtgaatttgcggaccaatgttctaccaactgaactatcgaccctgccaccacaaccatcgcatttgataacgtggcacttttcaaaggagaacttcaatattttcgcgcaaaaaattcccgaataatcaatcacttatcaaatatgtattactttaaataagtgttggacatgtcaacaaaatgattttctgtgctatgtattttcctcctaatttggaccaattttaatacataaattatttttcgcaagaattccgcatttatttttattttttgtaatgtgaaaaaatcagtgcttcttcaaatttacaagtatttaccttccctaattctttttttgatattttgcaaataaaaagatagccttcaatgggtttctttcttattattaaaaattgccccaaacaaattaaaatattaatttgaaacttatccatttccgaaattttcatgtaatttccgttaaattttatgtgaaaatgtgtcaaaagtgacc

SEQ ID NO: 1767 - DNA, 3650 bp, Heterodera glycines
  misc_feature (3502)..(3502): n is a, c, g, or t
  misc_feature (3504)..(3506): n is a, c, g, or t
  misc_feature (3508)..(3508): n is a, c, g, or t
  misc_feature (3516)..(3516): n is a, c, g, or t
  misc_feature (3518)..(3518): n is a, c, g, or t
  misc_feature (3520)..(3521): n is a, c, g, or t
  misc_feature (3524)..(3530): n is a, c, g, or t
  misc_feature (3535)..(3535): n is a, c, g, or t
  misc_feature (3543)..(3543): n is a, c, g, or t
  misc_feature (3548)..(3548): n is a, c, g, or t
  misc_feature (3551)..(3551): n is a, c, g, or t
  misc_feature (3560)..(3560): n is a, c, g, or t
  misc_feature (3563)..(3563): n is a, c, g, or t
  misc_feature (3579)..(3579): n is a, c, g, or t
  misc_feature (3582)..(3582): n is a, c, g, or t
  misc_feature (3585)..(3587): n is a, c, g, or t
  misc_feature (3590)..(3590): n is a, c, g, or t
  misc_feature (3596)..(3596): n is a, c, g, or t
  misc_feature (3600)..(3602): n is a, c, g, or t
catattttggcacgaaatacggtatttctctaggttgctcgaaagcatgaaaatttaagaaaatttgattgaattttcagaaatttttgcaaattttttgaacctttttcatcactttttgaaaaccggaattaaattaatattttttttgtgctaatagtgcaatccgagagttaagtatgagacacaagattatttaatttagttatgcttaagaaaggttatgacgaattttctcaaaaaatctgaaaattggcactttttgcgaatgacccacaggcactaatctgcttgctgttggtccgtggccacttatattaaccaaaaaataaataaactaaaaaaagaaaaaataaaaagaaaaaagtgaagattgttttttaaatattatgccataatttgctgttgttttttcagataattataaagttttattcggtgccgttcaaagctcaaaacaaacgcacaaattgcgcattaaacgcgtccattatcatgaaaatgcaacatatttggttcttaatgacaagttgaatcctgctagtggtgtttatggtgaaattgtgcacccggattttgctttaattgaagtaaaaaattttaattatttattttttaattaaatgttttttaagagcgtggagccaatacaattttcatctcgtgttagaccaatttgtttgtttggcataggtaagtatttataattttttgtgaatttacatttatctttaaatgttattaataatcttaaaaaatttaaaaaagttttataaattaaaaacagtgaaaaattcaatttttttaaaatcttgtaaaggaattttcggaattatatgcaaaaatggttaaaattaatttgcgattaatttttttatatttacgctaacctacgcatttcctgtaaaacttaaggttcctcaaattttaaaaattcattttccgaaaaaatttctgcccaacacatcaataattcacggccatttgttattgccggatggggcataacaaaaccaaagtgttcacgtgaacagcacagtacaagtgaccagctgatgtacggtacaatgcgcatggtttccaagaacgaatgtccaattacttatggtatggcataataatatttaagtgcaagaatgggttactgtagggatcgcgtttgtacttattttaaagagacaaaggggaccatggaaatagaaaatgtgcttattagggcaattgtggtgccgataggctccgttgggaaaattctttgcataaaactagcgtgaattttaataagaaaatttatccaaaattttgaagatttgagaatcaatttataaaaaacctagcacagccgtggatgatatttttctaacatattttgaacaaacaatgacaattttgagggtttttccattaacattttttggtttttatgttttacaaaatttgcttacttttgatctaaaatcttcagtgtaaaatttagcggatttgaaatgacccaggtagttcaaactaaaattcataaaaattttctcacttatttaaaatttacattggtaattaccaggtctgtcaaaaatatgttcagatgcatttttttttccttgaatgagtcaatgttccaatttttttcttggtttttctggattttttttgtctgtgagattcccggtccaaggtccaacaaaggaatccaggtccaaactttcttcaaaatgttttaacgccaattcaggctcatcacctgtggttgatccaattgtttccattgcaaacgaattaaatgaaataaatgtgttggacaaaatttgccttgctgccgaaccaagtgccactgaagcggttgttgtaataattaaaagaagaaattcatgtaaatttaaaaaatagaagcactaataacgagggctcggaattatggaaattcattttttctttcttggactgtggggaaggcctgaaacgcacgaaaaacatgtttttagcttggatttaagcttctaggatggatttctatatccatattttccatatttcgcgatttatatccatattttggcatttttccaaagaactctattagaacggtcctaaacagaaaaattgacctttttgacccaaaaacttgaaaattttccaaaaaatcattttatcgcaaaattttctggagaatattgaataaacttaaattttcttaaaaattgataaatttattttaaaaataagcaaaaaagctaaaatttcgcttttcgggttgattttcgttaaaatgaataaatcatagcattatcatgtttttttcttctaaaatgatttttaataccatttttgtccgtattgtggccattttatgtccatattttgtaatttttggtccatattttacgattttatatccatatttctccgagccatacaaatcacaaggtcatgtattcgacttttattttgccctatctcgaaacccggaccaaaactcgaaaaaaagtcgcacagattcgtacataaaagtgatttatgaaaaattctaattttcgacttttgtttgaattcgggtccggaattcgaaataggccaaaatagatgccataaaaactcctgaatactgagggtccaggcgggtccattaacattcccaaattggtagcggtgttgttaacaatcctttattcaagagtattatacaatggatggaccacctcttcccgattcgcagtcgggacagagactgattgtggggagaagtggggaaggggaaaagagttggattaaagggaccgcccccaaggcaacaattggtatgtcatatgtgattaggggggggggggtggcgattgggacaatgggttacaaaatgattatgatgtcactttaaaaaattattaatttttcatattcaaatttatgttactgctgatgaaaaaataataaatttaccactgataattatttcttagataaaataaagatgataaaaatttatttgataataaatttaaattatatcaaaataggaaaacataaaaattattatggaaatcgcataatttttcaactaatatctaatttaaaaatagttgaaccattatatttttaaagaattttgaatcaaaataaacgagatgttctttgattgacccaaagaattatatttcacaacatcgggaaatgccatgaataaaaataatgcatttatttaaacaactgctggaattatttgttattcttaataaaacattaataaattattaaaaaaagaaacgaaaacaaattaccaagtaaatcattcataataaaattaaatctaaattatttttactataaaaattaatttatacctttaaggcatttattgtcaaattgggtcattttgataatgtattgtaattagctttttcttgaagaaaataaacatatttctttaaaagaatagaagaatatagtacaaaatataaatacctaatgataattcccgaaaaaatcgataatttattgtataaagaaactncnnncnttttgtgncngnnggnnnnnnngttgncgctgttngtccnggngtcatctcnccncttttaaaagggctcntcngtnnnggnggcctnctgnnngaggtataaagaaagcacataactacttaaaatttcagtaatttgcta

SEQ ID NO: 1768 - DNA, 4281 bp, Heterodera glycines
attttttaagggcgacagtggcagtccgttgctaagcaaaattggtgacaagaattgggtccaagttggtgttttatagagaccggaccgggccgggcccggtaccggtttttaccgggcccggaaaccggaaccggtgatttttggaaaaatccggtttgaccggttttccggtttgaccggtttttgagagaccgggctcggaaaccggtcgttttttaaaatgtaacccggcccggaaaccggccttttggaccggttttgaccggttttataatcaagccaaaaatgtttctttttgttcatttttctttgaaaatgtctttttggcataatgtttttaattttttttgtcaatgttcaagttgaattttttaattctaatgtttgcttctttataattattaaataatgtcttttttgtttagattttatgcaaatgagtttaatttggcaaattggcctatttaaaaaaacgtccaagactacagcaaaaatgaattgaaggaatgggaaattgataatgacctcgatgaactacaacaaaatgaatttgttcgtcctgttatgtcgccccaacccgaaaatccgccagctaaacgacgaatgtcattttttgaacgtctgaaacacattacaggcgcaaacacaagtgaacagggtgatttttggtctctaaaaattaaatttataatgaaattaaggcttccaaacgtcgcaagatgatgacattgaaaaagaaattaaggaatttctcgcgctggaaattgcgaacccagaagcggacccgttggacgaatggaagaaaattgctccccgattttcaatccttgccaaatttgcggaaaaatatctttcagcacctgccaccagtgtcccaagtgaacaaacattcaaagtcgcccgagatgtctttgattatcgccgttccaaattatcacccgaaactgcagaacagcttatttttctgaacaaatctcttccccagatgaattacaattattgaatcaatttttctgtttattttattaaaattgttaaatttctacatataattgatgaaattttgtgggttttttcccaaattaacatgcgaaaatttaaatttttaccaacccggaaaccggtgccaggcccggcaatttgaaaatccggtttgatcggttttccggtttgaccggtttttgagagaccgggcccggaaaccggttgcttctgaaaaagtcagcccggcccggcccggcagatttggaaaatccggtctctagtgttttatttggtagcagcggatgtgatgaaaaacatcccttttccacaagacggcgtcgatgtacgacgataagccaattattaataataaactaaatttaaattaattaaattaaaaattttttaataatttttaaatagcattttacacaccgatcgattgcgattgggtttcacgcgtgacaaatgatgaagtgaaatgtaaaggatggtgaattgaaacggaaaaaagtgaatttaaatacatttgcattgtgacaaatttttagatgcaaaaaaaaatggataaaacaatatttacaaaattataaaattaaaaaattaaattgttttttttactaaaatttgaattagttgcataaaaatgcttcaacggttaaacatttttgtttgcacaaaaaagaaaacgggaaaagcctgaccttggacggaaacaaaaacaaaaaaaaaggatacagtatgaattagtatcgcatattgtggaatttttattccatgcttttaattcgtatatgttaaattaaataaattaattaaatattaatacaaacgaagttgaacaaaaaaaattataataccaacgaagtttaacaaacaacaacaaaatttttttatttgtcaataaagaaaaagtccacaaaagggaaaatccgcccgcttacattgaggacaaaacattaattaaaatgtcctcaagaaagcgcataaacaattaaaaacgagatcgccgccaaaaaataaaatataatgtgagatcaataaaaaaaataaaaataatgaccaaatcactttttgtttaatgaattaataattcgacttttatttttccggtcaatcttacagaaatgaaatagttttaattttatttttaaattgatttaatgagtttatttcaataagctttttatcgagttggttccaaatttttgttacccgccccgcaaaaggtataaattttttgcctaatttatatttcgagttaagtctataaaagggaatgttaaagcgtttagaaggtttaagtatttcaaagggattcagatctgttcggccataaattattttatgagccatgaacagatcagaaagctttctcctgctttcaagtgttggcagttgaaggtattctaatctttgttggtatggaatgggtggaaggctgcatttgaaaagaactcttttggtgaaatatttttgacatttttcaatttttttaatatttttttgaatagatggattccaaacctcaggagcatattccaataacggtctaacataagtattttacaaaataatccaaatcttagaagattttgatttaataacccgaaataaagaacgcatacgtaaatatgcattctttattatttgtgcgacatgattggaaaattgcaatttattatcaatatttatgcccaaatccctaattgtatccacaacatttattatatttccatcaattttatatatttctttggggtttttattccccaagtaaagtacaaaagttttttttaattgagattctgatttgccatttatttgcccattctgataaattatgcaatgctttatgcaaaatttctgtttcggtccttgctttataacaaatatacaatttaacatcatcagcatataatttaattcttactcctgatggccaagcatcaggaagatcgttaatataaatcaaaaataataaaggtccaaggacagagccctgggggacgccagagccaacttttttactggaggataaatcatcccctattttaacgcgaaaagtcctattactcaaaaaatcctttatccatattaaagtttgctccttatacctattttttccaatttgtataaaagtaattcatggggcactgagtcaaaagctttctgaaaatcaatataaatacagtcaacattttttccatttattattgcctcgtaccaatcttccacaactgttattagttgactcgttgtagacctatttctaacaaaaccaaattgaaattccgaaatttttttgttttttaatagaaatttgtaaatatttttgcttaaaattctttccattaccctgcagagtgagcaggttaatgaaattggcctatagttttcgagattatttttgtcacccttcttaaaaagcggaaaaacaattgattccttgcagatgtctggatgtgagccagtgtctaatgagatcctaagcaagtcagtaataacagttgacagagaagaatggcaaatttttaaaattttataactaatattatcgggagaagtgccatttttattcggaagttttttcagaagattttgggtctcgatgatgttaaaatttatatccgatataaagcattgatcaatttctataatattacccaagcatggattgcttgggtcggtttcactattattaaatgaattggcaaataaggtggcaaataattcacatttctcagcactgttatgatagcatttattttcataaattagattaggtatttcaaagggaacgccgacatttgcgccgcggacatttgcgccgcagacacttgcgccgcgacacttgcgccgcagacacttgcgccgcccagccaaatcgacatttgcgccgcaaaaaaaattttttttttaattttcaacaatttattaacgctaatatttgataaaaccctaataaaagttagcaaatggctaatcacaaagataaacgtccaattttttgtcttttgacaaggcgtacatcaacaataacggcaaattcttcttattcttgtgaacgcgcttcatttctccatcggcaccataaaaacaaaagccacattcataattccattctttgaatcccttcattttgagggggcgcggtcgaccatccattcgtttgccgacacggaagacaattggtgcctggtcgacgtccgtggcattcaacatgtggtccacaatggcatggtcctcccgggctctctccgccgctttgaccgatttacatacgggcacatt

SEQ ID NO: 1769 - DNA, 7606 bp, Heterodera glycines
tgttacggtccgcctcttcctctcgaggaagcggcttcttttttagcattggcatggtttctcagcgttgtcgtcaaaacgtctctcagctgttcaactcgattctgtgaagaccttgggaccggcacgcgtacaatgcggtgtttgtcttcttcaggaaccccaatatccgtgaagtggatgtctatccactgctcatccaatgtaccaattgttgaccacgagtatgggtagctaatgctgtgcagcccacacacccaagacccgttgaaatgcaaaggttttggaagccggacccggaatttgtttggctgattgtccggataatccgtcacattgctaggcaaaaacacaaagaaactatttgacattatggatttattcaactgatgagaaatacacaaaaattcaaacgcttttatacaatctgagactcgtcaatccattctcgttcgggatacccaatgaactttacgagcatctctgtggttccatccggttttcttcgctttctgtacactttttcaattctgtaactggtgccggcatcttttctcacgcgggccaactcctgctcataaaaggtgccccggaatttttcaccacgatcatcccggagcttgtatctgatggggcgcaccgccttcagcacctcgtcaatttccaagatttcgtctccatagtttggcaaataccccttctcgaactgtcccttctctctgctcatgcgtacaaattcatctttacggaaacgtggcttcttgcgtttttgcggtgattcataaattcgcttccacaccttctgagcattttcaaaattgacatcaattggtcgcattccgtgaacccgtgacggagtgctgttaattccatccactatttgttgtacaacatcaacccaattcagcgtctccctttcggcaaagtatctgtacagtcgctgtttcacatttcggattgcccgctcagcaactgacgctttcactgacgaatgcacgggctcatgtttctcaatctcctgctcctcaaagaattccttcagcaatttgtttttgaattcggtgcctttgtcggagaaaatgcggtgtgggaccattggcatttgcttgacaagctctttgaatgcatccagcatctcctcggccttcttatttttgagtggaacgacaaacaggcgttttgagagaacatcaaccgcaaccagcaggtatcggtgaccgcgattgtgacgagaaagcgcttgaaagtcagccaaatccacttggacgtcggtcatgaagccagcagctacagtttttgctctcggaaatcgtacccgcctggggcgcatcagggtgtacgtgcggtgtccctccaaatagtgttgtacatcctttttccgtaattgttttaagctttttccgcgcctccttccacagtgcactaacaccggcaaacgcagtaggagaggatggatcgttgtacagcttgtcaagagtggtgttgatcatttccattttttcggctgaaattccttctttattgacgtcctgctgcttgtgctctgcgatggtctctttggtggagccgtcaatgaatacaaaattgggtcctgcctaagccgctcctccaattggtccgctcccggtggtctaatggtaggtcgacccgctcttctgtcaattatatacctgatggctgttcgcaaattgcttcgcaccaatggttgagcattttgagtgttgataattgcgtttccccggacacccatacgatcggcataacggttgcatttgatgtatattagctcaattctctgtgccatggtcagctgatttgacggaatggcaaacagttcacgttgttgttgttgttgttgttcatcgctttgtgctgatgttgatggacccggctctggtgagtaatacactcgtactcttcgcgcttgcctcactcgtttacgtatgcgcagctcaccactctcatcaccattttccggggggtggcgacgtttggtccctctcctaggtgggggaacaggcggcacttgtggggcagcaggaggaggttgctgccgcggcagtgtttcttcaatttttggctctcttttcggaatatgatagggtgtggcacgaggaggtggcttttttgacggtttctgttcatgttttggttccgcaggggggttgtacccggcttgccgtgatgtggatggtcgcggatccagatcgaactttggctcccttttaggtttgcgctcaacttgttgtgatgtggatggctgaggatcgagcagtggttgtggttgtttcttgaggctaggacgcggtggaggtcgaggtgtttcaatttttggctgtggacgagacgggggtggcgagaagggggaggagggtaatagacccggtattttttgcgatgcaaatcgtcattgccatcatcgtcatctgctttctttaactttcttctggctgcaatcctgtgctgtgcagtgtccatctcctcaattgcgtccgcgttgtctggcagtacaggcaattcgccataatattgtgatggtgctggcagagcgaatccgctctccaacatgtagtcatcctcttcgtcactttcgggtagcggagcagcagctgcttcagcaagaaggtcccgcacaaccggctgccgttgttgtatgtcgtttctcttttttcgccattcctccacacgcccatctctccgagagggcggcgcagcagctctaggtggtctcggaggacgctgtggacgcggcggaggactccccggcggggacggacctgggcctggagggcttggtggacgacgaggaggatgctgaccaggaggcggtggtggaggaggaggagggcggggtggtgtatctacaacttctgcttcatcatcagcaccgcctcgcctcatcagaacactcaatcccttgactagctcaacccgtgctggtttgtccgcgacctcccgtctcatttgcaagtatcgcctaagctgttgattgtagctgacatttttagctgaagggtttgttcgttcagccctggcacgcgtcaaatcgtgtcgtacagcatccaaattgatgtcacccgtgtccgtcgcagaggtgagaccccggtaaatttcttgtggtacaagcacaaatttatttgccattttatgaaacaaatgaatgaatgaacaacaatttttttacggtatttatacatttttgctcacaaatgatttggcaacttcaattaacacgggtgttaggagtgcagcgaacagtccgccaacccctgctcccttctgaacaatcatacgtctcgcgcctcgttcacttcgcactctgctcaggcagcgaacaaaatctgcgtagggcatcagcctgttcttctgacgtttgttcaagcgaaatcgagatgcaacaatgttcaaacaaatttccaccagcgctagcagttgatcagcgttcgctttccgtatcagcttgcaacattttttcgcggacctcgttctggccagcgcacaaagccatttggaattctcatggatgagttgactaattttcgcttgttcatcctgactattggactccattctttggtacaaacacaactaagccttgatcctcctcttgctcgtccttaaatatatttgtgcgaaggcgaagcacggggtcagatgaggcgtgcatgtcaattattaaatagccgtatgggcgagcggtcgctttacgataggcgtcaagaaagaagtcgagctcgacgcgggaaaagctcgtacgccaacgttacggatggacaacagcgagttgggtgctcgcatcagtaccaggtactgggcggacaggcgggccactttgatctttcgctcaaacaaattctgcgtgacaaacacgacagcaaattggtggtggtgggactttttggtgaacaagtcggacaaatagtgctcatcaatggacagcatcaagtcgtctaggatcagcaaaagaggctttggcatgcgtttgatcagctcttccggtggaacacccgaataaacatcaacccccgatttttggagaatgggcacagcgggattcatttcaccaaaacagtaaagtgttgacacgggttttggtataattaattcatcggactcggcaacaaatttcaataggaattgggttttaccagaggaggagggaccggaaatgattagtccaaatggtagtttaaagcaaatggtctttattggagaatgaattaaacattatgtgttaacaaattaattctgaaaattaaattgtataaaacaatttatatagacaaattgttcgtcgctgcgttgacgctctcaaaaaattcgtcaagtgtcttgtcaatgtctcctagattctgtacctcttcggctgacttcttcattccgttgcttttgccttttggagtcggttgctttcttttgagcggtgcctgctgcattgaagtgtcgatcatcattgtggccgcagaaatgctatcgtagaattgttgctcatcactttccatttttgaaggagggagtggcggaggcattttgtcgactggtggaagtggaggcgttttcattttttcgagtggcggaagtggaagtgattcaattttttcggctggaggaagcgggagctccgcagtcttcttttccggaagcgaatcggccagcagcatgtttccaagaacgctgagtgcagttttggccttcttccaacgttgtccctccgcatgcagtgcatcgccggtcaaaccggcatcaatcagatcgagtgcaacttttgccttccgctttagctcagccttctgcacttcatcttcacgcaacgaatcagccaacagtccactctccaccaagtccagcgctgtgttggccttttgtcgcaagtcgttctgctgctgctgcagcagttgttgctgttccgcaagtgcttcttggtttgggtatgtgacggccggcaagtccccgtaggggatgttgaacacgcgtgccttgttctttacacggaagaaacagtggccgggcaagtcatatatgatatcaaacgggacaaattgcactcgggcgattcgcgtacaccaaattgtgataccctccttggtgaccataatgtccacttccacttccgtccctttgcaagacttgcatctgccgctctcatcgaatgggacaaaacggggagaggagaggcgaggaccgctaatcgttaagccactagtggtcactgttatgtcggcttctcccagaatttggttgagaagaccacgcttgtcctgcatgttgatagccatattttttagaaatgattgtggaaatttttcgagtgaaggtaccgaaccgaaattccactgctatttatagggaaatctgttgtggtatgtctatgagttagagaaagggaaaaatacgggtcagagaacgggaattggggtggctacataaattgggatggggacgggaatcgggctggggacaaaggagaaatattgacaagcataaaaataacctatccagactaatcataataatcatttttaaataaagccgaattgtcttttatttttttaaattcaatcaatcggaaaatttagtaaaaaaataaatttaaataaattcatttttctttcatcttcccaatcagcagtcttttccgttttacaataatcatcatcatcatccgcagaagcatcaggtttgacgacggcgatcatccagctgtccttgcgccaattgacgcaatgcttccacaatttgttgcggcgtgccgttcaagccaacctgtgaagaaattgttatggaaatgtcttgtaaattataatgagcaaattaccaggacgccatgttgttggagtacgttcatgatgtctcgcagttgagcatcattgaccagttgttcagcaaacggtggttgtctgtgtccgggggcgtcattccccgcgttgttgctctgtccttcacgtggtggcattttctttaaaattaaaaacaaataagacaaaataaaatgaaaagcatcatcccctttaccttaagggtattgagcgtgggaagggattgttggcttgaaatgaatcctgctaagccatcggtaccccttaaatattcacaaatgacgcacatattttgagcccgccccctgaattaagaatattttgcggaatggatatttggtagctccaaacaacagcactagtgccgcgcacaaatttgcataatccttcgttgccggaaattccacaccctttagcagaactgtcaatcacccaccctcccatccatgggattaggattggtcacccccgcgtcccccccaaccctgctcaaatgttcagccaaacaaattgttgaaatgcagtaaacaattaattcgtgttaccaatttgtcagcaatatccccataggttttggctttttccccacccaaataattaattaattaattgaccatccccccaattagtcacccgaaaaccctcccataggttttgattttaattcccccccccatctgtcacttttccctttgaccagctgtcaatcaattagctaattagcccccctccactggtcagctgtcacttttaattagtgtcatgctgcagaggtggcgtatggtttactacttataacttttttggtaattgtctaatcgcgaagcaatagcttagaaatatcttctaaacatgttaagctttcgattgataccaagactgctggatttggttaacaacaaaaaaagttataacctaaaaacttgggctggcgccaaaacgtcggcgccaaaacgatacggacccatatcggagggaccagagcgtttgggcccccgctggctcccggacatttcgacaatgaccgtttcgacaataaaattaaatatatttttttaaataaaattcaaatttctgcaaaattatatggtgcggatttgggatcaatatataaaagtttttttttcgtttttttcaaaatagcattatgagaatggctttagtttgtcaattttcggcgcaaattgcttatttttttttaattaaaaattgaaacattgttttacacctaaatagttgataatgaattagaagcttttaccctgaaaaaactattcttgattaaaaacacaatttttttttgttcgaattcgggtctggagttcggaattgggcaaacccgagttaagatccgttatcagcaccctcaaaaacgcctaaaaactggttttgagcacaaaatttaaaaaatgaaaattagggacaaccattcttcaggattgccgcctgggtaaaaagaggacactacaataagttaaataaatggtttcattttggatttatattataggtccgtctcattttgtcttctttcttcactattaatagggctcggatttttaggtgctaaaaatccctaaataggtactaaaataggtgctaaaaagtgcaaaataggtgctaaaaaccccaaaaaaggccaaaataggtgcgaaaataggtgttaaaaattgaaaaaatctagtatttttatgtacaaaaattcaaaaagtgactaattttttatcaatttcggcagcactattgcaactggtcaagaaaatccgagtcctaactattaataatcatac

SEQ ID NO: 1770 - DNA, 4504 bp, Heterodera glycines
acaaaaaaatggggaggcatttttttagcggcctcttactttctaagtcaactttatatcatttgtcaatgaaatgaattcttcaaaatgggcaattgaagagttccggcggcggaaaatggaccagtggtactgtattttcaaaaaaagatacagtattttgatccgctaataatttgttattttgtccgctttttttctgcccgccccccaaattggtaattgtcgttactctgtggcttcaaccattaaatgtgtttttctgatgcttccccaccccatttttgcttgtcttccgtcgtcctttcaccttggcatgtgccgttgctgctgacaaactgctgctgttgttgctgctgcggttgtgtcacaattggtggaggcgtacagcgaattcgtgccgcatttgctgctccgccctttgacgaggcggcagaagctgaagctgatgatgctgggcccggaaaggaagaagcgggcggggctgtgttggccaacgaatagtcggaaaaggcaactgaggaagaggccttaaaattattagccatcggcaaaatatggcgacgataaattattgtaaatgccaccaaagtgtgggtcatttaaagcgattagtcacggaaaatatcttttagggagtcagaaaattcgaatggaatggcaattccacgatttatattaaaaaagatgaagccaaagcagatgaaacaattggtaagaattcactcactaaactgtcgctctcatcgccgtcaacagccgaacgacttgtcaaagggggacgacgaggcgcggaatatttggcagctgaaattgccaactctcgaaatggctcccggacatttcgacaatgaccgtttcgccaatgaccgtttcgacaataccttttcgacaatgccgtttcgacaataaaattaaatatatttttttaaataaaattcaaatttctgcaaaattatatggacggtgcggatttgggatcaatataaaaaagtttttttttcgtttttttcaaaatagcattatgagaatggctttagtttgtcaattttcggcgcaaattgcttatttttttttaattaaaaattgaaacattgttttacacctaaatagttgataatgaattagaagcttttaccctgaaaaaactattcttgattaaaaaaacaatttttttttgttcgaattcgggtctggagttcggaattgggcaaacccgagttaagatccgttatcagcaccctcaaaaacgcctaaaaactggttttgagcacaaaattaaaaaaaaaattaaaaattagggacaaccattcttcaggattgccgcctgggtaaaaagaggacactacattaagttaaataaatggtttcattttggatttatattataggtccgtctcattttgtcttctttcttcactattaatagggctcggatttttaggtgctaaaaatccctaaataggtactaaaataggtgctaaaaaagtgcaaaataggtgctaaaaaccccaaaaaaggccaaaataggtgcgaaaataggtgttaaaaattgaaaaaatctagtatttttatgtacaaaaattcaaaaagtgactaattttttatcaatttcggcagcactattgcaactggtcaagaaaataaataaataaattttggagacgaatttttgagaaaattttcatttcttaggggaatattttctgaaattttggtcaatttttaggggtatattttttaaattttttgggatcgattcttaggggtgcatttttcgtttttattgcatttttactgtgaaatttctgggaaaatcccaaaataggtactaaaaattcataaaaatgccaaaataggttgtaaactattttaggtgccaaaacgccaaaataggtgtttttaggtgctaaaaagtcgctctaaatcgaaaattgtacggacaaaatgctttttttgggcttctctcatcataactaagccgggaaaaaaataggtaaaaacctaaaaatccgagtcctaaacgcaaaatgatcgaaggtcaaaaaaaagatgaatataaatggaaattggcgatgggttcaaaagcgaaggaatttctcttcccttttccaaatttacaattaaaaaactttaacatttgattttcaattattattaatattatttgttatataatttataataaatcaaatttaaaaaagcaaaacaaaattaagatttatttgattatccaaaatgaaatttttccttacttttttgcttctcgccatttcatttttggctataaaaacggctgccgatggctctgacgacagaaacggagacaaaagtttgccaaatccattagcagttgagggaaaggcgagcaaaaggtcagagagacggagtaaaaactgaccgggccaaagccttaaaagccgaaaattctcggctagtcccaaattacccgaaatcccgactttaaatttggattatttttcgttttttcctaatttaaatgtacttcttgtacttttctctttagtaatcgccataagcgccattatggctacggttacggcggttacggtggcggaagttggggcggttatgagtcgtcgagatggggcggttggaacaacggcggatttggaggaggaggcatgggcggtggcatgggcggcggcatgggcatgggcatgggaatgggcatgggcggaggaatgggaggaggaggatggtgatgagagggcatttttattcattcgaaattaattgttattttatgacaaaaaaatattatttattttaaaaaccaatttacaaaatacgttcaatctcttggcatttgtcacttctttactcaaaaagcaatgactcataaattaatattttattcatttattttatctttttttataagtgaacagcagaaaaactggtcgtcccctgctggtgtggttccttttctcgtatcactttgtgtttattgcgggaattttatgactgttttgtgtgtaattaattagtgtgttaattggtcacgcaccgccgatcaatttcccaaattatccaatttatttcaatggtaaaaagtggaaaagaattggcccaaaattcgttgcattatttggactttgccggggctgctttaccatcgcctcaatttttacaacggatcgccaatttgttgtacgacccgcgggaatgccttttggcaaacccacacagtgaccatatgatgggacggaggacgcgggacaaagtgcaaaacgcacgggcaaagtgagggagggcaattaacggaagtattcaattaattaattgggtacatatcacaaaagaatcctcgcccattttggtggcaataatttggaagaattcgctgtgattttcacttcaaatgcaacaaacgcattgaaactgctcgccgaaaactttggagacgaaactcgcaaaagtcgcacgacgaaaaaacacttttcaagtgatgtgaattgtctgtcggatggtaattagttctttccgtttaattaattggctttttcagtcagtttcgctttggcactttctttttctggttttcccatttctctcaaattgcccccccccccctttcagttgctcctttgagcacccttctgatgctgcgcgattcccacacgtccgtcgtcggaatgcgaagtgctgaaagcttcgaacgattgttgtggtcacttacgaagagttaagacaatttttgccgaaaccgagggcaataaacattttttaaaacttaaaccaaaaaaaataaatttaaaaatggatttaatttattaaatttaaataaatttttgcaaaatttttgcaactttttctaaaaaaaaaaaattttttgggaaaaaaggaatttccttttttttgtccacatttttggggctccccttttgtttccctttgttttggcacccccccccgttttttggcccccgcattttttcccccaaaattggggccctttccttttttgggcacttttttcccggttttttttctttctcaaaaaaaagatgcgcgggaaaaacctcccccgggaagattccctttttttttgtgttatattttttttttcttctttgggggattttttataaaatttctcacaaattttttttccttttttttgggggggggggggggcccccttaggggccccgcccccttcctcccccccattttttttttataaaaaaaaaaaggtttttttttttggggggaggaaagaagatttattttttttttttttttttttttgttttctttttcacaaagaaatatttttctccgccccccctcacaaaaaaaaaaaagaagtttttttcttttttttttttctctactaccccaccaccccccccctctatacaaaaaaaaaaaaaaagggggttgttggtgtgtgtggggagaaaaaaaaaaaatattttttttattttttttttttttttttttttttttttttttttcttttttttttttttttttt

SEQ ID NO: 1771 - DNA, 977 bp, Heterodera glycines
ctctgaatttcttcttaaattgttaagaaaaaaatctcaattgtaattaaaaaaaacaatattttcaacatttatgtgaaagtaaataccaaccaaacaaacaaataaaaatttatgtgagtggatcaaaaatgcaacacaaacaaagtgcgtcatggaaggcactatggggtcaagccaagtgtcactcactaccgtatttgctctttttatttgccagtctccattaatctgcaggtctccaattatatacccctttcgaactaggttgaaaaataatctcccagtctccatttatgtgccagaggggataaataaaaattttttaaataatttaattggcacatttttcaaaaaaaataaaatcaattcaacggtagggatacgatttatagttttttcattatttttttcctgagctctccgtggcctgaaatgcacaaaaaacatgttttttttcggctgttgttaagtattttttggtttttccaaaatttgtctaataaaggtaattttacgcgctatttcaaaaattacacaggtaaatggcttttttgtatggtttatttcgagcctccataactcgcctgcatttccaactaatccgaacattttgttatctaaaaaaagattttgaaaaggagaatcttttggaaatcaaatgctaagtaattccatcatataaaaaagttgtgggtctttcaaatttttatcacgctacaactcaggtcctaaactggtgattaaaaacaagcagtgcggccaaatggtgattttgaaaattttcagttggcaaccctgatcttgttccctccactgcatttagtttgtctaccccgaaaacacacaattaccgtttttcctaaaatagggttccagtggggctctgttttttaaactcttcctaaggaagagcgctctatttaactttttttcttgaatagttctaaaactttgatggggctgacctggtcaag

SEQ ID NO: 1772 - DNA, 7034 bp, Heterodera glycines
  misc_feature (7012)..(7012): n is a, c, g, or t
gttttatacacttaatttttggcacattttctaggcgtgatatgcgcgagttggacaaggtaggtccaatgtttaattattattgcacttttttaaaaaaaagtacaaatttcacacattttcagaagcagtttatttacatcaggtatgtgctgtcatcattgtccgaaacggggaaattttgaaattttaatgcaatttttatttttgctgcaaaaaattaaagttttttgtttcaacacttcacgctgtacgacatgctgatgaagaacattgacaaaatcaacgttccgaacccgtaggaggaaagaacggaatggtgcaaaaattggcgggtgtttaattgattgataattgaaaatgatcattattttgtgtatccgtccatttgttgatgaattggtcttaaaaatgttgcaaattagtggccaacattggccgcgattggtgtacaaacacaaagttccaaatgcagtccactcccaaaatagagcctccccccttaattagtgaatcccgaaaatagagcgctcttccttaggaagagtttaaaaaacagagccccactggaaccctattttaggaaaaacggtaattgtgtgttttcggggtagacaaactaaatgcagtggagggaacaagatcagggttgccaactgaaaattttcaaaatcaccatttggccgcactgcttgtttttaatcaccagtttaggacctgagttgtagcgtgataaaaatttgaaagacccacaacttttttatatgtatggaattacttagcatttgatttccaaaagattctccttttcaaaatctttttttagataacaaaatgttcggattagttggaaatgcatgcgagttatggaggctcataataaaccatacaaaaaaggcattaccagtgtattttttgaaatagcgcgtaaaattacgccaattcgctatttggcattttcagcaattttgtctgacactgaagcgcacccatatagtgagtgacactgggcttgaacccatagtgccttcatagaaattcgctctttcaaaatcaaccatgtttttccgcattgcatgtccaattcgcccattgaccgtttcattctgtcgcattttctcctctgaaggtccaactcggattggagtaacttcagccgcgaattctcacgctcctcattctcacgacacagccgctgcattttatcaatctgaaagtggagatattattagccaaatgaaagcagttttagaatatcgaatgacaccaacaaaaaaaccgaatgaatttgacaaatcggattgaataattttaatctttctttttcgagctaaaagtgactaataaaaagcaaaggacaaaaggatgccaattcaattggtcctttgcactaaaaagccgcttaacaatgggccaatgccatgccttctctttcattttggtttccatctttgaaagcatcccttgagaaaataacagtttcgaaaattattgaacatttatttgtccactcacattgtacatttcgtatttgactccgacgcggaacaaaaactcatggaaacgaatgacattaaatgcagaatcaaaccgagcgggctggacaaaaaggaaaaacgatgaagggaagtccatgtattgaaaaatctcctcggacacagaaattacaatgaaaataggcaattgctacccgactcattccccccccgtggtaaaatgtgctttaatataaatatgaaattaaattttgtgctcacgtcctctctctgccactgtgccatttggtcagctttcacccccaacaatgcctccgctttgtcctcaaaaatggttgcccaggtctctccagaaaagtcggccaattcgacctgaaaggaaagtggggaatcgcattgcacaacaagaagaacctgcaacatcattatgttcttgtaggtgtcgaaagtgttggcgcacttctcgcaacggtactggttgccctccatggacactttcttcttgcagccctgctgaggacacgcctggcagaacacaaaattggtggtttaaagtgagttttatttggcttttgcgtccgaatatttatgcctttgtcgaaatcgtattcaatttaatgtgtttccccatacaaagtctatttgttgttgggtctgacctgatagatggcctggtcactcttcacagtgacgaccatcgccttgatcgaaaagtactcgcccttgtcattgtctcggctgactccgtcccgtcggataattccaatcatccgaaagtcgcgctctgaattattatgaatttagcacagaaaagaaaattgtttatttaaattaaaatataaaaaatcaactgcagaccaaccaaagttcgcttgcgtgtcagaggcggacccaatgctcagcgatttgatgttggcgtccggcctatactcgcggtaccaaagacaaagattctcagacttttttccctcggggttaaacagcagcgaagtggacgaagttgtggagacggaaaagccggctaaaaaaggagataaaatatggaaatgcctaataaattattgttgtgactggaatgtagtccactcggccaagtggactacatcccagcggtacaccccaaaacacagccgagacataatccagccgtggaataaatttgtaaaaaaatttcatctgaaattttcaaaaaaaaaatcttagaaatttgttcttagaaaattttttgttagaaaattctatgaaaaattttcaggcgatttttcaaaatttaatgacgaattctaagaattttcaaaaaaaaatcgcctgaaaatttttttcatagaattttctaacaagggaacattccgagctgtcagtcagaaaatgcatataaatgatataccattggatagaggagggtcgacttctattgtgaatttttaattttagcggtgcattttgcctccttcaaaagttacagggcctcaaaaatgcgaatttcattgcctcggggcacattccgagaaaggaaaggatcgaaaataaaaccgtcccggtcgtcgcatggaatgccaccgcctcttcgttccacagagtgaggcacacttcggtgccagttgagtcgagcaggaaaatgtcgcgtttgtccaattgacgcatgtccttgcgcgaagtcacctgaataacaaggccaaaaagattttctcttttttgtattcttcggaagggatttagcataaaccgtagaggagccgtcttaaaagtgtctgttatctcaaacctgtgcaatttcgcccactctgtccacaatggcttgtacgtccacacattcgttcacatggttcggcaaatctttcaatgaaatcggtttcagcttcacttctggcacttcgatttgctcctcacaatagacaacctaaagaaatattagctaaaataaaataaaacttattgtaactaaaagcaaacggacctcagagtcacggtccaacaccaattcgtagtcgtgtccagtcgaattgaatcttttgttggccgcccgaacggaacgagggccaccggcgccgctaatgaaataggccttaaacgaaaaagaatatataataagagagactgctaaatgggattttcgaaatagtttcaatatttcgaattcgaatagaaaaaaaacaaacgttcgcattttcgacgattggaaagaatttgtccgcctgttccccgaaggcagcgattcgaattgcaacgccttttgagtccgtaacattgaaagagaaaacgcggaaggaaccacgcggactcgtcaggtctttgatggaagcatcctttccgctgaccacgccacagatgcgccatctgataatcaaataaacaaggtaaaatccgacgggtccgtccaaaattttcaatttctaatcttgaagcattcccgtattaattatagattttccgcctgcctgttgatgtacgggttgatcgcttcgatcggtgtaacgcccatccgtgccatttgcgcgcccgcatccggctggcgcttccgcaacggctgtcgctggtctgagggtgacgagccgcgccccctcttcgcggacccaccgccgccccatgcgttttcaggctcgtctttcacttgggtgccgcgccaaagggcgacactttcggccgctgtctgctgagtgtcggaatctttttgaggctaataagaaagtaatcgaaacaaaaattgacaataaatttgacaatttacgccacctgaacaactcggcgaaattccgccgggtttccactgtgtggttgcgggttgccaatgacaggaaagtcaagcgagtacagcgtataatccaacacttggaagaaacaaagctttccactgaaatatgtataactgttgctatttctttttatcatctcactacgaatattgccaattcataaattttaattattattttttccttacaatttgatgttaaagtggaatattcaaagtgtttgattttacccgtcgacccgtttccaactggtcacttggatgatgccgttgtgggtgctcagcccgtcgtcttggaaccgccgcgtcaccgtctgtggaatgacgcaaccgctgtacgagtacaaactgtcgctgagacgagcccgcatttgctgcccctgtggcggatagccgcccatcgccgacgatgagccaatggtacgagtctcaagcacttgcaaaatcggctgaaagtcggccggcactttttcatccaaaaaagtctaaaaacagaagagattgattagtttgagaaggaaaaactttaaagacctggaaaaatccttgtgaaagttgtggttgatcctccatttaaagattgggaaacgttttgccgtttagcaataaatatcaatgatctatagaatagcgaaaataaacaaaacaaacaacaacatcaacaaaaagcagacataaaataaagtgacttgtgacaagattaaaatttataggtaaccagtgccgtacgggcactgaaagagacgattttaatttatttataaaaaattgaaatagattcgctattaaacactgtctctagcgggcgccacgcgccaaaaagcttttataagaggggaattagattttttaatggccgggaatagcctctttctgttccttttccccttctcttcctcttcctcttcgccttttgttcctctttctttctcttcctcgtctcttgtattcccagggttcccagatcaaaattttcaaaagcctcatttggcaggcaaaaaagcctcatttctacaaatttattcaaaacacatttaaaatgttcaaatgttatatttttgattgtccatgaccaattttagcaatttttgctagctttttgtgaaattctgagcatgaaaaattgaagctgattttttgcggtactttttaaaaaactttcggggaataaggggccggcggtgccgataggcgccgccggtaaaattttgtaatttttaatgcgatttgttaacagatttgtccacaaaaatggccaaattttgtgattttgagcaaatttataagaaaataaaggacttttaggggctgacggtgccgataggcgccgccaggggaaaaattgagaaatttgaccatattttaacagattttcattaaaaaattattaattttgtgattttttagaaaaaaatttgttcttttctggtttttataaaaatttagcaaaattttttggaaaatttgggtgagattttcgttttgatgctctattagaaacccaaattattaaatatttgtaaaacattatgacaatttatcaaaatttaaaagattctgaggattttcccaaaaacggactgggtcagtttagtctggccggtttagtctggccgttttagtctggccggtttagtcagagggtcggtttagtctggccggtttagtcagagggtcgttttagtctggccggtttagtcagagggtcggtttagtctggccggtttagtcagagggtcggtttagtctggccggtttagtcagagggtcggtttagtctggccggtttagtcagagggtcgttttagtctggccggtttagtcagagggtcggtttagtctggccggtttagtcagagggtcgttttagtctggcaagccgttttcgcccataattcttacaaatgtttttttctgtcaattatttacaagtaaaaactttaaaaagcgatggtcgctgctgtccgcacagtctttccactttgtcgtgtgcaattctgcttttttcacttggtgagaagtatgaagaagcgaattgcttcagagggtttaacacaggtattgattgcatttttgtattttccaatagaatttttcatttcaagtagagtgccacgggaccgggaccgggccgggaattcccggtcatccgaggtcccggtcccgggttttgaaaagctcaggtcccggtcccggtagggcaaccgggaaaaacaagcactggtaagaatggggtctgagtgaaaaattagtgaagaaaattggagtcaacgggaaaaataaaaaataataattaatatattctttaaaagtaacacaacccaagtgtgcaaatggcctaatggctagtctacccaagtgtgcaaatggcctaatggctagtctacccaagtgtgcaaatggcctaatggctagtctccttggctttcccttcttctttcccctggttcaatccctctacagaaattagattattttcaatttttttttttttgtatactcgtgggtttcctacatataaagaaaatatgattcctcatagtttttttttaaattgatacatatttatcattttttaaatgaaaatcctaccaattgacttaataatcgcaaaaaccaacctttttttgttgaaaatgagttaacaaattgcacccaaattttggcgctatattaaaagtgacagtttttgaaacaaaaggggggacccttttgttttgtaaaatttttttaagataaaaaaccaggataattttttatccgngggttttaaaggtcgctaatca

SEQ ID NO: 1773 - DNA, 875 bp, Heterodera glycines
taataaaataatgcataaaaacagccaaaattggtgtgacccgaacccttgaccaccaccaccaaaggcaagaatactaaccatttgaccaacgggtcgcttgcctccatccaatttaattcccttttcactttccttcttttttggaagaaatcccgaccaaaagtgcttgtcctccctttttagagcacttcccggaccaaaacaaccctggtatcattcgaaagccaagagtttgtagatgtgcacaaacatattaaagttttgatttgaccttttttaaggtatgcaaaaagcattcaaaaatgagagatccaaaaaaagtccatttttgggccagtttttctaatgtagttcgaacagttctaaaccgatcgaaatggctatagttttgccttatagacattgaaaaactgcgtggattgaccccactcgcgccccgtaaaactcgctagaaagtcttaaattagtttttaagcttggatcatgggtagaaacttcttatatagggaaatgacaaattcaaattcaaggacagtttttttggactaaaaatttattttaaagttcgaattagacctggattcatgcttgaatttttcctggacctgaattgtggtcaagcaaacccaggcaaggctttttatttgtgagcaagggtttatcattgtaagacgcagagatcaaataccagattcgtccttgaatggcaaggacttgcttgaaatttgaaaaataggtacagtatagtttaattcaaaatgtttttgaaaataagcataccaaaaaacattcaaaattttacaatttttaaaactttatataatatttttttattaacttactgtatttactgtatttgaactcccctttga

SEQ ID NO: 1774 - DNA, 3507 bp, Heterodera glycines
atgatcattgcgaccaagtcgaaattccaagttacttcttaataactgttttacaagctaaatttttttttggttttttgtaaggataatagagcttgtgaagggctttcgaatgatactaagattgttagatttggtcatcaatgaaaaaagttatagcccgaaaactgggctggcaatgaaaccgctggcaatgaaccctcctgttccgccctttgaggggggttgaaaaatcgaacccccggggttcaaatacagtaaatacggaatgccattcttggtgcaaattctgttaatatgtaaatcgcacaaaaaatcaaattttcccggcggtgcctatcaacggggataaatggagatggggggattaatggagacggggcgataattagagataatacggtaaatcaaaattacatttacagttcaaaattaatattttaaattaaatttttatttatcaatcactgagcttttttgtagaacgactcaccacgctaaaatacagcttccaaatagagattcaagatcccataaatgcttgattttcttatcgttgctcctaaatcgactttaacgacgacgcccaaaacccaaacgaccttggccccactcgtcagtctgaaatcagcaacctttcttctcttcgtttagggttccccctttctctctccctttccctttgtttctttgtcatcctctctttcatattttccttcctttgtctactattgatctttttctctttccccattatttcttcttcgctttttctcttctccgccgacaattctcagcgcccctttccaatttcgtcctgcccttccatcgcaatttctttcttttctctgctcttagtgtgcttctcgccacattttttcttcctcactaatcactataaccaaacgaattatccattttcgcttcttttccctttttaaattctttttgtaattaaattatcaagaattaagacatattttttgtcgaaaaacagtataagtcggggcagtatgagttggacaagtacgagttgggtttcgtccatattgattgccccttaacctaaacacatttaccaatatgttagctgacaatgaaagagattagcgcctatcttcaacagcattgagttaacaatcacagaatgataaaataagtttgcttcttatgccaaaaactgaagaagcgattcatagacaaaagcgagtctaaaataggcatcaatttaacagtcataatctgcgcaacatctgtagaaaatatatgtaaattgaaaggctgacagtattaaattaacttactttaaaatgcaaactttctaatattgaaatacatactaggtgtatttcccttcaatccagatatcaaacaaaaattgttacttggcgatattcgctggcgaaattcgaactgtctgccctcagggaaaattaattgttggcattggcagctacggaatggcaaatggtgcgatggaccaaagtcgaaacggcactctaactctattatcggtaatgccatgccaatttccatttgcgcatcgttcgtcttctcagcttacatagagtgcccaacaagcattacataatcggttttggctccgttccgtccgtccgctacgttcacaagcgttgcgcctcacacgcttggccagccagcacagacagcccctccccatcaacgcaccagccttctctctcttcctcagtcgctccaccgcctcagtataaagcatacctcctcccccaagcgtcattgccgtccgtccctcacatttccctccattttctccctcgcgtttgcccaactaaacaacgccaccaccccatttactatcgacgacgacggaggaggattcgaaggcagggaggagaagagaagaaatggaggggagcgccctctttcactcatcagcagaggcaaccactgactgactgactgagtgtgttccctcccccccccccgccctcccccattcattcgcctctccccattcagcagcagcagttctcctctgctcaacatcgtcagcagccccacagccctaaatcgacgacaaaatccttctccaatcgcagaaatctcttccaattcattcccgaaacggacacaattaagcgaaaacttgaacagagtgagtgagcggtttaatttgtaaaattcatgcctcaatgtgttttaaactacaagatttgctcccaactttctaaactattttctctgtcttttttctattatttttttttttgttttccatttctaacgcccctctcactctttccttctcattttagccacaccatacgccgccactgccttttttgtccatggtattattttccgtgttaatcatcaacaaaaaaagaagcagtagcaatccaaccaccaccaccatcatcaacaccatcatttgtattaactctcaccagtgatagggccaaaaatagaaaaagtgtgtcgtccttccgagcaattcgcagcagtttcgaaacgcctgcgcatgcaaaacagtcaagagcagcaacaacggcatcagcagcagcagcagcagcaacactcccaaaaagagcaaccaaaacagcagcagcaaaaacaacagcggaaacgcaagtgcgaggacggggaggagcactcggcacgggcggactccgttgccaccaccaacaaaatcgttgccgttgagcaaccgacgaaacccgtcgctgccgctgctgctgttgccgtcccttcgacaagaacaactcggtccagcaaccgaattgccaagcagtacacgcagaacaccagtaaaaccagtcaatctcctcaccaacagtccgcgaactcgaccgattgtcaatacgacaatttccaccatcagcagagggggggaggaggaacacaaaggagaagcggtggaaagagtcagcagcaggtgaaaggggaaaggaagagttgggacggcaaaaagtgataaggaaagggacaatcggcggcggagaacaccgtttaaactgatcaaagaattgaaaaaaacgaatgattcacagacatactgtaaacgcgaaattattacttactccattagaattttcctagccactgtaatttttacagaaaaactgtgtgaactttgtgcgtatctgttgctggggctgccttcccctcccccacccttttaacatttaccccctccctctgcttttacgttggttgatcaatcacttatcccccccaactcccatgtcttctcctcttcctttcttccattttcttttccacccccgctccctccccctttccttccccctctcacttgttttcatcccccccccaatgactaggatttccggaactatgttttgtcaatagatcaagggcaaaaggttcttgggatcgaggcaagataggataaattcgttcaatgcatggtctgcggtttgccatccttttcggatccttagaaatgatgcgtggtttccagattttgttttttttgttagacgaaaatttctcaggcatatt

SEQ ID NO: 1775 - DNA, 1353 bp, Heterodera glycines
  misc_feature (92)..(92): n is a, c, g, or t
  misc_feature (95)..(95): n is a, c, g, or t
  misc_feature (97)..(97): n is a, c, g, or t
  misc_feature (100)..(100): n is a, c, g, or t
  misc_feature (104)..(104): n is a, c, g, or t
  misc_feature (111)..(111): n is a, c, g, or t
  misc_feature (120)..(120): n is a, c, g, or t
  misc_feature (123)..(123): n is a, c, g, or t
  misc_feature (127)..(127): n is a, c, g, or t
  misc_feature (132)..(132): n is a, c, g, or t
  misc_feature (204)..(204): n is a, c, g, or t
  misc_feature (230)..(230): n is a, c, g, or t
  misc_feature (233)..(233): n is a, c, g, or t
  misc_feature (238)..(238): n is a, c, g, or t
  misc_feature (241)..(241): n is a, c, g, or t
  misc_feature (245)..(245): n is a, c, g, or t
  misc_feature (250)..(250): n is a, c, g, or t
  misc_feature (264)..(264): n is a, c, g, or t
  misc_feature (267)..(267): n is a, c, g, or t
  misc_feature (281)..(282): n is a, c, g, or t
  misc_feature (284)..(284): n is a, c, g, or t
  misc_feature (287)..(287): n is a, c, g, or t
  misc_feature (297)..(298): n is a, c, g, or t
  misc_feature (305)..(305): n is a, c, g, or t
  misc_feature (308)..(308): n is a, c, g, or t
  misc_feature (311)..(311): n is a, c, g, or t
  misc_feature (315)..(315): n is a, c, g, or t
  misc_feature (318)..(318): n is a, c, g, or t
  misc_feature (320)..(320): n is a, c, g, or t
atcgaaaaaatttgaaatttcaaaaaaaatttttttttctaacaaggattaggaataattttgagggtaaattagtcctctttaaagggagnatntntgntggngaattgnttggtgggnttnattnagatnattttttaaaatagttattgtctccaaattagggaaaattattttttatttaaaaaaaaaatggaaaaattnaaaaataattgggtatttttaagggnagnttgantgnattnggggnagtggattttgtgntgnaaaatggtgaagtnntngtnagtgaatgtnngtttganttnggnattnatngnaaagtaaagtgaatagagcagcttgaaatgtttccaatcaatttctgaaaacaattaattaattgaggataattaatgaactgaaaaaattattattatttaaataatgaaatcaataattaattaaactaatcgtgaaaattaattgattaaacaaatattaaccaataaatctccaatcaattttttgaaaataattaattcattagggataattaattgaccaattaacaattaattacgataattggtccattaataattacgataattgatcaattaattaataactaatcaattgacctccatcaaaccattggatgagcaaaccatccaacacattggtgccgtaaagccagaaacaggtggccgtgtaggaggacatcatccgctgcacttggcaatcctggaaaatcagggaacccaaaccgtgactaattgaagtgtcaagagtctcggcatgagttttgcgaaatttaagtacacggaataggcaagggcacggcgaaatccacatgttttcaagaggtaagaacaaattatgtgtgcgatatgaaccatttggcggcctatttcttatgaaaaacaacaaaatcccaggaaatgggaattccaaaaaaaaatctttaaacttttttaaagaaaatttttaaaggaaaaaatcttgcaaagaaaaaagtttttgaaaaatcgttagaaaaaatagtgtaccgtatttcctaaaataaaagcccccccctgaaaagaagtctcctttcgagggaggaggggattgaaaaatagaagccccggagtttctattttaggaattacggtagaataaattaattagtcaattaataattaattagtataataatgaattaattaattgcctgattccgccgtgtagcgattgtgaaaggcattgacagagtgtgcgcggtggaaagagtgccggcgaatgagaagaattcggcacggacatggaaataaaagaggggtcttttgccggttggcatcgcggaacgggcatccaacagagagtcctttt

SEQ ID NO: 1776 - DNA, 1028 bp, Heterodera glycines
cgctcagtgctgcacgtgtgaaagcctgtgtatggctcgctgcgtggcaatgtgtcggtggcgggccgcctcgcttggctggttcgctgcgccaatgtgggatgcacgctcgtggggcgacctaacggctgtgctggcgtctgtgcgtcgttgagcggttgttgtggcaggcacataacacactgactggggatggtggtttcgttcccggtcttacgtgccgtaactagcggtgtgtttgtgcttgctgctacgtccgtggccgtgatgagacgacgcggtagtgcccgtgcttggcctagcacgtggcttaagactcaatgagtgtcagctcgggcaccgccagctttttctttttttttcattatttttttttacacttctgttgaagaatgaattctagtcttatcggtggatcactcggctcgtggatcgatgaagaacgcagccaactgcggtaattagagaccgtaattacatggacactcttcttaaaccttgaatggtttcttgttaaaatgccgtaaatttcctgaaatttggcccttatctgaattagtgccgccccttgaaataaaacccaagaaatcccagcctcaagggaaacttttttctaaaatccggcatgtatccgaaaaaattgaatttgtaaaaaaaaatcgaatcgcatcaagaaagccaggccggactttgaaattttgagaatttttagcaataaaaatttagaaattttcatttttttcgaaagtatttttgtaacattttatctgtttttcttctacctgataaaatcgctcaaattgttgatcatttggctgaaccgtcggaggcggttgcatccgatgcgctttgttcaccagctcaaccagggccagcgtggattttttcctgaaaaccgaaaatttcgcttttgattggaaatccaagaaaaaaatgacgatttttcactgtttaatagattttttaaaatttcttttttccgaaaaactctttactaaaaagtcagagcacttgaaatttaaaaaaaa

SEQ ID NO: 1777 - DNA, 3026 bp, Heterodera glycines
attaattaaaattatattttttaaacattaaaataatgcattatattaaaaataataaaaaagtgacggcacactcgaggagggaccaagtcaaaatcacactaaaattacaagagatgctcgagagtcttgggtgtagaccggcattgattcagccctctttcactaattgttatgaataggtctggaatttttagtcccaaaataattaataaaaaagtggcaaaaaaaaaaatgccgaaataatggcaaaatggcgaaaaatttcttaatgtggtgacaattttttgaaatctgtgcttttttctaaaaaatatattcgaaaatagtgatagaatttccgggctaaaaattttgtttttcatgcatttctcagcaaaacaaagccgtgaaaaatagttttttttaaactaaaaatcccagcccctagttatgaattttcggcctaatttttggattttcaaatttcaaaaaatggaaaatgtttctccactttttggcgcgtcgtacacaaaagatgaggataagtggcgcaccatccgttgtgttcagcgtcaaatagtggcggaatggaaatgcactcgcgcgagttcacatccgactttttgtgcgctgtgttaccaccctctgcaaaaaaaaaaaaaaaaaatttcgaacataaattattagttttggtcacgagtcgcaaaattaggtccgggaatctcagcatttttggtctcgagtcgagaaatggctcgacttgaggttcgagaaaagaaatttttctggagtcttgtcttgagtctcactctcaggtttaaacggtctcgagactctcgtatcacgacccgtgactagagtctcaatgttggtctcgagtcgagaaatggctctacttgaggctcgagcaccggaatttgttaggagtcttgtccggagtctgtctcgctctcaggaaaccggtttcgagaaactctcgagtcgcgcgactcatgactcgagaaaaatctcggaattctttgcaagggtatcggttccgtccgagtctcgtataagttcagacttttaattaccctccgatgctttggcattgttgcgcttaaccccagtggccggcttcattgccaaaagtgcggccgaaggggttctaaaataatttacaaaataataattattaattgctaaaaaaataatttaattaattggaattaaaacattttttctgagaataatttgcccactttcgaactggcgacggcggatcaaatgttttgcgatggcgcatttcctgctgaatttgttgcgccacctcctcactgacaatttgcaaggaaaagtcgcggaaaaagcaaaaacggcacaacgacacaattttcattggaaaactaaaaagataatttaaatttgcaaatttaaaaaattagcttttgcattgcattttgagaaatttttaggaaaaaaggagaaaaccaggacaagaggtataggtcctccgggtctgaaaaagccgctggtaaaattcgagatcagtcccgaccggttgggcatttgttctgctgggacagctctagttattcaattgttgtgaggttcggactgggacactatagtctggtcgttatagtctgagccaagtttagagcatcctaacttttttctttactgaccaaatccaacaaagttgatatcattcgaaagctcttaacaagctctatcagcttcccaaaaatcgcaaagatataccgacatgtaaaaatgttataaattaaaatatgcaaacattctaacttttgtgcaatattaatgctgcgactttttaataagtttttaaatcgattacaactagattatcttccgcatctaaacttatatggttttgcaatggagccttattcatcataaatgtacgagtatcgcaaacggacacttgaagaaattgagtttaatattttctgggcatgccccccgagctgatgcgcccagatttatggggagacggaaaccttcaggagtagcttccctatagcctgaactttaatttctgcgttggatttttgctccccataaatgtttgagtaccccaaatggacacttgaaaaaatcgatttttttgtttcataaatatttttttcagaaagtgctctaaagcgcaccaaattttatttacaacttaattttagcactctgatgctttaatatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttaaaaatttttgttgaaatatttgtcgtgctctgaagggcgtgggagggggggggggggaaggcccaccacgaggccgcgaagcggccgagtgagtaccttcggtgcaggaaaattattaaggaagagagttcattatttgtttattttttgcataattaattcataaatattttttccagaaaatgctctgaaacgcaccaaattttatttacatgttagtttaggcactctgatgctttttctattgaaaagggagatgaataaaatttttaaaaatttttaattcctttttaaacaggccaaaaagtttaggcttaacttttttttcagaaactgatcagaagcgcagcaaactttgcaaagatattgaaaggaagagaaataacctattttaaatattatctagtcagttcatttaaataatttttattcaaaacaatttttttttgggttttcggggcagtccccctgaaccgatgttaagcttaacttttttttcagaaactgatcagaagcgcagcaaaatttgcagggatactgaaa

SEQ ID NO: 1778 - DNA, 3038 bp, Heterodera glycines
gttacgtactaaaaatcgtaaattccgttatatccctatctacatttttcaccaggggttttccgggttacccgaaaagcccggacttttttctcgattcgaagtccaaagctcgacccgaatttttgtcgttcgacccccccccccccattttttttcgacacccttttgatagagaaattcggttcttgaatccgggattaggtcttttgggaagacaataaaatggttcggagtgccgaatcgaatccaaaatgccgtctctccgccccccagcaatttgttttttcagtaaggcctcttaaaaaaaattaaaatgtcccacagattgttggtgaccaggattgggttcacacttggctccaaacagatgatggagtcgccgagcagaacatccgccatgccgtacaccatgtgcagcagggggctgaccagctttgtgccggtcggcgccaacgatttgttggagcgaatttcgatggaaaagccctgggggggggtgagtaatttatgtatttgatcaataatttatgcatttaaggcaatcgaaaggaaatgccattggggtaatttaaaccaatcggatttggatggaaaagccctagggggatattttaattgttcatttttgaattggcgcataattcaatttgaaatatatgacttagtgatcaaataaacattggtgatcacatcccaatgagatttcaattctacccttatttgtgcgctaatttagtagaaaaaaaagaaatttccatgtggagaataagatacggtaataggtttttgggatactatatcactaattgacaaatgcatttgtccgggagacctatgaccaattggcatgccatccttcttctttttttacctgtatccgtgcagccaacacgcccaaattgtacagcatgtgggcatagaaggacagggccgagtccatgaaggtacggttgtcataaccgtaatgcgtcatacggtggatttggtgttcgcgcaactttcgccacaacaaattgccgtgctgtacaaacaatttaaaaatgcaaaaataaataattattttttaaacttacgcaattggagaaatcgcgttgaagcgccagcgcggcgactaattgcttcttgaaattggccaaatgggcttcaaattcggcactggttaagcatttttgttggcacaatgtgtacaattcgtgtagcgaaatcaacgcggttacataagcctggacaaaaaagaaaaattcaatttgcatttttaccgtataaatagtacggtaattagagaccgtaattacatggacactcttcttaaaccttgaatggtttcttgttaaaatgccgtaaatttcctgaaatttggcccttatctgaattagtgccgccccttgaaataaaacccaagaaatcccagcctcaagggaaacttttttctaaaatccggcatgtatccgaaaaaattgaatttgtaaaaaaaaatcgaatcgcatcaagaaagccaggccggactttgaaattttgagaatttttagcaataaaaatttagaaattttcatttttttcgaaagtatttttgtaacattttatctgtttttcttctacctgataaaatcgctcaaattgttgatcatttggctgaaccgtcggaggcggttgcatccgatgcgctttgttcaccagctcaaccaggcgagcgtggattttttcctgaaaaccgaaaaatttcgcttttgattggaaattcaagaaaaaaaatgacgaattttcaactgttaaatagattttttaaaatttcttttttccgaaaaaactctttactaaaaaagtcagaagcacttgaaaatttaaaaaaaagacattaaaaaggacatgcttttcctaaaatttgccattaatttttctaaaaaaaaaaaaaaattttttaccttgaaaaatagtaaatttattgccatttttcaaataaaaatttttgatcaccaagaattcttctcaacatgatctgaacttggcaccaaatttgagaggaatattaaatgaaaattttttttggcgcatgccttaaaatgtttgccaccgtaatccaacaaattcgtgtcctgatccgactccaaacggttggccaccgacaaaagggaccagcacaggaagctccattcgtcaaagtatccgacgggtacagtatctgcaaaaaggacggctaccgtatataataaacagtaggccagccaatttaaaattttagagaggtgaagccacagttcatccagaggaacaattttttctctgacaatttagcgtcaccgaatatttgtaccggatttcatcccaaatacagtttataggagatacaggattggagaagagttacagtacacaatcaaaaaccattgtttggcaatttcaaatctcacggtgaagccccgggaataaaaatttaaaaattttttaaatgtgcctatttttagtgtattttaaaaagttttatcgaacttagctctttctataattaataaaatcgtacaaaatttataggcatactcccccggtacaggataaaattaaactgaaaatatttcaacgcttattggccttaaaaattttttcgaaaaattctaagttctccattatttaaaaaaaaactttgcgaaataattcataaatatttttttttcagaaagtgctctgaaatacaccaaattttgttgtcatgccattaaaatgtattcatgctatattcagagctggtacggtatctgaaaaatccgataccgtatcccattaatggccaagtgcaattaattcaccgttaggcctatttttaaggcttttccccgacaattctgggtccccgaatctttctctccaggcttcaccccgatcaaattttcattttttgatcaaaaattgcccgctgttgaagaggaggaggaggagggaagtgccgcaattttggcctcaatttcgatcagtattttgtacagcgatcggttcagctgttcaacgcgttgatcactgctcagcgatgggtcctcctgcag

SEQ ID NO: 1779 - DNA, 3154 bp, Heterodera glycines
  misc_feature (1628)..(1628): n is a, c, g, or t
tccaggtccaggtcatttttttcggcaacctggatttttcctggacctggatttttgtccaggaaatcaaggtccaggtcaaatgtgaaaaaaaatccaggtccaggcaaaacaggaaaaacctggattttcctggacaaaattttagaatttattttttcaagtaaccgatgttttttcaagttttcaaaacagattaaataaatttaaaaagacattattattatttattagatatttttagatgctttacgcaaataattaattttttcaaacatttttttgatttttaaaataaatttcaaaaaatccaggtccaggcctggatccaggtctcgaggagcctggatttttcctggacctggatttttgtccaggaaatccaggtccaggtccaacatggaatccaggtccaggtccaggcttttttcaaaatgtcgatctctagtaaaaacccaatttccttaattacctgtctcggaaaaattttttcggcatccgatcataatataacaagagcagaagagaaacacgtacaaccaaagtacaaaaatcgttctgagacaagaaaaataaaatattagtaaaaggatggaaaaacattgctaaagaaaatggcaattagaaaaaccgaaataatcaaagccgtaattagacaaaacaaataggcaccaaccaaaatttaaaaaaatttgtttttttaattttaaaaattttgaggatttttctagttttattgatttcgtattccgaacgtcttactgtacccgaaaatgttagggtatgagaagagaaaagcgttaagccgcggcacaaagaacacgcaaaggcgattggatgtgagaagcgcggaaaaatgtaatgtggcattgtacgctacagtatcaaagaaaagcacggcataataccaaaacggatgaccgtatacctgaaaaaacggtaccaatggtaatcaatcagccattaattattgtcataacagaaactcactgcttctcccgtaaaagttatcggtacagccacaatgatttgtacagtttgagtcatcaaatcacagatgaccatttgccatgcaattgtgaagaatgccattcgacggaactgataatgacccttaagaaataaaaatattaaagcatttctcattaaaatatattttaaaaaataatttaataatcattatataataaaaatgcgcctcttgattatatgttgaagggaaattttttaaatggtcaaattgtgggcaattaaaatgagtcaaattggggaaagaccctcaaaaaggaggcaaacccacaaaaatagcaaaaaagcaactctgactgtttttatgcggtatataacagggatgggccaaattgaaaaataaaaagcgaaatgcgaaaagcgaaatttgcgaaaatgcgaaatgcgaaaagcgaaattttttctacaactttttaatagttaaaatcataaagcaaaaatcatttttttaaattttattccaaatttaaaaatcaataaaacgcttttttgaggcgcgctttttccaaaaaaactttttgggaagagggagcaggggcgccaagcaagcgcggcgcccggcaggcgcccgccgggaaaatttttgaaaatttgattanaatttgttgacagattttcactaaaaaatgatcaaattttcgtgatttttatcatttttctaatgagaaataagagttttggcgcgccgctgagaacagtttttcatcaaattaccaaattttgcgattttgggccattttctaagaaaaaataggagttttgggggcgcggcggtgccgataggcgccgccggggaaaaaaattggaaattttgatcatttataaacagtttttcactgaaaattagccaatttataggtaaaattttgaaaaattttatgggaatttaatccaattcttaggggtgtaaaagtcgcatttcgcgccaaaaagcgaaatgcgaaaagcgaaatgcgaaacgccaaaaaatgcgaataatgcgaaaggcgaaatgcgaaaagcgaaacctcggcccatccctgctattggccttcaaaatttgaacaaaaaaaatcattcagtttcaaaaagttatgactagagctcgcattttgaggcataagcctttttttctgcgcactagtttcggtatattaagcataaataacgcattttccacttggtttgaggcttctacgttgacttttattatgccttttttttgccttttttcgggattttcgtgccttaaatgcctttttggcattttgccgttttggtgccttttttagcgttttttatcgaaaaattccattaaaatgcaataaaattgggaaaatacacccctaagaatttaaaaattttctcaaaaaataatttaattttttttcttgataaaaaattttattttaaaaattttcctttttcgaaaacattataaaatatttaataatcatttaaatgaccaaaattaagtttttttgttaaagttttacgtgttttggctccctaaaaatccttaataaagaattttaaatgccttttttatgcctttttttcaattttttggtgccttatagtgcctttttcgcgatttttggtgcctttttttttgcgagctctagttatgaccagaggaactcgaaaaaccaacttttttttttaattttggtcataacttttttgaactttaatgaaactttttgaaattttgcaggctaatagaaaatgcttagcgctttcgaatgatataaagaattaaaaatttggttgattttgagcaaagttatatgaaaaatgttattcatttgatgatttttttgacttttcatggtttttgactgacgccataaaaccaaatttactcacaaaatcaaacatttccatgtgaagtggtgcaaattcactgttgttattactgttattattattgaaattgttattgttggcattggcatttatatttgttggttgttgcatttggccaatgattagtgacgatgccattttgaatttttttttaaatgaaaaaatatttgacaatttgtgaaaagggagcgaacagagaaacctaaaaataaagaaaattgatagaaaagataatgaagaaattgaaaaatggagctacccgacaaaaagtcaagga

SEQ ID NO: 1780 - DNA, 1885 bp, Heterodera glycines
ttaaatttactcaatttataagaaactaagattttttctataaataaataaatattttttaaaaatttttattttttgtgtaaaattttttttagattttaaagaaaaaataaaatttcatttttatgtacatataagaaaaaattttctagaattttgaaaaatgacgtaaaaacatacaaaaaaaaaaaaaaaaatttgcataacattgttgtgtatgtgaataaatattttcgttattttttttttttgtttgatcggacgattttatggaagggttactgataagataaaaataaaagtgacagatgcatggaatgaaaagaaatacataaaaagcttaaaagataaaaataattaatttttttgctgggataaaattcggattttttgtgggatccaaaaaattgggcgcgaggaataaaaacagaaatttatctgcccaattaatcaaagcaaattaatgagaaatgatcccaactatttttggttacatcgccaatgattgtgagtacataatgaatgtgattaagtgatgacgcatctgatcgctgatcaaaaagtgaccgaatttataaaaaaacaaatgcccaaaaagacggcggcaaaacatttgatggtattttaatgtgccaaaaattgaaccgacaagaatttgattttcctggataggctcattatctcaatactgtaataatttacagttagttattatttaaatatttttttattataatttgtctatatcggaaaattgttttacgttttaaattaaagctaaaattaacagttaaatattaaaatttatttattttagtaaatcttctacagaattaaattaaaactaaattattatttaaatattttgtaaaaatttagttttattcggttaaatacttttgcatattttaaaattcggtttgtaccctaaaatacagaaaatcttgtacccaatacataaagaaaacgttaatagtccgggaaatcaattgatggatgtcgagaatggactcgaaaataggagaaaagcgaatttgtcagaatattatcgacaaaaaaaaattcaaaagggtcaataataattgccttaatttggacgcaatgagtcaaggggtaattaacaaagttaattaactaattaacagacgaatttggcgaagacagaaaaagttcgcgaccaatttttgaggtgcaaatcgatcgtcggttcgaaaaacgagcgtaaatgttatcatattattaattattattatcagcggtaatttaggagaaaagggaaaatattattccgaggtcccagactctcaaaaagcacataaaacacttttataggttttcttaagtgttgaaaatgactaaaccatcaacaaacaaacaaaaaaactagggcccggcgcgggacgggactccgtgcgggattttgcgggattccagtccgcactcacgcatttttggaaatagcgggattaaaatcccgcgagatcctgtcccgtaaaaaatcaaaattccaatgttgttgcaaaagtcgggattttttccatcttacagaccaaggaaaattattaattttgacgaatgccattgaaaatttcaattttgggtaaatatcattctgagataaaagactcaaaattgctcaataacacttgtacaggtttggacaattaaaacatttaaacaggtaaaacctgtcaaaatcggaaattgaattttgcgatattgcgctaaaaatgaacgcgaaacgtgcggacttcttccggagtctcgcctcgcgatggccgccgtaatcgtgtgcgcctggttttaaacgcggataggcgaaaataactcaattttcgaatgttaacgctactttttaaccaaagagtacccatacacttcgact

SEQ ID NO: 1781 - DNA, 7901 bp, Heterodera glycines
tcgcggatcaatttgccgcggtcgcggatcgcgcaaaaaaatagccgcgaatcgcggtcgcgttccacccctgttttggaaataccgaaaaaatttagattaaattttttaaatatccaaaaaaactaactataattgactaattagaaaaaaaattaagcggttggcggcatacatgaaaagggggtaatgggttgccaaagatttttaaggagtccgagggttggagagaggtcggcggccaaattatcaatggaatcaatccataaatttaacgatttaattgcttttcaaatcatttttgcggcacgctttttcaaaaacttttcgtgaacagaggcccggcggtagataggcaatgccgggaaaattttttttgaaatgaaaagtggctttaatttaattgaatttaaatttattcaaaaatatttggcattctgttctttgaattttcaaaaaatttattgcgtagagaccggcccgggacgggatcacgcaggtataaatctcgcttattttgaaaaatttttgatcgaagccccgataattcccaatttcaaaagctttcttctgaaacatcattttatgcggaaaccccctctttagcggaaataatattgtaaaatatggcttctccgttgcgtctccctcaacggatcggtgcccaccatttttggcacaatttcgataattttctttttgacgccgacggcgtgttgtggcgggaacaacagcccctcgagggggcggtggaactcatcggaacgctgctcaaagcgggcaaaaaggtggtggtggtgacgaacaactccactcaaagttgtgccgaatacgtcaaaaagtgccaacgaattggcttcacaggtctttaagggattatacctaaaataaagtttagaaattcgtttataaatgaatttttcaaaacaatcgaccagaaacagcaaatttatggtcgtataaactttctttagaggccgactaaattcgttatttttcagaccttgacgagcagaacattgtcagctcgggcatggtgttggcacatcagttgaacaaaatgaagcgcagtgccgagtttgggtcgacggcgcatttgccggtttatttgttcggctcggtcggactgcaaagactgctgaaggagagcggcatcgacagctttggcacggggcccgacccaattccggcggacactgtgagcacaaataacattgtatttcctccacccccgaaatggcacaattttaaaatttataatagaaatccccgttctgtcgaccagtttttgagggttttctgcatttttattcggttaaccttttgtctctattttcccattttccgtcttttcccataattccgccctccccaaaaggccactttcgtctccgacttgccaagccttgacttgggcgtcccgcggccgttcgccgtcgtcgccggttacgacattcacttgagctatgccaaagtgatgcgggcggccaattggctgaaggagaaagcggtgcccttcttggtgaccaacgaagacgcgacattccccggaccgaacccggacagagtcattccgggcgcgggcgcagtgagtaaaaagggaggggaaatggacaaaaacggaataattcgcagtttgattgaattgctgctggacaaaattgaaacaaaaaaatggaaatttaaattggaattcaaaaaggtcacttccgttttgcgctatgtgtcgggccgtgagccgacggtaatgggcaaaccgagcgccgtctgttggcaatacatttgcgagaaggccgccgccgacacgccgttggacccgctgaggacggtgatcgtcggagaccggtgagaggggaagcacccgaagagctttttttacttactctttttgcccattgactattgtaattttcttaaatttttggttccatgtgaaaaaacgggaaattttgaaattttagccattgagacaaattttggcaaaaaagttttaaaaattgggacccggcggccgttaggaccgccatggagatttgggtctagtttgttaggtatttttctgaaaaattttaatttttcatttcgagggggtagcaactgccctccctggttgggcctggagatgtcccccttcgacccaacgcaaatagtcaaaatgttttcccaaaaagttgcgacacggacattctgttcggccgtctcaacgggctgtccacgctgttggtgctgagcggcgtccattcgttggccgacgcggaacattttcgtggccagggccagtctcagcttgtgcccgagttttacgccgcttcgcttgccgaacttttgccaccgctgtcagtgcctttggggtggcattaatttttgtaatttttttaaaattttgcttttccctttagcaccgaacaaaatgggccagcaaatgctgtgaattgaaagaataaatgccatccatattttatcgggtcactattttcttcatctccctgaactttttttgttgtgtttacttttaatatatgtaaactttcgcgcaaattgttttgttattgtttttgattaaacacttggtaaagataaagaggctgacttctgaacttatggaggggtggaagctttgtaaaaagcaataaaaatttatttcttgaatattacaattttgtacagaaaattcttttaaaaaagcaaaagttactgcaaagtctgggttcgattgatgttgtttgcctcttttgttttagctttcactcgtttgtacattgtttgtttttcttgaatattttaattttactcgctttaaattacatttctttgttatgataaatggcaataatttgtcgccatggtagctcagtcgggagagcgttagactgaagatctaaaggtccccggttcaatcccgggtcgtggcatttctttttcaaaaattttaaaataaaaaatagtctttttttacaagatcatcaaaatgagcttctcttctcttcctgtgaaataatttatttttttaaaacgataattaaaatttttctcaaaacaaaaaaaaagaatgaacaatataatttgtaaacgcacttttcgcatttctccaaatttgtttgttcagtcataatctgctgatttgttaatgacaaataaaaaatgcgttttcccttcgtgtgttctcaaaattttcttcttttcagcaggcataagggcgcgtctctcatcggtcctatggtgtagtggctatcactctggactttgaatccagcaaccccggttcgaatccgggtaggacctattcttttttgttttttaactaatttgctttgaattaaatgtgtgtcttatttgttagtaaattaaataaaatgaataagcattttaatttgaaatttttacttctaaaacaaaaatcgaagagaaataaaagaacattttgaatcactaaaaaaagagttgccttttcgtctctatcccaaagtaatttacaatttctctttttcattggaattgttgccggttttctcccgtttctctctcattttcctcagtttttctttcctttttgtccatactttttgaattcttttgtgtgatatttttatttgtcaggtgtcaaattcgcttttcatttccgtttttgctataaaaatgaccgttgaaactgtcccggccgatttgcgcaatttgcgtgcgtgtctcgtgtgttctttggtgagttttttcgcttttttaatcaaattattatcctacggttcgcgaatggcattttcttcaaaagtcgacaaataattcggtggtaaatttttaaggtcaaatcggaggaccaattcatggcagatggctgcgacaattgcgaacgctttttgaatatcaaaggcgacattgacaagtgctacgagtgcacgaggtttgaagaaaacagccaaccctttttagattaataatttaccaaaaatggattttgctcgaaatttttgggtttttttttgttcggtcatacttaaaaatagggtttatttatcaggcctttagtttgtttctaatcaccactattgttttcaatttggttttcagtgccaactttgacggaataatcgccgtttgtgagccgaacgactcgtgggtgtgcaaatggcaggtcaacgaacagggagagggcgagggtcaatttgcaacaaagcaaaatcatctcttttattgggaatggatccaaaataatccaatttgaattttgtggaaattttccaaaataatgcattatttttggacggtttttgaattcgaaaaatgggataaacagcagtttttatgcttaaaaatccaattacaaaatacgaatatttaagaaaatcaaccgaaaatgccctggcatttatgctgtatccgtgtcggggaatctgccaaaacacgtggtggccgagttaagccacatgggcatcaagtacaagtcgggccaacgcgacaaatcggcgaaatgatggacgaggaggggaagagggacagatgttgcgacaatttttgtagttttatacagaaaaacattatttattattattatttactattgtttttttgcactttatttttgtaagttgtttatgcatatagagaaagttttgtgaaagtttttatgaaacacaggtgaaagggaataagaatcaaaaaaagaagaaaatttcatgtaaaaaggcatttcttttaaaaatcttttgcaagaaaacataaatagcaaaccaaaattgacctagtaaaatgcctttttgtctcaaaaaaatcaaaaaataaatgaaaaaataagtttacacaaatttataggtaattttttatcacgtcaatgaaccatttgaaatttattgctctgcggctaactgaaaaagtcctgcagcaaagtgcgccgtttcagctccgcaacatgcatttggttctccaactcggctctgtccgtgtgctcggcacgctccaccttccaagacaattcctcaatttccttctccaattgtgcttgttgatattcttaaaaagaaaatggtttagaaaactgtaagacaacatttactgtcgccatggtagctcagttgggagagcgttagactgaagatctaaaggtccccggttcaatcccgggtcgtggcatttcttttttcaataattttaaaaaagaaaaacactaattagaaaaaaatttgtaaatattaatgattaatttaatttttaaattaaattaatacgccttaaaaaattggcactaaataaaagatatgaaaaatacgataaaaagattaaaaatacagtagtagtgttatttttgtgttctgtgcctaccgtttgccgcccatccccagctgacattcacaatgtgccatgtcctttttgccgcccggctgtccccggatcggctggcacaactcgcccggcctgtggcacttcagcgcggcacaaagctgaaaatgtacatgaaagtgcgacggctgtggcatttatcaaagaaaggcctaattaaggcaaataatctgacattgtttaaaaaaaatcggattttacctaaaaataagtctgattaatagtgcttcatttttaggcacaaaaaatcgcgaaataggcattaaataggcacaaaaatagtttttttgcttttaataaatttcttaaaaaatgcaaaattttaaattgtaaaaaaattatttaaaaaaagaaattaccgaaaaaaatatgagaagaatttattagttattaatctgacccaccggctttttgatgttgcacagagtgccggcaaagtcagcgccacaaaggcaccgaattcgttggccaacgcgcacacatttggccccgttggcacattccgaacaattgggcaccgcctgaagcaattaaggagtgacgcaatgctttttaatttttttctgccaaatttgcccggaagctcgggatttccctatatcattagggctttttcaaaatgttaaagagaatccaacaatttaaacaaattatttattataaaatcctgattttgaaaatcccgtttggcgctgagttaggtaagtcaggatttttttcggattttttttttttatatatttttctaaatttttgattaagaagtttttgagttagtgcgaaaaatgattaagtattgaaatcccgtcttctctaataccaataaacccatcataattagagaattttttaaaaatataaaaataaaatggcgaaatttttttttgaaattactcactcaattttgaatttttttttaattgttcccatagatttcatgcttgaaattttgaagggattattaactgtgctccacaaaagcaacaaaataccgtacccctacaaaaacaaataaaatggtttgagtacagtaagtaggaaatttgtttgtacggcacaaaaaaagcacacaccgaaactgttgtttcactgttagccagtccgatcaaagtgccaaaaccgccgtcctcatcatcatcatcatcaatggcatagtcctcctcctcctccccctgctgctggtgatcagcttcatcctggtcttcctgatcacctttctgttgatgactcgacgatccgtccactacagtatgcgttggtcctccgtctaccgtatgattttccattgccactgtatgatgattttcctctgccggtgtactgttcattggtcctctcccgtccacagtaggcttttcctctgtcaatgtcagtccatctacagtatgctgatccaccaccgtactcgtttcttcaccagctggtggcattactgtagacgccaaaaatggtggtagcaaaattggcgatgttttctccggttgtgtttgattagtgttattgttgttgttgccgttgttgttgttctgcaacagatgacaattaattaatgaattaatggggatttaagaaaaatttcggcaattttaaaattgcctcaaggcacaaatttagtaatttgttataaaacagttagaagtttaaggttaatttaccaaattgtttttcatttttaaaacttatttaaataaatatatttaaaaatatcaattttcataaagcatgattatgccctttaccgtacactccctttacagtatactgatgcgacaataattagagtatttattttttgaaaataaaacaatgtgcagagtgaattaaataaaaaatcttgtgaatttttgctatggaaatttattccaggcccataaaaattttattataaaaatgataatttcttcacccacccgatggcactcgaccagccctcgctggacctcagattcggcacacacttcgtcggacaaacaatggcattttagctggcagcgggtgcccgtgaacaggccagtcgggcactcacagaaggggcctgcggaatagaatttttcgaaaatttaaaattttaaaattcatttttttaccattttctttcgccacacattttccctcatttaagcacgggtttggcgtgcaatgattggtgagggacaatgatgatgatgcttttgtcggcacagatttgttcttgacagttttttgttcacaccaaatgcctaaaaagcgagaattttttttgggttggggtaatgctaaggcgacgagttttttgggttttttcgaaaattttttaaaaagttttaagtggttagggtaagcgcttaacaactggggatttttttttctaatattttaatgattggggaacattgtgcacctctgaaccagagcaagagtacagactctggataagcaagccccttatgcttttgagagaagtggcaacagatatatgagatggggtgagatgagatgatagtcaatgaagaagcggggcccggcggggggggggcgacgaagcgccgccgctcgaaacgaaattcctctttttgtcgtccaccaaatgtttg

SEQ ID NO: 1782 - DNA, 4333 bp, Heterodera glycines
  misc_feature (4298)..(4299): n is a, c, g, or t
  misc_feature (4308)..(4308): n is a, c, g, or t
aaaattttaatgatattatttttaaattaacgcaattttaaattttttcctacccgtaaaatttttgacgcatttgcaatatgggctgatgctgattttgttcccattttcatgatgatgttgaacacattgaccaccatgcaggcatttctttctttaaaacatgcacatgtacttgagaaaaaagaatttttgttttttgattttttcaaggacacattacattttgccaaggactgatgaattaattgactttaagcttccaaggacttgattaattgcttattcttcttctatgctctggaaacaacgatttttcattattcttggaaataaggatcatgttgaacttaaaattttaaaggaacacaaaatttttaaggactttctttgaaaaattgttggagatcattggacctaatttaatttccaaaaataatttttagtcaaatgtaattaaatgagaaattcacaatttaaaaactgataataaaagtttatttaaatattgaaaaattaataattaaatttgcaataattataaattttaatttaaataacatttcccaccctttgaccctgcattgttgatcttcttcatccagtgattgcttctgatcagcagcagaagtgcttcgttttgtagttgcttcatctgcgctttctgctgctgctgctgctgttgttgctgtactcaaatcgcggtgctcacattttgggccagaaaaactaattaatgcaattaatatatatttttttaaatttaaataattcatttttaccccgtcgggcatatacaaaatgcttttgtgccggccggcacacattggcccccattttggcactggccatttgcgctgccatcttctccggcacacggtgctgctgccatcacatccaactcacagtgatcacccttaaaacgcactttttgttatttgcataattttggcaaaatgccatgccagaaaaaaatgtcaattttttgaacaccaattcattgggagagaaacaattttccaaaaattcggaacaacatttgaccatttttcggaagagttatgaatgatcaaagatgaatttaaaaaaggcctaaattttgagggattaaagttgtaaaaagagggtaaaaataatttaaaatattaaaacaaaaactctggggcccaaacattaattatcctcttccttttatgtagtataagccctccgaagattggtgaatttctgagactttaattttgtgggattcaaatttgtttaaaaaaagccggtaaaaaataattaattaaaaaatagatattcattatcttcgctgcttttttttaataattgacttaatttttggtaagtttcagatcattattataagaagaattaagaaatattaaatttgccaaagtaaaaaaaaataataatttaaaaaatctaaaacaattgaaattcattggtttacgacgcttttttggcattttaagccctcctctattatctctttaatatttaatacacggctatgagcactttaagccacttattagttatatgccccaattaatccaaataaaaaatgcaataaaattttatttaaaattattttaaatgcgccaccattttccccgcagggcaaacgcattccgcaccgccagcgccggacgatgcatttggcggcgccacaatgcgcggtggttggcattctgtctcgcaatgtgtgccggtgaaattggcatggcaaatgcagcggtagttgccgcggttgtccatgtctttgcacttgccatgccgaccgcatgggctggttgcacaggtgccaatgtgatgttggcaaatcgggcctgtgaaatgtgcaatttttagtaaaattcaatttctttggcaaattttccatttttaccagggtttggcgttaaaatttaatttcacacttaaattgataaatttgaagcccaaaaattggtgtaaaagcccgaccgaaacatggaaaaagaagctaaaaatcttttaaaaatcaaataaaaaacggcaattttccaagttttcatcatttttagggggtctattgaacagtcttccaaataaaaattttagacaaaaattccaatttaatgaatttatttttgtgcaccagatccaatttctgggcgatattttactccgatttaattccaatttaagacgaactttttttttgcaccggggaatttcggattttatgaaaaaacttagtcataggccttccggactctctttttttttacactcgaaagctgattgcatctccagaaattgacaaatgtccccaacccgaatatgccgcaaaaaatgttaccaatgaaaaatgccattaaaaacaatgccattctcggcactctacccggttttggcaccccagaaccatatctacccaccttcaaaaccgggcgggcattggcactcaaaagtgccgggcaaattcacacatttgcccccattttggcacgggccgcgcaatagcgacaattcgcgtccaccaccgacatcatcaccaccaaaagcatgtgatgaagaagcatcgacggtttcggcacttcggcccacatttgccccttggcactcgtcgatgtcgtcggcacagtgccgtccgtcgaagccggccttgcactcgcagacaaagtcattcttgatcagaggaacattgggatgggtgtttttttagtaacttagaactaaaattctcgcatgccccggggctaaatttctcttgcactcgaaaattcatgtgagagtcaagaataaaattcaaaaatagccgagcaatttaaaaccaaaaaaagaagaaggtaaaatggatgatcctcctattaattggcaaaccctaaaaaatatttattaatttctatttaattttttctaattaataataaaatagccaagaaatttaaaaaaactaaattcaaacctaaatcttaaataatttaataaaaaatttgaaaaacaaaaccaaatttaccatcgagaaacttttcttagtaattcccactcctcttcatctcaatcaatccaccttaattggccggcacgttgcgttgttggcacacggcgactgtccccagcgcaagcacaaattccttctattaagcagggaaattgttagtgtattgttgttttgtattgtttgattaaccattcattaccaaggcaataaaaataaattaaaatttggctaattagtggagccaaatgccagtgatcccggaaaacgatttggtcaggctagattaggttcgagattccagctaatttccgaccaaccaaaacaaatgtttatggtctcgatcaatcaatcccctcagcgggataatattaattaataagggatagtcgagagtcaaaattttctagattcaagaccgagagtcgtcccctagattctcaagactaagacaaccccaaaaaaattcaagaaatctctcgtgtcaagactcgagctgccacaaaaaaaaacactcgagaatttcaccatgtcaagactctcgagtagtcaattattgtaaaatacgcactcgcaatggaactcgccgctctccgggtcctggaggcaaacatgcgcaaatggacatccacgcgaactctgacgacaatcgtccacttctgcgaccacgtcttccactaatttttcgccacataaagggccatgaaaacctggcaaaaaatttttaaaatatataaacatttcttaataagtttttcatggcattattccacaaatgagttacaattggtactcgtcccaagatttcttctttgccacaatcttggtaccggcttaaaatggtcctatgctttttttttgcctcagggcaaacaaaaaatgagaaatttcaaaatgaaaaaattaaaataaaagggcaccccgggactttctcgtttcttgatcatataaattatacctatgtataaaagttaatacagtataataattcaattttctcgcctttagggcattcacagaattcgcccttgtccgtcgttttttggcactttccaccatttaggcatttcatttcgcactgcaattcacataacagcccggcaaagccgctccttgaacaaatttggggagattaagacagggtaggtcaaaatttttcaagaaaattagaatttttagaaattttatatctttttttttacaaccctaagaaattccagtttttttttatatcctaattttctttaaatatagctataaaaaaaatttttgttttatgatgcagcctgccaatgacttctgctgaattaacatgataaaataatannaaataattnttccaaaaattccccagggctaaaa

SEQ ID NO: 1783 - DNA, 1855 bp, Heterodera glycines
ggtgttttttgagcaaattggacgtcattttgttcagtttataaactattaattcatttttactttaataatgctaaaaaatgattttataaaataataaataaaaacaattaaaaaatacagcaaaaaatatttaattatggcaattaagaaaaaaaataaatttaaattttattaatttatttattaagaaaattaaaaaagaatatatggggggagcaacataaagtttttacgtattacaattgaaaccgggtaatgtgaataatgtaattaaaaaattgtttttaagtaaatataaatttggcgactactgagagagtcttggcgccttgagtctcgacatgagaaaattcacaaaatttttgggcggatggtgggatatcgatttcgttgagtcccaatcgttctcactagagtgccacgggaccgggacctggtagcggacaactgagtacaactgagtaccaaggtcccggttttgaccgggaccgggactagtcccggttttttcccggtattcccagccaaaaattcccggtttttcaacccgaaaaggtcccggtcccgggtttgcccaaaattcccggtcccgtggcactctagttctcactactccaaagtgtcagtctcgtgtctcgtaaattttcagtcttgaatatcaccaattcttttttaaaggaaggcttccggaaattaaggaaaatttgactcaactacagtgtctaattagggtaattagtccaaaccaataaaacaaagcaaatttgatgcaattgaaaattaaaaaaaaaataaacattcgtacaaataatacagaaattatatttgcacaaaatgtgccatcagcagaatcaacacaaaaagctgacgacgacgacgacaaatatttgccgcgccgccactaaaataataggggggatttggggattttctgggggggggcggtaaaaattggggggatttgcaattttcgaattttcttttcgcgcgcggtttattaccaccataccaccatctgttctgacagtcagaagaatgcagaagcgattgatcagttttgttgtttggttgttgatcagcccagccatcacatttttgtgagttttgggagggcgacgaacaaaaaaaaaaaagaatttatgcgaaacaaatttttgtgcataaaaatgcgacaaatttttattgggttggtggcggacgaccgacggacggacgaacgaacggaacgacctttacgcggcaataaaatttttgtgtttaattaatttaattaaatattgtatatataattttggaacaaaaatgcggcccaggaaaaaaatggaataatttttcaattatttaaaatgcaacaaattaatttttaaatgagttcataaatttatacgcaatttttacaataaattttatttttaaggaaaattaatcatgtttaaaaattatatttaattaaaaattattaatttttaggttttgttttcgagttttgtaattatgaagtcgtttatcccttggtactaaacaataggattttttgaaaaaataattaaaatattttatttgaaacatatttttgaggataaaaaggaaacgaattcgcttggataaagcaaaagcaaatatttggttgggttgtgccatattaattacgccccacggtgggcaattagaaaaattaataaattaattgccagtaccaaggagacaaaaccaaaacaaacataaagtgattttttgaaaaatgtaagtcaaataaaaattagcataatttttttgaggaataatcaatcacatgcaaagattaaaaatgcattttaattaaatggaaaaaaaaagaaattaaaataaaaat

SEQ ID NO: 1784 - DNA, 2873 bp, Heterodera glycines
atcgatgagcatagaattgggccgacaaacgccaaatgcgaggccaacggaggctgagcaaatccgttgcgacacgtcggactttgagctctgccgcttcgctctgatcagaccccactttggacttgcacttcgccaacacaacaaaagtcacacgagtggcaatgagtgccctttgcccgtcactctctgcggatgggtccgtcacaatttggcgttagttcatccagaaacattaaacatcgccgggttgagaccgaggagtgccgttttgctcctttcgccaaatggcaaatcgactgacaaacttttatcattgtggcccagtgccgaagtgagtttatgccgttttgcagtgtgcttttcaccaaaagatgcccgactaatgccgcaggtgccgccgatgcgcattttgttgccctttcacgacgattctcttttggttcggctggccattcttcccgcttcttccgtcctcatttccaaaatgtttttgcagccgaatttgtcagcgtccgagttgcccttggaactttggccaaatttggcccaactttcgcatttcacattgtaaatcgactctttcccattactttgcctcttccttcagattcattcgttcgttcttttgcgacgctttcgtttgtgaacattttaacgaattggaacttttttattatggtcagcgccttattttccgcatcactgacatggaatttgcgaatgaatccgagggaaaaacgaaaggggagaagaaaaagactgacgaaaaaggccaagccgcggacgaaggaagacaaaatgtcaagacgcatcgaatttcgccactgtgtgcgtttgacattcattggaacgaagtgcgggagaatgcacggcgagaagaggacgacgatcccgagaatctctgttgatttcatttactcgaaactgactttttttcttaaagaaagggaatatgtagtaagaaaatttgatgtctgatgaaatatattcatgcaaggtgatttcgacagtgagtgaattcgacagcatcagaaaaattgtgaattcgacaaggatttattttgaagtaccgataaatttttaaaaaatagaataataaaaattggagcctaaaaatgaagtgatacagtggtggagaaaagtcctgactcaagatgattaaaaatttgtaaacttttaaacttcggctgaaattagctgattatttttcctatatttatttaccccgatatacaatacatgggcgtttcatacacacaaaattaattcaatccaatttatcattctcgtgaataagtcgcctgatcagactttgctcaaaaagaggcagaaaaaatcttgactcacatgagaaaccaccttatagttcatttaaaaatctgagataattcatgctttcttagttttggtcctgatcaaaaaaagtcatacaccaacttggtcagatcactacttcatggtgaccgggacaccacaaaacacgttgaaaatcggggaaattttcgaaaattcctaggggttgggaaaatttccatgaaaatttcgaataagctcgttggaaagaacacaaaaacgacttgtacataaaaagttatacttggttgaaaaatggtaaaaattataaaggaaaggtgacagggagagcaaaatcacgacccacaagccctcgtcgaagattttaaaatcgtgatcctttgatttatctttgagcgtgctcatataacttcatttttaggctcaatttttaatatattcatattttttaaaatttctcggtactgccgaaatcacatagcaccgaaatattgggcaatttaataaaatggaaggggggggggaaatcaatgcccacgattagaggcgtcgaccccgaagggcccgaccacatatataaactacattagaatataaaaatgtgtaaatgcacaaaaatgtttacaaatccaatcttacccagcaaaagatgtctcatgaaaatttgtatatattggaataagcaataatactaaagctgagttcccaactgaaattaaacctggatcaatagcagttcgtacaatgggcgtaaaataaggcataagactaagcataggcctaagcccaagcaagtctaagcttagagctaagcctaggaccaagcctaagcttaatccaaaagcttatgcttattctaagcctttataaaattccttatttaagaaaaataaggttaaaagtgtaagccccaaaacactattaagatacggacgatcggtttcgaaaagagctctttaacgcttcaatcaatggttcggattccaaaatatgctaatagtaagacatgaaagtgacggccacggatttacatcaattgggggtgggggaggaaatgatctcaaatggtgaggcgagtgaaaaaagaaggacatggacacaggagaagtgatcagcgaaatccgatcgataggtcattcattacaacatacagaggaaagggaggcacaaaaggctaattctgcgcctgttggttcgtctgcggccgcttcgcatttttcaactgctctctgtgggtgggcgggttgcacacctccgagtcgatgaactgtctcaacctgtccaggtatgcggcgtgcaattccacgtcgttatggccagcgccgcgcacccacaacggttccacggagccgggacaattttcgtaaattttcatgccgtggctgaattcgattacctgaaaagaattgtcagaaaagcagtcccaatccttcccacatcgtcgtctactccatggatgaccagcgttggacagcgaactcgcggtattttctcgatggaaggaaacgcgtcacagcaacgcgtgcgttgggtggcggggaaggcgacgcgcatgc

SEQ ID NO: 1785 - DNA, 1743 bp, Heterodera glycines
gaaaatgacgaagggagggggggaggcaatttgaatggggggggggggcgaacctggccaagtcgatggaaggcacagttccaatgctctgaccgtacaaaatgacctgctccggtggaatttgataacggctttcgagagatttaagtgccgcagcgatatccgcgtagagatttctggaggcaaaaaatgttttgtagaatgagaaaaggaatggaaaaatgcgaatttgaattaaaaagttaactaatgtaattcaaagaaagccaattataaaaaaaggaattcgtaagaaataaaattggttacttttccgaaggacgacctgtagactgaccataacctaaaatcaaacccaaaattgtaaaaattagagaatgaccaacccgagtaatcgtagctgaacacattgcaccgcagtcgacagccgagcccaaggtaaaagttacacatttggccaatatccaccgcatttccgtgagaaaacaaaagggtgaaatgcgaaagttcgaagggtcggacgaacatacaggcgattttattgcgacgttgagtacgggtgaagaacacctcgacattgttcagctcatctgaacagcgaagcttgaacggccatcgccgtatcgcccaaaacgaaccttgcccatgtggccactctgtcctgccgtcgatcagctccaacgtcgtcctgcaaaagttagtattttaaatgattcgaaattggtaagcactaaagacattgagcataattattcgtctcagtattccatcgaacttaacctaactcaatgactgtaagtcttctcagcacaaatattaccgtcccgagtcgttggtcaaaattcggtaactcggttccggtggcataaaagccaatttggcaacaatagccgaagggagcggcgggcaacaaaagagggaacaaaggtcacggagaaaaacacgccgaggggagggagtcggatcctgggcaatggttgtggccgtcatttatttactttgtgtttgcctgtctttggaaattaattaaaaatcatttattaagcagaaaaaaagaaaacaatgaggcagagaaaaaagaaagtgcattttgaaaaaggaaaggattttacatgctaaaaatctccaaatatttaaaacagaaaattctaaaaaaaattggcgctatattaaaagtgggtctttttgaaaattttttaaaaaagtcatgaaaatacatttccgggggttttcggggccgctgatcacgaatatgacattcatttcgaccaatttcgaaccccggacccggattgaagatcactaaattttcattgcaatttcaaatcgtctagcatatagtaggaactcaaaacttttgaaatacttttcttatccctttttgatataagacgcattatactgtcttcactatcatgtaaataaaatttggtgcggttcagaaccctttctgaaaaaaatatttatgaaacaaaaaaatcgattttttcaagtgtccatttggggtactcgaacatttatggggagcaaaaatccaacgcagaatgaaagtacagggtatagggaagctattcccgaaggattcggtctccccataaatctgggcgcgtctgttcggggggactgccccaaaaacaaaaaaatctattgttacaagtgtccgtttggggtactcagacatttatggagagcaaaaaactcaacgcggaattatagaacagactatagggaagctattcccga

SEQ ID NO: 1786 - DNA, 5086 bp, Heterodera glycines
atgacccaaatttggtaccaaagtgaaggagctgatttaaaagtaccatctgccatccaacccgacaaactcgacagcctgattatgtccgttcttgaagcaagtgagatgatacgctgttcgtcttcagggcctgtatcgccaaagacaaagccttcttgtgaagcagtgcgggttcgacggagctccggagggatttcaacatcttttaaagatttcggtgtttctttgaagttgccattggcttttcgaattcgactggcagttttttgcatgtgtcgtaattctgggagctgtattttggcagcatcgctagagccctgaattgctccatttacaattgaacgaggtggagttgctggttgtgcagctgcggtcactcttatgctgtgtttaatggtttgaacttcaatacgtgtcggagatggagcgtggttatgttgtttagttacagtaatttcgtcgtttattgcaatggcaaaaccactgcatttggccgaacttttggcctgatcacagcgccaataaattttgccaccagcaccatccttatgttttaaataagcataaccatcgtaaagcagtttttttgctcctttttgggtagtaataaatgaagccatattaataaagcaaaataataattttgtaatgagaatttaagtgaattgctagctttataaacttttctataatctcttttcttaattttctctcaaatttgtagatcaaaaaccatacattggctatccttaaatctgtgactgaagcatagctgatcagagaccaaaaattaatttttaagtgatttttaattttggtgacgttttgggtcggtgacctttttgagtggtgacgtttttaagtggtgccgtttttgagtggtgccgttttgggttggtgacgttttgggtggtgacgttttgggtggtgacgttctgtccggtgacgttctgggttgtcaccttccgaaggagaagctgaatttattatatctttctataataatttaaaccaatttaaaacaaactaaagcaaaattgctgaacattccgacctagctcttttgaaattttttcaaaaatgttgtcgggtgtaaattcctccactgacacagagaactcgtacgagttcaggacgaaggttatgggaaagaaatcttttaacagatcgccacatggcacatctttcggaaagcaaaggcgccggctgttttggcaaagtgaaaaacaaacggcgcgtgcggctggcacatccaatatttttgccaacaatttaccttttgggtactgttgacagcagatggctgctgacagccgacggcttttccaattgaatttaatttttcataaatttcatgtttattcatcaatgctaatatttatcgtcttctttttttttgttggaggggctgagtcaccacgcactaccaaaaaccgtgaattattgtttcacgacggttttgaatatcgccaaaaaagtgtatcaaaagacgggggaactcagttctggaattgtgtcaaaaaagactgcaatggacgtgcacacagcccttttggccggacagaacctcttaatattgtatccgcacataatcatgcaagaaaagctgccaaacatgaagtgaaaatttgatattgaaaggattctatattattttgcgacaagtgcaaaaatttgctttgtttgatttctgtggcaagacaccgtagtgatgaagccccgtctctttaggcgcgactttcgaaagaagcggtgaaagatattgccagacaacaacctgatgcacaacctcgcaatgtaattgcacaagaacgtgcacaactttctgatgaagcgcggatgaatttgccatctgcttcgtcattacaacgctcaattgagcgtcaacgagaaattcccgatcgagcacgaattgacgcaaatgaaattgcgaacgatgttattgaggtataaattaatatcgagtcggcaaagggtgatttaatgttcatttttagggaatattacttatatccgagttcttcaggtacttattgtttgtattttaatctgaccatgcaataattaacattcaattttaatttaaatttgctattaaaaataggccttggatgcttcacttggtattgcccctaacagtgttatgttagattttgaaagaggtaaataaagttttttgtttgacttataaagttatagccgcaaaaatgcttatctccacgtgtacggaaacgacgtgcaaattcgcttttgtctttttcatctcggccagagcattaacagaagagtatcaaaagacaaattaattcactattacacaacaaacaacgaatacaaaattctggttagaagcttggctgccctcgcatttcttcaagaatttcaagttgttcctggatttaatcttcttcgcttaaaagctcaagaattgaatgttcaagttattcaagatggaggccaaccaatctcagtttttgactattttggaaggtacataaatgggttaacaaatataatatttgttaacacagaacatatgtacatggtcatgctggccatggacccttgtttcctattgcaacttggaatcatcatgaaagtataattcaagatatgggacgtacaaacaacgcacaggaaggttttcacctggccttgcgaacacagttcactagtgtacacccgccattatcaaagtccaaatgttttgctccctttggtaatcctagtaaatgtaggctcgtcactgtattgaagaaggaggaacgtatagctgctgataaacttcgacaatacgagttggatcccacaaacggaattcggctccgtgaacgaaaaaaggtttacagggacaatgacgtggccctgcgaaacctagtcgaaggatttgatttgcttgcggatccaaacgatgacgaattccttactcatctgagatcgttgcaataccgtctgatgcgaaatgattttgaaaattgggatgggcccgatgtggagtaattaactacattttcccgttggcccttgggaaaggcattttctttttttcaaataaagaatcaacgactttgttgccttgaaaagtccatattaaattaatttaattaaaaaataatttttttttgaattcaaaaatgatttttctaattattttaacacgattttattaaaaaggtgattcccaagtgtcgagtccgcaaatgtcgggttccgcaaatgtcgggtccgcaaatgtcggggttatccgcaattgtcaggtccgcaagtgtcgagtccgcaaatgtcgggttccgcaaatgtcgggtccgcaaatgtcgggtccgcaaatgtcaaatccgcaaacgtcgcgccacgattttggcccattccgaaccccaaacccggattcgaacaaaaaagtcaaaatccatttttcaaaagattcacattttattttgatttttagatttgtttttgaagaattgatgcgagcctgggcgaagtattggcctctcgagtgattcttttaactgagctgctgtaccaaaaaagatttgcgtgtgtggctcagtggtttttgtaagatagtaaagggacaaagggtggtggttcgagtccgttgtgcaacatgaatattttcatttatttttgtccaaaatattaaaaaatcacgatatttgggaattatttttgaaggtttttgccatccaaattggataatcttggtatcattcgaaagctctcgatgaggagaagctttttctaagcaaatgctaaacaattggatgcattagaaaaaagttataggagttcgaaattttattttaaattttagaccaaaataaaagcgattgttttctttaaaaaagcgattgaacaattctatatttttttctctatcgatatgcaaaatatgaagaaattctgtaaggcggaaaaaaagttctatagagcgaagtgaatgttgttattcctaataatagaaatattagatagtacgccaaaaggagacaaaaaattagagaaaaaaagataatgtttttctctggcactctctatttattggtacacatctcgttttttcggacggtgtgtgtataaaatgtgaattttttgaaaaatggattttgacttttttgttcgaatcctggtttggggttcggaatgggtcaaaatagatgccagaatcggttttcccaaccccaaaaactcttaattttgttaaagtcaaccaaattaaaccttcttggtatcattcaatagcccttaaattctctatcttcataccaagtttcaaaaatttgattaagtatgaaaaaatggacgaaaaaatttctttttacgatttttggtcataacttttttgaaaagcaataaaaattttcttgcattttgcttaagatagagagttttaagggctattgataccaagaatgtttaatttagttgactttaacaaaagttatgacgatttttttgtcgaaaaacagtacgcgttggcctagtatgagttgggtttcgtccagggatgtgatctgttcttatttgtaagaaatgttctgatttcgggctatctatatattaattttgccgtgtgtgtcacaaagtaaacaaaaaatttaaataaagttttgacgcgattgtttttatttggatggaagaaatgaagtgaaaaaacagagataatagagataagttgtattgtaagaaagagtgaagaagagagagagatgaagacagttaggaacaaagagcggagagtaaaggagagagaaatgattagagaaacaggaaaaaagagagagaaagtatgggagtgaatgagacagagacaaataagagagagagagagataaaaataagagaagcgagagagaggggggagagagagagagatagaacagaggagagagagagagaaagaaaaaaggagagagagagagagagagaaaagagagggagagaagaggagagagagaagaggagagagatagaaaagaggagagagagagagagaaaagaggagggagagaagaggagagagagagagagagaaaagcagagtagagaaagaggagagagagagagaagaggagagaaagga

SEQ ID NO: 1787 - DNA, 3700 bp, Heterodera glycines
tttactgtctacccttccacccgccgcagccccacgtagacagacagtcagacagtgcactatttcttcctttcgttttgagaatttttgactttctaccaaatgttcgaatttgattccgggactcttaattgatcgagatggaggtcggattcacaaccagcgccctaaaccctggaaacattttttatacgagtttaaaaccatttttttttgtggcgtaccaactgcactactgtagtaccaaaattagtaaatcaacccgaactagagaatggcaaatcaacctttttattagtttttgcggggtatcaatttaaatgttgatatttaattaaatcaactaacattatgccatcaacgcaaatatcaacgtaatttttaaaatttgcgaaaattttttaaaatttatatgagcggtttataattttagtgcgagagataacgcaaaaatgagagagtgctggatctcagtcccagtcatacaaaacatttttgatgaaggaggtagagaaaacaatttcaatagagagcacaatgggaagggagttcatgtctcttcttcgctgattcttttggtaagagacgcagattcctcgctatgttctctattctctctctgtcttaaatctcttcccataacactctctttttaattaatttttctttattcttctttaccaaaaatgcttttgtatgactggggctgaatataacaccctctcacttttgcgttatctctctccccatcttattttccgccaaaagtcatttttgaaaaattgctttaaattttaaaaaattatcccaattttaaaaatagcgttgatattacgttgatggcataatgttatgttgatattaaataaatatcaacgtcaatgttgatatttattaaaacaattttcgctaagagaaaaatgttgatttgcctttctctaatcagcacttaatcatatgttgatgatcttttttccaattacattgatcaaccaatgtacatatgtcatcttatctctgatcagagaacaacaagcaaaaaaaaaaatgaaggacgatgcgccaaacttacggatgcaatattgccaatacaaagcaatgtgatctcttcagagccgagaaaggcaccgaccaaatcggcaaaaatgttggtgagtgtcgaaatgagaatggccgggcccgtgtcctaattgattgattgattgattaattaattagcatcattagcaactagcataatgattattagggtgccccattagttttgcccgtataaattaattaattaatgaataatttttctttattattaattgtttttcattgtttactctaattaatttggcattaatattaattaattggtctttcgtaccaattaattgattaattaattagtgggtagttggtattttgcgctaattaataaaaacattaattagttaattggcaatcccaaattgaaaaagggattattaacgttttaaatgagggtaatctgttcaaatattcaacacctctaacacttcggccaactgatcgaccaccgccaaattcaccgacaaagcgtcgtgtgccattacagcgcggccgccttcgtgccgtcgacgttttgaggctaattgccaagaatggatcattaggaaggcgtcatcaacgcctggagaattaaataaattaaacacgaatttatacataataaaaataataataatttatttaaatttaaattaaataaatagaataataaatttatttaatgatttttaagttttgaatttatttttattaaaataatatttaaacttatttaaacaaaaaaccattcaaataaagataaaaattattataaaataactttcaacaatttgaaattcatttatttttcacacaaattaaattcataattaaggtaattagccaattagttaattgaataattaatgaattaattgactggcctagtgccaagatcagaaagggagtgaccgccaaaattgaactgtgccgaacgccggcaaagaacagaatgccaagcgcagtgccgctggccatgaacgggcacagacaggcgaaaatagcgacgggcaactgcacatggaaaaaaaaacaattagacaaatgatttagtcaattaattggccaaccattactgtgtttaccgtatacattttacggtacaatgagctaattgtaaagccttccccacccaggcattcttactgtacagttgttcaaaataaagcagacactcgagaaatttttgaaaattcttttattttttaaattagcgattaatttattttctaaaattaattaatttttaattttttcctaaaaatgctccgttttaaaaagaggagcccggattttcagaacaggtttcactaagtttcaggattagaaatcctgtttgacaggactcattaggggtccggaacaattctgacaagatccggtgtcatgtccgggctctagttgtgagaaacccctaatttttcccaagataaagagagaattatcctgcattaggtgtacggtaatgaaggggccttggaaaaataggcacaccgaatttgaaaaattaaaattaatttttttttaaccttataaatggagaattgatgcatgaaaaaagcggataatgaattgctgaacagtgagcacaaaatcatcacggcaagcccaaagccaaaataggagcggatgatgttgccggcacggtccacctccacttggacataactgaagaaaatggcaaaaatgtggaatgccaagggtgaaaatggcaaaaaggttatgcaaatgatgaaaatggaaaaaaaacgccaaaaatggaacgttttagggtgaaaatagcaaaaatacaatgccaaaaatgaaaaagtgccaaaaatggaatgctgaacatcaaaaaatgccaaaagtggaactccaagagtgaaaatggcaaaaataaaatgccagaaatgaaaaagtgccaaaaatggagtaccaatggatgaaaaattgcccgaaaatttgagataatcccaaaaaattcaaaattccattaaacagtgtcaaaacttacgatgtcgagatggtcagaacgcgaatatgttggccaatgtatttgctaaatatgggcaaaaaagggcaattattattaaatgtgtttgctgtcaaaaagcgtcgtactccttgaagtagttggagatgctcatctcgtagtcactgaaattgatgttgatttgaccaattattagttcgaaattaattagtcgttaattaacacataattagttctcattataaactttagggaaaatttttagaaattttcaattcgaaaaaaaaatatttcatttaaacaagatttttttctttaaaaaaaatgaaaattcaaatgataaattaaaatgtaaaatgaaaaaagttcaataattttattttttttttttttgcaaatttttgtaatatcgtaaaatattttatttaaaaaattgtttaaaatgtataaaaactttctattcaattaaatcttattaaaaatgccgaatttagtaaattaatttttaaaattgccaattttcaattgttttgcctgatgtcgtcgtctttccatccgccaattcgttcggcacggtacagcaacacaaccatctccacactgtccaaagaggtgaacacgatttgaggacgacgcttctgatgatga

SEQ ID NO: 1788 - DNA, 4030 bp, Heterodera glycines
  misc_feature (23)..(23): n is a, c, g, or t
gatgatgatgatgatgtgtgttnggcgaaatgaatgccgaaaaaatttggctataatggcgaaatgttaaaaaatggcacagttaaaaaattgatcaacattggatcggtgatcagactattttatgtgatcaaaaataaatgatttgaggtcgaagattggttaaaaaagagggcgggggattatgctatatttttattgaaatgccgaaaatttttcaaaaaatcggatttttatcgaaatgatcgtcatacagtaatgctaacgaaatctatgtggcctacagtaaccatcaacagtgacataaacaatttaaaataaataccaaagtgccaaatctataacaattagcttcatgctgcgaccaatgggtgtaaaaaagcgccaaaaaatgaacccccaaaaatgggccaaatacagtagtaagtgtcccaaaaaccgataccgtaacccacctgtatgtttatacgttgtccgaacactgtagaagtgggatagtcaagctgcacattgtgactcggttgctggtgcttggccacccgtcgttggtggtctttgaagccgtcctgacaaattgggcacaaaatttgtgtacaaattaatcaatgaatatcatggcaaccgtgccaaaaacgacggcatgagaatgccagaaaaatggcaaataatttgttttaaaaaaatttctaatttggggttttcagcgtcgaagacaattttagacattgaaattcaaggggaatatttttttctacaatatgctcttggattgatatttatgtagaatttttcttaatttgtgtccttgaatgagtcaatttccagggacacccctcgagggaattccaggacgaaataattccatcaaatgatcgcacataaaacagtcggacgggctcattaattgtgcaaaaacggcgacaaatgcgcgaaaacggctcatcacgttgagtgatccgattgtaaatggtcaaattgttttggatcagttcgtcgacctgaaataaagaaaatgccaattttattttccatcaaatttttattggaacgattaaatttgttgggtttttttttaatttttataaaattttatttatgatttttgtttttacgattgcttttcaatatgctgtataaaatgccaaataaatataaacgatatttgtttcacaatttttgcctactgtatgcataattagtgtctgctccaatgtcaaatatacggtatttggcttgtaaaattttactatcgtataaaataccattatatattctgttgtaaaataattattattttatatgttgtctaaattgattatttacatgtcctcttttttagtgattgtatttgtgttaaatttcgatggtatttgggtttgtacaataattttcgctaccgtatacataaaaagccatcactgtatacgattcatttaaattctctgttgttttggcgatttgatttctctctttttagtgattttttttttattaaatttctacggtattttggtttgtacaataattttttgctaccgtatacataaaagccattcattgtaacggtttttggaagtcgttcaaaatccctgttttttggcgatttgttttctttttttttacctcaaccgtctcgcgcagtgtttccatgcgcatcatattggtgccattccgaggcaaaatcagcacaaagaagcgaatgccaacaccggactggtcaaaaaattcgtcgcgcacatcaaactcatacagtgcccgtgagccgtacggcgtatagccacggatgttgttcttatgtcttaagtgggacaaaaggtcgacagaagaggggaaaatggcacgaagagtgggacaaagtgtcgacataatggggaacaaaagctcacatttcagataaaatgtatgggagagaaaaggcgaagtgggataaaattaggacaaaatgaataaaaaataacaaaaaattggataaaatgccgacaaagttggggtaaagtggtgtcgaaagccgaaagctagacaaaatgtcaaaattaagggaccaattaagactgcctacggcacaccatcaggacaaggttttccggcattttgccccatttctctcggtaaaattggcactccgccaacaccgcacttggtttttgccatttgcccgtcctttttagccgcgcagcactttccggcattttgtcccatcctttttttggcccgcatttttcggcgttttgtcccactttgttggcattttgtccccgccctttttgggcatcactttcggcattttgtcgccatcctttttgggccgtacttttcggcatttagccctcatcctacttgggccccatcggcactttgtctaattttctcggctaaattggcacactccgcatcactcactcacttggtttttgccattttgaccacacatattgcggtcaagatgaagcatatgaacacaattttgtacggatgtgccaccacaaaatgggcccagcggcgataggcacgcgcaacgaccgcatggagacggagggagcagcgggcggaaaacgattgggacgacgtgtcactgtgggcagcggaggatgccgaggacgaggatgacgacgatgccgacggtgaatggcactgttgatcagctgctggaaagtgaacaaaattggtgatcactgatcagttcagggtgaaattttgtagcctgatcagctctagtcaatcaataattattggaagacaacagtcagctgtgcagctctctgatcagtttttggattggacacgcttgtcaaatttggatgtaatttttgctaaatatattgtgtgattagtgtggttttttttgctgtgtgatcaatttgaattgtttatcaccattgatcagatttggataaaaggggtgggtaaataaatctctgtctggtcaatttgtaaaaccccgatcaatgacaaaaaggcattaattctggatatatttgcatttaaaatgtcaaaattaaatgaatcgatcaatttgaattttaagtacattaaaaatgtcaaactgtacatttaaaaggctaatgatttttgattaaaaattaattttaaatttctttctttctgataaacccactcttttgctgctgctggtgttggtgttgttgatcagtgaaattattaatcacaatcgccccattgatgtcgccgccttgttgttgttgttgttgttgtttctgccgatgattactaattgccctatcattatcattcattttcggggctacaaatataaattatatataaaataattaatgactaaatggaggaaatttattttttaaaaacaaaattgtgatcagagagagagaaagatgatcagagtggtcggagtgatcagagttctctctattttatgagatgaacttaatgattaattattggcctgcagatagcatttgttcatgagaaacattacccaaaaattctgtttaagacctctaagattgaaaaaacttaaattcaaatccaatttcaaagagtcaataaaaaattgtgtgttcaatttgaattttcctcctgtttaaataattaattaattaaatttttctagacggcaattaggatggcaagcacatgagtttggccccacttcagttgctggtgatgatgaattcagtgaatttctcgacagaaaattcgttcgtcgatcatgtgatcagattctttacggatacgtgatgcgatcactttatatgaacagaatcttttttagcgatcagagagcgagaaagagaggagagagagagatagaagagagagggaagagagagagaggagagagagagagagtgagaagagagagtgagagagaagaaagagagtgagagagaagagaggagagagaaacgggagagagagagagaaagaggagagagatagagacggatggataaaaaatatacctattatttatttttttgtttttttgtttaattggagtgagaggtcattacttatatgtaatgttaatgacgcatagtaaacaata

SEQ ID NO: 1789 - DNA, 1815 bp, Heterodera glycines
  misc_feature (123)..(123): n is a, c, g, or t
atggaaatggtacatttatttggggaggatggcgcttagatagcctggatagataatcccaacccgcgcggacgattcagcgccatcggattccgtttaacagtgtgtgttttttttttgctntaagtaggattacaccggtgcgggtacccgaccgggttcccacccgaatttccggcttgttcaaaaccgggacccggcttttgtggatccagcaatattcgggttcgattctgcccaaaaacccggcccctgtaacgctattttcagggatgtaaccaaaaggccaaaaaaaattccagctgatcaaatttgatcacctgttttcaaactgtttaaaagacgatccattcattgccttaaatttctggattactctggaatttttattatccaaaatcagattccagcgccatccagacagaattttctgttaccagcagatcatggccctgatttatgtgttctaaacaggacggacgaaaaattcgcctagccatgcggggtggcgggagatgggggcggaaatggctggcgctgagttcgtcgacggcgatcagttggcgaggcaatttttccttctgatttcctgatcagcatacctgctgcacatgatggaagaaggaagaacctgttgcctgccgtccttttttgccatttttttttttgattcgcgcgcgatgaaatggcgaacaaatgacatcaccacccccgagggggcggcagcggcgcgcaacgcgccggcgccacacgcacccaaaaatgaataataatgcatttaattattttaaaacgatatgcgcgaaggggcaggggcacaattgtaatgtagcaacacaatttggttgctaattgcccaattataattaattaattgcttgatgaatttctgtaatagtgcatactttggttgctaattacttaattacccaattaattaattaattactgtctaattgtgttttgtgtgtgcaccgtgcgggaaaatgagaaaattattttttttgttattaaatttttgtttttggtggagaaatgtggttgtttgggcggctacttgggatgacaacaacaactcgtaggaaaatttgaaaaattttcaattttcaattttttttaaataatttttaaatgttgccagcgcccgacccgtcctgtgccataaaaaatgattaatgtgtagcaataattaacacaaaaaaatgtaacatttcttaattaacttttggaaaacggaatgaaattttccacgggggaagcgttataaatttgttaatttaaattaatttaatttcgccccctgatttcgtcacactatttttatgaaatctcccccctgcccccggggaatgtttcaagtgatggaaaaattcatttttaaaatttcaatcatattttcaagacgattgtgttggcttgcaacattgaagtgtgtgtgcgtgtccactccatttaaggagtaattaaaaggagaaattcgctcgctaaattaaattttgaaaaatgtaaatgaattttttttttcgtcgagttgcctcatttgtgagtgatgatggtaattaatggttataaaaataaatttaaaaatttgaaaggcggagatgagaggcaattacgaaattttttaggggacccattcacgcgcacattgttccgccgattaatgggctaagttggtgatcggaaatgggaacattaaccctttcattgggggtctaacagtttggggtgatcagaaatagaaaaaataacgctcctctgtgtactgatcagtttgggaagtgatcggaaataggagataatagtcgtgatcag

SEQ ID NO: 1790 - DNA, 1690 bp, Heterodera glycines
  misc_feature (1682)..(1682): n is a, c, g, or t
aaacattgatttgtgaaaaagtgtccccaaaaactgctggcccaaatcaaattaaaaaaatatgaatatgtatgagttcggttgggttttaaaattggagggatttttcccggttccatgacatttcgcctactttcatttcgcctactttcatttcgcctaccaagccaaaaacattcatttcgcctactaattagtaggcaaaatgaatgtttttggcttggtaggcgaaatgaatgtttttggcttagtaggcgaaatgtcagtaggcgagatgtcggtaggcgagatgtcgagtaggcgaaatgtccgtacacctttttcccaactcgaaatcgatgtttgtggcgggtaaattctttgaaaattgaaacaaattttcaaaaaaaaacgattaaaatgaatatgtttgtttaaaaacggtgccctcccccaatttttggggttaatcacatttattattctgtgtatttattgatcaagtaaaatttaatagagtaaaatggagaaaacaacaaatttgacaaattgcatttttatccccagcaacaccaaaaattgagaaaagaaagggcagagaaaaaagaaaacgggaaatttggggggaggcaaaaaataattacgaaatcgaaaaatctcaaaaaagaaatggccatggagttcaatttttggtcattggggccaatcaagcgtaaaatgattaaaattttgggggcccaatcaattaaatcccaattaactaattaattaaaaaaagagagagtcccctcatgtaatgccccaaaacaacacacagcgacaaaagacgtgtggcatggcgtgaccaccaaacgccaccacccatcagcagaaaatgttatgcattcattgtgaaaagagaatggggggaaagttgcgcagcaaaacgcataatttttattccatttttggaccaaaaatcggcgacgcatttttaaaagaaagaaaagaaaggggaaaggtctcataaatgaacaaaaaacattgcaacaaaacaacagcaaaaattgcacggaatatattttttcgggggacgggagaatacagtatatattgggcacacagaaatgagagagaccgtacacagagagagagagagagagagtccaacgggatacgaacaaaaaacaaaaaataaattaaaatgaattttggatgacaatttcatcagagtaataatgactgagatattcgcctaccgaattcccctccgtaaattattttacaggatggggcggggggaattgaattcgggtcatacataccaaggctcggaaaatttgtgacccaaataaatggaaaaacaaatttccgaaaatttgggaggcgaggtcaaagcaaatctcaacattacaacccagaataaatttcttggcagtttaatttatacaggttttgccagctcaaaacggaatgaataagcaaggggatgtatgtgtgtgtgatcaaaggtgcgacgacgacgaggacgacggctcattggctaatcatggaacagcagcgcgttcagtttggaccaatagggcgtgaaatagcgcgattttgtttctgacgacgaacactcggccaacagcgtggccaggtcgttgcgcagcttggccacggatgcctgtggtggaaaaacaatttgtatttgaaaatcataatttaaaaaaatacatganaaatctag

SEQ ID NO: 1791 - DNA, 5231 bp, Heterodera glycines
  misc_feature (5213)..(5214): n is a, c, g, or t
aatggacgacaaacggagggacaaaggaagacgaaaagaggggagggattgccattattagtgttaataggaattacaaagggacaaaaaacaaaacaaaaacaagcagacacagtaacagacacaccgaagaaaaatgggtgcgaagcaaatgggaaaaacatcctttctttattttagttttcccaaatttcggttgttattcctagagttgtacgggaccgggactggtaccgaaaaaaaggttggggtcaattccataccggccgtttccatgccataggccattttcgtaccaaaagtataaatattaatagacagtgaaattaaaacatccaataaaatttttcactactttttagacttagctccccaaaagctttcggatgataccaaatttatcaggattcgatcgttttaaaaaaaaagttagaagtgtcaaatctttgaatttttcgaattttgaaccgagccaaaaataggtttaaaccaaattccgcaacttccgggaaacccaaaaccgggctcaaaatcccggagctttagggacttcgggttcttacagtacctgctggggttaaatttgaatagttaaatccgggtcttacttcctaattttcgtgccaattgtaaattcgaaaaaaaattcacgatccaatttaagaatccggggactggataaaactggtaaaatagacaaaacaatattttaaaaattttttacttcggcttgtaaaaaagtatgatggtcattgttttgaagctttgcacggttctttttttgttagaagtatttccattttcttctctacaacattaaacataaaatatattgtcttataatgcatgagaaacatcaaaatgttgaaaatccccttctatttttgaaattttgccgaaaaaatttttggtacgaaaatggcctatggcatggaaatggctggtatggaaacggcggcatggaaatgggtcgatccccaaacatacataggtggttgatatttgctaatacttctgccaaccataatttctaaactctaattgtacatatttatttatatgcaacgacatttcatgtaaataatacatacaataatcacatgacaatgacaagaacataattaaggggacagaaacagtgggaataataagacagcaagcacatgataaacagaggttatcgaaaggtcacatttcatctgaacacagcgaacgctttcaaagggtaaattaacggtccaattggccaacagagcatcacaaataagccatccgatcgagtgctgaaaaagaacagataaacattgaaaaaaacacatttattcgattgtttgactgaccgttgacgatctcagcggcgcttgtccgccttcttactgctgctgaccggcacaaaaatcaagatggattggcccgtctctggcgctaaacgagtgatcagaatcaatgcaatgctctgctgcactctctcacttctgttcttcgcctcctccggcgttagcactttaatggacatgtccggaccaaattgatccatttgtgagtatcccgagtcggctgctgaaaaggaaagaaaaagatgaatggatgctaacattgagaatttagaactgaaatcttgaagaattgctcaaaaaccacacccgttgcttctgcaatgatcggttgcgtctcagccatcgatgtggaagccaaatccatcggtgttgatgaaatggatgattttcctgcggaggtagtcggtgaggccgatggtgctgaagtggtcggtttcgttgagatggtcggttttgctggagcggtcggtgccggtgctgctgaagtgggccgtttagttgaggtggtcggttttgctgagattgtcggttttgttggagcggtcggttttgccgagatggtcggtgaggccaatacagaagttggtggtgcggcctgcgctggaaaagcgggcgggtccacgcgcaatgtcggcaagaatttgtactcgtccgaaagtgccggctttacgggcgtcgcacttgctgaaaccaaaaaacgcaattaatgccatttcaaaaaagcaaacaaaacactccgacatacaataaggtccatagggtacggcttgtgaccgctgttgctgcgatggcgttttttgaacgaaaatttccttgtttataccggcaagcgtcgaatagcgcgaatcggctgctgaaaatataaaggttttggagctgttcggagacacaaaacacttgagtaaacagcacttacgatcagcgaagtttgttgtcggtggctttttctgtcaataaaaaacaaattaaattaattcatttgataaataatgaatgaatcatttattcacctttttcttacaacaagcacagcattgggtgacgagtgtgagcacagaagcaacgataatgacgaacaattgaacggagagcaaagagaaagggatcattacaacaaataacaagcgcaagaatggcaggggcagtggcaaggcattgcttaaatacaaaaaataacacaaaacaacacgaaacacacgcgaaaaacatttgccatcataaagagatactgccaaattcaaaattttggtatctcaaaaaatcatcagattaggtagatgaaaacggttaataggtaaacatgaggaaaatttgttttacctaattagctaggtaattaatatttgccaaaattgatcaattaataaatcggactctaaaaaaggcaatcttttcattcaatgcattttcattgattctttgcttttcattgcactatacatacttcatataatcttgataccgtccttttcaaaggttatgtcctttcgcaggcttttccaatttgcaatagaacaactcgaattagaataaaaatatatctttttcgatgctaatccattcattttagaaagaaatattatcccagtattctaagctaaaatgaatgcacccgaaaagcattattatataaatcctcgaaaagaaggaaaatttgagtccgaaaatcgttgttcatgccccgaggcggagctgtacgccgtcgaatgcaaaaaggtgggaaacgtaattagatttgtgctgtttgtgtgaacttaacaaatgcggaccgaacaattccataatgattttgctaagtcaactaaaccaagaaaaagcaatttgaaacattcggattttgagttatgtaatcccaaaattcggtcgatccgcttttgcccatattatcaggcctgccagattaaaattttcaaaagcctcattttgggtcaaaaagcctcatttttacaaaatgtattctaaacacgtttaaaatgttcaaatgttatatttttgattgtccatgatcaatttgagcatttttttttgttagaaataagcattttttgtgattctaagcttgaaaaaccgaagttgatttttttgcggcgctttttccaaaaaaaaacttgggaaagggggaggccggcggtgccgatagacgccgccgggggaaaaattaagaattttgaccatattttgagcatattttcattaaaaaattctttattttgcggtttttctcaaaaaaccacaaaaagcctcaaagcctcattttgaaaatttagcctcattgacccatcaaaaaaccacaaaatgaggctaaagcctcagatatggcagccctgcatattattaatggcctctctttcgtctttttccatttaacgcaattttctccgcttttaaggtcgtgtgcaacaaaatgaaccagaacaaccttgccattgccaaatgcttcatcgtgaccctcttccttgtgcgtgggttttgttgtcaacatcatttgctgtctctgctaatggcaccgctttatccgttctttgcccccgtttagattggtgtcatgttgctcattgtcattattggattagacatttggcattggtatatcactgctgagaaagacgaagcagcagaagatgccacggttgacacaaaagcatctgccaaaacaccatcagaggccgaatcgttcttctcttctctctacccgtatctcggcaccatcgttacgtgcatcgtcactgcactttgtcttgtcattatttgccaacttggtgcggattttttttgtccgagaaaattaccatttgcacaccatcgtaacacacgaaagcacatattatttattcatactgctttgatgcttcataacttttcagaagaatcaaattaaaaaatggatattttttacgtttggtctcctaaaaaaactacgggggagggggcttttggcttgcaccctgtggttataaaaaatgaaatttttcaggagggcgggaggcaactctaaaagtgtcaaaaacccttggtgaatctgaacataacttatattttttacaatttttaagaattgacacacagcgcgctgcaggtgaagtacaaatgtcgccagtgtggccacgaagcgtacaaaacatacgatttgatgggtaatggtggacgatgcaaaaaaatgatcattaaatgtttttgtttcccatttaagaacagttaagcaggggctttggcgacactttcagcgaatggggacgctacacaaatttgtgcgacccgccgccggaggtgacgaccaatttgcggaagaccaattacaacgacattgaggaccaattcagtgccatgtgccaatgctatatgccaatgtttcacaacagccaaatgtgggccaagaaattgatgaaacgcatcagttgaagagacgaagagacatgggagaaattgccaacgaaaaatggatgacaaatggaacaacaacatttgttatatgaccaaaaagagaatgcatttattactagggccgcaacttttagtgacgaaaaatctcgaaatagttaactaaaatagtgagtaaaaatgccaaaatagtgacataattttcagccaaaaaataagccaaaataatttttattcactgattgcagttgcaaatgagtaggactgggatttgtaagaccaaaaacccaaaataattacctaaaaaaatttttttaattaaaaatttttgccaagaaagtaaatttttgagaaaatttttttcatttcataggagtatattttgaaaaattttagctcgcttcttaggggtgtatttttttaaaatttttttaggtcgattcttaggggtgtattttttagttttattgcatttttgttaaggaattttccaaaaannatgtcgaaattagtgaa

SEQ ID NO: 1792 - DNA, 4682 bp, Heterodera glycines
tcgcttcttaggggtgtattttttggttttattgcattttgttaaggaattttccaaaaaatgtcgaaatagtgaaaaaatagtgacgatacgccaaaatagtgatttctagtgactgataatgacatcagaatcgaaaaattttaatgcagaaatgcgttttttgagctcctttcttcaaatcaattgagcaaaaaaaaaaagttttttcactaaaagttgcggccctatttattacgtccaattgttcattatcgtgtaaaataatgtctataaatttcaattatgcacttaaaatcctaaataaatgtttgtttccatttcaaacaccggttttatgggcgaaaaaatatcaaaataatggaatacatttcttatttatgtttttttgaaaataaattaaattgaggcaaacattttattcactggtgtcaatttatttctttttttttgagacacatcaatagagctgagatttttatgaaaaaaacacttgattttcccatttttaacacatatttagtatatatttcagtattttttggcacatattttattatatttcagggtttttagcacataaaagtcccagccagcagctctactgatcaacaaaattttttcatcattatttgataagtaaattttattccatagaatattttaatagagcagaattgctatggttatgtgattgatcgtcattataaaataaatttttatgaatttggttacaaaatatttttagaatgctttactggtcttcacaacaaaaaatagattattcaataagatgtttgaataagaataaaatttatataatgtaagattattttggcggatttgtaaacgcttaattctgccgattcatttggtcgagcaaaacattgtccatgaaattgcgaacgtcgctaattactttggagaggctcattaagtaatattcatcacaagtcgggcaaaacttcagcagcaaaatgacataaggctgcaaaaattggaaacattaagtgaaaaatgagccaatttatggacaaagggcttctgttggggttttagaatatttcacatttaacaaatttaaaacgaaaaaatttaggaacaggtggcagatttaattttaataatttattttttcattatttcgaaataattcttttgttaatattttaatgaaaaactgacagctgtgtcgagcggcacaaattccacttgcaatactttggacatgagcacagagtttacaacggtgctaggtcgtttcttaaaaaccgccacattgggcgttttttaaaaccgccagggcgtttcttaaaaccgtcagggcgtttcttaaaaccgccaactcatatgattatgtatgtatatccgttaaattaaatatacaataataatcggttagactcttttgattatacaaattcatattaaaaatttagcttacgaatctgagtcaaaaagaaacaacagcatcagtatttttgtattataatgatggacattttgaactgattaaacagccaacaaagataaattaattattttgttttatttctgtgataatctttataaaattcattcccttttgaaagttgcaaagaaattctgtgggacttattgtggcacctctctattagactcttgtctaatagctcctgtaatctggttttgcaactttcaaaaaagtaacaaattacgaattagcaattttatattcgaaaattttgcagttgataattgttgctataaccacgatgtgtgctacataaataaatatcagaaacgttacgattgtgatattaaattttgcaattgccttaatgaatatcctaattgctttctaacaaaagtctgttctccaactcatatcttaaatatttttttttttagaatatattatgctggtcagttcatatttttggagaacgttttaaaggataaaaataattattttattttaccgtcactagatatgcatatgtattttaaattttttattgttatgtaaacttctaatatatatatatatatatatatttatatacataatcatatgagttggcggttttaagaaacgcccaaagtggcggttttaagaaacgcccaatgtggcggttttaagaaacgcccaaagtggcggttttaagaaacgtcccagcaccatatttaatataattttattctattttattttcagaataataaatcataaaatagctctaatttaatctatttaatttatcttggtattgagcgatagcccaagttatactctgccatttatgaaattttaaaaaatttacgaaacatttacaaaaacctataatcaaaaaatttagataaaataatttgtcactaccttttttcaaacttcaaaaaaaaaattttgaaatttaattgaataatagaaaaatcttttctccgtttaattatataaagaaacttaaatttggttgcacaaggtatgatttattattaagtaaattaaatttaaatattaattaatttaatattattatcattgatacgtttttaagttcgacctagcacccttaaaaactaaaaattttggaggaattttaattttacttaataaaagtgtaaattggatagtttcagaatcacgatatggcaataaaaactcgggttcaaatggcacaaattttcacatggatggagggggcgaacgatgttgacattcttccaccaggcggaagagttgcaaacattgctacgatggattggagttttaaggcattgagtttattcaaaaatggtaataactgaaaacgaataaaataaatttcctttttaattgtaattaatgaatttaatattcatagattcccgtaattcggctgccactgagcatggctttcccgctcatttgctgctttcaaaaggctatttccaagtcagtctgagccgtgccatggtcgagttcatccagctggaactgaacctgaccgagttagtcagacgtttaaatttgattggatatggacgggacgaaatcctgctcaccactttgcactccgccgatcagcttaatgcaccgggcggatttacgcagacgtgcttcagccggaagggtggcggacggaccaaccatttgaccaggtgttttttaacgggatttaatttacaaattaaaagtcttagcatttttggcatgaagcatgaaattgtcaaagttttgtcttaaaatttaattatctgggctttccgaacaggctaaaagtattgaaacgtattaaataaataaataatttggcaacgcctattatctgtttagcttaccacccactccttaaaattggtcaaaattaaaagaaaaaatcccattgaaaaaaacatttatttttaatgactaaatttccttactcattaatacaaatttgttatctgctcattttcccccaatttagggagtctttatggatgccgaaccctttgtgtgcctctggccattcgtttcacagcatttgcatgttcggcattgaagatttgccgcaattagccacctttccccacctttttgtcaacaaatttttgccctccttcgattttggcgctgcgatttgtgtgtacgaaagaatgtttaacatgacatatttacacacgggaggagaacaattggacaaaatggaggcgttggtgaacaaatctgtggttgagcagctgccgaatgtgagtaattattgttgtgtaagaaatatgaaaatgagccaagtcataaattaatttttttttttttttaatataattttccaaaatttttaagaaatttcaattttaggtgaaatttcagcgatttaaaagggatatgattttacgcaacaaaaacaataagcaacaaaagcgtggtgttggtgaaaagcaattaacattcgaagaagtgatggggtttcagtgtgaagtataatgacttaaagcattcaatttataaataaaatcaggaaattaattgatgcaaaataaactttataaaatattgttttaatttataaaaagacaaatgcacttatgtaaaattattttaagctgacccatccaaaaatgaattatcgtattgtatatttacatattattaattagtatatgattttcgaaataactcaattacgaaattcctaattaaaaataatttatattaagaaactattgtttaaaatgaacaatataaaaatccaaattacagctcataaagcttctcaaacaattttagcacttccatttccttctacaatcgcctttatacatcccattatgagcgctaaaattatcataataccgaaaatcgcgtttgatctatccctaaaaaaaatgctctaaataaaaatcttaattacgctcaaaaagattctcatacaattttagcgcttccaattccttctacaatcgcctttatacatcccattataagcgctaaaattatcagaatgccaaaaatcgcatgtgatctaagcctaaaaaaaatggtctaagtaaaaatcgcaattaccctccaaaagcttctcaaacaattttagcgcttccaattccttctacaatcgcctttatacatcccattatgaacgctaaaattatcagagcgccgaaaatcccatgtgatctaagcctaaaaaaaatgttctaagtaaaaatcgtaattacgctcaaaaagcttctcaaacaatttt

SEQ ID NO: 1793 - DNA, 3425 bp, Heterodera glycines
  misc_feature (1724)..(1724): n is a, c, g, or t
ttattaattagtatatgattttcgaaatacttaatttacgaatttcctaattaaaaataatttatattaagaaactattgttttgtattaaaatttgttcattcagatgatttgttttattaaatttcaattttatcgtaattttaatccaatttttttaaccattcaaacatattaaattgaacattcttttccatcttcatcaccaattggattctgaattatccagttattcttcggccacttcctgctgctgttgttgaacaggaatgtccaagttcggcaggttcgggttggtcggaggaatgtactgaattttttatttataaatagaattatttgttttcatttatttttaaattaattttttatttaaatatatttcgtttttataaatcattttgttttcttacctgacctctggccacgttgtgtgccgacaagtactggtattggcttccgtcctggttgtcccccttcggaattgagtcaatgtcgcgggcaaccgcactgagaagcaagttttttttttgaaaaattgcttctaaaaattataaagcgcctaagaataatttattttcaaattccaccgtaatattttggcatttgtattactttaccaaatgagtcagtagcacatagaattttcaaaattcgctatgcctaaatgtttttgtgtcaggtgtcagaccctacatgttcagcatgcccgagctcagtccaaattctgcggtgaatttgggcgttttgcgcggcttcaacggctgatagccgtggtacactccgtccttcagctcttgatagccggtgtagccttcgcccttatcgaccattttttgttgttgtttagcgatgaaataaaatctaaatcagatggacaaaatcaatgtataaattagtgtataaatggaggaatgaatgaagcattaaaattaatacgtacacaagggaataaaaacagtaaaaaaataataataattagtagaaattattttagaaatataaaagcccatcccaaaacatttggaaggcaattaacaaaatggaacttggaaagcgattggaaatgctgctcaaaatgaaaagcaaaagcacaggagagacggaagtgtgaagcaatttggccaaaaagtgaacgagggggcgtacggaggagaagcatttgacggggctatgagcttttgaacagccctccgccggaaaaagtgaacaaaaatgaagtcggtcggctttttgtttgaaatcggcgccgttctaagccaagtaaaaatgaaaaagctccgttcgatggaaggaatgggcaatcaatcctttggaagcggagggggcgggggcaaaaaagaacagacggacagatgtgttggcatcgccgttctgatcgccaaatcggtggttaggcgattagagaaacggtaaaactcagtcccaacttcattactggatctataaattatgtgaatttaaataaattaaaaagcattttaaaaccttttcatcagtatataattattctttttaatttttggattccgcatgttttggccaagctgaaatttagagaaaaaccggcccagatgaagagtttagatgtagcgaaattcaagaaatttaacctattatctttttttgtctatagaattaagaacttactagcgacattaattaactttctggcagtttgcgcaaagcatttacaaattggaacacttttcaagactttaatncattagattaattttattaaggttaaaaatgtaaaatgaataagtaaaaacatcacattagtcacaaataaaaaatattagacaaagatacattaacaataaaaaagaaaagcaaaagaatcctcaaaaaattattaaaaattaattataataaaatattccgatcactgtcaaaaaatattatttaaaaattaatttgaaaacttaaaaaaatatgaaaaattcacagcttttaaaatgaaaaatagaattttgataactcatttacaaaatgtggtatttaattcttaagaaaacaaaatcccaaattcccatttagccgtgtttttatccgagcacgacatccatcgaaaccatattttcagcagcagaaggcgttgcgttcgtaatgacgttgagattgtagtaaacggaagagccaattccttttgtctttaaataaagaaaaatgaaattaattttaaataaatattatttaaacaatgtttcttgattgatctcgtaaatgattacatatttatttacctcaatgagttcaccagagtggactaattctttgattgccaaatccatcttttcataaatcttaaattcaaaggtttgaaaaaataatttaagcacattaattaattaaaattaagaatgataaatcaataatttaattaatattcaatgacaattatcatttggtgtatttgtgattatcattcattaattgtgtgtactagtgaaaatagatgcttatttttacaaataattaccgaaataataattattattgctttaccaactcaaacattttttgaaaagtaattaattagtgcatttacgcgggaagtgtccttgcccacgtcaaaggtgctcataatgtagttgagaattgcgcctttggccgaccccttttttgatttcagtgcgacaatcgctttcttcaccatctttgttttaaaaaactttttaatgtaacatgattgatgaatttttttcttaaattaccaatttgattgagattttcgtgctcactggtacagtagacgaactttctgcttcttccgtctctgcctttactgtagtggaattgtccgtttcctttgtctcagttgtcgaataatccgcttcttccgtctctgcctttactgtagtggaattgtccgtttcctttgtctcagttgtcgaataatccgcttcttccgtctctgcctttactgtagtggaattgtccgtttccgtcgaataatccgcgtcttccgtctctgcctccaccaaagtcgaattgtccgtttcctttgtctcagttgtcgaataatccgcttcttccgtctctgcctttactgtagtggaattgtccgtttcctttgtctcagttgtcgaataatccgcttcttccgtctctgcctccaccgaagtcgaattgtctgtttcctttgtctcagttgtcgaataatccgcttcttccgtctctgcctccaccgaagtcgaattgtccgtttcctttgtctcagctgtcgaataatccgcatcttccgtctctgcctccaccgaagtcgaattgtccgtttcctttgtctcagttgtcgaatagtccgcttcatccgtctctgcctccaccaaagtcgaattgtccgtttcctttgtctcagttgtcgaatagtccgcatcttccgtctctgccttcaccgaagtcgaattgtccgtttcctt

SEQ ID NO: 1794 - DNA, 1610 bp, Heterodera glycines
  misc_feature (177)..(177): n is a, c, g, or t
tcaatattttaattaatattcaatgacaattatcatttggtgtatttgtgattatcattcattaattgtgtgtactagtgaaaatagatgcttatttttacaaataattaccgaaataattattattattgcttaccactctcaaacattttttgaaaagtaattaattagtgcatntacgcgggaagtgtccttgcccacgtcaaaggtgctcataatgtagttgagaattgcgcctttggccgaccccttttttgatttcagtgcgacaatcgctttcttcaccatcttttgttttaaaaaactttttaatgtaacatgattgatgaatttttttcttaaattaccaatttgattgagattttcgtgctcactggtacagtagacgaactttctgcttcttccgtctctgcctttactgtagtggaattgtccgtttcctttgtctcagttgtcgaataatccgcgtcttccgtctctgcctccaccaaagtcgaattgtccgtttcctttgtctcagttgtcgaattgtccgcgtcttccgtctctgcctccaccaaagtcgaattgtccgtttcctttgtctcagttgtcgaattgtccgcatcttccgtctctgcctccaccgaagtcgaattgtccgtttcctttgtctcagttgtcgaattgtccgcgtcttccgtctctgcctccaccaaagtcgaattgtccgtttcctttgtctcagttgtcgaataatccgctttttccgtctctgcctttactgtagtggaattgtccgtttcctttgtctcagttgtcgaataatccgcttcttccgtctttgcctccaccgaagtcgaattgtctgtttcctttgtctcagttgtcgaataatccgcgtcttccgtctctgcctccaccaaagtcgaattgtccgtttcctttgtctcagttgtcgaataatccgcttcttccgtctctgcctttactgtagtggaattgtccgtttcctttgtctcagttgtcgaattgtccgcttcttccgtctctgtctttcccttagtcaaattgtccgcttgtgccattaccgtagtcgaattgtccgcttttttcgtctctgacgccaccgtagtcgaattgtccacttcctccttctcagctatcacagttgtcgagttcgatttttcaatctctgcatttcccgtagtagaattgtccgcttcttccgtctctgcctttaccgtagtcgaattgtccgcatcttccatctttgcctttaccgtagtcgaattgtccgcatgttccatctttgcctttaccgtagtcgaattgtccactttttccatctttgcctttaccgtagtcgaattgacagcttctttcgtctccaccacctttcccttagttgaattgccattgcccgcttcttccgttttagctttcatggtagtcgaattgtccacttttccaacttctctgacagcaacctttttcgtaacgtcttttttcattatcttaataatgtcaaattatttctactcacctcctttttttgtgtttgacttaccaccgtagtcgtgctgctttgttgctttcgtgtcacattgtccaactgaccaattgatttg

SEQ ID NO: 1795 - DNA, 715 bp, Heterodera glycines
  misc_feature (28)..(28): n is a, c, g, or t
attggtctaaaaaatcctaaatttactntattacgctcagaatattttatttcattttataaatattaatttaaataagcatttaatgtgtgcataataaaatgaaaaatattcgattgcttaaaagcagcagctaaaatgattctgcaaattccattaattggcgataggaacaaaatttatgatgatgatgatgatacgatggtgatgaagaatggcgatatgttatgaataaattattaaaagaattttttgatgtcagaataaaccaaatgatttgaacacataaaataaaaaatgtttaatatactttctgcacccgaaaaaaatgaaaagcaaagtgccataagacttgttgataaaaatattaaaaaataataaataaaaactgaccgaatactttaggattaattacctttctatccgcttttcagtggtatattttttgtctttatctcataatttggataaaaatagtctaaaaaatttctataaataaatttttttaattgctcaaaatttaaaataaagcgaaataaatttggatatttcatttttaaagagcacaacaaataatccaagcattcaaaatttgttgtttatttctgcttggcaatggccaaccaaaaaatggtgaacaatttgaggaaaagggtgcaaaaatgcatggacgaaacagcagcagataagcagaaaacaacttagtgcaaagttg

SEQ ID NO: 1796 - DNA, 6438 bp, Heterodera glycines
  misc_feature (90)..(90): n is a, c, g, or t
agggcttctattgttcaccggcctccaaaggtgacttatattcgagggggggggcttataatcgaggaaataaggtatcttatgaatttnctctttataattttttgagcctggaaaattgagtccacgtcacatctcagttccactacaacatgtacaatcgtttgggcgacattttggatttgttgtcattgtgtaatgcatgcacatccttcatcatctattgtacaatgagtgcacaattttgaaaagtcagtgaagatatatattttaaaatttagaaatatttattcttttaattttgaaaattgaacatttttttaaaagttttaatttaattataagattaattaaatataattttaaaaaataatataaaaattcaccatttttataagggattatatttttataaaattaaattttatttttttttttcatttcatttatacgcataagcgtgacgccgaaaaataagaaataatgaaacaatatcaaataaaacaaacaattggtcacttttggagctggggtggcaaagaaatcaacaaattcagatcagatctttcaagaagtttggcaaactcattagaatttagtaatctcgtctctttaggcaaaagtctatagagacgagaggttcgaataaagaacgaattgtgtctatcattggttgagcaataagctgttcttatggtgagttcgtttttgtacagggttttgggaaaagaaaaggattcgttattttgtaaatttattttacctaaaattatttcatgaaaaagttttaagtctatttttaacctacgactctcaagcgacttttgatcataaatgtttaacaattcagcataattaggtaaatcagcagcataattgttacgtctaaatattactctcaaaaaagttttttggacattctccagtttttcaatatccttttttaaataaggattgaaaattggagatccgaattctaaaattggtctgcaataaatattaaacaaatttacaagtattttcgtatcaccagttttgattgactttaatatagcaaaagcagatcgtaatgctttcttcgagataatttcaatatgttgtgcccatttcaaatcattagtaaaataaatgccaaggtctctgactggttcgtttccgggatttttagtaattggaaaatcatcaataaaataatttattttttggtttttgtgtcctaaatgtaaagttaaacatttatttgaagcgattttaaggccgtttaatttacagtatcgattaaatttgttaataaaattttggagtggagaaaaggaaatatttgaaagaacatgataggccttaagatcatcggcaaatagtttaattttaacattttcagtttcgcagaattttggtaaatcgtaaatgtaaataagaaataacagtggtcccaatattgagccttgcggcacaccactgagacagggatattcatcagagaaatcagacccgattttgacgaaaaactttcggttttttaagtaattctgaatccattttaataaggaattatttataccaatgttttggagcttagatattagccggttatgtggaaccgtgtcgaatgctttagctaaatcaaaataaattacatcaattgattttctattttctaaagcaaaactgaaatcatccaccacttcaagaagttgagtagtaacagaatgtgctttacgaaaaccatgttgacaatttggtaacaaattatttttttcaacaaaattttttatttttcctgctatattttcttccaaaattttggaaacagaacatagcagggaaatcggacgaaagtcgactgggtttaccggattttgaatttttgggacagggcaaataattgactttttccatatttctggaattttggcagtcatcaatgagaaactaaaaatatggaaaagaggtcggactaaattttctttacaatttttaaaaaaatattgggaattccatcaatactagtgttgttagaatttgaaagtttggaaagagaaaaataaatttcatatggagttatgttaaaatattcgatatttttttcaggattttctatgcattgaaattgttctagattttgatctgtaaaaacggaaaaaaattgttgcgctaatgcattcgacttttccttatctgagaagagaatcagactatttttatcagtaaatgcaggtatcatagtatttttagtcttaaggaaagaatttataaattggaaacgttttttagagtccaaggtccgcaaaaacttattttcgcgatttttataaaatttatttatttctacatcgatttttttcgaaacttctaagaattttatttttatatggtctttgtgaatgtccttccaaagctgtttacgatagatgattagtttcaaaatatgttctggtagtttttcaacttttttcgttgtttgtatgggaacataattccttatcaaattatttaggaaaaacataaatttttggtaaataagctctatgtccgggcaatcagaaaaaaataaattccaatcaaccattgagagtatgccatttatttccaaataatttgcttttttgaagttataaaattttttagaggcatcactattaacctgtaaatttatgctgaattgaattgcattatgatcactattcccgaatggaggtccaactttaacattattcaacagattttcattgtttgtaaataataaatctaatagattattgccccgtgtaggagagtttaccattaatcttagtttaaatccctctaaaaaggaaatgaaaaatgattcaaggtgattgtatctttttcgaaattttggatgctaaagtcttttgcttttaaaagaggaaaattgaaatcacccaacaaaatgcatttttcggaagccgagattaaaccagagagttgttcgaccaatttttcgaaatcttcttgtttttcatgggaggtgggtctataaatcaaaataaaacgtatttttgtgtggttaagaggtgaaaataggtcaacacaaagaatatcggaatttttgttttttgtagttttgataatttcaaaaggaattaaattcgatattatgaaagcaaccccgccaccttttttgttaagtctatctgatcttattatagaataggggagattttccaaaatttgggggttttctattttgttactcaaccaactctcagatacagctatgattttaaacctattttctaataacaaaaaccttaacttgtccaatttgttcgccaaacttcgtgcattgaaatataaacaatttaaaaaaggaagtgacctcaaaagtttttttcattgcctccgcgtcgcgtcgtgatgttttcccccgtttttttctttccaaattccatccacttcttttggcgctgttcccgctcaatttccaactcctccttcgtcagggatggcctgaccagaagacgctcccatccaggcctcatcttcagctccgtccgacgacgcccccactgcatcagcgcaaaacgttggaaggttgaagccggcaggaccaccttcaccaagcgcggtcctttcctcttctcatcaatcctcctgcccatcctgtagaccatttgcgggcacacttccacgtccagccggtccaacacttcctccaccgttttcgcgtcatccttcgcacgcagtgatggcacttcctcctccgattccggaagaccgatgagcacaaggctcctttttcgttctttctcctccgcgctgccaatgccattgttgttaattttgcgctcaatttcacccaggcgttccgcaatggcgctgaactgcgcagtcatttcggttgccaaggtgttgttgttgttggttgaaattaatttttcaatagcagttaagcggctaataatagctttaagttcggccattgtataatcttaattggactgcctcaaaaaacattctctgtatattagattagattttttaggtttataaaattaagttttaagtattttaatgggtttttttacattattatatatacttttttaatataaaatttttttttcataccttgttcagcattagacaaaatttatttgaaaatttcgttgaccatttttagtatgaaaacgttcaaagcacattttaaattcctttttgaacagtcgacgataatcagtactggaagaaaaataaaattaacatttgaaataaaaataattaaaaattaaaatgagtccgataataacgcataatctttaatattaattaattatttcgataataatgacctgttaaaataaaggacaattgcatttgatcctgccgctgcatttagcagaatgccagcaataaaaaaaattgccaaattcgaattggagagctttaatttttttgaaaattatatttaggtaatataaaattaatttttttattacacaaacatatggcgaaatgcaccaataaattgatatattgccaaatttaacaaatacccgccaatattaatggacaaaatgatgactaatgaccgtaacactcgtgcgttcgtctgttgatttactgtaaaaaaatactttcaaattttttcataatgccaaaaattgccaaaatttctgcgtcggatgagcacaaaaattgccacgtaacaacaagtgctacacaatgaaataatgaatgtgtgggtgatggatttatacccaacggtgccccgaaaagattcggccaccattccggtggttggactgaaacaaaatttgaaaattaagtatatttaattctaattgcgccatactttcccgcattttcaaatgcatttgcgagcacataattcaatgaatatgcaccataaattgtgcaaattaacagataactgaacaggtacacatatttgaactgtaataaaatgtccatatgtctaaaaacataaaaataaataaatttatggacagaatgttccttggaatcggcatttttgagaaagaaaaaatgtccattaataaaaataaattttggcattctgtttaaaataattctcaattataactaacgtatcgaaaatgattttctttttcaaagttttaagtcaaaaactgttaattttcctcactttaaaggtgaaataacagtaaaaagtcggtcaactgcagcacaaagcattgccattaagccacaatttatagcaaaaattgaaggctaaaaattggaatatttaaataatttttaactttcaaaatataccttcataattaagtcagcagtgagaaaactgacaaaatttgtgcccgaaatgacaacaaccaggaaaaaagtgtgcccaatttggtggaccaattcacaaagacaaatcaaagccatcagaaaattggcggagccgcggagggaactgaaaaataggaaattaaattaattaaaaatggaaagtttaatttaatttatcatttaaatcattataaataaaataagaaaatgccatggcatttacttggatctggcagtgaccactaaaactgtgccgtttaacacaatgccaaccaatgcaaccaaatacagcgcaacggccggcacaatcaaatcggcggatggaccgatagaacggtaggccaaataaagctgaattataaaaatcaaaataaaaatttcttatttattttaacattaaaaataattaaaattaaattaattattaattcattaattaatcacttttaccgggtcatttgaactggtgttaattgaagtcattttgaattctagccttttaaattaattgcattttatttttacatttttttccaattttacttggcataaatccaaaattttttcaaacttttgcaaagtttgaaaatttgaattgcttataattagtgctaatatttttaggcaaaagcctatttttttcttgagcttcccgtggcctgaaacgcacaaaaattttttgcctattttggcgtttttcccaaaatttgttaacaaaaatgcaataaaaactaaaaatacaccccgaagaatagttttttgggaattttaaaaatacaccctaagaatcgacccaaaaatttcaaaaatgcatcccttaaatgtaaaaatttactcaaaaattcatctccaatatttatttttttttttttggctagaatttttgattttaaaaattatttagctcaatactgatttggcctaatttttttaccttttttaataaagtttgtcattttacacccctaaaaaatgagttttttagagcctattttccatttttagtgcctattttgggggttttacactccttttccctttttttgcttgaatctgaagaatatggctgggaattaaagtcaaagccttaaaatgacttaaaaagtgttctacactttgtttgaagcttctaacatgtatttttgtgactttttt

SEQ ID NO: 1797 - DNA, 3192 bp, Heterodera glycines
aaacaaagtgtagaacatattttaagacattttaaggttttggctttaattcccagccctactcatcagatgcaagcaaaaggaaacggaagagtgggaaaaagtggaataaaagacaaggataagcattaaatgagggagcgcttgtcgtggcccagtcgattaagagcatgcatttagtcaacggcatggaaaggccgtgctgagacgaaccggaaatagataggctcatccgtgtcaataaaatatttaaatttaattatacaattcaattgggtgtcgaaaaataacaaatttaattatacgattaatattaaaaatataaactgaaaaaataaaataattccagctccgaccaaaaaaaaaaaatcacatcgaaacgaaaattataatttaaaatcttgaacccatcaaattgattgacaacgaagcttactagataaggctttttcatttttagaagaaaaaaaaatctactaattttcttgacaaatttcaaccaatatttgcgtaaatttaagtttttcattcgtttttccagaaattttatgtgctttttccataaattttgcttcatccctattcttttttccactaatgttacaattgaaaaattgttctgcatttattaatatggtacggaaaatagcatttatttcgagcgcagaatttttgaagaaaaatattgaagaatgaaggaaattacgatatatgtagttatttgaaaagtttaaaaattataattaatcgtaaatttaaaaaattattgcattaaaataattaaatttaaatgttttatttacactgacaatgagactattttcggttcgacctagcacctggaaatgccgtgggttcgcgtgccatcggaccaatgcacttttatgtactacactcttcattttaaggatctttaaaaataggaaatttttatgtattctttttaaattattttcactagaaagagataatgcggaaaaattcaaatgaaaaattttattcgaaggctgctaaaaataaggcttaatcacatcacaatgaaaaagacaatttaattaaacaatttgagcgcaatgctttcgaaagtgtcaaatttaattttgcattggcatttttattgctttagttaaccaattaaggcatgcattcgcttatgaaaagcaattaaggtcaagccaattgaattatattttgaaattaaaattttttttatatttagctctaaaataaacaataaaaattttaatttacattaaaatttgaatttatgtgattataagaccttttttaaattagtattttatattttataaaattttattttgtgctattatctaaatcattcatcggataattttcggattaaatataaaaaaactcaaaaatagttctatttgttggccaacagcaattaaactctaattgtaagtaaaaaagccttgccagataattactacccatttaaatttcttttgcccgcatttaatctgtgaaatggtgtaaatggggaaatgaatttttggtcttctaacaaataagctacattttactgccattttatgaaaaacttttctttaatcggaatttgttcattttacgtcgtcgctatatgattaaaggaaaagataaatttactcgggtagggaaagaaactgaaaaataagacaaagattattaattgagtattaattagttaggacaattgcaaaaatttaaattagctaaatgttttaataaatcttcacacaaaactcaaactttcaaatattttggcatctgttggatgatacagacggttgtcaatcttccaactattagaacattattataaatctaaaagtggcacccaatttaacttgccggtttcttttattttgattttattaaataatattcccaggggtttttcaaaaggtcagtcacatgccattctggcacattgacagatttaatttttgatttaaatattgaaaaataaaaataattaattaaaattgtattatcagtcggagaagcgccgcgcatcgttcgtagcggactcccgccagccggagagtatcagccgcaggagaccgaagtcgaatcgaatcccgtcctcatcgagtcgagagaaataggcagtccagtccgaccgttcggagcagctcaaaagggtccgacaagtctaaaaggtgatgcgcaacaaacaaagtgaacagagtctcagctttgttagccctcaagaaaaaggattggcgacatattttatttgtgaaagattttgaaaattttcaaaattaaatctatggatgatttcacgaaacgacttatctaatttggtatagtgtgaaaaagttttgtcttcattaaattgactctgactgactacaatcgccggtttgtgcgcaccttttctcataaatgtgccaaattaattttttttggcattttgacacatttgtatttttccatgtgaactcattagagatttttatgcattgcacgcattatgaaaatttaaagcttatgccagtaagaatctgttgcattgtcatttataaagaacgccaaaatgaaatgatttggccaagttaattgaaactaattaaattttttttctaaattagaattaattatattaaaattttttatgataatttattattttttcaaaatttatttatgataattttattattatttgttttgcatatggcaataatgaatagggctgccaattttatgtaaatacatattttttactggcttctccatgctctaattagtaggaaaaacactttcttttttgtgttttgcgaacaaaagttgggacttttattttcatatttttacatattttgggatttttctacatattacacatatatacctatttttatacatattttggactttttcgtacatatttcgcaatttttgcgtcatattttcattttttttaatatttgaggatttttgagaatttatagaaattttttgtgaaaaattaaaaaaaaatttttgaaaatgtatcctaaaaaatttaattttttttcaaatgatatatcaaaaattatttttgaaatactaaaatgtaactaagcctattttggtcatttttatggcatttttgtgcctatttcactttttacaaagaatttttttccaaaaataaccatttaaaaaaaatttatttacatattttagtacata

SEQ ID NO: 1798 - DNA, 3097 bp, Heterodera glycines
tatactataatgtgacgactctttacctgtttagtcctctattcacttatatattacattgcacattcgtcctcatcgcgtttctgcgcgagtccttcccgcaacatttccggctcaacatccgggtctcgccacaattcgtttccctcttcatcatattcggcttctgtaaaacaaatgccaacttttattcagcattctgagtgtccatatttaaatatattttaatattaattgctgttttaatgcttgggcgattttatacctaattagcttatcaaagagaaaattatttttaattgcgaatcatttagtaattaattaccattttgatgtccccagccaacaatgtgcaagttattattggaattaaaatctttttcagaagtagaattggccaaacaaattggctccacattttccataaaagtaattggttcagctaactaaattgaaaatcattgaaataataatattaattaaaatgcaagcatcctccctctatcaatgcccgcaaaaattgacggaatacggtagaattacggaattttttaaatatctattaataattttgaaatagtatctaaatttctcatttatttgctgagttcgtttttttcaatatgtatttttcattatgggcattttttattttaaaacactattcctgcaaaataagaatttgcattttccgaaattgtcataaaaatgccggaatgcaaaatgcgtaattcggtcccacatctggtgctccttcttttatgtgaagggctaaacaaaccttcatgatatagttttttttggactaatgtcaattaacataaagccttctgctgattattgtttttctctgtcgctgacttttatgatggccaaatcgttcacaaatgtgagctcatcgtactccgaatggacaatcactttcgctaaattgggctcaattgcctcctttgagctgtgattgtatgagccgaggcggacaaaaatctgatcagagaaaaatatcagacttcctagagctcaattttaaaaagtaaaaaatggaacttagccaaaggtggcgatttgcgctcttccggcgtcatttgcctcctcttttttaaaatgctcaatttttaatgccagttttaaaaatccgttaaaaattttaacttcctcccaccaccagtaggcaaatttcggtaaatttccaaaatttaatttaaaaaacattttgatataattagttagtgagtcggactaaaatcaaaatggccgttagtcaaaaaagcatcaaatgaaaatgggagaagttatgaagaattttctgtcaaaaattttcaatttgatatttttttgactaacgccattttgatagtttttggctatcgtcccagcaacaaccctactccaagtgaatttatttagactactcaggtacaacattcaatagccctacaattttgtgttcaattcggcaaatcatatataaaattaattaattagtgggcctaataaggaatataaaaatattttcccttcgattttcattaaccttttcgtgcatattttctcgctgttcgcctttgaaagacatgaaacaatgtgccgcggtcagcacatgctgcggtccaatgattgatgccgtacaacagaatttgttgccatcatcgccacaaatgccggcctcgcgggcaaacagtgccaccaaccatggccatttgttgtttgactttaccggattaccgtggctgatcttaatgggagaaaaaagcacaataagtaggcaacatacaataaggccaattataggagaaagatccttaaattgtggaaaatttagaaatttttgtatctgagtctgcttaatcattgttatggttttcgtatattataaagcggattttatctaaaaaaaatctgaaaaaaatgcaaaatttcattttcttaaattcaaaatgctaaaaatagatttaaagattagtattgaataggcaattcaaaaatgttcagcaattatgccgtttttttcccaaaacactgtcaaatgtatgctaggattaacaaataaaaaatttactttaaattgaaattttgccaattctgctgtttcttggtaatatttgtccctttctcgaaatgtgccgcattcgtaagcatttattcggtgcacaagcaccaaagaaaatgccaacaaaaaatatttgtaaagcattttgaaaacaaataaaaaatttttagtaaattatgaataagcaaaaatgaaaatggaagtgtaaatgtgataaaatattgaataaattaaatgtttaatcatcacatgtttttctttttgacaaagcgaccaaatttattctctccattacgaaaatgatttacaccagtgtaaattattacgatgaatatgttaaaaaattttaatataaaaaaaatttttatgaaaaaactgttttaatccgatttataagccgaaaaaaggagagaagaattttataataaactgtaaattgctaagaatttaggaatgtgtcaatgtcaaatttgtaaagaagattttcaaaataaatacagaataaaaaaaattaattggtgtttttaaaaaaaatattttatgtttgtgaattttcaagtagggttcggaccccgcccccgcccccgtccccgggggcgggacaggtttttggggctcacccccgcccccgtgactctgacccccgcatcccccgcccccgcgaacttcgcccccgcgggggcacgggggtgaaaatacacccctaagaatgacatattcatggataaaaggcaaaaaagttatacaattttgatttttttaaccattttgacaaattttttatgaattaaagttaattttattattggtcattgatgtgtattctgttagaaatcgagcttaaatttcaaaattcgccaggcggcctatcggcacctccggccccccaaaaacctattttttcttaaaaaattagccaaaaatctcaaaaatttggtaattctttagacaaaatctgtgtaatttatgccaaaaggaattgaattgaggcgatacattgactaaaggaatgtggagccatcacatcattcataaaaaattaatttt

SEQ ID NO: 1799 - DNA, 1246 bp, Heterodera glycines
tgaaatttatgaaaaatataataatagaatacatttttgatcgaataaaatgtaaaaatatttgaagcaattttgcaaaaatcttattttttggcctttattcttattttgaaaattttgaaatagaaaccctagatttagacaaaaacacacataaaaattgactattctggcataatttataatccttaaatttggtcatttttagacaatatctgtgcaattataccaaaaaagaattgaatcgaggcgatacatcgaataaaggaatatggagccaaacagatcattcaaaaaaaaattttttgtgagattttttggagctaattaaaaacaaacccccgcccccgtccccggtggcgagaaatttctcacccccgcccccgcacccgcgactctgacccccgccaaccccgcccccgcgaaaagccacccccgcccacggggctcgaaccctaattttaaacagtcaatgttaattgaaacaaaggtcccttcaaaaaataaatatgccgaaagcagcccaataaacaaataataatattaaaaatatttattaatgactttgaaggagtgctctaattactgtggtataaaagaattttttttgatcagtttatcaaaaattaaatttagcttgattatttcaaaattttcattgtttttaaaatccgtaatatgttaaacatttgattaaaattactcttcgatatctttttcatgccaattcatgataattgatgataaatgtgacatacttttcttcttaggaaaccagggccctgcgggccctgcgaaagcgccgggggcgctttcaacgctggctctagtgggagatataatttggcatgcaaaaagcatctattggccgctaagcggtcctcatagtttatgaatatgagaatttggaaatgatcgaattttgcctttcatgctcgttttttcgccttttcttactgaacatttatttgcaaattaattttgaatttttcatataaaaaactgatttttgcattatttaaaaaatctttttccattgccccaagcaatcctattgactgacgtttttgagttagaatttaaacataatccaatttgttaagaaagacatgagacagaattgatatataaatgaattaaaatttaaaatcattcgttcataaatatcaatttgtcagaatcaggtggcaaatcacacccaaacacagcattattaataagttccttttcaccattttcctcttcc

SEQ ID NO: 1800 - DNA, 6325 bp, Heterodera glycines
tgtttaaaatgatcaacaaaaagtgtctccattttaacgtacacctgcacttgatcttcgcgcgtgccgtgttcaacaacaggggtcagttgtctccaatctccgccaagaacaaccacttttccagcaaacggtttgtcaacggcacaaacatccctcaggagacgatcgacgtagcgaaggacttttttgctcaacatgcttatttcctaaaaattaaattgtttatttaaagcggaagtgataattacatcgatgatgattagttctacagcgcgtagttgtttcgctcttgcagattcaaacgcaattttcggcgatgaatcatcatcaatgtcattaggcacggagaactgtcgatgtaccgttccaccaccaattagcaacaacgcggcgattcctgtgcttgctgctgaaatcaccgtgccgtttagaagctgaaacaaaaacagagatgaaaatagtcgttatatcatacctttcgcccttgctcattattgttagcaatttgatcaatttctggctttccagcgaggcaccaacggatcagggaattgtatagataagttttacctatttataaataaattattagtttaaagacaaccggtataaaataccacatccgcctgcgccctcaacaaaaaaacatcgtttttcgcccttgccgttaattgagttggaaatttgatcaaatgctgcacgttgatctttggtaagccgtctaatgtgattaaccaccaatcgagctggtgtccaatgtttggaactttcagcaccaaaaaaagcggtcattaatcgcgattcactcaacacagctgattgttgtgaaaaggaatagtcattcggcaacccatgaagaccaatctcactaaattataaacaaattgaaaaacctaaaggagtattacctgcatgaggtatccatacagttgaaatagtattccaaattacgcattacttcgcccttgcgagttgcgagagatatcatttggttatcatcgtcaactccagatcggtgaggcctcatctcatcaacaaagtcttcaaagagtttttgcggatcagaaggacgggcatgaacaaccaacaaagcaaaatagtgttgcagcttgttcaaatccattttgtctgcgcatgcatctcgcatcgcccctacaaaaatgtagtcgtcttccaacagtcgcaaatggatggcagctgcagtgaatgtttttaacacttgcccattaactgtacgcaaatcaacaaagctttttggtccttgtctagacaaaaggagagctcttaaattaaaatattgtttatctaactttatttctggtatagtaacctaattgcaaataattcatgacgctttggggaaaccgtgaagacgcggaccaacatccgcgcccctgcaccctctttcagcggacgttttcgtttgatccaatcgctgtttttctggttccagcttaaatatacaaacactaagtttatgctttaattgtacttactaataaaaatagggcacacgattataagttaattcggaaacagctggttccttcgcacacaatgcaaaaaaagctgttagacgagttttgtttgcaatccttctgcgcccttgctcttcatggccttcttcaataacgattgtttgccctaattcgtcatgtattgaaagctgatagatttgatgagacatggaaacaatccgatacgaattgagccgtaaatatgcttccattgaagtcatgtaacggactttgaacgttgccgcaacctcgtcatagtcgtagacttcttcatttgtagacgcaccgcccctgcgcggctgcataacctttacgtatgctttctcaaacccttaaattcaacacacgtattgttcgaaaacccgacttttaggtataccttttagcaaatatttaaaaatatatttgcacgccttctgaccaaatacatattcgacattaatgtgacagccgtattttaaaagtaggaatggattgtagggtataacacggctatcatcaagaagtaagacgcccctgccacgtttgtttcttttctggtagaatagaccacacttctcctgaagttataatatttgaaaaaaagtataaacattattacatatagtcgtgccggaccactcatattctttccgcgccattccgatggaattcgtttataacgcacttcattacaatcacgttctgggtcgtcctccggaagaaaatgttcagcactgtttaaatcagctggttgtgcattttccgcccctgcaagcagagttgaatcagagaagtcggcaggcaaacgcacataatttgtgtaacgcacttctaaaaataaaacaaagaagagaaacaacaaaacaaactgcgctataaattacctgagagctctgtaaggtcggtatatggctttggaaaatgttttcggcatcgggttcgcccctgctcatcgacctctgtgcacgcagaattgcaatcatgcagcatcattgtagtaacataatgccatagccggcgctgctgatttgcttctattgacatgtcctccattggtggaagcggaggaattcttgcaaacacatattggtcaacactttcaggtgttaaaaccctctcccgttcttccaggataagaagcatatggatgtgtggcatgcctaaatttcaaatgctataaatattttctaaaaaattcaccacgcttttggtgttcaacgctatagcaccatcctgccacttttccaagcacattcttttcaaccaagtcgcgcacaaattcagcagccttatccataaatattctgcatacaatatccgcacgatgcgtatattgttggcgcccctgcaaggcctctttgagttccggccagcttgggtttccggtaaaggtgacaaacctaaaagcaacagagtgaccgatatttcacattatatacctaaccatgttggatttcccaaactccgaacaattgtcatcaaatcagcatatttttgttgatagtactgccttgatcccgcaaaggtctggggcatcaaatacacgcttcccaatttggcattgcgtccctgctgctggagtccttgctcaatggctttgatgtaatctcgagcaagagtttggcggtaatttttacgctgctgaattgccttgatatggtccatctcattgcgctcaattcggttgagaacagcaatgacgaagaattcggccaaacgacgggcaaaccatagccagtggaatgcccccttgctattttctcgtaacgccaaacgatagcggtaaaattgcctctcggaaatattttcctctgaaccggttttcttgataccaagttctcgcttctttgtctgcacaccaaaaacaggttcaaaaacagagtcattttgagcaaccaccaccttaatatgtactataatcaaagaacatgtaaaaaagtttgtacatcattctccacttgccgcccctgcgcactctcaggttcaggctcgttgtcaaattcggtctcgaaatcgttaatgtgttcagactcatcattaacggttgatgcattattttgacttgaatttaaatcagcacttatctaagaggcaaaggaagaattaaaaagttggattggagtaattaataaaaaaacctacattgcgcccttgcaaaaatgccttcttcatgaaccaacgccacccagcagtgccttttggatgaagcagtgggaagcaacaggggtctagctgtggcattccgcttttcaactccctcattttgcccgccttgtcactcagccagaaaccttaaaaacttaattcataaagcaatagtgcaagttttaccattaacttctggagcaaggccgtcttcttgcacccatattacggccacttgcttagctgtgggagcatctgcacgctcgataaccgtacagtcagcacggctacgaacagcatccattttcaggtcacgatcggtcaataagacgatctcaaagcattgttttcctaacacaatttacaaaagcacatagaaaaccaaaaaatattattttatgacttttcattttttctaatagcttattgtccgactgctataaaaaacattatattatttttgggtttttgctatttattataaaaatatttatttaaatagttaatgctttttattgttctaattttgaagatttaaaatattttttattaattttaataagtgtgtgatcattccaaatttctttttatatttaaataattgatcataatcattgctgtttcagctccttgagtcaccgattaatagttttaaatagggttcgagccccgcccccgcccccgcccccgggggcaggacaggttttttgggctcacccccgcccccgcccccgtgactctgacccccgcaacccccgcccccgcgaccttcacccccgcgggggcacgggggtgaaaatacacccctaagaatggcatattcgtgggaaataaggcaaaaaatttagacaattttgtaattttttaactatcgagaaatttttatgaaataaaataaattttacttgttttttattttatttgtggattggtggatagtgcttcaatactaacagtacttttgtctgagttcgattccggctaacgttttcctttaattaatttattttttctgattaatacagggtttctttatgttcttgtttctaagaaatgttctgatttgggggtaatgccttattttcatctaaaactcgcaaatttctgaaaaatttggctaatttgttaacaaattgcattcaaattcaaaaaattttcccggcggcgcctatcggcaccgccggaactctcccctcgcacattcatcaagtttttttttgaaaaatgtgccgcaagaaaaaaaattttaaaaatctgagttccaattttgagtaaatcacgataatttaatatagttaaaaaacgaaaatttatcgaaaaagtcttaatttttttggtgaatatctgttagaaataaatttaaaattcgcccctatcggcacgccccccccccaaaaaaaaattttttttttcttaaaaaaaattacccaaaaatccctaaatttttgttactttttagtcgaaatctgtgcaatttatgtcaaaagaaatagtatcgaggcgatcaacaaataaaggaatgtggagccaaagaaatcattcttaaaaaatatttttttgtgagatttttggacctaattcaaagcaaacccccgcccccgtccccgcgggggcggaattatcgtgcccccgcccccgcccccgtgactctgacccccgcatcccccgcccccgtgaaaagccacccccgccccacggggctcgaaccctaaaaaacaatcaaatcgaaaatttttttgttgtgtctatccttgcttaaaagcatccatatttttaattcttgattaaattcaaatttaaatagccctatttgttctctattatcatgcaaaaattcaaaaaaattcgttagtttttcaaaaaacaaaagttatgaccgaaaagaatttaaatgtgattttttaagttcttatagtcataacttttttgagagttaatgaaatttttgtaatcattcaggctaataaaaaaacatttagggtatattaaaaatttggttaatcttgagcaaaaataagaaaatcttaagaaattaaaaaaaaaatccttttggattaacaagacaaaatattaattttaattaatgttttagaaatttacatttcgaaaatttatttaaaaaaataataaataatttcacattcaataatttatttgactttacattagaatgttgaatctataaatttccaaatttcttaataaattaattaatataaaaaaaaagaaataaaattaatttattcattataatgagaaaaaatataaatcaattattccattcaataaattcaaggaatggcaatttttctcttaatatgtgcatataataaaattatatttctttcacattataatgtttctgtgttaaaattaggggggttttcgccagatgctaaacaaacaggaatttaccgttaattcacatttcccattttccaaattattttccatttttgatccttttaatttctgaaaaaaaaactaaatttttttaaagaattttaatatcatgtattcttccttcccgtcaaaaatacgcaaaattctgctcctataatatgtcattctattatagtcccgggggactctatttttctacccttctctgagggtgggaggatttattggagtgggatggctctaaaggagggggggggggggggggggagatctgt

SEQ ID NO: 1801 - DNA, 9576 bp, Heterodera glycines
  misc_feature (6)..(6): n is a, c, g, or t
ctccgnctggtcaagcatagtcctcctccaacagctgcaaaacagccttctcccgtaaaaactacgcccgcgtctaagctaaagcccgcgaaaacggttccaaaaccaccaccacctcctcctaaacaaaaaacaccaccaaaaccttcaccgatacttgagtcaccgcctcggtatgaagaatcgaacagaacaattgtaaagccaccagtcatacaaccatctccacctcatcttgaagaagcgaacaaaacaattaccaaacagacgacatttgatactactgcaaaagaagtgatgccgacagagcctgttgcagctgctttaacacaactagcagatttaccagaaaacaacttcagctttcgaatcaatccgctcccagttgtgccccgctcagtatcgattcaataccttgatgatgttgaacgttttaaagtttcattcaatgatcggttgatacgtcatttgtcattctcaccgcagttgggctatgtgctcgggtttgaaaacccgcagcacgtggtgtctaatgaggtagcaaaatatccggtggatttgcgaggcggaatctcgagttttgccgtttactcaaaaggactaactgagaatatgattgttggaaattcgctgagttcactgctccgtgttgtgtcagtcagcggtgcaacacccaatgactacaatgagaaaatttacgattcgcccatttttgcgcgagtgctgccacgggagatcaacgagattgagattgagctgcgcacaatggacaagggtcgcctcgtcccattcgcctacggcacgacgctggtcgtgttattatttaagaaagtgataaatttctgaaaccactcattttttgtattcattcattcattgaacgtaaaaaataaaatggttcatattgtgtttgaccctcgcagtgccgggtacgacgagtatgtgcaatacggtagcggaatagaacacgaacatcacttcattgggtccagtccctttcaacgagggtatgggcagcggggagcaggggttggagacgtgtttcgcggtctttggcgcttttttctcccaatcctccgccgcgttggcaccacggtaggatcggaggctctgagcacgggtcagcgagtgttggagcgagtcgggaacgacggaatgccacttaaggaggcactggtaagcgaaggaaagaaaggaattgataccgtactggagaagggaggcctaccaaaacagtttggcagtggtggaagaatgggtataaaaagaagaagaaaacacgcaccaagtcaccatacaataattggccgaacaatcagtaaaccagcaagaaaacgtgttcgatccgacgcatttggactttactaaatggcattccacaaaattgacaatgacagtgtgaactccatcaccaacgccttggactttttccgcatcccgccaaccaacgtcagtgtctcatcctccaaagtgtttgaactgctcccaagtaaccctctgacggacaccccctatcacttcaagcttcactccagccaaaattatattgatctctccaaatgctatttgctatctgagtttcgaattcgtaaagaaaatgcaaatggtcaactggttgacctcgcagctgatgaggttgctccgattcaactgattggacacacattcatccgtaacatcaaaatgagcatcaatggccgtgaagtgttcaacgcaaattctctgatggcctacaaatcgtatttttcacacgaactctcctattcaacagcggccaaggactcgcatttgaatgctgccggttactaccgtgacactggtggtgtgcttgaggtgggagacggatgcactgcacgacgcaacctgtttgtaggcagcagaacagcacaattcatggccaaaattgacgccgatttgtttaaccagcctctctacttgatcaacttttgtgagctggacattgaaattttgcccaacgacaacgaatttgtcctaatcacaccacccggtgttgctgcagccactcgctaccatttcgaagttgtcggtctgaaaatgtatgtgaagaaggtgtccctgatggacggattggcgttggacattgcgcgaaaacttgagttgaaaccggcacgatatgcagtgaggaaaacgctgatgaagtcgctgttcatcagtcatgggcgttttgaatttacgtctaatttgttcatggatcaaattccccggcgcatcacaatgggattggtggccaatgctgactatgttggcaccgtttcacgcagccccttcaactttcagccatttaatgtgcgtgaaatttctataattgccaatgggcgctcctaccctcaagcagcctacgacttggactacccaaacggaaagtatgtgcgccccttcaacgacatgaacgaagcggtgggattcgccaactcatcggaaagcaacgggattacactagcacaattcggtactacgcattgcatttacgtgttcaacttgacaagcagtggagacgaccaagcgacgctttttgatctgataaggaacggaaccacagcagtgagcatcaaatttaatcaggcggtgcccgctggaggaataatgctggtggtgatgggcgagtgcgactcgctggtgatgttggataaaaatcgatcgatcagcactgacatcactatttaaggcacacttattttcattttttccataacgataaacatgtattccaaaaaagttggcgtcattttattccttcttcggatttctcttcccgtagtgtcatgccgagaggaaattcctgagtattcagaatatataagaagaaaggcaatgcttacatcgacaacaactaaaacaattccgtctacaagcacaccaacaacaaccaccacctcctctcccccaaaaaacgacaagttaattgaagagcaagtgtcagctggtctcacgccactcatccaattgtgcaaagaccgaccagaagaggaaaatttttttcagcaagtcatttgctgggcggtgtttgcattgtacttgatgcttattgtcagcctggttctccatcaactttgctctattttttggctgaagaatggacagcgtgcaaatcacatcaatcttgaacgaaaaccgggggaccgcacgagtctttcggggctgcttcgccagtgatcaattaccgcctccggtcactctacagtatcccgcagcgctaattgtgaaccgggacccacattacaagggagggtctcattggtgtgcaatttatgcgaagggaatggaagaaccagtgatttattatgacagcttagcccaaaaaataccatctgtcattgtgtcatcattcctgaataagtttccaatgggcctaagaaaaaatattcgttcctatcaatcccaattagtgtcaacgtgtgccccacattgtattgtttttgtgtatcatatgtcacaaggtcattcatttcaacaatttattgagaaaatggaaaaaaccgacaaattccgacatgtatgtaatgataatgatgaataaattggtcaagtaaaatgcttagaaaatgctaaggaaaaaatgcaaattgtcaggctgactaagctcagggagaattcggacatacccagcatactttttcaagtgtgggttgaacagccaaaaaaattcaaaaccatcacttcggacctccggaaaaaagccatgagaaagcattacgttcatcggttgttgcagaatccacggcaaatgttgtcggaagaaaattccacagcaaatgggtcgcttcatgtgccaaggagttggtgagctcattgcaaaatcgagcagaagcccaaacaaattcccaatgccaattgactaaaaattttgtgttgttattaaaaatttaaaacttttcgcttacatttgttgcttggctcatcacaaaataagtctcgaacaaattcgttcccagtcgtccgtagcacaggtagtgcaggagctcatttcggctgaggtcatgcggcagttcttcctgtagaagcagtctccccactttcttcttcttcggtgtccttttctcctcaaacatcacatcgaataatgcgataacacccttctataaataatttatgtaataaaataaaaatggtgaaaataccaaatattcaaagcacttttggcgttgactacggaaacactcgaattggtaacaaacaggaccaattggagtccgcttcacattggcaaataggcagactaatggcacaaaactgatcagctcgctgttcaattcagccggcaggcgtcgacgaagtttgggctttttctcattcattggaaggttcaaaggattagggcgtttcattttaaagaatttgaataaagaatgatttcgatttcttgctgggaatcatttggtggtgcgcaagtgggcgtggccaaagtgcacacatcgtacacccggtcattttcccgattcattttaaaaattttcatcttttttttttgcacatctgctgttttcctctccgccctcacttgtcctgtgctttatggggaccgtatcatttaattgtgattttgggaccgtataattaaattaatatttttgctgttaaccagggcggtagctataattacaaaaagctccgtttatcctggcagcaatttgccttttaaggcttgaggtcgttcgcttgacttgactaatttcccgagtcgtttaggtgccctgtcgtcttgtgcttcatgggtggcggtgtgctgctcttcaggccatagtttgtttatgttttttgaaatttttccatctccaaatgtttatttattcattcatcatttcacgccattttccatgccggcgctcgcatataaataccgagattttactcattcctcctcactccactctcagattaaaaaaatggaaccacgaaaacgatcctctaacttttccattgatcatattctctccgcgcccaaaaagccccgtcaaggcttcctgatcaatgaactcttgggtgtcgtgcacttccttggatcggtgcagcaaggcgaaggaacatcaaaagaggcaaaggactacgttaaaaaattcggagaacaacatcgagcacatggccaaattccactacgtcaaaatcaagtcaaaattcaccattaccgacttgccgagtacacctgaggcactgttggctgggattttccaacactgcatcgacgaagcaattgttgaaagccgtgagcgcaacatcgaacctacacacctcggctgtatgatcagcagtcctctgctggaaggcggcgacatcccaatcccgatacgacaaatgacaaacaacactctcgacaccattctcaaccagttcaaaaaagtggcgcagtcaaaacaacagaaaaatgtgtcattatggggggagccgtttaccgtcaccatcacgactctcgaccgtaatggactaccatccaaacgtcgtgtcaaagggggagctcgtcgccctgtcaaaacggccgttcaccaccgaattaatgaccaatgcctgattaaaattcgtaataacgacaaccacttctgccttttctacgcgctgcaggcaacaatggtcgacaaaacatgcaattggccacgatggaagtttttggactacttgcacgacagacacggacagcagggacaactccatcatgatactgttaagctcatgcagcaggtgaaagcaccaatggatttggttggctacgacgcggacacatttgtgcctcacgtcgttgactactggaacaacgcgcagcgacaacaccgctttgctgtgttcatctttggatcgttgggacagtataagccgctgtacaagtacattgacaacatctacgacactccgctgctgttgtacttcaatgaggaccatttcgatggtgtgcagaagcagggtggtctgttcggtcaaccgtactgtttggagtgtgaacggccatacgacaaaatgtcaacacacaacaaaacatgtaaagcgcgctgtgtgctgtgctcacgtgttggaccagcttttccatgtccatcatccaccggcttcatcaaaaagtgtaaagagtgcaacaaaaaattcaccaacaacggctgctaccagcaccatctgcagtcaggcttctgcaagcggtcgaaaaagtgcaaggattgcggtgctgtttgggatgttgtcaacaacactcagaagggcagaaaagggcatgtgtgtggtgaacgcttctgtaagatgtgcaacaactaccacaacacggaaagaggctgtttcatccaacccattgagcccaaggaacgcgacccctaccgcatcgtggcatttgacttggaaaccatgcagcacacgccatctgtaaagcctgagaagcgtgagcatttgccgaatttcatcgcagcacgagtcgcttgccccgactgcattgaaaatgagagctggcgagaggcatcgggagggtgcgaggtgtgcgggccaaacagaacagtcgccttttgtcaacgccgcttcactgaaacaacagtcgacaagcaagtggtggcggaaaacccattggaagcgtttgtcagctggctgataaacgacttgccgttggcctacgacacctacgccttctctcactttggcggccgctttgatatggtgctggtgttccgcgaactgttcaaacgcggatataacccggacatgttgcgcaaagtaataattgactattttccataacttgtgtataatttttctattttcagggaaataaaatgtacgaaatgcggattcgaaggcagaagaagcgcaaccctaacattgttttccgggattccttcaatttgatgccaatgtcccttgcctcgctggttccatcatttggcttggatgtggaggacaagccattctttccgcacatggccaaccacccagacaactacggaaagcagatccatccaacaccagacgactatttggtcaagggtatgatgccagataaacgacaaaaattcgacgactggtatgaacaacaccgtcaggaaccattcttcctcgacgaggcgttggcaagctactgcaccaacgacgtggagatactgatggcggcgctggtggcttttcgtcatgagtttttggatgtgacgaaacgaaatgaaggaatcgttgcggagcgtgcggccttctatgagcaccacgacggcattgatgtgttgcgggagtgcatgacgatcgccggcgcatgtatgaagcattttcgcaccaaccatctgccgaagaagcacttggctatcgtcccggaacgcggctacgacaacgcacaaaaccagtcgttgctggcacttcgcttctttcattggcatgcggaggagcatggtgttgtggtgcagacggcgcattcggctggcggagagaagaaaattggccaatattccgtggatggctgggtggaggaagaaagaagagcaattgaagtgaatggatgcgtgtggcacggctgcaatgaatgcttccccaataacaacatgatgatgccgaatggaaagacagctggggaggtgcgagagcgggatgagaagcggctggaattcatcgaaagtcaagtgtcacgagtggatgtgtactgggagtgccaaattaaaagaatgctgaaccgtgacccgtacatgcgcgaaagttttggtgattatgtggatgatggcccgttggacattcgcgaggcgttcatgggtggaagaactggaccactaaagctgtaccacaaagcgggagagggcgagaaaatctcgtactatgactttacgtccctctacccgtacgtaaagtgagttttgtttcgatcattattcacaatttataattttttatttccagcttctccaccacttacccgattgaacacccaaaagtgctcatcttgaatgaaaatgtggagtggacaagcgcacgcgacaacccctacaaattgtcgttgctcaaggtgtgggtgattccgccgcgaaagtgtgatgtaccagtgctacccgtcaaagtcaacaaacggctctgttttccgttgtgcatgcagtgttgtctagactacccgaagggaggcgttgattttgactaccattgtgaacacgacgaccaacaacgcggatgggtgacaacatgcacatcaattgaattggacgcagcacttgaagagggctaccgcgtgaccaaagtgttccgggtgctgaagtacaggcatggcgacgacaaacttttccaaccatacatcgccgagttcatgtcgcagaaaattgaagcttccggatttgacgccagcatcaagggaaatgaagagttggagcagcagttcatcacagaatgtgcggagaaattcggaatttcaatcgacaaggacaacatgaaagtgaacaagggcaagcggtcgttggcaaagctgtgtctcaacaacctgtgggggcgcttctctctgcgcaacttcggcctcgcccagaccctcatcaccgacgacccttcagtgttgactgaatacgtggaaaacagctcaatcgacatcatttccgttgatgagctagacgaaaaacatcaattgatcagctacgtccagaaaaaggagtgggtggaggagcacgagtgctccaatattggtgagattttaaaatgccgcctcctctacacggacaccgactcgctgattttcgtccacccgatcggcatgaatccattggagacaggaccaaacttggaacaattcaccgatgaataccccaagcatgaaattgtggagtattgtagtggaggagcgaagcaggttaatttaccgtttatttagtgcataataatttatactttatcatttcagtatggactcaaacttcggcgtaatgggcaggacgaatttgtgctgaagctgaggggcatcacactgaactacgacgtgatgcagaaccagtccctatgctacgacacattcaaagaagaagtgttgcggtatgctgaaaccggagagtatgagccaataaatgtgatgtaccccaactttttgagaccggacattaggggtggcggacacgtcacttcaggccccctccaaaaatgttatcgcccatatgtaggcaaagggatagtgggccctaattatgatgttctcaatttcggacacattttgtaaatttatcgtttatcattcattgtatctctcacatacacataccccatacacacatatacacaccccatacacacgtacacacgcatgtaccacctttgtttttcatgttttataccaaaaattgtgtaattttgtcattttatttgcgtttttaataaaaatacatgcataattaagcaatggaagttacaatttgtaaattattaagcatttgggaatgtcatttttaggtagaaaagtgcagaattaagcgaaagaagacacaattagtaaataattaaggagtggaagatacaattttaaaaagtgcacgaacttgtcatttttaggtagaaaagtgcataattaaggacaataacatgcatgcataattaagcaatgcaagttacaattagtaaattattaagcatttgggaatgtcatttttaggtaga

SEQ ID NO: 1802 - DNA, 1741 bp, Heterodera glycines
  misc_feature (1714)..(1715): n is a, c, g, or t
  misc_feature (1724)..(1724): n is a, c, g, or t
ttcagtgttgactgaattcggtggaaaacagctcaaatcgacatcaatttccattgatgagctggacgaaaaacatcaattgatcagctacgtccagaagaaggagtgggtggaggagcacgagtgctccaacattggtgagattttttcaataatttttgtataattttgggatttttcagtcatctcactctggactacatcaaaggcccgccttctgctgttgaaagcgatgcagaaggtggtgagaacgcctggatgccgcctcctctacacggacaccgactcgctgatctttgtccacccgatcggcatgaatccattggagacaggaccacacttgggacaattcaccgatgaatacccaaagcatgaaattgtggagtactgtagtggcggagcgaagcaggttttcaccttttaataattcataatttatactttatcatttcagtatggactcaaactccggcgtaatgggcaggacgaatttgtactgaagctgaggggcatcagtctgaactacgacgtgatgcagaaccagtccctatgctacgacacattcaaagaagaagtgttgcgatatgcccaaaccggagagtatgagccaataaatgtgatgtaccccaactttttgagaccggacattaggggtggcggacacgtcacttcaggccccctccaaaaatgttatcgcccatatgtaggcaaagggatagtgggccctaattatgatgttctcaatttcggacacactttgtaaatttatcgttcaccattcattgtatccctctcacacacacacaccccatacacacgtacacacgcatgtaccacctttgtttttcatgttttataccaaaaattgtgtaattttgtcattttatttgcgtttttaataaaaatacatgcataattaagcaatggaagttacaatttgtaaattattaagcatttgggaatgtcatttttaggtagaaaagtgcagaattaagagaaagaagacacaatttgtaaattattaaggagtggaagatacaattttattatgtgcacgaacttgtcgtttttaggtagaaaagtgcagaattaaggacattaacatgcatgcagaattaagcaatggaagttacaatttgtaaattattaagcatttgggaacgtcgtttttaggtagaaaaatgcagaattaagagaaagaagacacaatttgtaaattattaaggagtggaagatacaattttattatgtgcacgaacttgtcgtttttaggtagaaaagtgcagaattaaggacattaacatgcatgcagaattaagcaatggaagttacaatttgtaaattattaagcatttgggaatgtcatttttaggtagaaaagtgcagaattaagagaaagaagacacaatttgtaaattattaaggagtggaagatacaattttaaaaagtgcacgaacttgtcgtttttaggtagaaaagtgcataattaaggagtgaacatgcatgcagaattaagcaatggaagttacaatttgtaaattattaagcatttgggaacgtcatttttaggtagaaaagtgcagaattaagagaaagaagacacaatttgtatataattaaggagcggaagttgcaatttgtataaacttaaaaacgaatttgtcgtttttaggtagaaaagtgcataattaaggaaaattattgtgtttaccnnataacgtangatggttggctgcattc

SEQ ID NO: 1803 - DNA, 2443 bp, Heterodera glycines
cacacacacacacacacacacacacacacacgtacccacacatgtaccccctttattttctctattttatacctcaaattatgtaattttgtcattttatttgcgtttttaataaaaattcatgcataattaagcaatggaagacacaatttgtaaattattaagcatttgggaacgtcatttttaggtagaaatatgcagaattaagagaaagaagttacactttgcatgaacttgtcgtttttgggtagaaaagtgcataattaaggacattaacatgcatgcagaattaagcaatggaagttacaatttgtaaattattaagcaattgggaacgtcatttttaggtagaaaaatgcagaattaagagaaaagttacaatttgtaaattattaaggaatagaaaatacaatttttattatttgcatgaacttgtcgtttttgggtagaaaagtgcataattaaggacattaacatgcatgcagaattaagcaatggaagttacaatttgtaaattattaagcaattgggaacgtcatttttaggtagaaaaatgcataattaagagaaagaagttacaatttgtaaataataaggagcggaagttgcaatttttataaacttaaaaaacaaattgtcgtttttaggtagaaaagtgcattattaaggtaacatacatgtgtttaccaataaacgtaagacggttgactgcattcgtagcgaccaccaccatcattgtcgtcaatttcttcgacttcctcaactcgaccaaggcgtttgacaggaatgaagtcatcttcaatttccataaacaatttgccaagccatcgctctttgttggtgtagtcctcatccacaatttcgagtagctccattgggtagtatctgtcttcgccactccagaagtatttctccacaacacatggcacgtacgggagatgcagcttgatacggtgccgagcgtagaaatgggcagcaatgttaatgttgtatggttgtcgaagtctgccgtatgctggggtcaaagccgctccatggtccgatattccgtcgacaaaaaatgttttctgcattccattccggtcctggtatgtcgtccgaacctttttccgaccagctccttcagtgccttcactcggtcctcaggatgattgagcttgtcgcggagtgatttcggggaacagccgagaatttgggcacaaaattcgatgacaaggaccattgtagcagaacaaatgagacatagctgacaaattgctggggcttttatactcccagaaaattaggccacgcccacttttgaaagctatttaagccgagattttctcacacaatcaaatcattcttgcaaaatcatcatcaacaaccatggcaaaacaatttgtacaacatgaaactgcggaggagcaacaagtgaaagctaagaagccaaacgttgatgagcgatttctttggaaaatcacgcggggccaatttgtactagcgattcggctgtgctcaggttaatcaaaaatttttgacgaccaaattaattgacagctttcagaggactggaacaatttatttcacaacaaagacaaggcacgtcggctggaagatgggcgagtggcgattggactcgagatgtgtgaaaaatgtgcccgaatcaattgctgtgtcagtgacatgattgctgatcaaaagaaaaagccaaaaaccaccaaataattcatcaaatttttcgcattatttggataattttgactaccaataaacatttttaaatttgaagtgcagaagcagatgtggggagtgggagggttcatgatcgcgcgcctcctcttccattggtcacgccattccgcataaactgctcatttcaattatattcccaaatccacaaaaatgtccccatgccgtcgttttaaatctcgcccccagaaaaaaaattccgaatataaatggcttcatattgtgaagcgtcaaaacagcagcggcaccaacaaaaccatttcaatgaaatgtgcgtggcatttcagagtatggaaatgtcggaatcggcaagacccctgcctggcggatcaataaatggaccaaagtccttcggtagaacaatttttgatatgcattttcagttcttactgtaatttttaataattttaggatgtgcatttctgaaagaagaaatcgacaaacagatgacgaatctgattttcacaatcacaaaaatcgaagagcgcttaaacggactacccgacccgcaagcggcgcacctttatggaatagtcaaggagcagctcgaaagaactattcgtcaaattgagaaggactgcttgtgaatcggtattggtgaagggaattattttggtggtgatgggattattttttaaaataaatctgggaaggcacaattaaacaatatgtttattgaatttagcaaaaaaaaaaaaatatgcatatgaaa

SEQ ID NO: 1804 - DNA, 1854 bp, Heterodera glycines
  misc_feature (1660)..(1660): n is a, c, g, or t
tacgataaatttatttatttaatatcaatttcaaagaaacacttgttcaaaagcaagctaaatttttaaaaattattacttcaagaaatttcacatcgtttcgaaaattctgatgatcgcaagattgtaatttattcttcaaaaactttcaataataaaataattatatcacaaaaaagtaatttagcgatatgtttacaagtgtcacaaaaaacaggcaaattgaacaaattgaaactaacaagatgattatctaaatgattttgagtattgaaaagtaaatttaataatttatttaaaaataattttaacaaaatttaatgtatgatttatcaaaacagttagattttttgcaatgtaacacagtgactttgcaataataaataataccaatgtagttaaaatattcaaaaaattcaattttaaattaatttaaatttcaataattactattttgaaaataaaattctattctctatctaataaattgtatgaacactgaacacaataaaaatgattaatttagaataatccgacaataaaaaatcgataattttacgagttaaaaaataaattaatattatggttcactttgttacagcttttggcaataaaaggcaaaaaattgcgttatttaattaagcagaattaattttgaatttaattcattaaataaatatcattcagcattttttgaaaaggagtaaaaactaattttttttaaatttattaataggaacctttttttgaattttatttaaaattttaacgatttattattttatttaataattagaaactttaatctacagacaatgaaattatgataacaattgtaaaatgactaaagctaaattttattttaacttattcatttaactgatttacatttattgattactaattagattcatttttgtatgatcccctacatttgacttcattttaaccaatcctttatcaattcctctttctcttgtccgaaattagcaatgatgtcgcagaattggaaaaaggtgcgttttattaaaaaaataaatttacatatttataaacctgatcatctcatcgttaatattcgattttacgactgaattttaatttacattctatttgattggttttatttaaaacataaatatttttaattcataatcggtaatctgcatgtatatgttctgtctaatttctgaaattcagcattcttgatcaatgaagattcaatcttggaggcgtttttctctgaatattcattttcgtggatttaccagaaaagttcagagaattattgtttattgaaattcttcaacagtaacggtttgttcaaaataaaatgtatttagcattatgtaatattgagaaatggtatgagagaagaattatttctatttaaaatactttatattatttatacaatttttagtggcatatatatgcaattagagcttaattcattttttcaatttgtattctttatttataggtgttttttctttatttttagtttagatttttaggccaaattttttattttttacaagaactgctttagtcatgaaaatattaccatgttttaagtaggctattaattgatttataatttgtcatctttagcgtgttggatttagttttcccagttatatttttacttttttcttanatttctagttatcttgtttattattaaaacataaatttgttcaattgacccttgtttgtgatagttttgagcattttgtctaataatattcaaaattatttacaaaattcataaaaagataatacacccataagaatcgaccctaaatttgaaaaatatccatacgaatgaaaaaattacttataaataatttc

SEQ ID NO: 1805 - DNA, 1554 bp, Heterodera glycines
ttttacaaaaataaaagtcttcaacaaataaaaattttttgaaaatagtttaaaaaactcataaaatattaattttaaaaaccaaaaataaaagataattttataatggagttactttatgtgaaagatggtaagacttggattcaaggggtaaagcaaaaatacgtttaatgattcttaaatggtgtataattaataggaatgaccattttttggcgtaaacccactagttcatggtgaaatgcatttttttcaaagtttaaaaatgtgttgttaaatcttaagttctttgcaataatcctttattttttgcttatatacaagtatattattatttttgctttaaaatggatcacaataccttttggaatagaaaaaaattaattcaatatatgggaacagaagaaaaagttgtgaaatggggttcagaccatgggtttataccaaaaactgctttttgttatgggaaatggcctaaccaacatgcaaaacaagaaatggttttcgagaatgagggcaaagtagggaatttccgatgcccaaaatgtcgtaaaaagcaatcactcttaattaatacatggtttgaaaattgccacatgcccctttctaaaattatgaggtattttaaattttttttaaaaatagattttgccaattttctatttagtataatgtactcctatgcgcacgaggagtcttacgaaaaatgcacaagggaagcagttgaaaacgaaaacggcaccttgttaggatcagatactattacagcatggttattttttacgaattcatttttattaaattggaatattaggtacaaatattgtcgtgaaatgattgtcgaccattacattgttagggagggtgagcgtgatcaaattggcggcgtaaataaactagcacaattggacgagagcaaattcgggaagcgcaagtataatcggggccgttgctctcgccccactacttgctccgtcttcgaatgctcccttttgcgaagttaaaaataaggttaccattatttctaaaactaaaataatggttttcatgttaaggaatgatcgaatacggatctgaggattttggccttgtggcttgcccggaaaagattgattcgagtgcggatgttctgattccaataattcaacaacacatcgcgcttgggaccgaaattcacattgattgttggcgcgcctatgctcgactgactgagtttggctacttgaacaaagtcgtgaatcattcagatccggaaaatcgtttcgttggtatttaaataaaaatgttaaattaggatttatttttgtaaattttatctgcggatggcacacatacacaacgtatcgaggcgagttggaggcccgcgaaggactggtttcgtgagatacgactacctgggttccattttgcagaaactttggtcgagtatcaatggcgccgggagctcaaaaataataaattggatccattttcacagctccttcaatctgttcatcattattacaacaaaaatatttgaaaaattttgtatatattttttttaaattttgattt

SEQ ID NO: 1806 - DNA, 1259 bp, Heterodera glycines
aaagaccaattgctaaagaaagtatcagcgaaaaatgaaaaatcaatccaatttttttgatcagagaatggagagatcgattttgaatttgtcggggccaaagttcgccacaatttcatcaccttcaaaatacaacgaaacaaagggaaacaattgggttgcatcagatggagaaattaacaaattggtagcatctgcaaaagaaataattaactaattaatcaggtaattatttttttgcaatccaaacgacgtccattattcatggattgaagtcattttgatggaggaacaaaacggagtaaaaatggaaaaataaattaaaaaaaataaaagataaatgaatttgtaaggtgatgtcgaatgcagaacagcaataggatgaaagtgaatgttttatgacccacggataattggcgacgaatgtctgcgaattcgtaaaggttattttaatattgagaaccacttactctgacgactgttcagataaatgtgtcgtagagtaagtgactaaataaatatatggatgatcactagggctgggaatttaagtcactaaaaatcttcaaaaagtcgactaaaaaagtcataaaaaatcgccaaaaaatcacaaaaaaatcataaaaaaaacacaaaaaagtcctgaaaaatttggtgaaagttaaagaaatccaatttaataacattttgatcggattttttttattgccttttcaccgatccaaattttatttttcggaattttctttgatttttcgccattttctttgatgagtttccaattttgcctcaaaaagtcaaaaaagtcataaaaaatgttagagaacacttttgaagtcattttaaggctatttagagcagcaaaaaaaaagtcatttgacttaaattcccagccctaatgatcacaggaattaaaggcaaaaatatgtgaataaataataaaaaataaaattaaggtctagtcttttagcatagttaatgcacaatacattttcacaaatgcgtcaccgggaaaatcttggtcatttttcggaagccatcgcaccactttcggggcaccataagtgcctgatccggaacccggaccggcccggttaagaacaaaccaatgccggacggagtcatcgcattcgacagcttgacaatttagtgagttaatcttcaaattagataaaagaataagaagttatttatcggggcatttctactcataaattaataaactctttcattcccccaaaaatcttacttgttagttt

SEQ ID NO: 1807 - DNA, 1614 bp, Heterodera glycines
  misc_feature (32)..(32): n is a, c, g, or t
aatgatcatcctataatatcgccgttaagaancataaacgtattttgcttacacctgaatccaagtctagcctgaactagtaataagcaaaatattagtaataataaaagtaatttaaattcttttaaatcaagtatttataataccaaagataaaaattttcaaattaaccataataagggctgaacatctcgcataagccgaagagaatggaaaactcattgagagaaggggaaagatgttcttgaattaaataaacgttatgcctcactgccccgccgtacatgcagtatcccccgtcatgggaagccatggcgaagttttaatcgtttaaaaaaagcatattaataattaaaaagtttcaccaaagcgattataaatatggtatcatgacaattcgtacaaaaggcaactcgtacaaattggttagcaaatcatttgaaagtctaatctataactttccataaacatactatcattcaatcattttaatttatttctaaacaactacatactattaggttaaattaattaatattttcacttataaaacgaaaaacaattaaatattaattatacccatttatttgttttaaattttttgttacatttcatttttactttaattaatttataagtcagatatgtagattcttttaactattttattatcaatttcttgtaccatggatacatactcatttttgattcgatcaacctgccatgccaatagacaccgccgagaatttataaatagattagaataaaaatattttgacagaatttgaaaattaaacttttatcatacaattgacatttttattttcaaaataccgtttttcaagtacaacattgtaaataagtgcagttaaaattacccaagcatgaaaatcaaaatttaagcacgactttgtatctatgtccgaatcatagcactgtaaaaactataagaacaaataaaacattttaaattttgtatgataataaatagcttggtataagggctttctgtctgcaaattattatgataatcaaaaaagctttttaaccgggttttctttctttaatggaaaacttaaaataaaaaattggtttcaataaataaaaaaagcttctcttttcttcgatactaagagtacaattatagtgatttaaaagtatataaatttaaattttaaaatttaaataaaatctatatccctgtctaattcttgttagagatatatgatattcaaaaaattaaactatcgttaaaagaatccaaggcattcaggaagtattgttgaccgcaatgtcgacaagtgtatcgaactgaagcatatatatttaatagcaaagcggaaacacaacatttattaataaatcaatttacatttttttgaaacaaaaaagtaatataacacccaagcaaatagataatgcataaaagcattaaaataaacactatagttaaaaaaaaattaaaccaaacaaaccactaatttaaaacgctaagctataataataaattttaaaatatactttgataataatactttctgttttaattatttagggtgggacataatttttgatacccaaattttttttattaaaatttttttttgaaattca

SEQ ID NO: 1808 - DNA, 6196 bp, Heterodera glycines
tgttaactcaccccattctgtacgcgtgctcgtaaagtgaccacaatacgtcgggtgtcccagtttattcggtgtgaaaaattaatcaagcaaagatcttcgctccaaaattctgaactggaacggtggtgtgaaagccgcgggacaattgggcggaaggtatgcggaaacatttgcagataatgtgccactgcttgccgaggaacattgaaccgtcgcggagacacaaaatggtggagaaattgaagcggcgggcggaggggccgtggaacacgcaaagcaggacggaacagacggtaactctgaagttgttgttgcacatgcggtggcagctgatcagcaacaacactgtacatagtgttgatctcggcgttgtcgattacctaaacgtatgtttaaaaagcattatcaggctttgttggagtgttaaagaatttgaatttggcgcccatcgattattgattaatgttgtgacgtgtcaatccctccccttattcattttgtttatttaagcactccttccttccccactttgttccttctccattcatttgctattttacattttatattttgtactgcatttctcctccgacataaattgtgtttattattttattgtgtgtccaaagttgagacacaacaattggcgcagtcagcagccgtgcttcacccattcgaagacacaccgaactgcaacccaacctcaacaaaaccaatagtcccaagacgggtgaggtccgctaaatttagcggttaaattcgacaaaaaccaatagaccctaggcgggtgaggttccgcaagacgcggttttcttcaatttcgacatccaatagtccctaggcgggtgaggagccactctgcgtggttaagtgcgatcgtcggacgagtcaaagccaatggacgccacccaactgcagcaagtgcttgatgcagtttttgcacgatttgccagaaatgcggcacctgcaaacgcggcctcatcttcattggcacacgcgactttggcaagttcattggacaaccggatcgccaaattccattacgacacggaatgcggcaacacatttgaccggtggtttaatcgatttggagtgcttatcgaagaggacggaaaggaacttcccgaagcgaccaaagttcggcttctccttggaaagttgggcgacgacgaatacagcaaatacagagacagcattagcccgacccaaccggaccaggttaaatggggcgaatcgctgacaaagctcaaggatttgttcgccgaaacccgctcacttttcgtccgccgcttcgaatgctttcaaattcgacaaaagccgagccaagacatcacatccttggtggcacacatcaacgccgcttgtgaaaatgccgacctcagcttgacgaaggagcaacttaagtgcatcatcctcgtgattgcacttcgcgacgagcaccacgatttgcgccaaaagtgcctaaaaatgctcgaagaagcacagaaaaacggcacgcaaatcacgctcaagcaaatcgaagaggagttaaggaccattcagctggtgaaggacagcgcactcactttggcaaatcctcctgttgcaacccatgccattcacacccggccacaacagtggagggacccgaaaggcaaaacaccgcaacaacccaagagggccaacaatgccaaggagcaacgcgcacgtccaccaaacaccaattacggcaaggcaagccgcggatcaccaactcatccgtgcggctcatgtggagaatcggatcattggcgtacggattgccgattcaaggacgccacatgccataaatgccaaggacaagggcacattgcaaaggcatgccgacgcagctccaaccaagcgaaaaatcgcagagagcgatccgtccacactgtcgttgtcaaatcccactgcatgggaattggaaccgcagcaggccgctggtggcgactcacgttcatcatcaatggaattaagattttgataaacatcgacactggtgctcaggccaccattctcacactcaaaacgtggaaaaagctgggttctccaaaactcgacaaagccgacattgaaacgcggaattgtaatgaagttccattcaacgtcgaaggaaaatttgtctgcaccgtttgccaaccaaatcaagcacacaaaaatttggcctcaaatccaattggaaaagtgcaaattcctccagcccgaattgctatttctcggccacgtcatctctgcgaaagaattggccccgaccccggacgatcagaagcaattcgccaaatgccgccaccacataacttgagcacacttcgctcattcctaggcgtattgaattattatggaagatttattaagtccatgcgcgaaatccgcgaaccactggaccaacttctccgaaaagacgtgaaatgggaatggaccgacgaacagcaaaacgccttccaaaaggccaaagaaatcatgctgtcggatctactgctcatccatttcgacccgtctcttccaatcgtcgtagctgctgacgcatcataagacggaattggcgccacaatcagccctatttttccggacaaatcagaaaaagtcattgagcacgcgtcatgcaccctcaacgacgcgcagaaaaactacagccaaatcgaaaaggaagcattggccctcgtttttgcggtccagaaattccaccgaatgttatttggtaggaaattcacgcttctcacggaccacaagccattgctggctatatttggctccaaaaagggaataccgatttatgcggcgagtcgtcttcaacgctgggcactgatcatgtccaattacgaattcgacataaagtacatcaacacgtcatcctttggacaagccgatgtactgtcacgcttaatcgccaattatccccggccggaagaagacattttgatagcaaatatctgcacagagacagattgctacatcaacaccatcctccaaactgcaactgatcaattgccgaccacgaaagcagaaatttcagaatggacaccaaaagatgaagtcctccgaaaaatttctgatcacaccaaaaacggctggcctcaaaagtgcaccgaccccgatctctcaccttattttcctaagcgaaaggaaatttaagagattgatggagttttgctctacggaaagcgagtgatcgttccgacccaacttcgtgaacgcatcatcaaggctctacacatggcacaccccggaattgtgcgcatgaaagccctcgcccgtcagcacgtgtactggcccggattggacttggaaatcgagcgtatggtcaggcaatgcgaagattgccagagcgcccaaaagagtccacccaaagcaccgctcgctccatggacgtcttgctcacgaccattccaacgcattcacattgatttcgccggtccatgttcagatggccactcctatttgattttgattgactcattttcaaaatggcctgaagtataccgaatggaccgaatttcgacaccagcaacgctccaagtcctccgatccattgtctaccgcctcggatttccagaagaaatcgtgtcagacaatggcactcaattccatgccgcagaatttaaggaattttgtgacgaatttggcatcaagcataccttcaccccgccgtatcatccgcaatcgaatggccaagctgagcgattcgtcgatgcgttcaaaagggccatgaagaaatgcgccaaagatggaaaattttcggcagaaaagaagcttctcgcctacaggacgacgccgaattcggcactcaacggactttcccccgatcaattgttcttcggtcgaagactttgcactcagttgtctctcgtccacccaaaggaagaacaagccgaagtcattgacccagccaaaatccgcaaatcgcaagctgattatgcgcgaaaaatggcccgtcaatttgatcaacaccacggagcaaaaccggtcgaatttctgccaaaagaccccgttttactgttgaacttcaaccgtggaaaacgattttggcttaatggaacgatcatcgaaagattggaaaaatccccgacgtatcgcgtccacgttccggcactcggaagagccgtccatcggcacgtaaaccaattgcgccaccgttatcctcttgaagagaacggtaacgatacggtaaggatcccacccaaggctcaagaagagcacgaccgggacccctcgcagaatcgcgagcctcctccgcaaccggcaccaattcgacggattcaggcaaagcaacgatctccgagtcctcctttggtcctgcgccgatcgcaacgccaacggaaacggccggtccgcttctcgctaaacccccgagggctcagcttaaagaagggaggtgttggagtgacaacatttgaatttggcgcgttttaatttatcgattatttgtgacgtgtccacccccactccccctcattcatttgttatttaaattctcccttcttccttcattttgttccttctcccattcatttgcaattttataattttgttctccaattgtcctccgaccaataaatttgtattttattattttattgtgtccgacattgagacacaacatgcgcaatgattggacttgcgaccaaagaaatgccattgtacggaagggttggcacttatcctaacagttacggacaccgaagcctttttttctcaaaaattataaaatattttcagatttatttcatataaatttcaattaaaatttttcttaaatttcataatcatgtcatttattcgaggtgttcaacaaaatgctgtctttacactgatcatggtaaacggtgaaatacattataaaaattaattttaattttaaaattttttagcaacttttccaaatttgactcactgtgaagaattgcgactgttgaaggccagaattgagcaattggaacaactgcaaagaatggagtcatcttcagttgcaagttcggaagtgttcgaacaaaatgggaatggtaggaaaaaacagtgatcagaaacagtgggggatacggtagcaaattacatgaggaaactgtagggaaaagcatttggggagtggggatacggtagcaaattacaagaggaaactgtagggaaaagcattttaatttttcggaagaaatttatgacacaatgcgatcggaaaatggagaacaaaatgaaggagttgctccactatcagcagctgatcagcagcaactgaaggcgcgtgaaaaacggagaagggcaattaattgttaaaataaataaaaatgaaaatcgaaattttattttatttattttaatttttttaggaatttcgtcaaaactttggcaaaatgcaaatggaattgcgggaaacaatcgaaaaacttgtggctaaagttggcgaattggagaagcaacaacagcgccaaaaggtcaattaaatgggagggaggggacaaagtccacaatattctaaaaatttaatttaatttgaaattttcaattttttcaatttaatatataaataaataagaatttttccattaaatattttaaaaaaaatgttatttcattcgacagaacaacgcgggagtgttcacaaaagtgaccgttgcaatggttggaaataattttaaattataataaattttaaattcagcagcaaaattgttgggatggcaccgcttgccccagagaattggaaatcattggtgccaaacgtttgatggtccaatacaaaggaaatcgcttaaaaggtaattgtcacaaattaacaaaaaaattattaaagaaatttaataattaaaattaaaatcactttaaatacgattattttaattgaaaggaagtcgctcaatgttcacaaaacgctgcattctgagcacaaattcgtccatttcttacgtcgaagtgaaaatcatcagtatgaaaatgtaaataaatcttagaaaaataaaaatataatttaaagtttataatttataataatttttaggtgcgcaatgattggacttgcgaccaaagaaatgccattgtacggaagggttggcacttatcctaacggttacggacaccgaagcgatggccttttttgggtcaacggttcctgccaaattggcagtcaaagtgccaaatttggcatcggagatgtcatcggcagtggcgttattttggcaacgcgccaaattttttcacgaaa

SEQ ID NO: 1809 - DNA, 4253 bp, Heterodera glycines
  misc_feature (152)..(152): n is a, c, g, or t
  misc_feature (179)..(179): n is a, c, g, or t
acaaagcatttgatcgtgcctatcaaatccggatttgtcttgtcccttgaaatggcacgccgaccgggggatgtgcttcgatgagtttgtcgcattggctgcccgtgcggagtcaattcaaaaggcaacaaacaatgtgccaaacgaacggncgaaatattgaggaaagaacccgtccntatgcagcaaaacttttcaagatttgcgcaacaattcaaccccaacaaaagcaaaatttttcacaaagttttcaaccgcgtgaaaacactgtttgttacaattgtaatgaaccagggcacttttctcgcgaatgtcgacgaccaaagcaatattttgatggaagggctaaccaaagccatgcagtgccggccactggggccaatagttttcagatgcggccaaatggtcctgaaaagcgagcacttccacagacttcgacaaaagagtctgatcaacgtcggtcacaaaactttttgaagcaaaattgcattgttgtgcaagaagaagcaccaccggaagctttttgccgtggtgttcagctttcatcagaaatcgctgaatttttcgccaacgagttcaaagaaaggaaagacggaaacaatcagcgagaaatgagttccgacagagttggaaaaattttggtcatcaaaatcgaaacatttggtgcaaaaacggaagcgatgatcgatggtggagcgcaaatttcgttggttggcgcctcatttctgtatatgctgatcagagaaaaaggattggatttgcaaaaaacaaattttgcacgcacaaatgacagaattgccgacgtcaatgggaaggaactccgatgttttggcacactcacattgccaattctccgtaaaggctgtgaacaagtggccatacatttttacgtaaccagtgcaccgttcggattcgacatgcttttcggaacgaaggccgatcagttttggaattatggcgcttcggcaccggttacaacaccgatcacgtgaccagcgacgggaagatgacggaaaagggcctcttgatcctaagggcttgggtcatgtctcaagtgaagggaatgccaaaagaggaggctaacgagccggaaaagaaggacgaagagaggccaaaggcgggcgtgagtcaagaagaaagaggaagtgggcactttttagaatatatttctttcgtaaaagtttccataactgagcattagcggtgtcgctttggttgttgttgctggtggtgatgttgttgttgttctgctctgctggcgcgttttgttgattattaaaagaattcatttttattttgcaaaaaaattcttgtgattaaaatgaagttttgcgtcatatttcgggcttttatatagggaaaaggtacagtgctgcgcgctacgtgaaagacgaagttacggtgctcctacgcacatataaaagcggttgaaatgtgtacacaaaatctcatttgtatgaaatgcatttgcttatcgcattctcgcgcattttggactgttcccctgacgaagtgggcgcgcgaatttgtgctagtggtgcggaccgagaaaacttgttggaggaatttgcacacagtaagctcgtcactacatattccgaccgtaatggcttcacccacacactcttctttggtggactcactgaagagggcgccgactcagtgcttgcttatggcaacctaaggcgtccctacaatgtttgcgttgcggcccattattactcgcggcaccgcattatgctaaaatacccgcaattcccatgtgtaattgagaaatgttttggtcaaagggatggaccctttcacaaatattacccgcttgaactgataaaagtcgtcgatgactgttttccgcctgtgtacgcgagtttactgtctcaaaagcgtgacggagcatcatcatcatcatcatcatcatccctgtcatctctgcgaaatttaccatcactttccaacgatgacgatgatgatggtctctggtttggctcgatgtccacacaaaatagtgttgcgacaacaccgccttctccgtcttgcgcttatgtgaagggaatcatatggattgaaaaagagcaaatcaaaaatattctcagtcaagcaattaaatatggctaattgtgcatttttctacccaaaaaccttaactactgcatctaaactgacgcattttttaaattaatttttccaaaaccgctacttctcttactaaattatgcatttttctacctaaaatttgcaacttgtcacgcttcattattttaaatgttaatcttccgtttgttaattatgcatttttaaaaagtgcagcccgtataaattatgtctttataaaaccaaaatcatgtacaatagcattcatccccacaacccccttagttacaatagggcggtaacgtttcgatagccggacagaaataaccgtcccgtccttaatgttgggtctcaggaaattggggtactcaatcagaattgaaaaaatgtcatcatcatcatcatcaccatcatttgaatggcacattgaatagcgtaggacactccttttgaacgtgtcaaagtggagaagctgacaggcatcggcgctcagtgttatgccccgtactttaagcaccgttttttcctccccgctttgacggtgccgcatccgcagggcgtactgtttgcacccaccagaaacaaactccacgagttcatggtccggccattcatccgaaaggtcgcctagatggggtcccgtctccagagggcacccgtccgtctcacgatgggcgaaacacacactgtccgtgtcggtgtagatgagcacagagtttggtgcgcgaacaaccttctgcattagccgcaacaagtgtaggcgcgcgactgatgttgtccaaagagaaagcacaatgtttgagcactcgtgttcctccacccattcgtttccggccgcataggtgaccagaacgcattcgtcggtgagttggtcaatggagctgacctccaccgctgggttgtcaagcagagcgcgcagttccgcgggagagtcggtcacaatcgttttggacaacccattgcgtaaagagaaacgcccccaaagggagttgttgcacagttttgcgatggtccgcttggccttgttgtgcaccatcttttcccgctcgattcggattcagaatttttcctcacattcctctatgaattgctgctgatcttcctcggtttggccaatttcgtccgggaagccgctggcatgcgttttcatggccatgaactcggcgacatagcctcgaaaaacgcggtcgctccattgcgtgtcgtcccactcaacggagcgataataggccgtacaccggtacccgttgtgaagcgcctcctccaactcaattgacgtcacagtggacacccacccccgctcatcatcttcgcgatgcgtgcattcgtagtcctcattgaccgctccatgcgggtgctgcagagcgcacgtacggcacagcgggaaaagaagccgctgatcaaatttcactggcagaacaggcacatcaatgtgatggggcggcacaacgaacactttgagaatgcctcggaccggcacttggtcggcgcgtcgccagtcaaccgcctgctctgcttcaccaatgacgttcactcgtgttgggtgacccacggggtatgctgtcacagcattcgtgtgggggtagagcgaacgaacgtcgtaatatttcatcctccacccctccggcacctcgtagtgtagtcgttgtggacccacacgtcctccatggtagcagtccttcaaacggatagggccgctgtccttgtactgcgcaaaggtgcgcttcatttcgtcgttgtcgcgcttctccgcgttgatttcacactcccaaaatacgagcacttgttgcacctgggatgtgatgaaggacagccgtcgcgcatcgtcctcccgtatccgctgcgccgttttcccattcgccatcactgtttggggctgaaaacggtgacgcgggtggtcgtgagcgtgccagtggcagccgttgacctcaatcacggtgtcggtcgccgcgatgtatccgtccacagtgtactggccaatttttttctctccgccgggcgagtgtgccgtctgaatgctcactccgttccttttggcgtaccaatccatgaatttgagcgctacaaggctttgtgtgtttgtagtgtcgtagccgcactcgggcacaatcgcgagctgatctcgcttgaggtgatgtgtcgaaagtgcctcatgaggcact

SEQ ID NO: 1810 - DNA, 8817 bp, Heterodera glycines
cgtcgtcctcgtcatccaagcatccatgtcgctccagtggatcgctgatcgccaagactccgttcgaaaagcaaccaacgcctcaattagtatgtgcgtgtcgttggtgcagtaggccgcgagctgttcacacaggtcgaactgctgatggtggtgttccgcgtaccactggtcgaatctgcgctgtcggtcgggcgtcattccgccgtataagtagtcagcttttgacggtaagcattgtagagtgcgcccataatttgcctcaacattcgccaaatgagggaaaaattccttatcctgcacattgagtccgaacgctccgggcagagcgccgagcggcaccggcataaggttccagctgtctcttacgatgatttccgggtttttttcacccctcgcaattttcatttcgtataatttgttgctacgacggatcatttgcgggcaaaacccgttgaggaagaactgccgaaacagcatgatgttgtcaaaacgaccctgaaatgggcgaagagcattgtgggatagcgcggatcgaattcgctgagcagccattgagcaaaggccgccattggacaaggagtgatgaattgggcatcggtttgagtccgttcgtagccgctttgggagaaggtgacggtgcgctgccgaccacaaatgctgcatggcacttgtagagaatttcgccacgaattttcagttatgcacttggtgcaggcgacgtggcatgagatgaagttgacggaatgaagtcggcggtcgccgctgccctcaattcgtgtattctgtgttgtttcacagtcaaaggcgatcagtctgtactttttggggcggcgcgcctttaactgttgtatgaagcagccccgctccggcttatggtagcatttacaggtgtagcagaatttctcaccgcaaacatgtccgctgcgtccttttcgtcggttttgtctgatattccacacaattccgcactgtttgcatttgttgaattgtcgacacacattgctcgacaaatgatgattgaagcagtcttggctcatgaaatccttgccgcatgctgtacattctctgtaataattgttgtcatccgctcggcacggtcgccccactcctatgcgaccgcagtttatgcactttgcttacattgtagcgtgtgatcattggcgttatcatatgggcattcgcacgaaaaacagtagtagtcacgcccaaacaccgctttgcccaccccacatcgaattccgtcgaaatggtcgttgtgatggtagagcgggatttcaatgttgaagttgtccggcccatattgaaattttggccgataggtgcctgtagcgccaaagatgtacaccttaaatcgctgatttgcggtggcgtatttccgattccaatagtccacgacaatcggcacatagacaaccgcgtcatattctctcaaatcggtgcgaatgtttgcaccgctcatcagtccgaacacgtcttccagtcgttgcccgttctgacagttaatataatagcagaaatttcttctgggcatctctttgctgtggtattttctgcttgcctccaaagcgtaaaaaagacaatatgcatcatcgctgttgttgattctcagaagagcactctcttttacgatatgttgtactgaatacggtgtccttttcccactgccacgcacctgttgtcgttgcggtaactgtgcaacatccagcgttgtgatggtcacagtgaacggcgagccccacagagagccctcccgcgattttgactgtgccacttcaagaaagcggttcatgattgaatcggcggtgttgtcggaaatgcggcgtatgggaatccatatgctcggatttagaagatctgaagagattgtagcaaccaattgatccggtgtgatgccgttctgttgtgactcgtccaaggcagttgacatgcagtgagcgaacaatgcgcgcagcattgactcggggttggcgggcaaattttcgatgacaaaagtcgactttacgctctgcactttgaatttttggttgtattgtttgtcggcgctcagagtgcggatgcaatttttttgaaatttctgttccccgtcatcatcgtcatttctccttcttctctttgtgggcgtttcgttgccgcccaactcaccgcaataattgtggtcttccagcgacatttattattattatttttattttgataatttatttttgtgaaaaaagtgagcctttcccgcgtgagttcgctatatatatgcggcggcaccaacagcgcgcaccgtgcgccgttttgtaataaactaatcaatcatttcccttatgcgctttgccctagggagataaaaattggcaggcacacacatacggattaatcattttattcagaatgcacaatgaatacatgtcggggctttcactagcgtctaatatacgcagaaatgtgtcaaatgggtgacctaaggacatgtgataaatgaacacaatacagtgaattgcacatgtggtagtcagtggggactggtacgggtgcttatttgtaacaaaacctttttgaaatttatccagaaatgatgtttttacaatagtaggaattgtttttgtgagactatcaaagtaaatgaccgcttcctccgtcttcgaaggggcataaatcgcgcaccaatgggatccttgtttgtagtgtgggtcattgttcacaactagcgccgctgggtaccgtagcgtgtccggcgctgggagctggtcacttgggaaacagccccggaaaactcgttcggtttcccgactttgcctcaaaatagtcgaaatctgcgcgctgtccatactgagcagttacctccttcttcttctttaaccaacagatagaacaaagctgatgaaggatcaggctgacaatcaccattaaatagagcgcaaaaagagcccagcaaactgcttgctgataaaagttttcttcgccggggcgatccttgcacatttgatgaatcaatgttgggaggagtgttgcgactggcaactgctcatccgcaaccaattttgcagtttttcttgtaggagtggtggttgttgttttgctgctgctatttttgtttttgacggtggtggtgtttggtggtttaccagtcacggcgcctttccccgtgcgagttgataccacacgaggcataacagtggttgtggtaatggtggtgatggcggtggtggtgcttactgcccccttgggtttggttttgtttgcattagccgatgcacatttttcgataccaataaaaacaatcaaaaagaataaaatagcagtagcgcttttaaaatacatttttatttttggttaacagtgaatgtaacaaatgtgagagaaatacactaaatcggcgccttttatatagtggtatcggtgcttatcgatcggttcttgtccagcattaccagcgagtcgcattcgcccattacgaccagcatcagtccccccactggtaccgcacgattgaattttatgctcaccgcggttgttccgttctttatcaggtcaaagagcgcggcttggtcgtcaccgctgcttgtcaagttgaacacatagatacaatgcgttttcccaaattggggaaaggttattccgttgctttccgaagagtttgcgaacccgaccgcctcattcatatcgttgaaagcgcgcacatatttaccatgcgggtagtccaaatcgtaaggggcctgggggtaggaacggccgttggcgatgatcgcaatttcccgcacattaaacggttgaaaattgaacgggctcgcgtgattgtgcccgagtagtcggcatttgaaacaagccccattgtgatgcggcggggaatttggtccatgaacagattggcggtaaactcgaaccgaccctgactgatgaacatcgatttcatcatagttttcctcactgcataacgtgcaggctttatctcaagctttcgcgcaatgtccagcgctaatccgtccattaatgacaccttcttcacatacattttgagtcccatcacctcgaaacggtaacgaggaacaacaccgccgatggcgggtgcaattagcacaaaatcgttgtcatttggcaaaatttcgacatccaattcacaaaagttaatcaagtacagcggctgattgaataggtcggtatcaattttggcaataaattgggctgttttgctttcggcaaacaaatccctgcgttgaatgcagcccggccccgtctccagtgtctcgcccgtatcccggtaatagcctgcagcattcaagtgtgagtcctttgctgttgttgagtaggagagttcatgtgaaaaataggttttgtaggccatcagtgcatttgcgttgaacacttcacgcccgttgatgctcattttgatgtttcggatgaatgtttgcccaatcatctggattggcgcaatgttttcgtcgtcaatggtcaggtccataagttgaccattcgcattttccttccggattcggaactcagtgagcaaatagcatttggagaggtcaatgtaattctgacttgaatgaagtttgaaatggtagggggtgtcggtcagagggttgctgggaagcagttcaaacacctttgatgaagagacgctgacatttgtcggcggaatgcggaaaaagtccagcgcattggtgattgagttcacggagtcattgtcgattttatgaaatgtcatcctgatggtcgctgctaatcagtagagtccaaaggcgtccgaccgaacacgctttcttgttgtctgctttacggcgattgggggtccaccaattattgtttgatgacttggcgcacgtaatcgtcttctttttatacccttctgtccagtaccaaactgcttaggcaatcctcctttgtccagcacggtgtctattcctcgctttccctcgctgaccagagcctccttaatcggcattccctcgttcccaacgcgctccagcactcgttgcccagtgctcaacgcctctgaccctactgtggtgcccacacgacgtaaaatgggcaaaaagaagcgccaaagtcctcgaaacacgtcaccaacgcccgctccccgctgtgcgccatagcccctttgaaagggggtggagccccgaaagtagtcgaaatcgtctttttccaatccacccccgtgttgcatcatcatgtaatcgtcatactgcacaatgcttgggtcaaacacgatattaaccattttttattcaaatcaaatacaaaatgaatgacgagtgaataaatcagaaatttatcactttcttaaatatcaacacgaccatcgtcgtcccatacgcgaatggcaccagacggcctttgtccattgtgcgcagttcaatctcaatctcattgatctcccgtggcagtactcgcgcaaatattggcgagtcataaatcttctcattataatccccagggatggcaccactgatagacacaaccctgagcaacgagctcagcgtattgccgattatcatattttcggtcaatccttttgagtagaccgcaaagcttgagatgccgccccgtaaatcaaccggatactttgacagttcatttgacacaacatgctgagggttttcgaagcccagaacatagcccaactgaggcgagaaggacaagtggctgataatatcattcttgaacaccactttgaaccgttccgcatcatcaatatattggattgacaccgagttgggcacaaattgaagtgagtctatttcaactatgaagctgttttctggtaaatctagctctgatagagtcaacgcagccgagacaggttcgtcgacggtcggaagttgtttttcttttgaaggtaattcgataacagtccccgtcgtaggagaggaagtgaaagttttggtaggagcagttgttgttgttggctctggctgaggcggatgtgttgtagaagtgggaggaggaagtttaacagcaggcggcttaggcgatggtatttttggcgttggagagacctgggttgtggtttttgttgttgattgaggggtcggtgttgttgttgttgttgttgtttttgtatttttcggtatatggacggttgttattggttgtgtgggagtcggtgttgctgttgttgttgttgtttgaggggtcggggttgatgttgttgttgttggctttggctgtagaggaactgttggaggagatggcggtggcggtaacgttgtaggttttgttattgctgtttttggagggccaggtgtcgttgtcgtcgctattttttgttctgacggctgaactgcagatggttttgtcgggacaggtgttgccttttgctgttgtgctgatggctttgcgatagagttgggatccgttgttgctgttgttgttgttaccggttttacggatggaagagtcggtgttgttgttgttgttgttagcggcttaaccgccggaactggggctgtcgctataggagacgggctttttggatcaattagtgtacctttttgtgctccttcgttccgcaagtcatcatcatcatcgctcatgtgttgctcttcgccagcattcggatcgtacaacgggggagagccgagtcgctttccgtgctcatcaaacagcacgggggattggggaggagtggtgttgttcacatctcttctgcctctcttccgtggtggtggagagccaagcggctttgtccaattccgatcggcctcctcttcatgagggagcggcaacatttttgcaccgatatggttcctcagtgtagcggcaatgaagtctctcagctgctcaaccctgttatgtgatctcttgggcaccggcacccggatcactctcggtctgtcctcatccattgtgctacgctgtgtgaagtgaatgtcaatccattgtgcatccaatgtgccaatggttgaccatgagtatgggtagcttatgctatgcaacccacaaacccaagagccgttaaaatgcaacggctttgggagccggacccgaaatttattgggctgattgtccgggtaatccgtcacattgttagacaaaaacacaaagaagctgttcgatgacatttttatttcacataaaaatatgaatggaatacaatacgggcggtgggtgcttttatacaacaaattgtgactcgtgaacccattcgcgctcggagtatcctatgaacttgacaagcatctcagtggacccatccgccctctttctctttctgtacaccttttcaatacgatagcttgtctctgcatcctttcttacacacgccaactcctgctcatagaagctgcccttaaatttctctccgcgctcgtcccgtagcttgtaccgaatggggcgtaccgctttcagcacctcgtcaacctccaatatttcgtcgccataatttggcaaatagcccttctcaaactgtcccttctctctgctcatgcgcacaaaatcgtctttgcggaagcgtggcggtcgtcgtttttgtggtgcacggtgtccataatcatataatcgcttccacaccctctgagcattggaaaagcccacatcaatcggacgcattccgtgggcacgtgacggggagcggttaatcccgtccacaattttctgtgctgcatccaccagttcagcgtctccgtttccgcaaaataccggtacagacgctgtttcacattgcggatggcccgctcggcgaccgacgccttgaccgacgaatgcacgggttcatgcttctcaatttctcgctgctcaaaaaagtccttcagcaatctgttcttaaactcggttcccttatcggagaaaatgcggtggggggccatgggcatttgatcgatgagcagcttgaatgcctccagcatctcctcggctctcttatttttgagtggcacaacaaacaggcgttttgagagcacatccaccgcgacaaacagatagcggtgaccccggttgtgtcgcgatagcgcttgaaaatcggccaaatccacctggacatcggtcatgaaccctgccgctacagtgctggccccttggaaagcgcaccctacgggggcgcatcagagtgtatgtgcggtgcccctccaaataatgttgaacgtcctttttgcgtaaatgcttgatactttttcgcgcctctttccacagcgcggtaacgcccgcgaacgccgcgggcgacgatggattgttatacagcttgtcaagcgttgtgttgatcagctccatttttttgggcgaaattcctttttgatttttggtgccgtccgcgtggttttgctctgtgacggtctctttggtggagccgtccatgaatacagaattgggtcctgctgaagcctttcttccaatatggccgctcctggtggtctaatggttgggcggcccgctcttctgtctattatatatcggatggccattcgcaaattgctatgcgccaacggcttgccgtttgcggtgttaattgtatttccacgaacgcccatacgatcagcgtaatggttacatttgatgtatagccgttcaacccgctgagtcatggtcagctgatttgatggaatggcaaacagttcgcgttcttgttgtcgttgttgttgttcatcactttgtgcagatgtcgatgggcctggctcgggtgagtactgtacccttacccttctcggctgtctcactcgttttcttatctgcacctcatcatcttcatatacggggtagcgacgtttggcccccctcctaggcggaggaacaacgggcatttcttcgtcgtcaaaagcggcagcaggaagaggctgttgctgttgtggcgcttcaaggagagtgggttccctttttgggatacggtatggcatg

SEQ ID NO: 1811 - DNA, 1406 bp, Heterodera glycines
caagcgttgcgttgatcagctccattttttcggacgaaattcctttttgatttttggtgccgtacgcgtggttttgctctgtgacggtctctttggtggagccgtccatgaatacagaattgggtcctgctgaagcctttcttccaatatggccgctcctggtggtctaatggtggggcggcccgctctttccgtctattatatagcggatggccattcgcaaattggtatgcaccaacggcttgccgtttgcggtgttaattgtatttccacgaacgcccatacgatcagcgtaatggttgcatttgatgtatagccgttcaacccgctgagtcatggtcagctgatttgatggaatggcaaacagttcgcgttgttgttgtcgttgttgttgttcatcactttgtgcagatgttgaagggcctggctcgggtgagtactgtactcttactcttctcggctgcctcactcgttttcttatctgcacctcatcatcttcatatacggggtagcgacgtttggcccccctcctaggcggaggaacatagggcatttcttcgacgacaacagcggcagcaggaagaggctgttgctgttgtggcgcttcctcgacttttggttctctttttgggatacggtatggcataggtctctttgttgtcggctcatgttttattttgggcgtcgggggaggcgggttatacccggcctgccttgatgtggatggtcgtggatcgagatcaacaaactctggcactctttttgccggagtggggtgaccggttttctttgatgtcgccggcggtttgaattctggctttggcttttgttgttgttctctcttgacgttaggacgcggccggggtgtaggaggcctcggctgctcaacttttacttttgcgcgaggcagtggtggtggttgataaatcctatattttttgcgttgatcatcatcatcgtaagcctcgtcctttttcaattttcttctgatggcaatcctgcgctgagctgtgtccatttcctcaatttcttccgcattgtcgggcagcacaggcaaatcgccatagtattgcgatggtgcaggtagcgcgaatccattctctagcatatactcatcatcatcatcatcatcatcatcactttcgggcagtggcgccgcagctgcttccgcaaggaggtcccgcaccactagcggcggcggctgccgttgctgttgttgtatatcgtatcgccttttccgccattgctccatacgaccacctctccgagaagtcctgcccggtctcggggggcgttgtggacgaggtgggggacttgttggtggcgaaggacccccgggtccagccggaggactgggcggtggacgacgaggaggtcttccaggcggcggaggaggtgctggagga

SEQ ID NO: 1812 - DNA, 1031 bp, Heterodera glycines
aatagaggctttttaaataaatatatgaaaaaaccaggggaacaattccataaattcatgaaccaaataaataatttaaaattattttttagaaaaattacccttgtgttgggtactaaaatttgtattccgaaatagaggctttttaaataaatatatggaaaacccaggggaacaattccataaattcatgaaccaaataaataatttaaaattattttttagaaaaattacccttgtgttgggtactaaaatttgtattccgaaatagaggctttttaaataaatatatggaaaaaccaggggaacaattccataaattcatgaaccaaataaataatttaaaattattttttagaaaaattacccttgtgttgggtactaaaatttgtattccgaaatagaggctttttaaataaatatatggaaaaaccaggggaacaattccataaattcatgaaccaaataaataatttaaaattattttttagaaaaattacccttgtgttgggtactaaaatttgtattccgaaatagaggctttttaaataaatatatggaaaaaccaggggaacaattccataaattcatgaaccaaataaataatttaaaattattttttagaaaaattacccttgtgttgggtactaaaatttgtattccgaaatagaggctttttaaataaatatatggaaaacccagaggaacaattccataaattcatgaaccaaataaataatttaaaattattttttagaaaaattacccttgtgttgggtactaaaatttgtattccgaaatagaggctttttaaataaatatatggaaaaaccaggggaacaattccataaattcatgaaccaaataaataatttaaaattattttttagaaaaattacccttgtgttgggtactaaaatttgtattccgaaatagaggctttttaaataaatatatggaaaaaccaggagaaacaattccataaattcatgaaccaaataaataatttaaaattattttttagaaaaatt

SEQ ID NO: 1813 - DNA, 5346 bp, Heterodera glycines
ttttaaataaatatatgaaaacccaggggaacaatttccataaattcatgaccaaaataataatttaaaattattttttagaaaaattacccgttgtgttgggtactaaaatttttattcggaaatagaggctttttaaataaatatatggaaaaaccagaggaacaattccataaattcatgaaccaaataaataatttaaaattattttttagaaaaattacccttgtgttgggtactaaaatttgtattccgaaatagaggctttttaaataaatatatggaaaaaccaggggaacaattccataaattcatgaaccaaataaataatttaaaattattttttagaaaaattacccttgtgttgggtactaaaatttgtattccgaaatagaggctttttaaataaatatatggaaaaaccaggggaacaattccataaattcatgaaccaaataaataatttaaaattattttttagaaaaattacccttgtgttgggtactaaaatttgtattccgaaatagaggctttttaaataaatatatggaaaaaccaggggaacaattccataaattcatgaaccaaataaataatttaaaattattttttagaaaaattacccttgtgttgggtactaaaatttgtattccgaaatagaggctttttaaataaatatatggaaaacccagaggaacaattccataaattcatgaaccaaataaataatttaaaattattttttagaaaaattacccttgtgttgggtactaaaatttgtattccgaaatagaggctttttaaataaatatatggaaaaaccagaggaacaattccataaattcatgaaccaaataaataatttaaaattattttttagaaaaattacccttgtgttgggtactaaaatttgtattccgaaatagaggctttttaaataaatatatggaaaaaccaggggaacaattccataaattcatgaaccaaataaataatttaaaattattttttagaaaaattacccttgtgttgggtactaaaatttgtattccgaaatagaggctttttaaataaatatatggaaaaaccaggggacaattccataaattcatgaaccaaataaataatttaaaattattttttagaaaaattacccttgtgttgtgttgggtactaaaatttgtattccgaaatagaggctttttaaataaatatatggaaaacccagaggaacaattcctgtcgtggcgacaaaaaatttgcgtcgaactctgcggggtgaaggggacgggaaggggatgaaatgggcgaggcgcgcagagtagccggtcgggggaacgtagggggtcgggaccgatcggagagcgatgagtcgtgccggtgttcgtccaggcaaatagaccaagttgggcacaattttaataagagtatgtttattgtgtcgacctcaaacttgggtaattaaaccgtcccaatcgggacggtgagggaaacgaaaaatgggggacaaacatgataatgtgaacggggaaaagggggcacaaaaacggtgacagtaaataaatcacaaatggaaaatgtggcaaaatcaaaaggggtcagaacggcgaaacggcgatgggaaaaggaagggcattcgggcaacggctggtccaaaaggggccacacaatggcaaaggaaagggagggcactcgagcaggcgcggacagggagggcactcgcacagacagagagcagcgaaagccgggtgcagtgaaaggcggtgagcgggtgccgggaaacttcggagggaaccgtttgtctcgaatctgaaatttccggaaaagtccacccctttaaatacgattttttttgcatcaaagtacgctacaatttctcattttaattaaaatatgtttttgtgtgttatccgtttggatttgccattttcccattaattgtttgcttttccgttttccctttacaattccaatttctttaatatattaattattaataatttgtttacgaacaatccttaacagaattcgcaatttaatattaattaattttcgttcctttcgttcctgaggaaatgcacttttccttttcaaacaattttccgttattcatttcaaaaggttttttcatttttatgtaattatattttcgatagttttttataatattatttttccaaaataaatgtaaaaatattttttattatttatgttttatttttccccattttattttctattgttttttatttttcctcttttttattttgggttttatcttaggatttcgcgttgtcgcgacaggcgtctttgaacttcaggttgttgtcaccttttttgatcaattcgacccgaatttcatcacttgaaatgccattgataaacaaggcacaaagacacatgtcaatgctgtcgcggctccattctgccttggcgatcaaactgcgcaatagcaccgaatagtcccttatcgattgccctgtctgctgcttggctgaaaacaattcatgcctgcacgcggcaatcgattttgcttcgccaaatcgttccaccatcagttgttcaatttcggcaaggtccatggttcggacatcctcaggctgtgccattcgccgaagctcttcgtacacctgacccatttcggtgaacaggagcagacgctttgttgcgacatcggtcacgcctttaagctggatgaagaattcgaaacgttcccaccatgtcgcccagcacatctctggcaaaaacggtctggggccttttccagcctttattaccgctgccatagttggacttttcttaatttgtcccactcggatcaaattcaagatgctgatcaactgtaatccgacttggatttacagtgattcaattgttatccgtaccggattaacaatgaaaattggtgctgctcaactgctattcaacccgaattaacagtgagaataaattgttatccgtcccggattaacaatcaaaatcgatgaaggccaatgttatccaactcggattaacaatggcactcagtttccagtcttgccttccaatcaaatttttctcttgctctgttcggcctcgatcagtgattgaaattgttatccttcccggattaacaattcaattcctccaaattcggcgattcgtcgctggctgatatccgtcccggattaacaccagaaattgagagtgccaccacctgggtgaacagctattccaactcggaattagcttcctctcctttttgacggttttggaaacagctattccaactcggaattagcaatccaaattttgctgcttctcagctctttcgccgctcagcttcagttcgcttctgctctgctgactgcgccaaattttgttgtgtccgagaacaacagatatgaagaaaagacaaatatttatttggagcacaaatataataaataaatggtcaagcgaagggaagtgcaatggaaggaataaatgacagaatgaacgagggagggagggaaggcatcgcttatatgtgggaaggaatgtgcctaagggaaaggagtgaacaaagttcactccacttattgattggtctctcaacaccacattcgtccctccttcttaaagccgtgatcaggccgagggatcgaagatcttcggcttcttgcgcttccgcgttgaacgtcgaggttcagcgttggcatgctgttgtggctgctccggttgcggctcttccggcggtggttgcagctgttcatcgtccatcgcttcgatcggcacttcatcctctgagtccgaattttcctcactttctgaactcgaattgtccgaattctgatcagtcaaattctctttcaactgatcgaaatgtcttttccaaattcctctcgctgttcgaacgaggaacatggccgtgccaatttgtcgggtgatttgtccttggatccatttggatccatcgcgataatttctcgcgtacactcgttggttcacctcgaattttttccttgaattggccccgcgatcgaaattccttttcattcgttccgcatatgactcttttggcactttggccgcttcaaaatcattcgccgctgttggtttaaccaaatccaacaaggttcgaagcctgcggccgaagagaatttccgaaggtgccaattctgttgcaggatgcggtgtgacacggtatttaaggagaaattgagataacgcaatgtcctgcttcatcccctccttttggagcttgttcattccttgcttgaaagtttgaaaaaatctttcagcagctccattcgactttgaattgtatggcgcgatcgtcgtgtggacaattccccgtgatttgcaataatcaccgaattctttcgagctaaattgtccgttatcggagacaatttgcccgggaagtccatgcgctgtaaacacaattctgagcgcctcaatcgttgccagtgccgttgttttgcgcattctgaccacttctggccatttgcttttggcatcaatgatgatcaaccacattgatccccaaaacggtccgcaaaaatcaatgtgtattctttgccacggtctttccggtgattcccacgggtgcaatggcactttccgctcatccggcgcctcttcttggcaaattttgctttcaacttcattgcgaagtgaaaatggcatcggtctcggcttgcttcttccgaattcgtcctttttggttttcacggcacaaattgtcgaaattccaaaggctcggttcaaatcgattttcaatcccatgatcaaatcgcggccacatatatttttgtgcttaccacttatgacatgaatattggactcaatcgatcttcctttgtgcctcacattcagcgttgcctttcccaaaatgccaccgatggattttccgccataggccaccaatccattggatggttccagttttggcttaccgatgcttttccaatcaatctcgtcaatcaccgtgacatctgcacagctgtcaagctcaaaattcagctttccattttgaattaagagttgaataaaaccagtgtcggcagatactccgttgacttcgtgaatgacgctgactgtctttggtttttgaccagggttggcatttccatcactgcttttgcttttgcaacccacagcccaatgcccccattttccgcatttgctgcatgtcgaattctgattcgggcacacatttgcaaaatgtcccggttcaccgcacccaaagcaacatcccgtgcttttcctcggcttccttggtcctctttgctgattgccaactttcgcaactccggcattgcattttgagcaattgcttgggaatccaaatgggactgctcccacaaaacggctgattcgacg

SEQ ID NO: 1814 - DNA, 1185 bp, Heterodera glycines
cacccgaaatgaaaatgaaaaatttttcagggaaaattggcaaattttaaaaaatttgtaatcattttttttttaacaaaatgcattaaaacatcaaaaaaatttccagcggcacttatcggcacccggggcctcaatttacccttaatttttgaactttgactccaaaatcgcaaaaaaaagaagtaatttttttgcgaaaaacggcttcaaattcctgtctttgcgctcagacacttaaattttaaaaataatcctgaagaaaaacatttttagaccgaaaagcaaaaaaaaggtcttcggctcccatccgaaattttttcttgttatggacctgacccaaaaggcgcccaccttttgtttttttatcgggccataaaattcatgtacaagtgcagaaaatttattcatcaattcgaattacacatttaggccattgtctccaccagcggaggtgaaaaagaacgtaaagtgccatctttaattcggcggaagtgaattagatttgggaaattaccgattttttgacttctcgatgcatatgaatgcaagaatttacaaaatgtacaatttcattttatttataaattataaattcacagaaattacaatttacagtgaaaatgtcccgttcgaaaataaaattgaaaaatttgtcaaaaaattgaaaccgaaaatcaggagaaaacatccaaataacttgtcccaaatatttcagcaaatttccattcgtgaaaatttttttgaaatttaaaatattaaaaaatcccctaatttatccattacaaatgaatgcatttgtcaccgagaaaataatgggtggggggggggtggcagaaaatttaaacaattaaatttaagttggttaatttttaaatctattcatgaaataaaaacaataatttaaaaaaaaaagaattttttaattgatttacacaaacccatcctaagtttagactttttctttctcatttatagccaattttatggtgtttcgtaaaaaagtcttattttgaccaaaaaaagtaggtttattttttttacggcccatttaccattgtttggcattttttaccttattataatttaactatttcttcctggcattcaataaattgctacaagattgatttgcacgtttttcattatggcaaataccattaatgccattatcaattaatttat

SEQ ID NO: 1815 - DNA, 4935 bp, Heterodera glycines
tttatattgaaggtttttgtaatttaaattaaataatcaatttctgcttaaagagtacatggaaaactcagaatttgaaaaaatttttataaacaaataagcgttgaaatattttcaggtaaacttagtccacgtactgggtattatgcctataaaatttggtgcgatttttattaataatagaaaaagctaagttttcgatcgacctctgaaaatcctctatttttttaaaattggctcaaagtcactaaatttggacgattttaggacaaatcaactccaaatctaaatcctcaaaattaaaaaatggatgatttgtagcaaaaatttgtaatattatagaaaaatctaggaaatagctgtaaaaatatacattcaactgggttaattaactgccgaaaaaattatccaagttctatgccggaattttgccataaaatgaaatgcaaaatgttcgtaaaatatttttggcaataatataaagaaaagacaggcattttggcatatgataaagtgcaaaaatgttggccaaatatttttggcaataatataaacaaaagacaggcattttggcaaaacaaaaaagctaaattagggacccccattctttaggattgccaatttttgcccatcccttcctgttacacgttcaattgctgacataattatattcaaaatttcatattccttcttatttggcgcttcgtcagcataaattattttcaaatcatttattgccttttcacatttttcggtttctttccattttatttgccaattagtttggccaagtttttaaacaaacttacaccattttcggctaaaggtataatttggccaaatgaaatgcccaagcgattggccattaaaaatgcagcttctttcgtatgtttttgcaatttttcataaatttgcaaatcggtacaacctaaattagcaaattttcatttatattaagaataattggtaatattgaaggatttaaataattttttaaatttaaaaacctttaggaaagtttaattctgtttcaaaagaaaagcgaaaattatttttttgaaaaaatcagttttattgcattcgttctttcattaaaaaatgaaaagctttttaaaaattttttttttattgagaatttgtttaattaataattacctcctttaatgttattaagtgtagtgattaattgtttgaaacatttgataatgttgggtccttttgctccacaatatcatatcgttctctcaacaattttgctttatttaaaatcggctcattttttctcccataacttttagttctatcttcgaaaatttttgcgtaattctaaaaaattctttctttaaatagcccccctatttatgcttcccattttgtatgaaatggcaaaagaacacaaaaagtatatttagaaataaaatgtaaaaaatgatatcatttttaaaaatttttaaaataatatagactatttgatgacaggaagttttggcagctggaaatttggtcattttgacattaattaaaaataaaaaaaataaataacttacgatgtgatttaatccttaaattatcaaagctgcgcttaaaaattatcacttttaaatggaaatttaaatattttttaaataaatggacacctgtcaatcttattatatatttaatcaattcttggcaattaaaagtagggctaaacgtgtattagtttttgcttgggtttagagtcgaaccccccagcttataaggacaccaaaatatcgggagtccgtatattctatctaaaagtataaaattttgagttttcaacataatgaattttcaaataatacaaggatttttaatgccattgtaagtgaatgggcaattcataaatactttacattgattaaaattaattattaaattatacgttaagcattttttacaatttaaaatatttttatttttgaaacttataacatgcccaatttcgcgatgcccaaactgaaatttttcggcgaatttcgaccaaaaatgcatattcataccctttttaatgtaaacttcattaaaaaaaattatttttttaacctcatcaacattgattaaattcaatgatggcttataattgtgagttgaaaacactgcaataataagtgaaaattgctcatccaattcacagatgaattcgcgcaatattccgtcgtcggcttcattttcagccattttgtcaaagtaaatttttgccaagaatttgctggattctgttctgggcgagttgcatcaatattgttgctgaactgctcgagcagccacgtttaaatgcccagccgagtggtggtatacgtggcctgacgagccaacccagcggatagacctaagaagcgggggagggcatttgaacggcctgtgcccgaatgttggtcaacgggtcggtggatatggcgatcagtgtgggcaccgaggtgccaggcattgacaaggccctgctcgagcgtttgccggatcacttgggctgagttgacacggacaacctcactgaaagcggactaaatccatcacaaaaatgggaggaaatcaatttttatttgttatttttaattaaaaatattcaataagaaaatgaaaattggggctgactcgtagtggaagtagcagttgagtatggctttacagtactgctggatgatggtcgagctgatgccggacaaactcagctccatctccttcaagtcgtcaattgcgcaaggggcgccgccgctgctagggctgtgcgagaagtgatttttacctggaaccgagaaacgagaccgagaccgagaaatgaccccgagaaacgatacgagaaccgagaaatttaaatgaaattgattcaaaaatacttttttaaatcaaaaacacattaaaaaggggtaggtcaatcaaccagaatttttgcgaaggagtcttgagggggggggggggggggggagcagccaattttgcgatgggcttccacttcaccggcggacccgacaggcggcgccggtaaaattggattttttgtgcgatttagtaacagattttacccaaaaaggccaattttttatgaaaaaaatattaagtttttggggtccggcggtaccgatagaccggaacggaccaactccgtctaaacaaatgaatcaatatatttttttgttatagagaatgtcgaatcttctaaccatttaaagctttcgagtttgctgagttttatcaacaaagaaaacaatttttgaaatctacttaaacggagttggctagacggagttcgccccataccgcgataggcgccgcgtgagaaatattggaaaattttgatatttttcttcagacttcattgaaaaaatggcaatttttaggtcaaattttgaacggggaaaatttttttgggatttttaatgaattttgttaagaaaaccgagactctcgcacaaccctagccactgccaacgcattgtcagcggaatcgcgggcgggcgacgcgaaactgaataatttgcaaaaacatttgaaattaaaaaatataatacggtcggaggaaagagattcaaatagatgtgatagaaaactaaaagttttgaagcaagtgatgatttaattaaagaaaaaaatgtcagtaggaagacgaaaatttcagtacgatttgtgtctaattttttttcccaatttcgcattcaaattgaacatttgtcatcgttttataaacactttcttttcgcaattcctttttcatcaaattaaatttgtttaacctttatggcattatttttgttttttgaagttctttgacgtcgatggttttaggttttcccatatatcgtcaaaatttttttttacgataaattgactcatccttcaatttgtgcaacggattgtttcccatgaaaagtgcgattgttgtcgggttgttgatatcggagaaagatgattgggtgcatgcgatccaatgaattacttttttgtcgaatgatgaaagaccctcttaaaaattttaaaaaaccaatacatatgcacatttaatataacgtaccacttcctaagaccaagtgtgtttcgattgtccctttctcacctcgcttctgcttcaacaaatcttcatacttcgcctcatattcgctgtttttgtgttttgatttaaggtggtttatcgcattggaggtgttgccttgcttgcacttaatattcttactgcattcagcacattcgtactcaaattcattgttgttgctttttttataaagcccgatttgccaaatcgcacttccagagggcatgttgactattgctgtaatgttttaattatattaataaattaaaaaagaaatgaaaataaagcaaatagcactatgggtacgcgccagtgtcagacaaaattgctcataacgccaaatagcgcatttggcgtaaatttttgcgcgttaattcaaaagatatactgattactgccttttttgaagaccaattaacattaataaactttattcaattgactaaactctttatttaataatattatagaaagcggaaaagatgtgttcaacataatattcagatagtggaaatgtgaaatggtgaaaatgtttggaaaaatgaaatttgatcaaaagtttgggtatttatttccattttcttgattgttttcgacacctcgatcgtgaagggcattcagcagtgtcacgtgtttcaccaacttctcaacaaccttctctggagtgccgagatgagcataacgaccgacctggatttataattttaatgggaaaaattattcattaaaccaaattgttgcacattctgtgcatatgctccattccctgttcactgatcagtccccaccagagatgagtgcgtgcaaatggaacgacgtgagcagcgagaagatgaagcttcggccggactgggtaacgaccgccgtcatttgtccgagttgctgcc

SEQ ID NO: 1816 - DNA, 4715 bp, Heterodera glycines
aatataattgtatcaatttaagatttgatcttgttaaactatatttagctgtttgtacaattttatttttgaaagttatttttaaatatttttattatttgtcaatacaatttttttaatttaaaataaagatttcgacactgccgtatttattgaatcagagcccactttcgaggggttgaaaaatagagcaccagcagactccctctaaaaggtaaatatgaatttttaaaaaatattttaaaaacgaggaaaattcaagccgaggaaaaatccaggttgctgaaaatggcctggacctggctggatcaggaaaaatccaagcctggatccaggtattggttgaactagtaataacatttttgaataaaaatttattagaagaaaatttttttagaagccttcaaaattcttaataattaaatatttttataatttttaccaattttccataaaatgattacaagtctttcctatgcctaattttcagataggcaatctgagaatttaaaatttggattttttttgagggttggaaaaattttttgaaaataaaaattgtacagcaaaatcacaaattcaaaatacaaagttctccgcggcgcctttcgttaaaaagattttttgaaaaaaagacgccgcaaaaaacatttataaaatgaaaaaaagttagtcaatagttttttaatttttaaaattaattggttaaagaaaaaaagaatgttttaaatgtactgtgttagaatttgattattggcgttttattttgatttaattatgttgccccttcactatgggtacgcgccagtgtcagacaaaattgctcataacgccaaatagcgcatttggcgtaaatttttgcgcattaattcaaaagatatactgattactgccttttttgaagaccaattaacattaataaactttattcaattgactaaactctttatttaataatattatagaaagcggaaaagatgtgttcaacataatattcagatagtggaaatgtgaaatggtgaaaatgtttggaaaaatgaaatttgatcaaaagtttgggtatttatttccattttcttgattgttttcgacacctcgatcgtgaagggcattcagcagtgtcacgtgtttcaccaacttctcaacaaccttctctggagtgccgagatgagcataacgactgacctggatttataattttaatgggaaaaattattcattaaaccaaattgttgcacattctgtgcatatgctccattccctgttcactgatcagtccccaccagagatgagtgcgtgcaaatggaacgacgtgagcagcgagaagatgaagctttggccggactgggtaacgagcggcgtcaattgttcggagttgctgccagtggcagtagaacattttggtccagtgttcaagcgaattgaggtcctcgggatgaaggattttggccctggaaagacggtaaatgttccgcagatcattcattgcatccatcagcaagaatttcaatggtccgggtggaattggtgccgtgaatgaagcgaagttttcttggtcgaggattttgtatatgtcgccacctgtcaaaatttggcctcgataactcccaccccatccccatgattctacccgtgaattgttttgtccgagggtgccgtcgcacgccgacatcagacagtcgtttccgaacaacgtccccatttccacgagcatccgcttccgaacaaatggcgtcaataatgcgctgaccattgcctgaaaattttgaatcgtgttttaattcgctttcttcaccatgcaaaagatggaaactcggcggtacaacattcgtcaaagcaatgttgacaaggggagggccaatgtacaattttggagtgggggaggcgacgggcgagcaccgacaatgttgttcgacaattggtctcttcgagctgtgcacagtggacaagggaaggttgccgcagatccctggtgccccatcagtgccgaagtgaatttgaggtctgcacagagaagcctgaaatttaaaactaacattcctgatatttattatttctttacatttggactggaatggtccgcttcctcccggcaatttccactgaaacggtcttcagctggttcaattgcgcaaaaattgagccaaatttgttctccaaatttttccggtcatcattcccaaaataaatacccaaaatggagagatttttgggggaattcgggtgatcaacgttgccgatcaccagtcccaactttgtcgttgccgccactccatcgccccctttgtcacccgtcagcaccaacacaatttgagagacaaattgctggtggagtttcagtcggccttcatttaacattttaaaattcgattatttttctctctctcaccactgttcaccaaatcctgaagacggccctcgatcattgcacgaacgtcaacggaaacgagcgcacgcgtctcaccattgcccgtccaatggaaattgaccgcctcgcacagttccgccttcagacgcttcactgctctcgtcggtgcccaaacatcatgtccttggccggcgaaagaccgcttcaacgcttcacgggccttgaacgagatgcccgcgtccaatgtgatgagcagatcattcgccgcgctcagcctgttgtccccctgctggttgttggtcacgtcggaaagtgccttgcgctggcgacatgccgaagccgatcgctcaaggcttgttgaccggtcgcgctgggccttgagctgtttccgtagaaaggcattcgaccggcgctgtcgctgcagttcctcctcggtccaaacgtggcgccgtcgcagctcgtcaaacatgtggacttaaaaataataaaaatgaaatgaattaaaaaaaactaaatttttgtttgaatttctctcaccatcatcgagaccaaaggcaccggcgcactttgaagtcgatggtgtcgacatgaggtcacagcgtgccgtggatgttgacggcattggttgaatttgttggtcttcatcggcaggcgttgaagggatttgcacatcggtgtccaccatctccaccgacggcacgtccatttcctgcggtgtcatcggtgttggagttgatggtggtcgtccgtcgttgtcccgcgccggtgcctctgatgtcggcggctcatcttcggatggttgtggtgtttctgcatcggtgttgggctggggagcggcttaaatttgggaaaattgcatattttatgaaaaatgaatgtaaaaactcaatttcgtggcccaacgggcttctgtcgctttggccgttcgcgcgcgtctctcctcccgcttgtcctcccactttttccaacgttcctgggccccttttttgcgctgtagtttacttattaaatttcttttggccataaaatctaattaaaaaatattttttattaggaacttcttaacttttgagtttgagcacagacaataataattgagcatagaataatgcagaatttttttctctatcgatatgcaaattttggtgtaggtttaacgtatagaaaaaaagttagacggagaaaagtaaaagttgttttttacattgttaaaaataaagagatagtacgccaaagtgagagaaattataaagaaaaagagaaacgacgagatagtactaggcttttctctgcacagttgggcgtacccatagtgaaatagtgataatcttttcaaaaacctgagaatttcaaacagtatactatgccaaaaattgttattaacgggttatgtctagggctgggatttttaggtgctaaaaatcccaaaataggtgcgaaaataggtgttaaaaattggaaaaatccagtgtctttatgtacaaaaattccaaaagcgactaatttttttatcaatttcgcccacacaattgcaattggtcaagaaaataaataataaatattgtggatgaatttttggggaaattttttgtttcttaggggaatattttctgaaattttggtaaatatttaggggtatatttaaaaacaattttttgggcaggttcttagggggtgtgtttttcaattttattgcatttttgctatgaaatttctggaaaaaggccaaaatacgtgctaaaactcgaaaaatgccaaaataggtgcttgaccgaaatccagttttaggtgtttttaggtgctaaaaagtcgctctaaatcgaaaattgttcggagaaaatgctatttttgggcttctctcatcataactaagccgcaaaaaaaaagtggaaagaaagtcgaaatttaggggtctatttttcaattttttgtattttccttaagaatttttctcaaaaatgccaaaatagctgctaaaaattcgaaaaatgccaaaataggttgtaaactattttaggtgccaaaacgccaaaataggtgctaaaattcgcaaatgccaaaataggtgctaacccccgttttaggtgtttttatgtgctaaaaagtcgctctaaatcgaaaattgttaggagaaaatgctatttttgggcttctctcatcataactaagccgcaaaaaaataggtaaaaacctaaaaatcccagccctagttatgtctcttcaattcgccattcggttttatttttagatttttcataaaagtcggtcgattgtttcggttttttgattatttcggtcagtcggtttcggttaaaaaaccgaaaaaaatcgaccggtccgatctcta

SEQ ID NO: 1817 - DNA, 3145 bp, Heterodera glycines
  misc_feature (908)..(908): n is a, c, g, or t
aaaagtcagaatttttgcatattttaatttataacttttttacatgtcggtatatctttgtgatttttgggaagctgatagagcttgttaagagctttcgattgatgccaaatttataaaatttggccagctgagaaaaagttacgatgctctaaacttggctcagactataacggccagactatagtgtcccagtccgtttttgtcactcaaatttggcaaaatgtccaaaaatatttcaaaatgtttttttgaccttttcatgacttttttcacattttcggcaaaatttgaattttagtcaagaaaattactaaaaataagtcaatcgtagacagcgagaaaaagatttacctacatcaaaagcattgaaatgcttttgattagcactgggctagcgaaatggataaaagaaagggaacgtgccgggccgaaaatagaacttttcccgagtttgggttcctcgggataattgtgattttccaattccatatttgattgtccaaatcccttaaaataattctccgctttttataatttccatatcctctctttttacttctccattatccatttaacttgatcgatttatttattttaaaaaatggaaaatggttgtgattaaatgtgagaatggaattgtgatttcaatatgaaaatcggtgaaaaataagattacgtaaatgagaaattggtgaaaatggaaatggtccgagttctaagtgttcttttagtgaaaatggccgaaagaggagaatcctgagggacggcccggggaggggagtgggaaagagaaccaaagatgaattttatccgggaatcgaaaggggggggtgggaaatggaaaaaggacggagaagttttccttctccggagccgctcgggaattttccgggggtgagtcgacntgactgaaaaggaggggatggagaaggaaagggacgggaggagagtaagtgggaatctcgggatgaatggggctctcctccgctttagctgtgttacccttggcttttaaagggaacggcgggatccgatagcgagaggcggggtataatgcgattgcctaatcgaagaagaggattattggaaaatcgcgggaaagtgaaggaaaaggaaagggaaaggaatttgtaaaaggtaagggacctaagaattagaaaatgcctgtgggttacataaagaatgagctatcttcttgaaaaatgaacgtattttttgaatattttttttcagtttttgtgacatattttttccatttttgggggtttaggacatattttggttttttggcacatatatatgtgcatatttggaattttttaggacataaaatccagctctgatatgaataacaacagtaactcatcttcgtccgttaatgcatttggagagtccgaccaaatttacgtgtacaccgtatgggtgaccatcattcagcaaattttgtcactttttggcattgccctaaacagtgcactcgtctatatcaccatcaagcacaagtcagtcactagaattgtgttagcattgttttgaaatttcgttttgaattgacgacgttatttttaattctaaactttaattaataaatcgcgctgggatttttatgtgctaaagatcctgaaatatgtaataaaataagtgctaaaaagtattaaaaaatgtgctaaaaacaaaaaaaaagccaaaatatgtacgaaaatatgtgctcaattggaaaaaccaagcctatctgtgcataaaaatcctcagaaaacctcatttatcatttcccctcaaatacatatttatatttttgcaaaatttaaatttcaataatgaaattaggaaactccaccgaagtttcggctttctgttggccatctgttctttttgtgatgcactcactgaattggccactccattggctaccggtaaaataattaaataattttatttttattattattttttaaatttttagttctcgtttttcttcgtgtgcggattcctctgttgacttgtgtttatgcccaattttttgctttcactggaagtattaattcatttataaatctgttttggataagcgttgatcgatttgtggcattggcatttcccgttttgtaattatatcaattattattaagaaaattaaatattcaggaaattaatcaaactttctttaagttttcgtaacatatcaagattttccggaaaatatgtgctaattgccaatgtcttttccttgtcaattgcattttatattatttatttgtcgtttttatttgctctacaaaatcccgaaatgtaattattaataattgattaattgactaattaataataattttaccaattgaaaggatggtctattgtgagcctggtgatatgattcaaggcgaagtatttttggttgcttctcttatcatggttatttttactttggctacaattgtcatttatattataatggggattatgttaaaaggtaattaaaattaaatgacttacggtggttgttaaaaaatgcattttgatttcccagtgatcagaagtgatcagaacaacagcaacaattcgtcccagtcccaaattgaaatcactcgtcgcattttcaaatcattggctgtgatcatggcagtgatcttttgcttttggtttttgtttgcactgatcaccaacattttggcacgaggactgatcaccattgagccatcactgcaatttcttatcattcgattagcagcgcaaatggtcacaattgctggagcgatcaatgcaccaatcctatatatttgcaggcaaatttagaattaatattaaaaaaaacttttttaataaataaaggttttttagcaaagaatatcgtgatatattgaagagtgagttcggttgggtcataaaattgtgctcaattcggattcgaatttcatttgcccatccgaaacccaatcaaaatgctgttactgttatggttgtgccaagaactgtgaaaaattcaaacgaaaatcgagtgcatatccgatgaaagaaaagaaaatgttttaatagcaaaaaattgagcgttatttttacaaaatagattaatttatgctttttttagattgatcatagaatcaaataattatggataaaaaatcttgtacgtcatttgtcactt

SEQ ID NO: 1818 - DNA, 1342 bp, Heterodera glycines
ttaaacagtatgtttattgtgaacctggtgatatgatacaaggggaagtttatttgctcgttactcttatcgtggttatttttacgttggctacaactgtaatttatattatcatggcaattatgctgaagggtaaatttaattacttaatttctaaaataaattttaaaatagtttttaattgtcacattagtaaaacaaatgaatctttgttgctcaattttcagtgatcagaagtgatcaaaacaacagcaacaattcatcccagtcccatattgaaatcactcgtcgaattttcaagtcgttggctgtgattatggcagtgaccttctgcctttggtttttgtttgcactgatcaccaacattttggcacgaggactgatcacgagtgatccgtcactgcaatttcttatcattcgattagtgatgcaattaaccacaatagctggggcgatcaacgcacctgtgctttacttttgcaggtcaataaaataaataattaaattgaattaaaaatacccaaaataataaaatgagattaaaaaataaaataattaaattgaattaaaaatattcaactataacattcattaattgcttttcgagtgaataaaaaaacttttattttttctacgaaaaattttgttgccagaaaactgaattagtaaaaaaaatgaaaatacattaatatcactaacaaatattcaatattatttcatttttagctctgaatatcatgaaataatgaaaaatgaatttccattggccaaatttttactgtgctcaaataatcataattcgccagtcgttgttgtagctgtcgggcaacaaattctcggttctcccaacatacaagcaaatgcatcataatagaagaaattttgaaaaattttaatttgtcataataaatttcacaatattttgatttttatacgcataaattataatttcattgacccaaatataaatttggttctagtcagttttatgcgtcccatgtcatcaaagaacttttcgcgaacaggggtccggcggtgccgataggcgccgccgaagaaaatttagaaaaattgagtgtgctttattaacagattttcaccaaaaaatgaccaaattttgcattttgagctaatttttatgaaaaaattcataaaatattaattttttttaaagttttccattgaatgcttttcttttttctgttgttgttcccttttgctaattgctcttattgctttcttctgactgctgaccattttctattaattaattaattaattaattacttatttgcaccttttccttaatttcctttcaacctgttcgcatcgaaaattactg

SEQ ID NO: 1819 - DNA, 1569 bp, Heterodera glycines
tcattcatttccacagaaaatcgcacttggatcaccggacgaacaaccccgcccctctcgttcgtttcgtccccactttccagcgaaccctcgtgaccatcgcttcgccttcgggtcgtcgtcgtcggcggcgacgccaacgaatcgtcggcacggcgtttcgccgggggctcacttccgaatcggtccgtttcctccttcactcgcgaatcgaatcggctcgatcgcatttcgcatcatttctttcgaatcgcgtctccagaaactaaaaattgaggaaattttggggaaacgaaaaagtgacactttttcagattaaaataaaaaatacttgaagttttaattcccttaaaaattttaatttttaaaaaaaccgaaccaaatgtagaccaattttggtttgcatttttttgttgttatcaaatggcaaaaacatgaacctttgcattttgctggcgtcgttttgttgccgattcgcttcggttgtcctgtgggccctccgctcggatttggggctgccctttttcggttgttggaaggcttcggcttccttaatttttttaaattatttcactccaaaatacatctccccactcaattttcagctttttataaacaataaccttttctgttttgtgactccgcgttcttcgagtgttttcgtcgacgcgtccgaatcgtcgctggactcgctgagctgttcatattggccaagacggtcgaggaggaagtttttgtcacgcgacagtttaagcaatttccgctgcaggttccttagctcttcttggtaatattcattctcctggattaaattgtttgttaaggcgggaggataaattctcggcccgcaattattcaaaattaccaagaaaaaataggtaaaattgttgattcattttttaaaatatctttaaaatttcaaaaaaatctcctgacgtatcggcaccgccaaaggctataaattcctacttttttgccggcgctttgtctttgaatttcaattttaaagtgattttccccttttgacccacataaacaaggtatttgaacttcttcttcaagtcccgatatttctgcttcggggaaacgttcggttgcgcttccatttcggccattatcgcagcggtaaaccgttgcgatccgatgtaaaggtgcgggtgcggaagagggggcgggtgcagggacgggtcatgcgcactttggggtggcaatgtaggcaccatttgttgctgctgctgctgttgtacaaaaattcgctgggtttggtgctgcggtggcgccggaggggccgcgtgcatatgcaccacttggctaaatggggggaaatggtccaatccggcgctaccgcagcaccaaacccagttaaaaatttttttcactttttttggactaaaatttttttgttttattttgatacagaatttgcttttttaccatattttacgcatttcacgaaatttaataattgaaaacaagaaaggacgaatcaagaaggaactcattaacactttggattttgaaatttatcaaaaaccaaagggaggacccttttgatttgcacttatttaa

SEQ ID NO: 1820 - DNA, 6579 bp, Heterodera glycines
aaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccattttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaattttattcatctcccaatttgatagaaaaagcatcagagtgcctaaactaacatgtaaataaaatttggtgcgtttcagaaccctttctgaacaaaatatttataaattaattatgcaaaaaacaaatagataatgaactctcttccttaataattttcctgcaaccaaacgtactctctctgccgcttcacgctcgagtgcaggttctgacacacattttaagggaattttggcgctagttaaaaagtgacagattttgaaaaaaatttcactttttttttgtcaaaatttttttttttgttagttttgatacagaatttgtttttttaaacagatggtactaatgacaaaaaaaaaccaacaaaaaaaagtgaaagattttgaattttatccaaaaaccaaagggggggggggggtcattaaaaagtgaaagattttgaattttatccaataaccaaaggggggacccttttgtttcgcaaaattttctttgataaaaactcgtgaatatacttttattcgccataattgtgttgttaatgcttaatgttcatcattctgtatcaaaataaacaaaaaaatttttagaccaaaaaaagtgaaaaaaattttcaaaagagtacgctttgcaactagcgcctccaatcccattgaaattgccacttttttgtacccggattgttctattcgaatcgccgtggtgggatgctgctgctgtgggtgttggctttgctgttggctgatcagtgtttgctgctgcgacgggtgatgggtcgcgtggcgttgtcccatcatcacttgttgttggtgagaaatgtgcgtgtggccatgctgcgcaagcctcggctgtccaacattgccaatctcatgctcttgaagggcttggacactcgacggttgcgattggaacaatggcccggccattgatgggtactgctgctcggttgggtgttgctgcggatgtgccggccttacgccaggctggggacggatgtgttggctttggttcgtctcctgctgcaacggatagtgctgctgtggtggctgatggtatgcgacgtgtggtcgctgttggaagtgttggctttgactcgacgtcggcggtgccgtcgctgcgggactttgcggagtgttccgaaggtgctgagacggatttgaatgttgagcctgagtcgattgttgctgcatcattatctttctcgaaagaaaatttgtaaaattagcgataaaaagtattaaatcaaaattccctttccagtaaaaaaacaaacataatgccaatttttaattaaatatttatttaaattttaaataattaaatttaaaattaaaaataattcaattcaaaatagtagggttcggaccccgcccccgtcacccccgcccccgcgactctgacccccgcaatctccgcccccgcgatcttcgcccccgcgggggcacggggctgaaaaccacccctaagaatggcatattcgtgggataaaaggcaaaaaatttatacaaatttgaatttttaaccatctttgacaaatttttatgaaataaagtaaattttgctgttaatttccaatgtatttgtggtttggtggttagtgcctcaacactaacagtatttcttgttaggagttcgacaccggttgacgttttcatttgaatttatttttatctgattaatgcagggtttctttatgttcttattgctaagaactgttctgattttagggcgtattttcatccaaaagaatgaaatttctgaaaattttggctaatttctaacaaaattcataaaaaaaatttccttagcataaatcaataaatttggtcattctttagacaaaatctgtgtaatttatgccacaaggaattgaatcgaggcgatgcatcgactaaaggaatgtggagccaacaaatcattcataaaaattaatttttttgtgagattttttggagctaattcaaatcagacccccgcccccgtccccgcgggggcggaattatcgtgtccccgccaccggccccgcgactctgacccccgatcccccgccccgcgaaaagccacccccgcccactgggtccgaaccctaattcaaaatattaaatcctgtgaaaagcgttttagctaaaccgccaattataggcaattatgatggagatctttggaaagctaacagaggataattaaaaattatgtaataatatattaggccaaaaattaatttcaaacataaaaatattcaaaattttgtaggaaatatgccgaaatcatcgtgtttatctttttttgctaataaataggacatatactgtaaaacgtcgaaggacacttttaacgagtttatttatctacatcctaattaggtaattaattaatttaatattaaaaatgcgttttctttattccatcaatgattttccgattaaattcccgaaaggcgagatcgcaatttcgcttccatattcgttttgatttcatcgtaaaagcagcgcttcattttctcgaaatggtcgtagcatggcaaatacgaatagtccaatttggtcactttgcccgctcgctaatttttgacgagtaaaaccaaaatttttaaaatttaatcagccgaaccaactgacctggtcacaaaatgttaggcctaaaatgatgaattgccgttagaatggctttttaaaatgctttcattcgccttacatttgtcacccgccgaagtctttccaatgcccacttttgtgcagcattccgaatggtctctgccctgggccgcacaatattgaaggtcagccttaattggccataaatcggtcttttgattgaaaccctttggcatttgccaattaccgccgcgtcaattgggcacgggtcgtttttgaagaacattagctgaagctaaacaaacaaaagggtgtacggaagctcatttttgtgccatttacaagaggcacattacgcaatataattatccccaaatgccaaccacatctttggtaattatccccaaatgccaaccacatctttggtaattatccccaaatgccaaccacatctttggtaattatccccaaatgccaaccacatctttggtgtaagtgttgaaatgacacttccaaaggcacgagtccggaagttgtctatctgacaaatcaaacaactgctttggtttgatcaatgcttcttttggcactttccctccttaccttcgcagcactgtctgaacaaataattcggattctgaatggcattttggtctctgagtttgctaagcgccgtttgtcaatgtttctcttttaccgtcagtttcaagaacattccctggtcaatggtgcccggtggtcgattgccctcgtcgtcaattgggcgcgatttcctgcgctcgaacccataaatgtttctcagcggctttttcgtttggttggccaaaaagtcgtccaccggcacaatgagcccgtcctgtgccatcgccggaggggaaatgtttgtgccaatgccaatggatatgcttcttccatccctctcactcacctttctggtcagtgctgagcgtgctttgtttcgagcgcacccgtaatgacctgagcaatcgttggttcattcattgaacgattcgaacattcattggacggtaccgcacgtgtagccgggctgacaactcgcgggattacacgccaccggcgccggctgacacgccgggccacagcatccaccgccaccgcaaatgccattggaggcgcactgagagggacaaacattggcaagggaataggcgctgatcaaagcgaccaaaacaaagtctgatcactctgatcagcgagcagtggggacaaaccgcctcagagaacggaggaataaacaaaatgcaaaaaaggacgaaacgaatgggcaatttgaatgccgaagaggaaagcattttttgattaaaaatcaaagagaggaagaagcaaatggaaaaggaagagaagagggaaaaatttatatggacggggataaaagagagggagcaaaaggaacaacacaaaagcacaacaggcttaagggtaattattcatcggagcattgttaaaagatggttggtggcactcaaatgggaaaaagccgaaggaaaagccgaaggtggacagagggagagggggggggaatgagtgtgggaagaggcaaaaagtaattgcactttgggagggggaggagtgatcagtgatctgagaaattgcaaataattagcaaaaaattggggagagaagaacgacggcgtttgatgagctgatcgaatggagaggacggcaaaaaaaagtgattgatggcaatgccaagaatttaatggcaaagggaagaaaaataaacgaatttaaaattaatttattcacgaatatcattgacataatcaaatgtacataaaaagagaggtggaagttgtgaaatggcaacaaaaatagacaaaaataaaaaaggtaaccaaataaatcacattaatgtaataaatttcccatttgttaattgactttcgtttaaaaaacgaaacccgatgagcattttggacggaaaaattgcacaaaaaaaacacagaaaacagaaagaaaggtccgatcagcgactgatcagaagttgccggtcagcaccatgccgtgtgttcgcatattttggtctgaaattgccaatgttccttttgttacgtccgcttttcctctgcttacctccatcggataactccgatcaaaaaagtgtccgtttacataagcggtgggccaaattcgaacgccggccctgggaaaagcagcggtttttgtgggagttcgattcgttcttttttgcctgtgcgtgttcagcatgctgacgtaattgagcacctccccggtttgcgtttccgcgcattgctttagtcggaattgcgtgcggggcgaaagccgcgacagacaccgccggtaggcttcgtccaaattcttcagtccctacaattttaataattgccatttatttgatgccactttccccccttaatcaatgctcacttgaatgcacgtcaccaagccaatatgccgtcgtgggaaatactgtgaaaagggggggggggataattacagaaaatatgggggaacagcagaggctgcataatgtggctaatggaacaaacagtggcacttttgtgttttaatgccatgaattgttgccaaaaccccttttcaccgatatggcacagttctgcagtcggttcaggtcgcattcggtgggcccgtgcatacatttgcaaatgatccgccggtcgcgcgtgaattcgcagttgcctttgccgaagggaatcacctgaaaggaattcgatcattcacacttttggccacacggagtttctgaaggacctgcagattcataatgccggggaatcgggaatggaattgccaaatctgttctcgaagcagtcgcgtgcagaaggggcattgggactcggtgaacagctgagaaaagaaaagtgacggaatgccaaattcggaatgattcaaagtgaacgacgacaatttgaatgtgtgccaaaagtttttctgatttcttaccgttacgttgacacgttgtgtactaattggaggaaatgcgcaaatgaagagaagcaatgaacaaaggcaaaggccaaagggacgcgaaagtgaagaattggccatttggcattggcaaattcagcggttttgagaaaaaacgaaaggggagagagtgccaaagacaaatgctaaagcaaaggaaaagcataggaaatgctatcgaagagtgacatccccgggcattatggccaagtaaaacacttataataatgcctatttaaaattgcaattacaaagtgagtcattgcccccccccttggcacttaattcggccgattgataaccgtccattccgctcccctaaattcgtgatttttgcaaataatcgagaggtcaaacaaaacgggggctgagcgtgggctgtggtcatttatttattccttcagtttgggaggggcggcgagcaaagcgaagcgaaggagcaaagaatcaaattcaaaagagacaccacagcagtaataaccgcacctcacaacaaacactacgca

SEQ ID NO: 1821 - DNA, 320 bp, Heterodera glycines
ggaggtgaagcaattttggaaggacaacagcagaaatgggaaggaaggaatgacccagggggtgaagcaatggggaaggacaacaggaaggaagggatggcccagggaagagggggggggggggtcacaacagaacttatcgttagcccaacggacaaatgttgaacagaccacgcttttccatttgaataaatattggacatgacaaataaatggtcggctttatgtttaattaagttgagcaaagaaatgtgtagctgttttgtttttgccaatgagaacgtgtcgtgtacacatattattattattcattgctttgt

SEQ ID NO: 1822 - DNA, 3126 bp, Heterodera glycines
ggacaaaagcacaataaaataaaacaatcgaaaacctgtattagtacacagaaagctaatatacaaattcatacaaaggcatgtaattcataaggagcatataaatccatcaattatttttctgcatatggaatttcaggccaatagcccccgcccgtcgggcgccaacttttttttttttgctcattatgcaatctttgattgggatttcatgaaattatcagtgatgcttaatttttttatcgctcagttggccagcacataaaaagagagaaaccccatttgaagtaacaagacacggagtccagttaaaattggactttttgtccagaatcctgttcgggttcgactcggaaaaccggtaaaagattagcaggcaaataacctatggttttatcaatcaaaaataacatatgactttacaatcatggggtacaatttgtacatttgaaatcgaaataaataggaataacagtattatttggacattatcaacaaatcagaccagcttgtacattacattggtcgggataataactcgaaacataacacatttatgggacattatcatcatagaatctgatcagaggacacaggatctactagacgaatcgtcgtcatctttgggtttcttgttgctggccttctcctcccaaagttcgatgtgttctcgcagctgctttttcaagttctcagattcattgcatgcgccaccatgttgatcagaatttgcgtcctcaagaacctgaaaaggttcaattgaattccaataaaaattgttaatccctagcctttttggcgaaatcgattgcggtttcttccatgtccaaattgtcgtagtagaagatgcagaagttcagtccgagcccaagccgtgtagcatttgctggccgtagtttgtccttggctatgtcgaacgcctcttggtatgcttggcgagacttgtcaacaacacctccgattgcctccgccgccatgtaacggtagacgtcagccttcatctttaggtagaacaccttcacttcggggtcgtcggccctcgagatcaacttgtccaataactccttaaaattgaattttaaaactaataaattggtccatcctctcaccacgagctcgttgcatgtgtcgtgcaactccttgaccaacttttcgcgatatcgcttgagcatttgcagctgcttttccgtcccatcctgcgtccattcgatcggagagatctcccgtaaggcgaagcgaagcggacggatgacagctttgtacgcaatcgacagcatgttccgctcctcttcgttcaagacgttgtccaactcaaccacctgaaatgggaaaggaaaagggatataatttgttattcattaagctatacaatgatcaaaaccaccttcttcatcaactgtcccatgtcgtagtaacgaacggcttgatccgctagtttggcacgatacaagattaattccctgttgctctccattattgataagctgaaacggaaattttacaactggaaataaatttttgagaaaacaacaaaaagttataatatgtggaacaaattttttttttttttttttttttattcagaagaaataaaatatccaacgaaggggtgaccacttacacgttagattttagtaaattaatatcaagtccaaggagctcttttacagactgaatttttgtttaactcaatccatttatttatacgttttttgaaactgtcaacagatggagcatctgttatatctttgttgagtttagaccatattaaggccgttctgttgataaaagaatttgaagttttactggattgtgattttaacacaactttacgtctaagattataagggatgtgaccagaaaattgtgggaatatgtcttttttaagatgagtgagaccattaataattttgaatgcctgaactaaatcaattgtttttctcctttcttctaaagtttgaataaatcaagtctttgtttgtaaggtatgtaaggaagtctgcatttaaataatgcaatttttgtaaaatatttttggcatctttctaatttatttatatcttttttgtatgtcggattccaaatttcaggcgcatattctaaaagaggacgaatatatgtcttataaactttggtccaaattagagtgccacgggaccgggaatttttgccaaaacgggaccgggacttgtcgggacctgagaagccgggaccgggacctcgattttttttcgggaccgggaccgcaagaaaaaccgggaaccgggaccaaccgggaaattttaaaaattcaaaaaaattttaaaaatttaaaaaaaattcaaattttaatttatatcaagtgaaaataatacaaaattatttggtttttttatttaataaataaattaatgaaaattttcaaacaaattttcttcaattatttcaaacaattaatcatttttggactaaatcatcgaatattaatagaaattcagatttgattttcacatcactttttttcggagcgctttttcaaaaaacttttgggaaagaaggggtccggcggtgccgataggcgccgccgggggaaattttaaaaatttgggtgcaatttgttaacagatttttaacaaaaaaaggttggtttttgcgattattaagctcaattggtaggattttcatttaaaaaatgataaaatatgtatcaattaaaaaaaaaactatgaggaatcatattttctttataggaaacccacgagtatacaaaaaaaaaaaatttgaaaataatctaatttctgtagagggattgaaccaggggaaagaagaagggaaagtcaaggagactagccattaggccatttgcacacttgagcagtgttacttttaaagaatatattaattattattttttatttttccctttgactccgattttcttcactaatttttcactcagacccccattcttaccagtgcttgtttttcccggttcccggttgccctaccgggacctggaccgggacctgagcttttcaaaacccgggaccgggaaccgggaccgggacctcggatgaccgggaattcccggcccggtcccggtcccgaggcactctagaaaaacagattcatatttttttaacttaa

SEQ ID NO: 1823 - DNA, 1427 bp, Heterodera glycines
attgacggcgcacgaacagaaaaatgaatttggtaactgacggaagaaatggcattggcacgaagaaaatgctaaacaattcgataggaacaaatatcagtgatttgttgaaaatgtggggccacacctccttgaaattgttgacccaatctaagtccgtttgtttgttgtaatctacgcaacgcaatcgcttgggtcgaattatggccacaccagggatggcactgaattccgatttctgaaattttttataaaattcggaatttttcaaaaattttcgatttataacttttttggggtcgggtttcagaaaataactcagaatgccatccacagaccgggtacacccctaaaacgtcgccgtctcgtataaaaactaattttctgaatttccagaaaaataaaaaaacgacttttttacatttccttgaattttcttaataatttttttcgaatttatctattttttttgatttaggctaggtaactaaattttaaataattttttaaattaaaataaaaatttgcggctacgttttgtccccccccccccccggaccacacctccttgaaattgttgatccaatcagtgttcgtttgttctttaatgtcttcgcaatgcaatcgcttgggttggccatcttttctcggagagtgcaaccatttggacagaattttgccagcagaaattgttgaatttggcccatcaaaatcatcaccaaacgcagcgggcgacaaatcaccggaatagattgaaatcaattggttgagatcagtgagaattgttggcgaaatgagactacgcaaattgtccaaatgatcaccatggggaaagcccaaatggcgaatgtttgccgaaaaaattggccaaatttcacgaccaaaaatgtccaaaatcggctggccattcgtagagtgtgatgatggaatccacaaatataaattggtgcctcttttgtcgaaaatttggtgatttgaacgaagaaaagcgatgacggagtgatcgatgtaactggaaatgaaataaatgcttttattgccatagctctgattttcaattaccatatcttaagaactgaaaaaagttttgttaggtaaataaatgacgaatttgtgcttaccgtcggttcattttttggcaattagcaaaatttgctgttgaatttcgaatgatgtcacacaaatagcagaaaaataattgcgttggataaagcctggatttttagggttttcctattttttacggataatacttgatgagaaaaacacgagaatcgcattttattaaaacaattttgaaccagttcagcttcaactgttgccaatgggctcgaggggttggacaagtgccaataggaggcgaaaaatcattgccaaaaacggaaggcgcggaaacattttgacataaaatgacgacggatcggaag

SEQ ID NO: 1824 - DNA, 3279 bp, Heterodera glycines
atcggaagaaaaagggaacgcacataagaggaccaccaaatagaaattgaccaaaatggaaaaacataactcgtactgtctttcgacaaaaaaatgccatagttttgccctaatggacttatttaaatattcttggtataactcgatagccctaaagattctctgtatacaggcaaaatttcaaaaaatttgatgaagattgaaaaaaagtcatgtacgaatttttttttacgatttttggtcataacttttttgaaaagcaataaaatggcggtgccgataggcgccgccgggaaaaatttttgaaaactgatggatccgttaatagattttgtccaaaaaattataggtttttgcaatttttagagaattttttttaataaaatttacgaatttttgggccctgcgatgccgataggcagcgccaggcgaattttaaaattaaaaaaaataaattaaaaaagaaaccgtcaacctgaatcgaactcacgacagtaagtaatgtcaaggttgattcactaaccactacaccacactacacatcaatgaccaataataaaattaactttaattcataaaaaattttttttaaaaagattcgatcgcttgctggcggcggctagcaggggaagggtactgtagcttgggatgggtttttgtaacaataatatactgtagctagttggcatacagtaagcggtgggccttttggaaaaagttgctactggatgtgcgccagtgggaatccatcagtaaaacaatccgtcggttatggacaatctgtcagtggacaatccgtcaacaaattttttttttaattctctgacgaaatgtcctttgacggaacgtcagtctactgacgaattgttcttcactgatgaattgtccgtcactaatagaattgtcttccgaaagattatccactgacggattgtccggaatccggataccgtcaatggtgggaccgcattccgggagtttttgcgacggaattacacattccggcatttatggcttgccgaacacctccatggcatacacatttaaaaatggcattttaaggcgaaatcaaaacattcaactggctccactgctggtggtggactatcagtgccggcgccaaacaatcggaagaaaacgccaaatcaacaacaacagcaaaaaggaaacagcgaagggggaggagaaggaagagaaaatggggggaaaagagaggaaaagggaggagaaaaaggagcagcagcggaagcagaggaaaaggaaaagaaaattgcagctgaacaccatcagaaacaacaacaacaaaagcaagaagttcaagcagtacagcagcaacaacaaaagcaaattttggtgtgaatggagatgaagatggataacagcaaaaatggagaaacaagggaagaggtggaaaaggaaggaaatagcactggggaaggaggagagacggaagagaaagagaggaaaaggaaaaattcggcggaaggaagaggaggaggagagaatgaagcagaaaagaagagagaggaacagcagcaaattgacactttttaaaattttgcctgctaattgctaatggacgtcgtaaatcccgcgtcaaaatcccgaaaattaatgtcacaattttcaagcagagagaaattcatacactcgatagatagcaagccatttttatgcatccgattgatttaccaattgagaggtttttgatcataaatgcatttgatcactgatttaattatgatcagtcggtcattcttctcaattaattcaattcttcttctgcggctgatcattgtttttttgttgttttgtccgtcactcatttcgcccttttgtgatgctttgtcccgtttcttctgctggtggcggagacaatggccttaattaagcgcaattcgaattatttaaacaaaattaaatgtcttttctaattgctcacccaatgctattagtgccaccaagcaaaatgatcacattgtcccaattattgtcccaatttccgtctttccaatgaaccgccgccgtctccccaaatttgcatcgtttcattatccaattgttgttccattcatttttcactttggccaatgtcagcttttcctttgtccattcgtttaccaattcaaatggcaccatttgcattggcgacacaagaacagaaaaatgaatttggtaactgacggaagaaatggcattggcacgaagaaaatgctaaacaatttgatttgaaaacaacaatcagtgatttgtcgaaattatggccacaccagggatggcactgaattccgatttccgaaatttttgataaaattcggaatttttcagaaattttcgatttataacttttttggggtagggtttcagaaaataactcagaatgccatccacagaccgggtacacccctaaaacgtcgccgtctcgtataaaaactaattttctgaatttccagaaaaataaaaaaacgacttttttacatttccttgaattttcttaataatttttttcgaatttatctatttttttttgatttaggctaggtaactaaattttaaataatttttttaattaaaataaaaatttgcggctacgttttgtccccccccccccccggaccacacctccttgaaattgttgatccaatcagtgttcgcttgtgcgttgtaatcttcgcaacacaatcgcttgggttggccatcttttctcggagagtgcaaccatttggacaatgcttggccagcagaaattgttgaatttggcccatcaaaaccatcaccaaacgcagagggcaaccgaccaaaggaatagattgaattcaattggtcgagatcggtgagaattgtcggcgaaatttgacgaagcaaattgtccaaatgatcacgatgggaaaagcacaaatggcgaatatttgccgaaaaaattggccaaatttcacgaccaaaaatgtccaaaatcggctggccattcgtagagtgtgatgatggaatccacaaatataaattggtgcctcttttgtcgaaaatttggtgattggaacgaagaaaagcgatgacggagtgatcgatgtacctaaaaatgggataaatgcttttattgccataaatctctgattccgaattactcaatccgaagccatttaaaacggattttgctgggcagcggacggtccggcaacggaaatggcacaaatttgtcatccatccacacagacagcttcggttctggtcctttgtccttgcgacgaatttcgatcgttctccaaattgtcaattcgcttt

SEQ ID NO: 1825 - DNA, 2177 bp, Heterodera glycines
  misc_feature (12)..(12): n is a, c, g, or t
  misc_feature (56)..(56): n is a, c, g, or t
  misc_feature (61)..(61): n is a, c, g, or t
gatcgttctccnaaattgtcaattcgcttttgccattgaaatgtttgtccaccaancgcanttgaaacgtggcgaaagcaatgccaatttgaggccgagttgaggacggtcaaaagaggggaaaatgtccatccaaacgtcgttgcaaatccaactgaaatgggaaaacagtttagtcaaataaacgacgaatttgtgacttttaatttaattaccgtcggttcatttttggcagaaataagcacaatttggacgagttccgaatgatgtcacacaaataacagaagaattaattgcgttggaaactttatttttatataattagaaaagcggaaaaccaaaaattctaacgaaaatcacattttatccaaacaacttttgaattttgtttgccttaaattgttgcaaatgggcccgaggggttggacaatatgccaatgggagatgaaaaatcattgacaaaaagcgagcagaaaaagggaatggcagtgctttggaatggaaggaacgcacgcaacagaggagaatatattttgcaaaatgatgacatttgccgggcgttttagcccctacccccaaatcaatcaataaaaaatcaatttgacggattatttttatccaactttcatttgcaaatgttagacgcgcatttgttttttgaaatttgaaaactgaccaacgtaataataaatagggcttacatttttagatttttacctatttacgagaatttttgattttaaaaattatttttctcaatttgtcttaattagggaacggatttttaagcgcgaaaaagtccaaaataagtgcttaaataagggcgaaaaaagcgcgaaataagtgcgaaaataagcatgaaaaaattccaaatgtagaggtgaaatttgttaaaattgctgttttctctatgtaaattagttaaaattaagtcaaacaattttatttactgattgcagttagaaatgaagtacatttagaaattttcaggatttaagggtcgattctcaggggcgtatttttccgaaattttttgggtcgattcttaggagtgtattttttgaaaatttttaggtcaattctcaggggtgtatttttccgaaatttttttggccgattcttaggggtgtattttttgaaaatttttaggtcaattctcaggggtgtatttttccgaaatttttttggccgattcttaggggtgtatttatcatttttattgcatttttgctaataaatttccgaaaaatcgcgaaataagaacgaaaataagcataaaacgctaaaataagtacaaaaacttattttaagggcgaacctctaaaataagcatttttaagcacgaaacgccaaaataagcatttctaagttcgaataagtgcgttaaaacacaaaattttcgaacaaaaaatgtgtttttcgtgcatttctcgtcgagttaaagccgcagaaaaaataagcaaaaacttagaaatccgttccctagtcttaatatttgttgactttttaataaaatttttgtcattttacacccctaagttcggaactttttggcacctattttcccatttttagcacctatttttggggttttttagaacctaaaacctacctattttggcagtttttagcacctaaaaatgtaagccctaataataaagagtcaaactaccgtatttctctaattatatgcaagtcaccaataatctacccctttcgaagtaggttgaaaaataatctccccttctctatttatctgcccgggggataaatagaatttatatttttttcgaaaaaataacttcttttctatttttataataattaattaattccaagttgaaattctttaaacaatttttttttaattttcaaacagaaatttttcttgaaaaagcctgcgaaaaatttttctttgaaaattcggtaatagttaagaatgttccccacctttttctgaaaaaaattttcaaaatttttttttcgagaaaatggcgtttttagggttttcagggtcgaggaatccgattctgagactcaattcgacccattccgaaccacgaacccggattcgaacaaaaatcgaaaattcgatttttcaaaaaattaccatttactcaacaaaatcgaacggaaatggcatgaatgtgtgaatgaatcaattattggcacggata

SEQ ID NO: 1826 - DNA, 2046 bp, Heterodera glycines
gcattctcgccgcacatgcccacgatttttatccgtgccaataattgattcattcacacattcatgcatttccgttcgattttgttgagtaaatggtaattttttgaaatcgaattttcgatttttgttcgaatccgggttcgtggttcggaatgggtcgaattgagtgtcagaatcggattcctcgaccctgaaaaccctaaaaacgccattttctcgaaaaaaaaattttgaaaatttttttcagaaaaaggtggggaacattcttaactattaccgaaaattctattaaaaaattttttcaaaaaattaagcgatttttttttgaaaatattttgaaaattctcagaattcgtcataaatttgaaaaaatcgcctgagaattttcaaaaattttttcttgaaaaatttctaaattttaaaattcaaaacggggttctgaattttttcagaaaaataacaaatttcgagaatttcagaaaataaaattctcccgattttctttatttttaagctttataccattaacattgtccaaccatggagtgagcttgaactttgctttattattgacgcgatgacattttttggagaaatattcaaaataaatttcaaaaattttccactaaataaatcattcgaaaaataatctctctgtctccattaatctgccagtatctaattatctccccctttctaagggtgttgataaataatatacccgggcatataattagagaaaatacggtatgtacataagggatggcattccgccgaggctccaaaaatatgcgaaatgaatgtttttgggttagtaggcgaaatgtcaataggcgatatgtcggtaggcgagatgtcgagtaggcaaaatgtccgtacacacagcggcccaattttgtgctctcagtgcaaataggtttattatttatttagtaatcagaacgccaaaactttgcaaaacttaaaattttttggggattttcccttgtaaaaatagaagagccgatctcgagttaaaaactagacagctaaaacatgaactgtttttacgacacttaaacttgaaaaaaaatttcattatgaaaaattgtaacactccaccttttattcgaattcggaacccggattaaatagttgatccgtagcgattcgatggtcccaaaaactccaagaaacatgttttaacgactattttttccaaaaatgagggggaactatcaacagtagtacagggaaaattttaattctttatttttgtttaaaatttttgttaaaaagatttcattttttatggccaaagctgagaatcgaaagctcaaaaatggcattgaaaaaatgcaggaaaaatttgataagaaagaggagcaattggagaagaatttggaggaattacagaaaaagttggtcgaaatggatcatcagcagaaagaacaacagaaaagcattgatcagatggaaaaggtgggaaaatgtgaaaaaaggaaaatgaagcaaattgatcagcacattttgaatttgattttcttttttgctaaaatgccgtaaaagatgctacagacgaacgctgatgccgaaaaggagaatgatgacaacatgaaaaataagaaaagcttgagaaaaatgtcatggcacaaattgatgtgaaagtgcagacgaaggaagttactgtcaaatagttaagggaaatgagcaatggttaattactgtacctaccgtaacattattattataattactgtcaaatattaataggatttgttccaatttaagttattactgaaaaggcaattttgattgaatcggtgaattggagggacaacaaaaacaccaaaagcagcaaggggagaaggggacaaaaggcgagttgtaattatttatttgagcaaaccacaagacaacatgtaattgcacttatagcggaaaacaaagtaatgaatacaattagaaaaatatgatatggtcaatacagtaaaataaataaaataaaataaaaaagggatgaattaccactcaggacttattttctgaataaaattctctcagaaa

SEQ ID NO: 1827 - DNA, 1226 bp, Heterodera glycines
tctttacacagttacaagtgactaattagcgtatcacttgtctgactaaaaagttttgagtgaattttttttttgtttgttttagtcaattagttgagtcaaataatattttattatacatatatttatatgcttatgcaagagcacttaaacttattagataatttgaacgcaactgtctttacaacagttacaagtgcactaattagcgtatcaaataactgactaaaaaattgctgagtctaacaaaattcgaaagcaattaagaaaatgagttagttaatgacctgctgtgccactaattggcggttgcttgtcgtgtcattgctgttgtcgaaatgcttttcaaggatgtgctcgtagagcagctcgtacagcttcattgccttcaacttttcgatgccatccttcgtaatgtgccaacatcgattcgctgcgtcgtcgtgccattctttcccctctccctccggcgatttttcatttttcggtgccggtgccatttcgtcaatttcggcccattcgctgtccaatgtttcgcggacaatacccacaacggttttcaacatttttacatcattttttttattgcgagcaaacactttgtttaattggtccactaattggatatagccaatttttgacaaaatggtggcaaacttttggccaaatttgtggactacctaaaaaaacattggttgctgagaataaaaaaatgtattagacattataccaaaatatacctatacattgattattaatataattatatgaatttaacgaaacggcacaattaaatttaattattttatcaatcagtgagtttttttcgcatcgaccttgcacctttttatcatttagttatttcttctcccatgtcaccctttgggtatgcctccgcttttttccggtgcaccccaaaacgtcgtcggccgaaacgtcgtcggaagactttttgaaccataactttgttcactgtcaatcaaattaagaattgttggtgttgttcgataactctatgtgtttattattaatttgcaaaatctcaaaaattttggttaagtttcaaaaaagttatggccagaaggaactcaaaaacccagcaattcgaacttttttttgctctgatttttttgtgcataaataaaaaatttttgaaaatttgcacgatactagcatttttccaatgctttcgaataataccaagaatgattaatttggatgagaaa

SEQ ID NO: 1828 - DNA, 3039 bp, Heterodera glycines
ttatattcattcaaaataagaaggaaaaaacctaagtatttgttttgattctgatgaaagttgtggctttatgatttttacatattttcggattttttttgttgcattattatttacatgcatatctcacagttttttgtacaaatttccactttttgagaaatttttcttagaaaaactcgtaaatttagaatttttaggcagttttatcaattaaattttaattacaattcttaaaaagaaaaatgctcaaaaacaagagtttctaaacgaaattcaaaataaaatcaaattcatttgttagtccaaaatgtatttttaccataaaaagttaaacatgaaattgcaaaaaatagtgtaattttttgtatatttaaaagaaattaactgataaaattaaatattttcaagaaatttaccgaaacttaaaattacacaggtaaagctgaaaatattcagaaaacttacgaacctctgtttataaattttaaataatcattacaaataaactcacattaataagatgaaaaagacgcggaaattgaaaacggatgcataaaattttggctaatgttgtgcttaaactatccaatagtctgtactttttttctgaaaaagcttcttcgcgttcttcgctggaattaaaccatgaccaaatggcgaatttttggcgttcctaaaatttatttaatttaatttgcatttgaaatttcaaacgtatgaaattgaatgaatttggttaacaaaaaattgagtgcccattttttgaagctttttaaaaatttttttcatttgttgaagatttttagtccatataatccatattttggtgttttgtggaataaatacatatttcgtcatttatgcgttttttcccatattttggcaattttttggaaattttcacaagaaaagagcaaaaaaaagaccgacgactttttgggaaattttcaaaaaaatacagaattttttcgaaattttggcaaatttattaggtattttttcgcttcttcctaaaattttcattgacgtcagaatgagattattacaaaaatttctttgagatgtattaagtttgtttaagcaaatattgaatatttttggaattttgatggtttaaaatttaatttttgtcagtttttagtccatattttggtccatatttggccatttttgagctttttagtccatatttcaggaatttttagtccatataatttcgagtcatattaattagcatttgaaattgagaattaaaacggataaattgaatgattttggcaaaaataaattgagtgcccattctttgaaccaccttttttccaaacagaacatcatcgcgttcggcactgaaaatagtccataaccaagcgacgaatttgttgtgttctattttctgaaattttattaattgacacatttttgtcgcattattttttttattgttttattttccaacatccattaattaattaattaacaaacgttgttagtcacggcacatattttctgctgttctcctccctccaatttgggcccaaagttcagcccaaaatatgccatttcataggcaatgattccaaacgcccaaatgtccgtttttgaactgagccgcatcgaacgctcattatgcagcatatagccccaattgcatagcttatgatgttcggggctctgtaaaataaaaatatttttttttataaattcattgataaaataattaaattttaattcttacgcatagaaatcagggggataggattaaagaagattttggagaaaagcccaacacaaagaatgaaaaatatttttcgtttgtttcttaaacagatagatatataaagtaaattaaattttgttggcttaattgccaattaaaattataaatattttggcaattggccaattaaaaatataaaatgttttggcttaattggcgaaatattagaaattttttagtagtaaaaaataaaattataatttttaggctaaattggccaattagaattataaaagattttagcttaattggccaattagaattataaaatgttttggtttaattgaccaattatctttttttggtgtgggtggcacttgcctcgtaatatttggtggtcaatgggtcattgatgacgaaccatttgcaaaagtttgccatctgctgtcgttgtacatcctcctcttcaacaatgaattgagcagttccgaaatctatggctttcatcactgaatcctctccattttccttttttacataaagcaaattttgtggcttcaagtccaaatgcataattactaaaaataatttgaaaaacaaattaattattaatagtttaaaatattttaaatgcttttttttacttaaaaatttacaaatattatttctttaaaaaaaaacttgagactatttgctttttaaatacattattgttttttcttgtttcctattcaaaaaataaacacttaatggctaaaatgcatgctgacgcattttataaatccgccaaaatgggtttgctgcgttggcacccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgaatataccctttatattaccccttgcctaaccttaggcccatctgaataataaaaaactcaaattcgagacttggacatttcgtgggctggacattttgtgggtcagccagcggctgcgttttataaatccgtcaatataaatcagcatgcattatttaaaatttattattattattcaaacagttttattgaaatttgtatttttttataagcattagttaattttgtttatcaatagcattgctaaaaaagcaaccaatttttaattattgatataattcgagagcccaaagagttctgtattagcctaccaaatttcaaaaaatttttgctaattttgaaccaaattaatggccattgccaaaaatatacc

SEQ ID NO: 1829 - DNA, 1453 bp, Heterodera glycines
  misc_feature (1430)..(1431): n is a, c, g, or t
  misc_feature (1446)..(1447): n is a, c, g, or t
attttactctatttattattaggaaatttaatttgacatgattaatactcatttacgaaatgacccgaataattactttaaaatgcgcttacaaaatagtatctatgaatttaaacctttgttttgcctatataattaatgcattcatcttatttaaaagtgttactcagcatgttgatattttttcttcaatccaaatcaaggaaacgataaatggacttactccccctcggaaatctatctccttagttaagaatacattttttcgcatcttcaagtcagagttaatgagactaaattagagatttctttgctatgagatgagctttaattctctaccattacctaacaactaatagacccaatattctcctgctagacatgcccatagaacttgtggcgattctgatcatcttatgcacgactatattactacaagtttagtatctgccgaatttcaattgccttttcaccgttcgaacctttgctttccttcggcatttgtgtgatcaattttaataactcatacacaaattaagaggtcctacctaatacatagtaataaatttatataatgttggtactcaaaattttgtgatttttcattaattcaaatcaatgaatcgaaaatgcacttaacaccgaaagagttctgtattagcctaccaaatttcaaaaaatttttgctaattttgaaccaaattatggccatgcccaaaaatataccaggaatcagcatttcaaacattttcggttaaaactcatcacattttaaaattattattgaaatgcataataatttttgaaacttaaattatcatttatgttgaataacaaatagatttgatgcataattatattctaacttatcagtggctttttataagcattgttggcgtatttataaaaagcgcatggataacggaatttataaaacgcattagcaccgctaaaatgtatcagataatttctcgaacagggattccggcgggactctcgattatcccccccccccttcgttcccccaatttactttggtgcatgtcgcgcaacgtctcaacaagttgccgaatgtccggctccaattgttcatcaccaacttggatttggccttcggcccactccttccgcttttgcttcatgtgtccgatgaggtcatgttggcccaactcgagaatggagaacacaatgggattgggattgccaagttccattccatggtaaccgctaattaaatcatttttaaaatatttttgaatattataattgcattttttacattatacatttctattgcaattgcatgggcagccaaaattaaattaattaaaataatttcaaaaatattttcgatgatttgaaaactatgatgattaaatgttttgaatcaaatttgtgaatgataaaataagtaattatcccaactaatnntatcattagcagacnntctaga

SEQ ID NO: 1830 - DNA, 2278 bp, Heterodera glycines
tcaaatttgtgccttataaaataagtaattatcccaactaactatcattagcaatctccaattaaaattaatttactaagcaattaatttgatgactcgctcattttttggcaatgcatcgaatgctttctgaattttccactccttgacatgcttttgccaatcactggtttcccagtctatgtaagtccttttcaatgccacacatttgttgtacggacgggcaccaattgcgtacaatacggcatgctgcacctttaaaaaaattaggccatgaaaaagccagaaaatttggcttaaaaaattaaagacattaaacaattgaatttatttggattaaaaactctgatttaaatatttatcttttagacctggggcttcgatcgaaaatttttcaaaatcagaacattgggctcaaaaaatcaaattttgcggtcgacaatcaaaacattttgcgaaattgcttcaaatcagttatttttaaaattattcgacgaaaaaatgtaataaaaattatattttttcgcctccgattttcatcgttaataattttgtggaggaaattagcaaatcgttcgggatcaaaaaatcagatttttaacatttttgtgcggcgcatttttcaaaaaacttttggtgaatgggcgaggggatggggtccggcggcgccgataggcgccgtcagggaaaaatttgtaatttttaatgtgtattttttaacagatttttgtccaaaaatgaccaaattttgcgcaaatttccttgataaaaccgtgacattctgccataaagtttcaaaaagttcatgagtttatttaagaaatcagaacaaattttggcctttacctccacatcaggacaaatctgataaatcaggacagatcgaagcccagttttagacacggctaaattctttattaaaacgaacttctgagaatgatccttcgcctattggcttttcttctttttgtagcttaagtttaattgttgcgttgtccactaaatttgtcatttcaagcgcttcattcatttccgataaatttgactgtccacaatggcactgtcccatgggcaatttttgctgttttggcacaatttcttctttggacattatttctatattgccgtttaacgcagctgctaaatttaacaaaacctaatgaaaaaaacttggtattttaagaaaaaatattataaaatttatgtaaatgttttacaatttttcttaccattttttgtagtgacaaaaaaacattttaaaagaaaaatgaaaaggagaaatccgaaacgggaatttctgatgaaaggcgatcacattcattgtttgcttgaatttttgtttttttctaaattagcattgaaataaaaaagaatttcccgagattaatggtttgattttttatggcatagtcaacatttattaagattgtacaaagttcgagaatatattcgggaacaaccattgaaaataatttaaaaaaattttattcgtaaatttgatatgatttattaaataaaaatgttactattgtaacagaatttagagaacacccaaaaaaagaaaaataattttaaaaaaccccaaaaaatcaaaacaaaacactaagactcaaaaaaaaactaagtaataaaaatacaatataaatctttaaataatataaaaagtaaaaatatatcatttatttgaaaaagggaattaataattaaattggaaaaatccatccacaagcaaaaaataataaagtgagttggcaaataaatattcacatgtgaaatgaaagaaagtctattgtgaaatatatatatatatatatatatgtccataaaagcagaaaagtggtggtggtattggaaaaatgacactgagatcgattaacacttttttaaattatagttaaagctttttttaaattgtaatacatgtggatccatgccagaagagtggggtgggaggaaacggattacaccagcaggaccgagatatatcttaatcccaggaatcgggcacggaccccaaaacaagtccaaaagctcaatccgtttatacatggctctttatcatgtcggattatgacaagcgagatatttttgaaattaaaaatgagtcaataaataattatttctattttataataattccaagatgtacttggaaatgagcataagaaaaaaacattcaaaattctacaatttttgaaattttataccaatttttttaattaaattgtgcatttattaagtgcaaaatctgttacaaatcgcataaaaaaatcaaatt

SEQ ID NO: 1831 - DNA, 4114 bp, Heterodera glycines
  misc_feature (210)..(210): n is a, c, g, or t
  misc_feature (229)..(229): n is a, c, g, or t
  misc_feature (247)..(247): n is a, c, g, or t
  misc_feature (260)..(260): n is a, c, g, or t
  misc_feature (279)..(279): n is a, c, g, or t
  misc_feature (292)..(292): n is a, c, g, or t
  misc_feature (320)..(320): n is a, c, g, or t
  misc_feature (357)..(357): n is a, c, g, or t
  misc_feature (362)..(362): n is a, c, g, or t
tattttagaaatttatcgaacttaaaattaggcaaagcagattcagaaaacttacgactctatttataaattctaaataatgattacatataaactcacattgataagatgaaaaagacgctgaaacttaaaacaaatgcttaaaattaacttttatggattttctaactgaaaatccctgccctattcatgcgtcccttgcttttccgngtgtccttggttttttcgnctcgtcgttctttctctnttgctgtggcttnttgtgtgtggcttggctgncggcttttctggntttccctgttccgggtgcggtttctttncgtggcgggtgcctttcttttcgccggcttcccgtgntgggnttgtcttccgcgtcgctcttttccccttcacttttcgcttatgcttttttgaccgccgcccattttctttttgagtgccatcgcggaagagcgaggcgggcacgggcagtagccgctgtctttgcccggttggccgggtgccccgggctgcccaggctgaccaatgttgccagacaggccgggcagtcccaggcgcaccaggagggcccaggcggtccctcgcctccggcctgtccgggttggccttgactgccgggacttcccggttggccaggcgcaccgggagctcccctcgggccaggaatggtgttactaaaaaatatgtaatcctaattacttattcaataaactgcttactaaataacagcgttatttccaggctgtccgggttggccgggtgttccgctgcgtcctggttgcccaggctgtccttggggtccggacgcgccaggcggtccttgtcctccgcccggagcgggcgcaccaggttggccaggggctccttgctgtccgggcagtccctgtgctccggggctgccgggtgggccagccggacagagtgggcacgggatgttctggggcgggcacggaggagctgtgtgatattagccatgataattatggaacgcgtagcgattgctcaccaggttggccaggtgctcccggctgtccgggcagtcctgcgcctcccggctgtccgggttggccaggcggtccggacggaccaggtgggccaggagggcagtttggccgttgtgggggaccgcaatggcaatggccgggcaattgacgcttggcacggaagatggagctgaaggggttggcacgggcctttgacggcggtgccacgacgacttgcacgtccatcagatcagtccaggccgagtcggtgttcacgcggaaggccttgggaatacggtaataattacggtatttttcaattgtttttttacttcaacgccatcgcgcactttgttgcttagttggttcatctccgagtacagtgatggcagtgtgactacggtggcgataatcgccagcagagagcataccgtgccaatgcccaagacaatgtgagtctcttgcatattatgcgctaaatttttaaatgttttaattagccatatcacaacttaaaagacttaaaattcgaaaattgacttattttaaccgcgttctgcggaaaaagattttgcattttaatagaaattaaagaattttaaataatgtcaattttattccaaaattattcattttattttaaataattttaaaaatttttcgggaatttcaaattggtgagcaaatgggtgttcttctgctgttgttgttggtaactgctgattcacttttatatgaacccaaaatggcaaaaaacttgctaattgttgccgtaatgatttttgtttcgggtttattactcgttcatttgaaattaaaaagcatattttggacattaatcatatcgttgtggaaccgtttaacgctcatttgatgtgttaaaaaagaccatcatcatttgtgtccattaattagttaattactcgcctccatttccaagcgaacatttttttgatcaaaaaacagctcatttgtgcgtgaaatgtgatgaatgacgaattgaaaagatgaaagttatggatcctacattcatttgtcaattaaagaaatataattgtacagataattttataagcattttttaatttatgaaataataaagtgatgttaattaaatgccgttctaaaaaacacacaaacagtaagaatgccctaattttctcggcggaatcaatcagcccaggcggacccctaattaaattgccatttaattaaacccaaaattttaaaatgaatattttttagaaaaaatttttttttattaccaaatgcaaattcgactttgagttccgaagtctatagttttattttctgaataatataatgcaaaaaatatataaaaattgaagcccaataggggtctcgatcccctggccttgagattaaaagtctcacgctctaccaactgagctaacgaggcagtgaaaatcgttgtgtttaccttaatgaataaaaaattattaaaaattttgtgcgccaaagttcactaaaaattaaattaaatatatttttttttattgagtatctctattcatcatgtgattttcggtgctggacatgtacgtcacttggccggtgaccgtgttgccgatcaaacagccaaaaacgtccaattcgggcgtggcttcgacgttcagccacggttccacattaaaattttctaaatttttttaatttttaaaaatgctaagcctaccataatgacaatttttgacattttgatttttgttgccattattttggtgctaattaaatccaagatttattgctgattccttttctgtcgctttgcttgccacccgccgcccttttttcaatgtatgccgtaagctcccaaaaatttcttatttttaaattcagtcttaaattaaaaaaaataatagaactctttaatttttaattttctttatatcaaatcccaataaattttcaaaaacttttttcggcggacgaaacattaaattgtgagcttttaagtatgacaagtttgttttgagctttgaaaaagccctgctccgttagtttttgagcaaatatttttattgtaaatttattttttattatagtattttattaaaataatgaataaaacactgtctctccataaaaattattaattgccaaacttaagatttactaaaatttgtccaagctgaatttgctttttatagaatgttttaaggaagcaactcaaccgaaaagggcgaagtcgtactaattttgtgccaaattttttttcggcaaaaggaccaaaataaataaaagaatgcccatttgattggcatttggcattcattttgagtcttttttgttttttattcctcaaaagtattcatagtttggtaatgaaaaaattaacattttttaaataatcgaataaaatattattgttaatttttttctttttaaattatttatactgtttaaaaaattttttttttcaatttaagaaaaattaaagaatttactgacacaatgctttttcctgttttgagcacccttaaattagcaatgcttcttcatcgtggcacattggcacgagttgccagtgaaaagaattcaaaaaatatatgcgatacggtttggaaggaatcggacagttatttggtaaaaattaattattttgtcgaattttaattttcgcctttcaaaattaattgaatttacaaaaattaattaagtaaagactttgtaatcaaagccttaaaaaaacaattttgcaatggaaaaaagatttattttttcttgtcaaatttttcttttttttcttttttctaatttttgaatacgaatttgccaattaattgcccttttcactcagttattcgcgaaatttgcaggcatttttcaattttcatggcatttaccttcattaatttagaaatgctgtacgacaatgagtcgcactgtcaaaatgacatgccatttgtttttggaattcaatttgataaattttccaaaaagttcatccggcgaattggcaatgccatgccaatgatgccaattttgaagtgaccatccatcgatgggatggaaggtatgattaaaatactggctaattccattctattttttatttatcaaagaagaatttttttttaaattcatttttttaaattaatcaattttta

SEQ ID NO: 1832 - DNA, 3751 bp, Heterodera glycines
aaggttttattttgtaaataagataaaaatggattttccttcctaaacaattaaattaatttattttacaatttgcttaaaataaatttaaaaacttatattaaaattaacatgaatttaaaatatttcagcagaatatataatttaaaatttgtctaaaaatactttttaatgcattaggaggctcaatggtgtgccaacattgaacgaatggattttgctaattgctcttttggcggtgccaatgttcttccccgttggatgccaaagtgtcgccacattgggcgcatttctatcataaattgtggcctgcgctccgcgttgcaacttgcccacattggttcggctgttcaaattcgtgccaaacataatcaaattggtgatctgcaccgggttgcatttgaatgcactcgattgactgagcttgaccttagtgccaatgaggtcagtttaatttgtgctagtgtaaagccttaatgttagattattttaatttgggataaatttataatttggtcacccaacaaaaaatataaataaataaatttctgtataatgccggccggataatttatgggcaaactcttctctcaatctgtaaaggggcaggcatgagcttgccaataaattggaaatatttaaataattccattaaaaataatttttttattgtgaaattttcagtttgttcgaaaaatcttgaaaaaactttattggtcactaaaaacttcaaacttaaccaaacttcaattatcctacctctattttatgacacagattgccaaaatcggtgcccacacattggcgcgatgccattttttacgtttcttggacctaagtgataatccgatgggcgagttgccggacaaattatttcaaggatgccgacgtttaaaagatttacgattggatcggcttggattacgggtgaacatttgaaaaataataattttatatctcctcagcaggatgtcgcaattggattttgattttcaaaaagaacctcttcacaacaaaagttttatgaaaattaattatttatatttttaaaataattaaatcaattttggataataaatttaatctaaaatgttcaacaatttttgtgtatagcgaagagaaagaaaaaaaatgccatgttttctctgaccataacttaaatcatggataataaattagggctaaacggttaaaccaatggagtaggactgagtaaattaattaatgatttcattagaaatccattttttttactgttttgttcagagtgtccgtgctgagctgtttctcgggctgaacgcactcaaatcgctttctctgtccggaaatccgttgtcccgcatcgatccgttcacatttttgcccgcccggtcaatccgcgctttacgcctcgacaattgcacattggcacaaatgccattggcagtcacacaatgttgcctattggacaggtgtttttttttgttttgttttagtcgccaaaattagccgttggtcttataagattaaaaaaaatttttttttcggaaatttatttttaataattcaaatgaaatgtaattaaaagtaaataaataaattattgattggccaataattacaatgatttaaaataattcttatatattttttcttcatttttggaggttcaattaaaaacagttgaactttatttctgctaaaaatttgctaaattttaatcaataaattcactttaaatttgatgtgcccaaaatgtctgccaattatttattaaatctcaattgaaattacaaaaaattcttgcaattaaatgcgatcaaatcttcaaaaagcttgtcaatggacgacaaccgattggcaactcgtaactcaatgcccgccccgctgttggcccttcttccccgcctttcccacttttccttcgccaacaatccgttgttgcagctgcccttggcacttttcctctatgagcataaccgtgccgaagaggcactgctcgaagacattgtggacaccttggtaatttgcataaatcgatcaccattttaatccttcgagaaccattaaatgattttattaacttaaaaatgaatcaatttccaatatttattattaattaattattgtttaattttgccgatcaaattgcccgtctggcgcttggagccctgcacgccctatctttggcacttccatttgcgcaatgccagctctgcggcacttcgtcgtcgaatggctgcgtggaatgcgttccgaatgcaccgcgacggtttagcgcattgtgaccaactatacgaaacgatcattgacggcattggcatttacaggcaaaaaaaaaagacgaaaaaatatgtattaatttatccaacaaatttttaaaattaaagtcctggtcatatgtttgtgatcacggatattgtcctaactttataaatggaataatttttttggtgatctgctatgaattctgtataagatgcaaaaactgcgtccagctctgttcagaatcagtagtagacgagttataagttctttaatttcccatgatatgcaaaatgatatattactttttaaaccgatttaaaaactggttaaactgattttttttttgaaaaatgccgaaacaggtcaactgatatttcaattaagctatttttgaaactaaaatcgttaagattaactaaaaactgataaagtagtgccctgtttgaagtcatcataaacatatgatcatgactgtaggaaattgaacttttattaagttattttctttttttttcttttttaatttaagaaatttatatgggtttttgtcttttcatgcgcaatttttattttaaaaatttttagactttttgtagggaacttcgtgaacacaatggttgtgaggcgactcgtcggctgcgttcagttcgcgctgatggtaaaaatgctgtgggaattcgctgcgattcggcaacaccaagcaaagcgacggaaaaggaagcaacaaaaaaccttggctttaactggcaccaaaataatgccaacaaaaaaccaaatgtcaaaaaccaagccacgtcagtaggaccatcagcatttgcctacggtccaaatggcacggatactgtcattttgggaagtgatttactgtcgactaatgcctgtcaaaccgcatacagtgtgctgccaatgggtggaagtgcaagtaaatcacatttattccgcacaaatttttttattttttgaatttccatttaattttcaacgttttcgcttttttaattttatctttttccgaattcatattttagttcatcattttttggcaaaaattcaaaggtttttatcagtttttgaaaaaaaaatgctaaattattaatttacaattttagacattattttttgaatgaaaaaattttaaaaagaaaaaaagagatatttaaatatatttttttctgcgaattttaccattttgtgtcttttttttgtatttttggtgtcataatttacgcaaataataatgatttttttcatataaatgacaattttttttatttattcataatttctaataaatccaatagaactaatccgatttaatctcatgtagattcgtccctaatcaccactaatcgtcaaccacctgctgctgcgtcttttcttccgccgttttgtacccctaattatcattttcatcatttgcttcttcccctttcattggtcacaaattttgcccttcttttctgcctatttgcattgatgaaaagatggagaattgaccgttgtg

SEQ ID NO: 1833 - DNA, 1463 bp, Heterodera glycines
catttcagaaagatgaaactgctgcaaaaagccattgatattctccgaaattcgttccaacccaaatgaacgaatttgtgtagcaaaagacgacaccaaacgaagttgaaaggcacattcgcctcttattagccacgggtcaattaggagaaacaatcgcatataatcagtctttaattcgttttctttgttaatttacaaaatggataaatgatgtagttagtggtaatgatctaatggaaacaacaaaagggagattcactgtggcgttgaattggctgtagaattaggcgaagtctattcctttgctttttcgatggaaattgttgaaatacgtcgcttcaaattgattcttatctttggcatccgtgggcatttgatcacgggtcctcggctgttttgtggtggctcctcctcttcgtctccactttcactttcctccttcccatcgtgttcactgttctcctctccgtggctcttccccgctccctcttgctcataatttgaaatccatcgtttgtaaaattcgtcaaattcatcaatttgtagactcacttcgctttttttattgccacacgcatttctcgagcgaaactaaaaatgaaattatctttttttgcttttagtttttaatagtcacgccttatcagttctcaaaaacaatgaagggtttgaactcttcagagaagcgagaagccgttggttgcatccgaccgttgcgccatcaatgcattcgatcagtcccaaagagtccctttccttcggtggaacccgcccaaattcctttcgctagaaagtggcaagcaaattgaaccattaagcctcatttatttacccatccgatgttctcgacaatcctctgattgaacggcttcgaccgcttcgccaattgcactgatgccatgggctcttccggcacattctgtgccatttcttcgttgacgaccgtccccacttcaatgccttcttctaattggtccattgattttgcaacagtttcttctgcaacatccacaacagtgttttcttcgtagctttccttctcggcatcttcctgattgttctcgttattcgtcgaatgcaccaattcacaattggtagtaataatgttgttgttgtcgctgttttgctcgttatttccttcaacttctgtgctgatattcgttctttcgatctcataacaacccaaaatttcgatttcatcttcgtcatccgttggcgaatttctccagtccgttggtgtttggaaagttgacggctgttgttggatttgttcgtgttgcgggatgggcacaatttgttcactttgtaatttctgttgcgcctcctcctcatctttcttctgtttgttgcgcattttcttacggatcgcgcaagttcgattttttattgtgtggtctgtcggaacagaggctccgatttcttgagcccttctctgaactgcttggacctaataactttaa

SEQ ID NO: 1834 - DNA, 10490 bp, Heterodera glycines
tggaacagcgtcaaaatgtgtggtggatggcgaaggggggacgaaagaacggtcgacatcagacaaaaaagaagtcgaatgagtgacaggcagagcaaaagcatcgtttgtaaccgaaacctataaaatacgatggatttgaggcgaattaaattctttgttctaatttgagagtattttacctccgaatgattgttcggtgtgtcaagcaaaatgatgtcgtcatcacttccgtcttcttggcctattttggaggtgtctaattctgttttcgagaataaatttgttgttaatatcaactaattccctaccatcattcagagaaattgcaaagttttggatagtttgtgcattcgtcaaatgtccgtgtgatggagaaaactaagttaatgatttttaaagtaaaaacgaaagaatgcaaaaaataccaaatttggagcgatggaagcgcgagtcaaattagagttttgaacagaggcaacgacacaatcaccagggacaatgttgtactgaactcaaaatttacaacaacaaaaacacatgtgaacataggttaaaaaagatagaaacgaaccaaaaaatagagaaaaacatttaccattttggcgtactatttcattatgttaatagagaaaaaccaaatctaatgcgtgatgtttaattttttttttcgagatgttaaatctatttcaaattttgcataccgataaagaaaaaatttctacatcgattaatattgcattttttaactcataaaatctaagcaaatcttcatcaaagagcttccgaatgatactaattgtaagtggtaccacctaaactatacgttaagattgtctaaattttcgaaaacaatcaacacttttcttctctataaaatagcatgccaaattgagaatgctttctttgtattttatttgttcatctctcgttttttgaaacggtgtgtaaacaaagtgcccacccatcgccacctgttgttgggaagttgcggtgttcgccgtgctgtcgagaattctgctgatgttttgcacaacatccaaagcagtgcggtaaatggccgtcgccactcgtccatttgagtgagtcaaagtctgccgctgttgctgcatggaatatactgaaaaagataattcacaaaaatgacccaaaccaaaacaaaataaattaaaccattttaaaaaggtattattccaagagaaaattatatttataatttgtttaaatcttcgaattgcgccaagtgtacattaaaattaacaaactcaacgaaaaatggcaaaaagtgagtaaattggaatataaaacaaaaatggtcgaatcaaaaaatcacagtcagaaattcttctttcgatcaaatcgcaattcaattaattcgttgctgttgttaagagatttcgaagaaagacgtgaacgagcgaccgtttcagaagcggtggaaggacgaagaccaagcagttcagaggcaacttcaatcggttccgtttcgcccgttgttgagttagtcgcagaagttgacggaagagcatgcaaataccggggaatgagttgttccggaacactgctgaaatgggaatgaatgttgaaaatattaagttaaatgcaccaaccttcgattgagctgttcagcaatttctcgaattttgtttatttttttgccctgttcttcggtaaatggcccagttttctcgagctctttgaccaatgatgtgatgttctgtgtgcaaatttgtttcaacagatcggagtcattaagacgtgattggagttgtgcaacttgttctttcatcagttcaatttcatccgcatattgcgctgcatttggctgttgtttgacttcgatgtttttagtgctagcgaattctgtcgaaaattgtccttcttttacaaggctttcttggcctttgtgttctttccgggttaaactgctgaagtgaatttgttgggcactggtcaatgcctgtcggcctaaattcataaaaaaatgaataaatcctatgtcatttcagtttttcaaatttgcattttgaataatgtaccaattttgttgaaaacattctccaattgtcgtgaccttgtcagttgtattggcggtgatttgcttctgttcggatgcgtttttccggccaatgtcaaatgcgtttggtatgctttgtgcacattttcaagagacccgcaaaacttctgttatttaatcaaacaataattaaagcgcctctcctatacctttggagcgactaaatgaagaacataatggatgaaagtttggatgtctaaaattaaaattatgaaaataaaaaaagtccaaaaaagattaccgacaattggaggataacgcatcagacaatggatacaggcggaataatcaccgtttagtaacacatttcgaatttggaccaaaagagcgacaaaaatacagtcgatgatttcgagggattgttgctggtggcattccgcaaaaattacgtcccacaaatacaataaatcgggcagcgaaaattctcggccaaataacaagcgaagccacctcctatcttaagatgcctttacaaaaaaagagttgaaatgcaaattaaaccaacactccgtaaatttgcggtaaaatatccaaattgcttaaatggtggtgcaaaggcggatcaacttcaagcagtaaaccattgcaaatgtaatccaaccggcgcaacaattcagatgactttccaggcaaacttaagaaaacatatcggaattgaatttaaaacgtagaaaatgcctttctgagaatggctctctttctaagtgacttttaaaggttgcgacatttgcgttgactgaaggcgcattatcgctcagataaaagcaacggatcaacgacatcaaccgagtgaacaatgcacttacagagagaaaattaagcgcaattaaaaattgactaacaatgcgtcgtgctctaagaaaactgggtcatttaatacaaccaaacaatggacgtcaacatcggaaaaatcactcccattaggcctggaagtatggacttaaaaacgataaaataccatattaccttaaaatgtcctgttctttcatgtcttggaaggccttttggtcggaatccagaacaaatagaattggaccaagaagttcgtgcattcccttaatgcattctttcagaaacaaataaaataaagagatcatttttcaaacctgaatataagaaatctgcgaattgagttttgaatagaaaaacagcacattgaccattgtttgtttaacatcatcgatttggaaaaactttaagtcaggacacctgtcaaactcatttatataaaaacaaaaaataatttttacgttctgtcaacgtctttctcgatgtttttcctcgttgattgattctcaaaatgtctgcaccacggactctaaaatttcatttcaccagtattaaacaaaacaccaacttctgcactgagcgaaagtggattgttaccatcaaaattctttccttctggcgaattattaattcttgggtttgactcaatccgatgtctcaattcggtataatttcgacgttcttgaccaatgacttcgacccattgtgtcctgtcctccatgggcaaaactcctaagagaagcctccaaacaatggatctcagatgtgaatttcgcaaatgtcctcgaatgcattgtttccgaagctcaaatggtgcctttccgaacaatgtcctccaatcaattcttaataataaaatattttttttaattttaaaaattcataaaatcttacaagaaaggcccttgttcttccattagaaataataaaataaattgtatttccactttttttctaataatcttatcagataatgttcatatgtatatataaataagaaactgtatgtaataataggaaaaatacatatagccaggaacagagcccggatcctgttgggtttttatacgcctgatccttatccttgttaccctgataggaatccgaaaaatataatttttaattgaaacagatagggaccatctctaaaaatttgatcctgatctaaggaaatttgactaattgcaagatcaaccggatttatttttagcataataaaaattaattaattggcaaaatgtttttgtccttttttcaaattcatttttaatcaaggttcccttccagacaagttaggtgggtgggtaggttcaccaaataccaaatgatcgtttctgatttaaagctcgcatttccagaacattacttttaaattctcatttttcgggtttcggaccagttcgaaaatagggttcaaaaacccatttccgtgactggagacttagttttccaacgaaaattgaaaaaaaattcgcttttctactttattgtttcagctccattctgttctgtgtctgcacttgaatcccttctatacttctatattgtgctaaatcccctctttacttttcctcataaatgcaaccatcccttggtccgtttccacatgtttattctactgttggtaatattggaaggtaaacgaaaatgaacgacataactttatcattttgtctgtttaagtattgcacaatttccctgtactgattcttcttacacaattttggtgtttggccgtggctcgacgttgtttctcagtggtgccttctcttttcaagtgctttatggttgcatcagtgtcaatggcttccttttcacttcgggtcgttttaacgcgtcgaattttacaactgtttcgattccgcatggccatttgccgggtgtgtctttgtgttattgcattttaaaattttttacgcctgtggaattgaccccaaaaaaatcaaattaatttgacattttgttgctatacgaataatttattaaggcgtccttttctatctgcaacgaattgtctacagaagaagtacacatagagaggatccaaagcagacttcgggagtttgtcaacgattccaaagtcattttgccgtttatcgaggaataccaaccggtggccattttactagtcaaattggagatggacattgtatcccgttttgtcaaacaacaatctcaggttttcgaattttatgaaatcttccaatttttttttaaattttagtatcttttaaatattttttcgcgtgttggcacacaattgggtccaaatttgttttgcatgaatgtcgctgaatcgggcgaagggagcaatgccaattcatcatggagtacaaagaatgttgaatcgttgcaaatgttggaggagaattaccgtgatgttctgctcagaattggcaaagtgctcgaaaccgaaagtgtggactttttgcatttaaacttacaaaataaattgaccttttacctgataattgatgggttttaggttgctgtgttattcaaactgttggcaacaaaggcgtgggaaaatcgactatgtgtcggtatctgatgaattcattgaattctaggaggttattccagaacccggattattgaataattcatcgacttttctaagccgttctagcactccagaaatttgtaaggtgtttttgctcgatttggacgtgggccaatccgaatttactcccccggggtgcgtctcgctgttcaaaacaaccaaacctttaatcagttagtttgctttattggactgtaaataatgcttaattcgatgttgttttttggtgccccctttgtttcgcttgagccttccttttccaattcatatttcttcggctccaataacattgcggtggattccgattcgtttttgaagttggctgaacttcttattcaacgttttattgattatgaaagtgcgtcggaatcctctggtgaaaagtgtgtgctcattgttaatacgcctggatggattgaaggtcagtttttttcgtttcgtaacaccaatttatttccttcaacaaattaaagaatttgataaatttggtttctttccctaaacctaaaagattaactttgctattgggaatggtatgacttgcttttccaatcgtggttcttttagaccttggctatgacctgatgctgaaaatcattaattcggtaaaacctaacattttggtgtgcatcgataagattggcaatggcatcaatttcgaggtaatggccatagttttcttttttgtaattattttaatttaggttccaaagcacctacaaaaaattacaatgagaatccgtctgaattggtccgtaagaatttttgaattccatttttttattttccaaattctcactccattttagtgaatgtccccaacttcctccgcttggaaattccgctcttctccgcaattttcttgtcatcggatacctcgcacaaacatttcggcgcttcaaaccaaaactgccctcgggtcagtgctctccccccccccacccaccctcttacttttaattttacttccttaagtcggcatggatcttcgactctccgacactctcgcttcttatcgagttccgtttcgttcaatttccgtttacactcatcccgaaattttgcacattgaagaccatcttattctcaatgtcctcaactgttcctttgtcgcactttgcaaagttgaggatggctctgaaatggtatttcattcgcattttccctattaaatacttttcctttttgagtgctttgagcgtcgtcctctgttggctgacaattcgttgccctcgcgtttgttgctttgccgccgcggcactgactgcgctaacaatggtccctctccaaacagaaatgagaaattacacgagggagatggaatcatcgaactcaacgccggatcaacagatgaaatgaggacacttcccttacgctgcattggctttggattaatccgcgcgattaatttggagcgaaaattattttacataatcactccggtggagcagcgaaaactcggacaagtggacgttttggcattgggtaagaaacaacttttagaactgaaacactccactaaattaggagcaaaattcaaatatttgcaagtttagtcatttctttttgcaggacattgtctgaacacgcccgaattggtcttcccaacaaatgtatctcacccatccttaccaattcatttttttcaaatggatatttttcagccttataccgaagctgttccgtatttggttgaattgagcaacaaaaacatcggtgaaaggcacaaaaaattgttctcgccacttcgggtcattaccggcgcaaaaagggcactgcacgcgagactcatgcaaatgggagcaacacaagtgacggcacatttgcagaaacggatcagacacaactgaagaacgacggaggaccgaccgctgacacgggaatttatctgtttatcattacgcttatttttgttttataaatagaaaattatctacttgtcgtgatttcatgacttataaaaataaattgaatttttttatttatgaaattaattccaataaagtttgcttaaaacatatgtcgcttggctgtgtacaaatttaattatctgggagattctttggcttattgtcgaaaagttgctgcgctcggcatttccctgtcgacccactaaaaacaattttttcaattggaattttgccggttcatttggatctttttcaccttgagaagggcgtgtgcattttctcgggcactttcttcccgtgccgtgtcaaattgtcgccgttttgcactgatttcctcctccgcttttttcgagtcgctcgcgtcaccgaccgaacgaatcactgaaaatgcaatggaatttgtcttttttcttcgtggcgttcacccgaattggcccacagcaaaaggccaacgtcggcactttttgtggcccattcggaagcagcttttagcacatccctttggagaggaatgaagaaatttgggattaaaaatgggagaagggcacttggaggaaaggagttttgcgagcagaagcaacgcaatgctctgaagccgggccatgtcctcctccttggagatggcaatggagtccatcagctgtttcctggaaaagccaaaagagtcaattagggactaattaatggcttcttcaattaacagtcaattagtgactaattaatggctcttcatttaattaattgggctcctcacttgcactcgttgtgtcgcgcgtgcagaaagtagtgaaagccgtgaatgagatgggccgcggaacggagtgaattcgcttgggaagggatgcgcgagggcgaaagtgagtcgaacagttcgtagaattgggcctctcggccggaggaaaggaaaatcagtgccaggccgaggttggccaatgtgctcagttcggcgtcgtcgttgggtcccttcagctgacaaatgaacaattaattaattggtggtcctaatgatgggccaaacgaagccgaccgactgaccttcagagcggcacggaactgtcgctcggcattgtccgagtcgcgctgataggaggcgtacagaccctgaaaagaggaacagggtataagggaaaaccgaacaagaaaggaccaaaaggatgtgcagctgaggctcaaaatcggatagaatatggggacgacacgcgacggaacattggctaatggaacggaacatcgccgcaatctgagggaagaaagggaggaaaaaggggaaaagcagcgacagaacaaatcacttacagtcgagagcgactctcgaggagagcccagcacgagatgagtttgggtcatcgcttcgtgaagaaccaattccatccgagcgacaaactctccgagacgaaggcccgccttaattggtacaattgggttggattccgtctccccccccccacccattggccccgaccattggccaattgctctttctcatcaatgcctttatcccttcaaaatgtttcagtgccgtgccaaaatagcggtgagctctctcaaagttactgtactgaatgttgcacagtacggtaagtgtgtaggccaaactgaaagtgaaatgggcggccaaataaacgacaaatctgcaacaaaaaaaaaagaacccggtgagaaattcggaactgagccagcgaatttgaacggcgtacgaattggcgacgttcgaaggcgtggagggggcggaggcttttgcctcctccgcggattggacggtaatgtgaagctgacgaaggcattgtttcgaacttttcaccttttcaattgaacattttaaatgcggcggattttggcccattaaccattccgatgacgagaaaatagcacaattggattgtgtagcaaaaggcgcggatgtcgttgatcgccgatgggtcgctgttagccgccacctgaagatcggaaacgctcactgatcagtgcccacaatcccttcaattttgttttaccgtctgcaatatttcgcccaattctccgacagactttcccaattcctgctgatcagtcatttgaatggagagcacctgaaagaccgaacacaaagcattgcttggggaatgatcgagcgaccagcgatttgaccagccgaaagtaacattcggcgatcactccgccccctccggggccccgcgagaattggacgccggcacgaacgatgtccaaagcgccgttgaagtcgcccaggcgaaggtacgcctcggcgaagaggaaaagcatttttgtgtggacggagtgacacttttgcgaatcgggcagctcagaacgcaacagctgaaatcaaaaacaaattaggaaggggaaaagccaagtttacgggataaaatataaaaaagagccattgcaacttaatgggaatacattttggacctgaacgcaatcggagaacaatcgccgcgcgagaaaaacttcggccaaaagagtggccgtcttcagccgcggctgttcaaggccgggacccaactgtcgcatcagtttatgctgcaggggaaagggaataatttagtaaaattaaaataattttagttaaattaaaataattatgaagcgaaaaaaagagttaaattaaaagagatctatggaagccaaacacattttgctatttgggcttttgtttttaccgcttggcacaaatggaattgggccaactccaaattgttcgtgtataaccacaaaagttttcccaattcgaaggaacaaagtgcgaacagttcagaagagcaggggacgcgcagcgaagtcaaaaattgccacagggaaagggaaaagcattacgatagcttacggtagatgaggacatactacaaaaaccaaccataacgcatttgatggccattttatatttattcgccgtgcggaaaatttcagccattgcctgaggtcatttagccaaattcaagaaaatgagaagcggtgccaaccattaggctgatcgctgcttgatcagaattgaccccgggcggggccggcactcggctgagctgagggaacttatccattctgctgaagaatgccaatttaatttaataattcttttgttaattttgccctgaaggccaattaggaaaaatggagacagaacgccaaatacaaatttgagtccttctaa

SEQ ID NO: 1835 - DNA, 7461 bp, Heterodera glycines
caacccattccagtaggggtcagttccgtctggccagttccgtctcgccagttccgtcttagtactcaaagggccggttccgtctcaaatatttttggactcaaattttttaaaatcaataactaatttagaaaaaaaagtaaaaattcttttacttcgcagcctaccgcagcctaaatatacctggttttttaaaagttgtggttaattaaaagtatattcgaaaataaaaattttttgaaatgaatttaacattgcaaatgtccagtaattctgctcgggattctcagtcttggtcctcgtgtcgggaaatttagcagccttaatgtgtccagcactttgtttgcagcgaatccggcacccattttggaccccgaacccgaatataaagattaatttacataaatttcgtctaattttcaaaaatacacccctgagaattttcaaaccaatatactaaaaacatttgtgaaacaccttttacttggttaagaattaaaaaatttagcctattaaaatatttagaaatttttttattatattgtatattttttgaaaaatttccgatttcttgcaccgcaaaaaagtgggtttgaaaagaaaaaaatagtcaaatttatgaaccgttaataatttgatttccgatcaactttttaccgtcggatccaatcgaaaaatcttagtcgacccatcatcagccccttttaatgcattccgccagcccctaaaaatttattttcagcattttttgatttttggaaattttatgaattttattgaaattttttcgaattttccaaaatcccacaatcccgcaaattttaaatgcgggatttaaggattgcgggatttgcgggattaatcccgcgggatcccgtcccgcaaaaaatgttgagttccagtcccgcagcgggatccgcaaatttgaaatttccggtctctagtgtctatcgttgtgattaatttttttttttttttttgcatttcttttaattgtttttttgttgttgcacaatagttcgagtaaaattcgttgaaaattggtaaaaatattttaaaatatatttttaagtgagcggcgcaaatgtccatttttgctgagcagcgcaagtgtccgtttttgctgtgcggcgcaaatgtcgcggcgcaaatgtctattattactgggcggcgcaagtgtcgaggcgcaaaagtcggtacaccgctaggcccaggcccgcgcgttcaaagatttggtggatgtcggcttagtgatcatcaccaagctggacggacacgccaagggcggaggcccactttcagcgtatgctttccaaaatttaagccatattttggtagttgcacgttttgccaaccccattcccaacgccttgaaaaagttgccatttttatgaattttttcccccttttattgtgtccgtctaatttgagtggacgacaaaaaggaaaagtcggcatcaacatgccccgaatacaggaagtggcactgttcaaggagatgctccaagtttcaaatgctgttgtacgtactttatttgcataaaattagtctatgccaaaatgctggctttagctcgtaaaaaattggtgcaaaattggaatccattcccaaaaaattgtacttttcgtctatccccccccatttttaggattattttatttttgagtttttaagactttgtcattaaaatttcacttttttgtcaccaattcgtatctccacacggaatttttgagagaaaaatagtattttgggctgaaaactttcgatttttcttgtttataccccctccacttttcctggtatcgtacttggtttcctgctgtttttacacgaaatttgctgggtattgggttaaaaaatgacaccttttttttggtggatttttgtccctttatgatttataattttctttttattttgtatatttttcaaaaaattttcaaaaccggacaacattgtgttcgttatgaacgcgcccactggacaggtaggtgtattttttacattggcaaaaaaaatttttatttttttgttttccccccaaaaattaggcctgcgaggcgcaagctcgcgcgttcaaagactcggtggatgtcgctcagtgatcatcaccaagctggacggtcatgccaagcacggagtttcagtgtatgcttttcaaaaatatcaattccacccatattttgggtattgtaattgttcattttgtcagacccccccccccctctcctcaacacctcgaaaaatttgatatttttgcaaaagaacaaatcgcatgcggaattgtcgactcaaccagcaaatggccaaaatcatggacccgcgcgtgctgcagcaaatgggcggaattggcggtctccaaaaacatgtaaatgccgtcaataaaaatgggagaagccgcatagctatgttccgagttgatggtcgaaattgttgtcccgagtgcagctaaaaatttaaatttttggaaaccaaatgcataaatttaaacaaacattcggccttttcaaagtcatacaaaactaaaaatcacatttttgatttgttttttttgtaaatttcaaagggttgacctttgcttgggacctccggagagatgcgttcacggagaaagttcagtgcttcttcgtagtagcgtcgctgtttcccaggcagaagacaccacatacagatgcacattttctgattcactgacgcaccaatgacgaagaactgctcccacatcgctggagcgcatttgaaagttccgtcgaggtgccacgtgccacattggcgcaaaatgtccagagtctaaaggaatgccaataaaaacagaattttatagccaaaaaatgtaccttaacactgccgaaaataaggacaacgtccttttcgccttgcctgacattgcgactgtcatacaagacgatgtcctcaccgcccttttcgcgtaacgttgctgggatgacaaaggccagtgggttctgcacgtcgacgtttcccagcaactttctcttctcacgccgcatcatttgggtcaacgcattgtttgaactcatggccacaaatgcttcatctgttgctgatcgcctcacttttgctaaaagtcgcgtggtcttcagacacggctcggccaggacactttctttgattttctgtcgccttgattccgcctttaacacagcattaattatttggttttaaatttaaacaaacttgttgtttctgaggcgctgggggtggttgtgttctttttgacccaaggttccagtagctccaatttcgtcattgtttgtgatgtttgcacatgctgagcaactacgaattgtgcatctccaacggtcccctgagtggtgtgtgtaacgaaatcctgaacatttggagtttatttttttgcgtcgcttcaaacgtaccattcaaccataggcaatgtcccccaaaatttgtttttccgcgctcaaaggtcattactgagacttcagcctcgttcaaagtctgttgttcagcgttgtcgaaagttatcacggcattcggttcgccaagttccacttccaaattcacggcatcctcatttgtgtttgaaatgtctgaaatataacgcttcttccgactttttttgttgactttcaagcttattacgaatcatttggtccaaatgaatagaaaaatctaaagtcgtcagtacaacacacatttaaaataattcttgaacttatttcatgttcgggtggatcaagggatagacaaggggcaatgtaaatgtcatattcgtactcagcgactccaaaaaccctaaattagatccgttttcctggtttttatgtgcattttagacttttggacatttcgtatttttacccttatggacatttcgaggcttggacactttgtaggggcgccaaaataacgcctgagaaattacaaaagaaaattttcaagaaaaaaattattgaaaaatttttttagagaatttccttaaaatatcagttttaaaaatttttggcaatattatgtctcggcgaatggtgtgtgctgattcttctccttctctttcagtttgtttgctgacaaaattgaattttgtgactttgggccataaaaaaatagttcgggattcaggacgagaaaaaatgggtttctggattcgaatggaagtctgttttttgtggaatattttttaatgtgtatattcgattttatttgaatttatctgcgagacagcgacggtcctaagacttgatttttattctttacctcgcacaaaaattatatgatcaaaaaataaaaaaatgcgagaagagagtgatagatgacgcagggaagaaagagaagggaagtgaaaaataattggctgggaagagacaacagatggaaacacggaaatcgagaagaaaatggatggacgcacacaaaaaatgcggaaaaaatattgtatttgttaattgaccgatcaattagaatcaattagtgtgtgtttaatgatgggtcggtgggtccgccgaatttttgtctttgcatcccagaagggatggacatcgagctaaaagaaaagaatttttttacaattctgctaaggtatattaattttttgaatggtgaaaagaaacatttttgggcgatattcaaacctaagtaattgcttgaaaattattttgaattggccaatgcctaaaaaacaaatcggtattctgacgaactcctatttgggatgatggaattaatgcaggattttttaaaatctaccaattagagaattaagaatcacttttgctcaaaaagccaaattttacatatttgtgtaaattattttttttatggtttaactcacaaaacgaaggtgaaatttgatcgccttgcgcgtgaacgactcctcggtgttgtcgccgcttttcaacgcgtctaggatatccttgaccattcatcgtgtctggcacaagccaccaatccatgcaaagattatcacccacgcgcacgttgcgttttcgaaaggagccagaatttgcagatccaaatgaagcgatcgaatgtaaatcatgaagaatctcaaatggaagaacatattaaaaataaggaaatttgtcaggcataaaaacaacaaaattccattcctcatctccagatggcgtcaaacggcactgttggccttgtatttcgtaaatacagatatagaaaagggttttttacgaagcttatttgggaaaataaattcaaaagaaacctctttgaccggcatagattagggattaatctaaacgaggttcattgtcaataacactaaaaaaagaaacgtgcccaaataaattgctttcgaaaattaatttcacatttgttttcaaactcaaataaaaatggcctttattggtatttaaattcaaaatttagaaattaattagaattaataaattaaaaatttagaaatttaattagaattaataaattaaaaatttagaaagttaattagaattaataaaatcaaaatttagaaattaattagaattaataaattaaaaatttagaaatttaattagaattaataaattaaaaatttagaaatttaattagaattaataaattaaaaatttagaaagttaattagaattaataaaatcaaaatttagaaatttaattagaattaataaattaaaaatttagaaagttaattagaattaataaaatcaaaatttagaaagttaattagaattaataaaatcaaaatttagaaatttaattagaattaatttctaatcgaaaagcagagaaaattgccgtattcctccgcccaatgtatagcctaataatttgatggacaactcagccgtacaataaaacttacaattaagcctaagcttaaacctaaaccaaggcctaagcaagcctaagcctaggcctcgcctgaagcttaggcctaagcctaagcccaaacagcctagcttaagccattgtacgagttgccttttataaattctcgtaaagctgagttgtccatttcgaaaaacaattcctttaaaaatgttttttttcagtaactcactccaacaaactactaatttaattgcaaaattcaatctatccaaaatgaaaatgaactaattgatttatatgtacaaaaactatagcacgaaattttgaaaaaacagggcccggaaacccggggtgaacccggacaggattccggactaaaatggcttaacggttttttcaaattaagaaaaacaggagccagactagggcctgggaaaatcctgtacaaaattgtgtcctgtctgggctctaataatgcatagccctaataataatttaaaatttatacttgatttttaaataaataaaaaaataataaaaaatggaaaaatattttttattttcaaaaagtacaaaaagcaaagcaacaattatcataaagaaaaaaactaacaatggaaccaaattttatctcattaatcctttaatcctcatttaattcttctccaacttttttcttccatttcttctctccctactgattggtcgcgattaataatgctaaaataataagaataatgtaaataaaaataatttaacgattggttaaattccaatcctactgatcacaaaaaagtcagatattttaatttgtttttttttacatttttaaatttatcattgtcccttaaaagtagagatcggactggtcgatttttttcggttttctcggtatttttcgattttcggtttcggtttttgaccgaaaaaaaccgaccgagaaatttttttgagaaaatttttcaattcttaatggtatattttctaaaaattttttagagcatttcttaggggtttattttcccgatttcattgaatttttaatggatggaattttttggaaaaaatgccaaaagggcaccaattcgccaaaactaatctgccgttttttagaatcaaggagcaaacacatgttttttggctgcctttttaaatcattcttacaacctatagtacaccgttcaatagagatttcaatagccctacaattttactcggaggagatttttcgttttttctattaatagaaatagtttattgcttttttgggaaaaaataaacaaattcaaaaaaaccgaaaaatcgaaataaaccgaaaattttcctttggttttttcgatttcggttttttcggttttttaaccgaaactgttcgaccgagaattttttgagtttttcggtttcggtttttttcggtttttaaccgaaaccgttcgaccgaccctcttgtccggtctctacttaaaagcacacccagtgcagaaaaaaatcggtttacaaaaaaatcagctaaaaacatttaaaataatttctgaaaaattttgtatcatttgaaggctcttaacgacctaagtctaaaactaggggatgaagtcaatctgacgccatctgagcactagtacaactgtttcccagtgaaaaatcgagaaaaacctaaaaaaatatgcgcaaaaaat

SEQ ID NO: 1836 - DNA, 996 bp, Heterodera glycines
  misc_feature (29)..(29): n is a, c, g, or t
  misc_feature (56)..(56): n is a, c, g, or t
tcattttcatttgccataaatgtttgacnaatttaaatttttgtttcatccgtttntgatttgttgtgccatttgtatattcctaattctttgatccatttgtaaatgtattggcgatttgtgcccaattttttcgctattttcgaattaattttactccatacttttgctgaatattttctctctttttgtttgattttctccttaattttatagaatttgtgaataatttctctctttttctgttcattttctttttcttcccatttttctccaaatatttcgtcaaatgttttttgctcaaactttttcttttccgctccaatttcaatttgaataattaaaaataatacaattaaaaagaataatatccactgattcattgcagaatttttttttagaaattataataatattttttgataagaacgaaataaataagaatataaaaatatttctcaaaatgaattttatatttttctcttataaattctacacattttaaagtgaaatattgacatgattacaacactcattaaattgtaaattgatttttttctctctacttatttgtcacatttaataatattataataataaggtaaataattaaaatttcaatcctactgatcacaaaaagtcagatattttaattaattttttaatattttttaattctatctttgtcaaaagtacccggaaagctgtggttaagattgggcaccaaaagtttcatggtgtcgaggcgcggcatctgttacagagaactggaattgacggtgtaccgactttttcgccgcgacatttgcgcctcgacacttgcgccgcccagtaagaatagacatttgcgccgccctacaaaatccatttgcaccgttctaagtaatccaaaaagtttttttttaaaactaaaatttgtatatataaatgttgcttattatttttgttttccttggcatcaaatttgtctttgctgctgaagtacgcattaacaaa

SEQ ID NO: 1837 - DNA, 5847 bp, Heterodera glycines
tgtaagaatacatatatcctaaacggcagaaaataaaaaatatatataaaagactttttggctttgggtttataataatatcactaatgacatatattgtctcggttatgaaagcgacgcattaaattcttctatttttgggacaaacaatcacgaatcggtcggctgctgggtttcccatagtttgaccattgctttcaccaaatcagcgcccaccagcttcatgtcctccattttgatctgattaattaattgaccttctttgtattcacatcaaatacctgtcgacccatcttggaaccctggtcaaagccgcaataagttgattccattgtgtacgcgtgttcaatgccaaactgacgacacgtggtcactcgggccgaaaattctttggctttggtgatggaaaaagcacagtctttgagagcaaaagaatcggaaatctgaatataaaaaaaaataagaaaatggcgaaggcatacttcgtctaggatttgtgggagaagggcgaaggattgtcgaaaaacagcggaggtgtcgacggccgcgtcacggtccgattgacgccacgactcttccaaattgttgccgtacataaacacatttgacttgcgcgaatgcccatgcaaatcgacgaaggcaaacggtcgtttcttggccaaatcgtcctgaaaggaaaaagggttatttcagaaatgttaggaggaaacacgccatgtattgtaggagtcctttcgcgtggtaaatggtcggatgaagtgccggcgaaggatcattccacactcggttcagatcatgaccggacagagaacagcgctgacttaaaataacgaaattaaatcgaaaagaaagaaaaatgaccatccattgataacgccgtcggggttcaacattgggaccaatttgaagatgaacaactcgcgagcacgaacagccagcggatgggaagagagcaaaaagctaatgacgccttaacttaaaatgcaattgttatgaattagctcaagtttaccgtgcataatccacgaggaattagcttcaccgggatgaactcttgcggtgatcagaacaaattctcggcatttgacttccaatggtgctgctgtgatagtcaacaatgggaccggatttgagcacaatgtgctcgtaagtctttgacggtgcatgtaaatgttgtgagaagacgatgaagaaaagaaacgctccaaagttgcctaaaaatggaaaatgacaaaaaagcggataaaataagaaagcggacttgcaaacgcgaataagtgtaggggaagtggtaggcgatgtagcaaacatcggcctcatgcggaaattggatggtgaagcgcaaagtgaagttcctcctaaatggattgtcgtttaattattgcatgtattcatcctttattttttggtcttttccgtattgacattttcgtttgtattttattcccctcttccgccctcacttcccatcccccttttctgctgcgattttgtgtgccgatgccgtcctcgtctttttcgttttccctttgctttgtttcccatccaataagtgctccgcctcctctttttgttgggtattatttttttctgtttgttgtcgacgcaattgcattttggaggacaaatcattgcccgcgaccgatggtgttgaagtgaatgaagtttcgccactctgattggatgagcgagtacggcttgaaacagaatctacttggaagtctgcagaaatgtcctcgttgttcggggtagcgactgataataaattgaaacgtccaaattgcgattgccaaaggaaggaaagataaaaacttctgtgtactatcgcttacgatcgtgttctaattttgggttaggaaagtagcaaatggacgatccgacgcgtgaccagcatgggtttttgtaacggactgcttctacaaccgaaaaaagcacgggttgcattcctgaaaaaaaccgtttcttttcaaagctgctgataatgtcaatgaatccaattcccccaccttcagaaaacatggaaaaactcttcgcacaattgacaacttcaaatgtgtatggaacgccagaacgcatatcagacacttggaagaagaaccattggaaatgggcaccgcattggttgatgtccggagccaaaaccaattcgtaaccgttgggtgaaaccttcagaaattttaaacaatgttcatttgcaattcaagcaagagatctctttttaatgacacagcaccaacttgaattgccttgcgcagatttccggactcaaaacgactctcaaagagcaaatgggccccaacgggggtgccaatttttagcgcgtcatcattgtctagcagcagtggcggttctgattgtgagtgggccaattggtccaagtcgaaaacgacgcgtttttcgaattcatcgtcgtgtccagtttcagtcatttgcctgcagaataaatgaaaatgacaaaacgaattgttcaacaaaatatattaaatgcacttcattgtatccgcatcatcggctccttcgttcgttatttttgtcgcattattgtcttcgtcggtgtgttcctgggaagaaaaatgcaaaagagttttgccgtcagcgccatccgttggacaatcgaccaattccgggaaggccaacttcacaaaatgtataacgcccttcgctctctgagctaacatccgcgcaattgcttcatattcagtgttaacagggcttgcaattgacagtttttcctgcgcaaaaaccttttctgaagatggtgtggattttgtcaattcggcgaacaatttttgataattgagctgaaaagcaatgggtttaaaaacggacaatccgtccaatttcagtttcaaccgtcaattccgtctccgtctgtctactgtattttgcaatcgctgcgtgcgaccccaacgatggaagctgacgattttcagcatcgttctcttaacaaaatctgtatgtaaatatggttagcaattgtttgcttttacaaaccaataaatgtatgaaatctcatcaaaataataaatgttttagaagaaaagacggactgtttcgatttaatgtgggaaagggaaaagacagctcaaatttcctttccttcggttcacaatcagtcacttttcttcacttccctccttttttccacggaataaaaacaaatgaaagaacggatattttccatttgaaacttacggcacaaaacagcgaatgcaatgagtcggaaaagagcggtcggatgagcagaaaaagaaaaggggaggagagagtgaggcgaacggttgtgagcatgaaagtgttgcgagtggtggaaatggtcgtggcaacaattggcattttcagacggcggaagacgagagacgaacattggtacgaccccactcagacggacctttaggaggaactttcgatctgaagtggaaaaaaacagtcgaggcttttcattgtcgcaacaccgccttcggccactgtaaacggagtcaccttttgcggagaagcacaaaatttgtgtgtgccaaggtgtcttcggcaattcgattcatttcattgttgggtccagagagcaacgaacgtaacgcacgaaggcaacagccgacggcgtccaaacgaatgcattcgcgcaaacgacgccgactctctgacaaatatgaaaaacaattagtttaaagggattaatttaattaaaataatccaccagtctttttgcaatgacgcaaataaccgcaaatgatacgacaaagcaaaatcaaacaactttcatccttcgtcatcttaaaaagggaacaataagagaagcaagtcgcacaaagtcgcgcctcaacagcagagaataaacgcctcagtgcgtcttcgtcgtcgtgatttttggttttctcgttgcaacaattgcaatcgaattgcgtgatgcaattggatgcatcggaagtttgcgatttatactttgaagatggacgaatctaaaaatagaaacactaacttttattagaaatatacgaaattttaaagaattcacgaaatttgttcagtgtcattcgatatggggagagggaatgaattaaaaaaaaagtccaactccgtgtgatgtgctcggcctttgctgttgcggaataagaatgtgactgctctgtgttttcttcggggccaatgccgagaaagagggcggccgcttggaaatatttgccatcgccaatgactttcgacggctccgttgtcgctttgcgggcgcatgcggaagaatgccttcagaagcggacactgactgtgagagtcgtccgttgtgttcgtccgacaatttgtcggtggaaatcgccttttttgactgaaaagcaaaaacattgttttcgactgtgcttaattaatcatttactcatgtccaaatcagttttaattttactcctcgagactcattttgacaaagaatgttcgccttttgctcactttcgatttacgtctgctctccttccgcttcattttggctgtgccatcgccactttttgtccttcttcttccaacttctgacctttgtctacgcttttggttcggttgagtgaccattttcctttttttggtcggagaaataatgcccaaagttgggcttgtggacaaaatgacatgtttatttgagagaaaactaaaacaaaatttgaaaattgtattttctgtacgaattaattcttgatggttaatctataataaatgtgacttttaaaatccgcaaaggaattacattggttcctttttgggaatccataaattttaattttcttgaaacgatggttaacaaaatccctttttgcatacgcgacctgtaaatggcagggtgagactcgatttcggttgtccatttggacaaaatgtaacatgcgattgagcgttgttcgcggacacgtgaatcacgctcaagacaaaggtcgacgagaaaggaaatgagcgatggaatttcggagggacaaatcggagaaggcggcgaactaaaagcaatagaaaatacttttgctacaaattctaacctctcaaaaaaacatttttatttattacccagaatatataagtcggtcagtcgacatcggacagccaaaaatagcgactaaaaggagttacttatttgttcaatggaaatttagtagagtaactaatgagaaacgatataatgcggagaaggaaccaacaaaaaacaaaacgaagaaaataattcattcaatcatttattaaaggcatgaaaagaaacagaaacattcgaacgaaagaatgaattttgaggtggaaaagccaaaggaaaagtacgagcaaataaagctatatgacgagaaaccatttacaatagtcctaatgagtttgtgagattatcacattacggcgatgagttgtctgtttccgacccctcagaattaattcgaaaaaccaccactctgaaaatgaatggaataatattaaatttagaactcagttccagcaaacttgaaaactttacattgatcacttggatttcctcttcgctgatcattttcctacgaaattttgctggcaattcggtgaagtcaatcgccggtttgactgctgcagtcgaagttttggcgttgcctgtattttgttgaaatgaataatcgaaaaggtttttttaccaaatgaagcagaagatgttgcaattgaactcattgctgatggatcaaactttggctgaggatggcgagtcccgagaaatttgatcgatggttctcgactccgagttgagtactgaaaaagcaaaacaaataaaaataaaatttgttttcggcagcatttcaaccttagagagcaaaaaaaacgcattaacacacgctccgcttggccagcgacaaatattttgca

SEQ ID NO: 1838 - DNA, 4455 bp, Heterodera glycines
  misc_feature (39)..(39): n is a, c, g, or t
atgaaacagtcgggttcgaattgcatgcccaattatatntattttctttaattttttgtttagcgtcaaaggtcatcttcgtcagtttgttcttgacatgcattcgggagttagttttattttcttttcttttaagataattggttgtttcagaaactccatcgtgagttccaccagtggcccgaccccacggaacagcccgcaccgaccaccacccaaccgccggcctcggtgttcaacaagcttaaaccgtcagattcgaggttggccaagaggcatgcgccatcaaaaaacatttttactaaagaaaaagtttaaaatttggcgttgagacctttcgcaaaaatgttggttttgacctcccacctttttttaatgtatggtccaacaattggttctttggcatgttcccaatcattgttcgtttttgccttttcagatattctctgttggaaaagaccgaactttgaattgctttgatgagacgcggccattgcttcttattggttttgctttatttttggtctccgttctgttcaatcgattcatggaatgtttaacaccgattcaatttgcttttctttgttttttgggttcaattaaattatttattgagaaatttaactgttatttccaagtgctatccatccgaatgcaattgtggccaattttcctttattccgttctttcttctgttgtccctcgtcccattttcactggtatttttattgccttattaaacgaatatttatatttttgagttttctttcggtagttttttgatattttagtaagtttagtcctttgttgttgtttttcctgaggattaaatagtcttcttatgatccctatgtgcaaatcgtgtagctttatttttccatttaaatttttccgtcaaatgatcccaaattttgattcttttataggtcatccagccaaagattcgtttaaaatattttatgtgatttccattatgaggattttatttcaacttggaaaccgcaaaataaagtcctcattttatttattgtcatccttcctctttgctgtttgtaacctgtcgataaagaatatttgatttgattgaataaattatttcagtttgttttcctatacatcttttatttctgggaatgtcgacctcccccttcggttccgaaattataataattacggagtcattgaaggcccattaaatggcttcataaaatgaacatttccaatggcagcgattggctttctgttcctcttctacctaatcggcctttcttttcctcagatttaaacagaagtggcgaatgttcgtcgtcgtccgctgctgccttttcccccccgccgttcggcgctccgttttgccaatgttggccaatgcgaacggcagccaaagccaccacttccattgtcggccattaactctctttgcattgggcaacaacagcagcagaaaaaggcgacaaaaaggtgggaattgaggaggaggggagggagacaaagcattgcattttgaaatgccaaagaaaccaaaaagtgtccatgtcccgattgaccaacccttttccaaacaaaactgaaaacagcgagagcaaaaagagagatagtagttagtcaccgtaggaaaatgagaccggtcatttgttttcagccgaacattccgccgctggctcccctcagtcgctgacggactgttcttccgcaatgggcgtggaacttccgccgacgataaccgagcgactgagcactttgaaggtgccgaaattggggacgaaatggaaaacagagacaaatcatagagcgattgggtagtaattcgacattgcagaaggatgtgatcgatgctttgctggacaaaaacgcggtgccccccgaactgatcacttcgctgatggccggcgtcggcggctcggctttcagcaaagcgctcgaattggtcccgtcgtacaaccaaaacttgcagaagatggccaagtattacttcacggcaaaaggcggcaaactcatccgaccaacagtttcgctgctgatgagtgccgcgtgcaatcaatgcgcgaaaaggccaacgacgccggcggacaccgccccgggcaggcaagcgaaatcacaaagagtgtgatcggaaagggaaaatagggacaggaaatcccggaaaacccctcaattatttccaataaaaataaataaattaggacaccaaccagcattgtcaatgagtcggaagaacagccaattgagatcagtatgaatcagtacaggatagcgatggtggccgaaatgattcacaacgccactttggtgggtgggggcaatgatgtgttggtaaaagaactattttcggaatattcaggtgcatgacgatgtgattgatgaatcgaacacgcgacggggacagccgacggcgaacgcccggtggggcaacaaacaggtggagaacgaacaaaccacccaatatcaggggacggggaatgggcaaaccacccaatatcagggaacggggaatggacaaaccacccaatatcagggaacggggaatggacaaaccacccaatatcagggaacggggaatggacaaaccacccaatatcagggaacggggaatggacaaaccatccaacatttggtgagaaatggacaaagcacccaaaaaatattaggacgggggaacggacaaagcatctatcgtcaatcaaacgcgcaacttttctttaggctgttttggtcggagattttattttggcacgcgcaacaaaagttttgtgcagcatcggagagccgcccgtcattgagacaatggctgagattgtggaggatttggtgaagggcgaactgctccaactcaacgggccatgtaatttcgcttttttcatggaaaataagtaattcgtgccccttacgaatttctgttcagccacttcgactggcaatgcacggttcaaccattacatggtgaagaccttttacaagacgggcagtctttttgctaacagttgccgttcggtggcaatgctttcaggtcagtacattttgtttcgcgttttcatcctttcgtttttgttgacgtttatcggaatatttttttggaatctgtgcatttaagaaaattgcaatggactccttttggagttgaccaccgaattcggtcgaaatttgggcctcgcttttcaactcgtcgacgacattttggactattgcgccactgaggaagccatgggcaaaccgacggccaccgaccttcgccttgggttagccacctgccccgtgctattcgcagccgaagaattcccggacgcgttgaatccgatgatcgaacggcgcttttccgccgacggggacgtgcagagggcgttggaattggtccaacggtcggacggattgacccaatcgcggcggttagccaaagagcagggcgagaaggccattcaatgtgtgagtgaaggagcaacgtttccatcccttcgctgtgaaaatgaattttaaggaaaaattgctgtctttttaaaaatgtataaaaataaaaattttgtagccaactacgcttataattttgaaaaattaaccttgtgaaaaagtcttcggattttggggtcgaattgtcacttttctaccataactgatcaaatgcaggctgaacagctgttgccggagggtgggctcgtgcgcgactgtttggtggacattgtgcagcgtcagttgtccagagaacggtgaagaagacaactgccgtcgatgtgtctgtctgtcgtcgttcgcctttgtttctcttgcgtctctgctcaacatttctcactctttcgctagtgcctttgccttctctctcatttcctctccatcttttctcatccacatttactgcactcttttcacacaatgtttcctttctctatctctgctcccccattttgttgcattaggctcaaccaaaccaaagataaagcattcgaaagtgcttaaaagcgcaaaggctgatttggcgaatccaatttgagtgattgttaatatttcacatatttgactcatttttgatgttttgcccagtagatgatattgacctctcaaaataaacaaaaattgaatttatattgacaaatatggttggattgtgttcacaacagttggagggaccttcaaattgagaaaggagtggaaagaaatccgtttttgccccaattcttttatgatttttatattgtgagctgtcttacctatcttctcgctgtctgcactctcacataaatataaacgcttttttaagaattaaagcattttaattgttcaatggaagtcaaattgaagccctattccgatccgtcccgttgggtggccatttacccgctgtacatcgatgcctccaagtcgttggcacagggtcgccgaattgcgaaggcgaaagcagtcaacaacccgacatgccaaggtgggggaggggggcgaattggggagggcactccgaaaataaaataa

SEQ ID NO: 1839 - DNA, 2978 bp, Heterodera glycines
ggtaagctggagttttttattcaagggaaattaaccaattaaaataaatcttttttcccgattttgctaaaaccccgctttttggttcaaaactgatcataaatttggaataaaattcttagaaaatattcaacgctgtgtaataaatcatttttcagtcattccatgcttatgcggtgccatgctttgcggtgctcacgttggctgtctttctggcattgcctactcattattcaaaaatatttcaagcaatttcgcatgccgacccaaccctattgagggatgccttttaggtttagtctaataaaacctaacaaaattatttattaatcgtgtgaaaattggttgcttcaatttaaataccgttacaacatgtaccgtaaacctgtaggttgctgctacggtgccatggcgggaatactttctgcatacactgtagttgccgttgtggacacgtcgctgacgtttggccacccgttggcaaagtacagaaacccaacaaaccatcaagtttttcccataaacaattgatacggtaaagatttagagtccaaattactcagcaaattgctttgattttttaatttcgttttttttgcgctttattaacaatcaattgcataatcttcgacaaattatattaataaattttgtttataaaactaattcttaaatttaaagggaaaatgaattcagagcctatgaaatgttcacttttttaaacgagttcaaaaagtcattcttcaattttttgagtcactttacttccattcttttttagccttccaaattcagaaccaaacgacaaatatatcatctaagagttcattattatatttattttgatcagtagggctggcaaaaatatgcacatgcatatttttttcctggactgtgggaggcctgaaacgcacgaaaaccatgtttttagcttgttttgaagcttctaggatgactttccatatgcatattttgcatatttgtgcatatttcgcgatttatgtgcatatttgtgcatatttgtgcatattttggcatttcgtgcatattttatgtgcatattttggcgtttttccaaaaaacctctaatagatcggcccccaacagacaaattggcctttttgacctcaaaaaccggaaaattttccaaaaaaataattttttagcaaaattttcacgaaaaatattgaataaataaattttctcaaaaaatggttaatttatgtcaaaaataagcaaaattttgcttttcaggttgatttttcgctaaaatgagtaaattttaagctgtatcgtgtttttttctcctaaaatgatttttaataccacatttagccatttttgaagattttactttatgtttaacaaatttgaagaaattttgagaaattacaccctcaattggaaaattttatgtgcatatttttcactttttatgtgcatatttttgccaaccctaatgatcagcgaactctaaaaccccggataacaaataatcatgtttttttatcataaaaagggtccccccttttgtttttgataaaattcaaaatcggccactttccgtatagcgccgatatttttttctctgcactctctatttattgacacatctcgttttttgaaacggtgtgtaatgttgtgcaaccctttccacaatgctaatgtataaaataaccgggtacttttctagtttacggggtacttttcacatacattttcagatgcctataaatgtactaattttacatgattttttaagcatggaaattttaagactaatattcgtgacttatttactctactgcaaaaaaaatgctaaatttgaagaatggctgcgagaatgtaaaaaaatgatttaaacacattttgagtcatagatatgaaattcgaaaatttgtatgggtggtataccctcatgggtatctgcccatgagggtacccgtggtacagaaagctgtcaattcgttgtcccctgcacagctcctagggtgtacgacagcgctggtctgagcccgaattcgtgatcggcacctttaaaaaccccttgaaactattttcattaattttgaaaacaaaaaatttcttttattaaaatatatgttaaaagtaccccgtaaactagaaaagtaccaataaccgattaaaaaaacagtaaaacaagataaatctttttaaaaatgttttttatagttggtttgtatcataatccttcggtcgctatgagcaaacaatgacaaaaaatgttgtttattattcctgatactacattattagcttccatattcatcaatttcctcaaaaacaaacatcagttcgccgccccattctcattttccaaatcaaatgaaaagtccaaatggtcatcatcactgaaaaggcgatgctcggtggaaatttgcgagagttgattgttttgatttgccccgctgacggcgagaggattttgttcacggttggtcgacaattcttcaactgattggaacaaatcctgcagccgaagttcactgtcgtcgatgccgttcacccaatgctcgccgatggaatttgacaacgaattgaaacgtgcgctgttttcgtctaaaaaagcaccggaaatgaatcatataacaatttaacgaaacccaaaaatgcgttgagcccggcgatgtcggccatttccgtgtcgtttagtaacatcccatcgcttagtgaaggtgccatcttaaaaatggaagtaaattatacagtcagatgattgattgttatgttaatcacatcttgatggacaaccggaggagttgaaagaatgttctgattctgaaattcgttgctggttgtgggctgctgatccaaaagttcggtcatcgaaggttgagtgtgtggagaattctgatgaggcagctacaagaaataaaacaaaaaaatcatgtttttgggggtacaccccaaaatctctcgccgccgaaatctcgccgggacaaaatcttgccgcagaa

SEQ ID NO: 1840 - DNA, 2382 bp, Heterodera glycines
tttagcttggtttgaagcttctaggaaggatttctatatccatatttttccatatttcgcgatttatgtccatatttccatatttttccatattttggcattttggtccatattttatgtccatattttggcatttttcaaaaaaacctctattagaacggcccccagcagctaaattagcctttttgagcccaaaacccgaaaaatttttcaaaaaatcattttttcgccaaaatttctcgagaatattgaataaatttaaattttcttaaaaattaataaattatgtcaaaaataagcaaaaaagcgaaaatttcgcttttgttgttgattttgcgctaaaaaaattaataaattttagcttttatgttttttttcttttaaaatgattgcacgtaattgccgaaaaaattcgagaccaatttccgaatgttgaccgactaattgcaaaacgaaagccgtctttgtcaaagcgccttaccgagtcaaaaaatttggaaatgtatctcatatgcaatttcaaccaataaatttgaagaaattttgcactcaattttgaaaaatttatgtccatattttgacatttttgccatttatttccatattttgagatttttgccattttatgtccatattttgcgatttttggtccatattttatggccatatttcgcgattttatatccatataattacactccctactcatgacattattgtcattcatttagccaactgtttgtttcctcattttccaatttgatttttaattggttttttcattttttcggttatttccatttgcataaaaaaactgtgctgtctgtgccaatggagtatgcgtattctatgtatgttagcggaccgccattagtggaccgctgttaacggaccaatggcaaaatggcattagcggaccagggacgtatccaggatttgggcttgggggtgggggggggtacgatccgaaaagtcaattcttaggggtgtatttttgaaaattcttcgcccgattcttaggggtgtatttttgaaaaactttcgcccgaacgacctttttttttttttgctcataccagcgaatagcggaccaattatttttcaaaaatattagggctggaaaattctcaaaaaattgataaatttattcaaaaaaacccatttcttccaaacacaactaaaaatttacaaaatcaatcaaaaaccccaaaaaatataacaccatacaaaaaaaaataaaaaaattttgttcatatggtaattttgtgaaatgctaatgctacacattatggctgcttttgcgcccatcaacttctgtttttgcggagaaatgataagaatagcctaaagagtgggtttatcaacaaaaaaaggctttaaaatatcgtagttaccaacttaccaatacattacgcattacattgatcgtaaaacgtgagttatgcaaagttcgaatggttgatcagtcattcggtggcgagtccggggttcggaattggtcaaaatgggtgtcattttcgggatcggcatccctgaaaacaccctagaaatgtgtttttacgacttttataaactataaaaatttatttaaaaagaggtgtggcagcatctaaacgattaccctcccattttcagacagaaaacttcaaagaaaaaattatttgttaagttttttgaaaatttttcaaaaaacagtaatttatcttaaaattccagaaaaaaaaaattgcttaaaaattttcaaaaattttttctttaattttttttatttcaaaattttcagaattttttccttgaaaaaattctgtttgaaaaacatattttcttttttgaaatttctgagacgagattttgggcggcgagattttgtcctgccccctatttttggacatttaatcgcaaacgtcaaaaacttcgcggtgtatttgccgcaaggggtaagacgtacgcacataaccccggggagaattctgtttcgaataaaaaaagttcaattttctatttaccggttgttgttggatttgggatgtcaatgttgcagatggaaaacgcccggttgtgctgtaaatgggcggagcattgcctgtgccagctccgactgtagtgccgccaccgcttccgcccaccaccggtgcagacgcgggagaggggacggacccggcaccgtcgccgacgtactcgctcaaccgttttgccccgaagtcgtccaaaacatacatgagtcgttttttgctcaaccgatgcgactgttttccagccgcagtcgccgggccgacaaatgaaaccaaaaattggattaatttgttgacgatttgctgttgcttcagatgagtgccctaaaaggacaaaaacattccatgggaaatgtattaattgagagtt

SEQ ID NO: 1841 - DNA, 4475 bp, Heterodera glycines
  misc_feature (13)..(13): n is a, c, g, or t
tgcaattgaatanttgggcacaaaatgccacccatactaatgtgtattttctcggatcaagagcagttcgagaaatggggataaaatgttaaagaaaacgggacaaaacgccaacaagtgccaactcagaaaatgggacaagtgccaattctgtggggagatgatgccaaaagggggaaaatgcaaaaaaaaacattgaaaaaagcgacaaaattcaaaaacaataatttgaaagtaaaatgctgacagaatgccaactcagtataaatttgtaggaccaaatgccaaaaggacagaatgtcgacctctgaaaaatgggacaaagtggcaactttctcggattagcatagcaattcaatgaacaaaagtcaattttattttttctaaaaaaagaacaaaaccaaccgaattcaatgaatgtcagtcgttccactaaaaaagggaaatcattcaaggacggcacaatgtcaaatatataaaaaaggaaatggcctcctctatttaatgtgaatgaatccacatccccttctcttcaattggccctaacattcatttttcattcgttttgcggctgctgctgctgctgttgttcgccccgaaggacacgcctttatcccgtgccaaaaaatgcccgtaaaatgccgcggcacccctcttgagtttatgtctagtaatttgccaaaaccttcctccccatccctgccgtgcctccgttcccgctcatctcgttggccaatgccatcttttcgggattcacccgtcgttgaaattggattccccccccccccccccccactcgccccgtcttatctcgtgggatgtgccgtgccgtcttttcagggcgcgtgagggggagaagggggtgggggagcaggaaacgggcgaaatgcaatgggctttcggttctcaatttcatgccgcagaatttaaggaattttcagtgaatttggcatcaagaataccttcacttcaccgtatcacccgtagtcgaatggccaagcggagcgattcgtcgatacgttcaaaaaggcaatgaagaaatgcgccaaagatggaaaattttgggcagaaaagatgtttctcgcctacaggacgacccatattcggcactcacggatttttgcctgatcaattgttcttcggtcgaagacttcgaactcagttgtctctcgtccacccaaaggaagaacacgccgaaatcatcgacccagccaaaattcgcaaatcgcaagctgattttgcccgaaaaatggcacgtcaatttcatcagaaccacagagcaaaatcggttgagtttttgccaaaggatcccgttttgcttctaaacttcaaccgtagaaaacgattttggcttaatgggaccatgatcgaaagattggaaaagtctcccacatatcgtgtccacgttccggctctcggaagagtcgtccatcggcacgcgaaccaactgcaataccgttatcctcttgaaaaggaaggaaacggtacgataaggatcccagctgatggttacgccaatgcctgattgactaatgtccgcagcaaattgattgcgccaaaaaaacaacgcagtgactcaggtcatttggcggcgacttggctgaaaaactggaaataaatttatcgtatgataacatgcacctaacagtcgaattcgccagacaaactcaattctaagaccagaaaacacaagcttgtattaagtgcttgttcagatattttttacgccgataaaattcatttaccaattatccattctcatgattttctctttcaggttcaatagcggtcgaagcgctattttttaacagcgtcgaccatttcggcgcagttggagacctgcaccaagcaacaaaaattgccgagacatatgtaataatttaaaggaatggtcgaatggaaatttcgaaataactatcagtttgtattaataaatttctaaggtgtgccgtttcgagattgaaatggtccccccgctgaaggttgaatgcaaccttggtgaactgtgccataatcaggaccaagaagtacacaaacgaggaggagaactcctgaataaaattcaggacgagttgatcaaattttttgacactgaagaggttaaaaaccttgtcaacaaggtaaacatgaaaattgaataaatttaaagcacaactcatcttaggtttcggatagggtccttgaaaagaagacggtaaaagggcccgaattttatgagtaagtttattagtcccataataaaagaaaaatgaccgattttactcaattgtctgcacaaattgcgcctaatgatattaatgacaaacatgatggcatattcttattcacaaaccagtaccttcaatgcatcggtggaaaagcctttgaacaaacatcaatttttgtgtattgatttacaaatcgatattagcaatcgtttatgtatttattaatccaatatatcagcttcatatcagcgcaaaaaaaaattccgaatgaaaaatagaatgaaggtgatagggttaacgtagcgagagtgagagatcgtcaaaataatggcggaaaaaagtttcactccttcatagtgaccgggacagactaaaatacattgaaaatcgggaaattttcgaaaaaaattcttagcgggttgggaaaatttatctaatgtaaaagaataagccgattgaaaagagcaccaaattctcttccgaatggctaatacccgctcgctgatatagaggaggggccaaaattgtacaactcaaaaatgactgatttctataataatcaagggaaaataatcaaaatagataatttttatggtgattcaatttttttcaaccaacttttaattgaattgcctagacccaacattcaaagggcaactcggaagagaattttgtgctctttccaatggacttactcatttttactaaataatgtttccaacctgctaggaatttttttcgaaaatttctcgattttcagtgtttttagtgtgtcttggtcactatgaacgagtgatctgatcattttggtgtaaaagagtttttcattcatcatcaaaagataagcatgcatgacttatttcagatttttaagagaattttgaaatagttttttaaatttgttctgaatttttgcgccattattttgaccatctcacttcgctgaccctatcatcttcattctatttttgatttgagcttttttggtgccgatatgaagctgatatattgaactcataataaaaaaataattgtccataatgcttcatttaattatcaatttaaataaatcaatatacaaaatgcatgtttgttcaaagacttttttgaccagtgtaatccttgataaaatgcaatcaataaaattggtcatttttttattatacgaaatgatctatactcattacctaataaactaaaattctcttaagaataattcgtcaattccgaggaaaataagaagggaaggaagattcgtgaaacaaacatttggagatatgtagtgaaatattttttcaaattgttattatgaaatataataatgacatgatgccaatgttttttgccatttttacgaaaccaattctcgtcgctaatttctctagccattaactgatggtccctggggcgatatgcgggacgagtacccccccccccccccaaaggctcccggtcaatacggcaatagacaataaaaaattatttaaaactatatgattataattacatcgctaaaaaagtgaattaataatttctcttattttttaaaaaataattaaatggttagaaatgtaaatgattaattaaattgaattattaagtaacgaaaaatgttttaaaaatatatgttatttataaaaccgctctttttttcttttcccatatctttgcaacccaaatcgtgttgggatgacgcgattaaagaagaggcggaacgtgcttttaggtaattttccatgtaacttgaaaaaaccaatttttatttttcccgttaaagcatttgtcggtggattatgatgccacgctgaacatttccgagtctggagtttggcatcagcaaatcctacgggtaccaaccaccatctcaaaatttaattataaggtttttgcgaagaaatcggatttggatgtccatttcccgttcaactcaccacaaaaaaaatggtttaaaaagtattttcaatgaattttgaactttggtgcactcaaatatggaatttcgctaaaattgaattcgaaaaaatggaaggcgttgaaaatggcaaatttaaattaaaaaataaatatataaacctcaaatttgtaaaccattttccttcccccccccgttcagtttacattgcccacatgggctccgctgtcgttggcattgaagtcgccagtgaccatgatcaatccgtgtgcgggccatgcgcatttcccaccaatttgcagccaatcttcagcgccgagacgggccaaattgttgcctacgaggagcggtggacg

SEQ ID NO: 1842 - DNA, 2224 bp, Heterodera glycines
aattctctatattattattttttattttttaaaagaacattcaattaaaaatttaataaaaagtttcgggtaagcggaaacgattcgttgggggaggaaacaagctgctccccgttcatttttttgcatctatttattctttggtctagtagttatttatattttttcaaaaaatttgccaaaaattgatttttaaaaatttgtaaaacaaaaaatgattataagaatatgaattcagtcctgacttttcgctgtctgtactcttacataaatacaaattaataacaaaatcggtcgattaaaaattggctaaatccttcgtcccccctacaattgttcccaattttttcagtcatttacactttgccaatcaaagcattttccaacccgagttttgcagtttacatctccattttggtgacgttgggctggtcactggcggttcgttcatatgtcgattttccaacaaaaaaattttttcccaacttttctcattagacatccaattaaactcgaactcttctatttggcgctgatcaaagaaattctgcgctgttttacaacgggacggaagtgatccgcgagttggagtgaaattagctgtgacgattttaggattaaaaaattctagactagagttttcgaatgactattgaaccgcataaaaaatattttaatcgcgagaatttttgagcccttcgctaacgaatattccctctccttcctctcttttatcggcttcatctggataagccacctgatcagaattacttgatttttaaatatgaaaaaaaattaatatttataaagtaataaaaattaaaatagtgttttgctctcaaaagttgaaacttaaacaatgtgtttttaaaccacttaattaaaaacattttcattttattgccaaaaatgaaaaaatgcattaaaaaattataaagagcaaaagtcattaaaaaccaaaatggtaggaaatagtcaaaaaagccaaagaaaaatgtatgctcaaagcttcaaatgttaaaaaatatttaaagcattttaaggctattcgagtcagcagaaaaaattgacttaaaataaaaatcaattgaccctcaaaaataatgttaaaattgtttaattcaaatcacatttcaatgttatcaaatgataaatgttcaaaattgtgtaaaatttgatgattagatcattcgagtcctggctcatcatttcctctttcctcattgcttcgtagtgaattttgaaagcgattcaaaatacactttattggaatcctcaaacttgggtaattaaaccgaagggggaaatgggggaacggcacaaaatggggggaaaaatgggggacggcacagaaatggggacggcacaatggggggaaaatgggggacgtcacaaaatggggacggcacaaaaatgggggacggcacaaaatggggaacggcacaaaaatgggggaaatgtggagaaaatgaaacggcaggggaaaacggcacaaatcggaggacggcacaatttggggacggaacgggagtggtcggctcggcacacgtcaacggcacgggacgggcggcattgagcgggcggtgtgtcaaggcggtagtcgggcacggcagggcacggattggcatggcacagaacagtcggcgcacgaacggacagggccaagagtcgacggcacgaacggacgggcggcgcagttgtcggcggctgttgtcggcacggggggaaggggagggaggaaaaggaggacgaggcaatgcctctcagaaaccgttggtgtactgattggtggggggtttgtggcctccttttataccggcagtttctgcttgaacaattgtttgccaacttggcatgtccaaatttctgtccctaacatttgccaattttactaaccttttctcattttccagtttgtgccactttagccttttccgattttctaacattttactatttctttaatatcattcaaaatttgtcccattttaacatttgtttaaaatctgttatttcttttaacgttcaaattattcataattaaagtttaacatttgacaatttttctactggaaaaattgtgacaaaaaatgactaatgatttttctttctttcaattcattcatttcgttcacatttaattaattaatgtttagctgtttaatttaaaattaatttaaatgttttttgtttttaatgtttttattttttaaattaaaaatcc

SEQ ID NO: 1843 - DNA, 1576 bp, Heterodera glycines
  misc_feature (10)..(11): n is a, c, g, or t
aacaattgtnnttgccaacttggcatgtccaaatttctcgtccctaacatttgccaattttactaaccttttctcattttccagtttgtgccactttagccttttccgattttctaacattttacaatttctttaatatcattcacattttgtctcattttaacatttgtttaaaatctgttatttcttttaacgttccaattattcataattaaattttaacatttgataatttttcggatagaaaaaattgtgactaatatgactaatgttttttcccttctctcattccttcattttgttcacatttaattaattaatatttatctgtctaatttaaaattaatttaaatgttttttgtttttattttttaaattaaaaatcctatttcgcgtagtcgcgacattcccgcgacggaaaggaaagtatttaaaaagaagtgggtaaatcattggacatatacaaattataaatgttatcatcacaatcaaagtaaaaagtatagttaaaaaattaaaaagatttgttttgattaatgtatatatgaaattaaatatatcggaaaattgttcgagggaagttccaagtacgggtgtttcctttttgttattcgatgggttaattattttgtcttgttggctcacataattcagagtggcttcaattgttatttcactttttccatctggacatataacttcacatttttcttttacactcggttgattaaaggaaagctgaatttgctgttggttcccttttgtgtcacagggtatttgaaaattctgactatggcattttacatttgccaatgcggtaccaaagttagttgtacatgtaaatttaaattttgctccattttaatctgactttataagataaatgggaatttaagcgaaggattcatgcaaaataataatctatagaaattctcaaaaaagtagttcctcgcagattcggggaccgtttctataaagctagagacatatgcgctaaccataaaaaagatgaatcattttttgaaaaatttatatagttcgactaaatttgctaatcgatttatggtgtacaggatgtttgtcgaaacataactcgtcaggcctttaagatagacctgccattgttattcctgcaaatatggagtctagtcagcccaatcgattgctattcgaatggtttggggtcattggcccaaacaaaagttgtgctgcttcttgcaaataagacttagccaactgtaaacagcaagccatccaaatgcttcaatgtaaaaaaatttacatttggatgcaaccttcatttttcctcgcctcttttttcgaaaagaaaagctattagcaagcgtgtttggaccaattctaaaacaaatcggggtaattaatttaatctgactttataagataaatgggaatttaagcgaaggattcatgcaaaataatattctatagaaattctcaaaaaagtagttcctcgcagattcggggaccgtttctataaagctagagacatatgcgctaaccataaaaagatgaatcattttttgaaaatttatatagttcgactaaatttgcaaat

SEQ ID NO: 1844 - DNA, 2622 bp, Heterodera glycines
tttagaaacactgacagaatgcattcattggtttttgaattttgcagggcttcgattcgttgggaaccctttgaattggtttcgcagttcgacctttcgcatcagctgcatttccccttctcagcctcgaattattcttcgcaaacaaaagatggagcaaatgaaaatccgaaattgcattttctaggcatttcttttgtcttacaattagcatttgctttcctttccctcacccatttgtttaagacatggaagtgaaaaatggtcggctcaaccaacttgttgtcctgcagaactccgatccctcaaaatgtgcaactgtttattctgcgagtctttcattgtcggtgagttatacgaacctataaaagcatttggccattcgtcattatttgctttgagggattattctgtctcctctcacaatcagtttcctagcaacgtttccttccttatgtgagggaacaattacaacattcgatttactctttataaggccttttttggaatcttattatttagcaccttgaaaaatgtggcatttcgaccaattcgtgcgctgagttggaatgcatctcatcaaaaataccccaacaattttcaacgattgcacttggcagtgacttattggacaaaaaagaggaagatgacttttctcccgaagctgctctctcatcaactccaggctcacttttggacagtctcgtaattgaccaagacgaacaagacaatgacaagggaatgaccgaaacagagaccaacaaacacgaagttatgtcacgatctttgacggtgactcggattgtccgtgaaacaccctcacttcttgccgtttagaaatcttcggttcagatgccaaatagcagaagaaatgcttctctgtcgcaaagaaatggcgcttcatcttcgtctaatgatggaacgcttgtaagaagcgtttttttacagaaccagactcacaatcagtattcatgtaaatgtaataggtatttcgagatccaacgacgcatttacaaaggccgagtcggctcataatcaatgaacataaaaatgcaagccaactttgttcaaacaacaacgacaggtatttaaaaggttcccgggacatttgtcaatggacaatccagcagaaaattgattttaagaactcaatattttattccaacattaaaaataataaataaaacaaaacaattaatatttaagttattttttaaaagaaaaaaatcttttttaaaataacactatttctatagatgattgattcatttaaataattaaattgtaaaacagctaaaaattaagaaaacaaattttctattcgaacaaataatttagcaaaattatttattatggtaaaaaataaaatttactgacggattctccagaccatttaaaataacccagattaaattctgatcttaatttattattcccaacaccaattagtcaaaagccagcctcccttatccgtcgtgggagttcattacacgacatggcaaattgtgcgtcgacttccgatgctgccatcacgcataatccttcactaaatgctgttggcatatcgaaagctttcgtaaatccttcaactttttcttcgtcttcgtcgacaatgtcgtcttcaagcagcaatgcttcttcctcaaatgtctcttcatctgtagcggcaggcgacccactcaaaagacgctccgaatcggaaattcgatcattggatgaatttattcaggtcttagggttagtgtcacttacattaagttatagccaattaagattagcccgaaactgaaagcgactgctaacaaaatgaaaatcgaagcgggaactctgttgtccggccttggctccatccaactgaacaaaggcacataaatgctttttcgtttcttaaattgatttgtttttttagccgaatacattgtcaatgcagtcgcatactttgaagaacttcatatctttgccaaacttctccacgactttttgcgtcagcctcgtgaccattccctcgctttatgcgctgcctttttgccacgtcttgaactgcttcttaaacataagaacaaagaataccctccgatggcgctggacttccttgagatggtcctcacgtcgtacggcgaagcgattcgccatggtctttcatcgcgtgacttttccattggcgtggatgtggcggctgaacaacgctttgaccgatgcacaaagtgtaaaaacgcactcttgcaggtattaactaaaagccattgatttgccatctttaaattaaaatctgttacagtgaaaaagtattttttgtcaccaaatctactggttcatttttgggggcattggtcctttcattacatgtataaccaacacgcttaatttatcaagattcggatgaattcttcatattgcgtcgaccgattagacgaggaccaacaccagcgcttcgacaatttaatggctctcgtcgataatatcagtaattcattttgaggacgaatataaatacagtggcttgaaaattttccgctaattcacttaaattaggtccatttttatttaaagttcggtgtttgcttgtcttcttttccataacatttattgtttaaaggaattgtatatttgtcaaaaatctat

SEQ ID NO: 1845 - DNA, 3282 bp, Heterodera glycines
ctcagattttgaaaatcattgatttatcaacaatttttcattaactacttgatttttccaaaaacatcactagcaaaaattatttttggcctgaagagcaaaaaaaacaaacaaaaaaacggtgtcctcccaacaattttttctagatacgggcctaactaggctacacagagatttttaaaaccagtgatgcttagtgataaattggtttaaaatctgaaaaaccgttttgggccatttgacccaaaacgggtctaagaattttttttttcttggcgcttttgaatgttggccaaaatctttcaatgtgattttgtagaagacagatggggcttttaaaataacacaaaagcagtcttttccaagaaattttttgagatttttcactttttaccaaaaacggaacataattatgagacgacccaatacattcaatagctcattaattatgccatgtaatttgaattatttccttgcacataaaccaacctccgtgtctccggggacctccatgcccccagcctctcttaccacacgtttaccttaagatgcattacattttgattccgcaatcccatccctcaatattacgtttcccgtaacggttagtaacgggtttatgccatgcaggaagatacacaccgaagttttcgagtttgaatggacacattgaatggtttattgagtcgaaggctctacggcgtgcatgaattgttgggaaaacaaggcgaccggaacaataacccttttgtataaattttattaaaaattgttgcatttggaatatggctagggtacaacactcggctttctctgttttaattcatcaaaatcttaatttttcccagcggcatctatcggtaccgccgtaactcaaattttctttaaattcgacttaccccatccccagatcttttgtctcatcaattagcgttggtacatatttctcgagatatgcacggaaaatgttgtataacgagttaatctcgatatgatagtagtgcgcccctctctccccctttttttgtgacgaaaagtgattttttatgattaccctcccccatcccgtttttaaaaccaaccctcctcaaatttccatgaagtgatgtacttgctgtcaaatttacttcaacgacatcaattccaagcgaagaaaacaattgtttgagtgtatcctgtcacgaaaagggacaaattcgtaaccataaaaacaaaatcgaaagtgatccgaatgtatattttcggataatttaagaaaaaataaacattattttgtttttctaatggaccatctccataaacccgcaagtttttaaataatcttagaaaactttccatctgttgagttcaaaaataatagtggccacgtaaacccaagtgaatatgttttcttttgcaaaacatttaaatccttttttgctcacctcatccaaataataaggaacgttcgctatagccaaactgtttgcgtggtttaaatcgactttaagaagcatttcacagacagcgtcaccaagagaataaggcaagacttaaaatccattaaaaaaacattttttgtccttttcgctcttcgcccacctcttaattcgcaatttgtgtccacgttgaaacggcctagcaactgctttagcctgtttttctttcccatcttttgctatcaaaaaacacttagaataatgagaatataaggcatataatccctttgagaaagaatgttttagcagtaaaaatacggaccattccttttttagattacatttgtagtaagagaattaacatcttttggataaaacaccgagagaatgaaaagacacaattgaaattggcatactcgtcgttatttaatgagtgttgtgccagaagaactaaccataatactatgtcaattatcagaacaggtgtagccaaaaagttattaggtacgtaattaattttaataatttcctctttcgctacaacctgtccccagacgaacaaaaggaataaaacacaaagcgacagtcacacctcgaagtacccataatataataaaaggggggaaatgtacttctttcatacatcacagagcaaatgactcgactaatagagatcgttttcctcccttttgttccactcctccagtgcctttttgatggcgttcaattttgcatgaagatcagtgtgtcgctgtcgcttcaacatgaactgttggtcattctgtaggcttgtaaacttctcgcgaatacgttttacgacctgaaatattactaaatgaaggaatattctcagagactaccatttgacattctatggcatcgtttgctttgtccattgttgacttaagtgcaaggaaatcttgggctacgtgcgttaaatcatcataacagcgtcgatattctgcatattcattctaaattcgcgttttaaacaaaaattccatattcggttactttgaaaatattgtgataacgtttggcctcatcctggtttaggatcattgtaaattcccgagaccagtcccttgttggtttcgttggaatagtcattgacccaaatgagtcttccggtgagcatgaagaactgtgttggagggtgctttccacagaaggaggacggacgatgggtggcgaaattgtcttgggagtagaagtagcagttgaagccggtgagattgatggagcgccctgtaacggctttcttttgggaatgtaaaacaggtcctttttcggtgaggtttcagttttgatggtttcctttgacaatgtctcgactttggcacgttccttaatttgtaataaatgaagcatcaagaaatggaattagtttcagactttaaaaccatgtggttcgatcctttctttcgattgtgaaacaaccatctttttcggtaataattttgttgcatcctccgcctgttttcgctgtttgattggcacagacgacgggtttgttagccgattagttaaattgggcgacggactatgcgttcgtttggtggcatattttgccaagaagctattgtgagttttcacttgtcgttgggagtcgcttgctttctgagatttaggcatgtcttttgctttcttttgttgctcagcttcaacaagtttttgtgtcttttctttcaaatcggtaaatgctttagaagtcgcttgtacctgaattgcttttcattttttttttcaaaaaatgtacttttacctgcaatttagttttgatagaagaaccgacattagtataattattttcttttgggtcataacgtattgagtcagtttcggtttggttttgagacctgca

SEQ ID NO: 1846 - DNA, 1389 bp, Heterodera glycines
aaaaaaaaaaaattttttttatacgttaatcataagtcatggatataaaatgaaatacgagcccatttgatattataattcattaaaagctcatggatttatctaatcaacaagtaaacatactcagtttctcggactaacttaaaagaggacaaataaaaatttgaaaacgttatgccatttcgaatttagatgataaatagggatgcaatttttaggctataaaaaacgccagaatgcttaggtaggttttaggacctaaaaaacccacactaaaaatggaaaataggcactaaaaagcctaaattaggggtgtaaaatgactaaaatttattcaaaaataactaaatttaagccaaatcaatgttgagatatgtacataaataatttttaaaatcaaaattcttgtcattaaaataaataaataaattttggaacttcttgagaaaatttccatttctcagggtatattttcaaaaaatttgggtcgatgcttagggatatatttttcggaaatttttggggtcgatgtgtatttttcatttttattccatttttgttgaaaaattctgggcaaaacgccaaaataagtcaaaataggtttttcaattttttagcaacaaccaccaaaaaactcgttttccatgcatttcagccacttggagctaagaaaaaataggcaaaaacctaaaaaatctatatgttatatatatataagaagttagcaaataactaggtcctcaacttcattgtatttgattgacaacatgtccgatgctaaaatggaaattgaggagagtgcgacgtctacttctgttgcttcattatcagcgattaagaagcgttttgaagtagattgatacaaaattcgatttggttaataaaatatattaaggtcaaaaaatggaacgcagttgcactttgggcatgggacattgttgttgatacatgtgccatctgccgtaaccacataatggtattcaaattttgctaagttatttctgacattttacatttaaggatttgtgcatcgagtgtcaggcaaatcaggttattatatatcaacaataataattataacaattattggtaatcatcggttttactggtcccataaaaaagaggtaaaaaagagattttgaggtgctcttgggggttttcgggggcgctgaacacgaatatgacatccatttcgacctatttcgaaacccggacccgaattccaacaatttttttttgcatttttcactcggaatttgcgtaaaccttctttattgtatgtaaaaacaaactgtctatgcgctaatataatccaaatgtaaacaaaagatgaagaaataaatacgaatgaagatttgttgattgactttcatgtagcggaataaccaa

SEQ ID NO: 1847 - DNA, 4764 bp, Heterodera glycines
agaacagttgcgaacaaacatttaagcaactttggacggacgaagggcaaacgatcgccgggggcaaattgggaaaagcggcaatgatcaaagggggtaattattaacgaattaattaattgactatccatgcaattttttgattgagaatagcttaaaggcatttgtaaagccgggattctgctgggtttgccttcccctcgtcctctgtggtcattcttcgtcccttttggtattcatctgctgacaaatggacatggaggaaaaacactggtccatccacaaatatttgtttacttgagaattgaagggatttttcggatcgatcgccctttttccccttcgttcaacttccccccccccaactgctgaagtgaattccattgatgacaataaacacaaatcatgcatttatttatttgactaaacccaatcaaaatgaaactgatgccattttcgaaacaaacgaatgaatgaataaaccaacaaaaaacaaacagcgaaagttgtaaagccattgccatcaattaacaaattcacttataaataaaaatgggtcaacaaatgccaaagcaaagaatgcctccgaatatcagcgtctgcgagactatttcttctttttctgcactttttcctgctcaattggcgccggctttacaaagggaattcgttgcgaatattgcgatggcataaacggccgcaggggttccggcacgacaatgccatcctccgtctgattgttctccagaatggcacagatcactcgcgtggtggcacacattgttgcgttcagcatgtgcacataattgacctggaattgacattaataaagacctaaaagagaagaaatgcaaataagaaaccgcagaaaagctgaacccaagaacaggacaaatggtcaaggatgaagggcattatccgttttattaattgattgccggctgatcctttcgtttcaaatcactttttacctctccgtccattttcttcgtctgtccgtaccgtattcgtaaccgtctcgactggtaatctgtacagttggagcatgaaaccagctcccgaaatgcaccgctgcccgggaaccacgcctcgaggtccaatttctttgccgccgcgttgttcagttcggccgaaacaatggccacaattcggtagggaaggccgagcactttgcaaaactcttcagcattgccaatcatctgaattttaaaaagaattaaatttaatggactatattttcaaaagtccactaacttcgtccatgtgcttccacgattcgttgtcaaatggtgaacagatgacaaattgttcgatcttctcgaattggtgcacacggaaaatcccgcgggtgtctctcccatggcttccgaccttaaaaaagtgaaaataaaaggtgacgatgccacgggattaaagaaacaaatattggcagaatatacaaacctcctgccgaaaacaggtggacattccggcatatttgattggcaaatccgatgggttaagccattcgtcaccttacaaatggcaaagttgaggggagcagaataaacggataaaaatgtacgatgaaaggcggcgattggctgctcagaagttgcgattagatatttctcgtcgggagagccgtcttcattggctgcgtccgtcttttttgcggtggtcacctaaaagaaacttatacttacccataaaagttacaagcaaagtgaaagaaggtgattttgaaaagccaaaattttcttaaaatagacttaactcataatttctctagtaatggctcgggcttaaaatgggtaagaaacacagccaaaatctaaaattttgtttcaaaaatttcgttatgccctccctggttggtcaatctcaatagtaaagaaggaatccgaacattttgaaccttttgtacaccttgtaaagctcttcgtcgaattggctgagttgtgccacctcctgcattacgtctttgcgcataaaaaagggcgtgtaaagcggcgtgaagccctttttgttgagcatttgcaatgccaatgcgatgagcgcttgttcaaggaacaccaacggtcctttcagaaaatagcctcgtcctcccgccacattggtgcctctctctccgtcaaatccgtcgcacatcaccacgaggtcaacctgtttttcaattggaaaagaggaaaatgactgaaccatgagtcaaatcactgacatgagaataactttttctgcttgcgcagtcgccaaatgtccgttcgactcgattttcgtcttcattgtcactgatgggcaccgaattatgcagcaaattcccaattttggccaaatgctcatttctgtccccctcaagcgtttccattctgagtttggtccgtctgacttcttcgtccaccattcccttgactgttttaatttgcgaaattttcatttcctaaaataccaaataaaatcagtcggtacaaagaaaggttcagtcattttactttgatgtcatccattttcagttctgcaagtgatttgatttgtccttccggaatggcatcggagtcaccagccgactctttcttctaaatccgaattcccattgcaaggaattccacccaaattccaaatgcgacttttggtaatcatcggttttactggtcccataaaaaagaggtaaaaaagagattttgaggtgttcttgggggttttcggggcgctgaacacgaatatgccatccatttcaacctatttcgaaacccggacccgaattcgaacaatttttttttttttttttttgcatttttcactaggaatttgcgtcaaccttctttattatatgtaaaaacaaactttgtctatgcgttaatataatccaaatgtaaacaaaagatgaagaaataaatacgaatgaagatttgttgattgactttcatgtagcggaataaacaaaaacatcgactgtagctgggggggggggttgtcggtcatttgaatgcagcgtcgacgactcaatcacctcacctacactttgaccacccacccgtcctcattttttaactaagtttagctaatttttaagaaggttgacgcaaattccgagtgaaaaatgcaaaaaaaattgttcgaattcgggtccgggtttcgaaataggtcgaaatggatgtcatattcgtgttcagagcccccgaaaacccccaagagcgcctcaaaatcgctcaaaatctcttttttacctctttttatgggaccagtaaaaccgatgattacccaattattaacacaatgtgcgactctgtcttcctccccccacattcgattctattgcactataattccaatcacattttatgaatctaaccaatccacccctgagttttttttaaagcacaatttataacaaactaaaacaaagtcggggtaatactatagatggtgttttttgaagaaaaagtgcaatagattctggggttttcgattcaaaattacttatttggtctagtttttgtaacataaaatatatttaaattatgtacacgttaaggcttcttcaaccaatgaggagtgtactgttgcttggggcgtctgcaaccacgctttccatttccattgcatttcgcgttggcttcgtactcgtcaggttgcttttatctgccttgaatgtaaatggataatactgacgtcccctcggaattgcacaaaaaatactttcaagaatacaatcccgtgacggatgtgagttggttaggtacctttaggactaataactggggttatctatttttctgtgggtagcacttatcgagaggagcgcaaaaaaaacttatttccgcttaattttcaaagcgagttaaatgactgcttcgagaaaaaaattttgaatttttttttcgaacgaggaggggggggggtggcaccatcggcactgtaaccttttagatttttcacgtaaaacatacacgttatggctaaaaataaaggtcagattcttgatcagcatcaaaaattagcctagaaaaaattattagagaaaaaatttcaagggggtgacaaaacccggaagtacccaattttattcactttcccgaatgtatacattgaaatattttgaaatataatttcttcaggtttgtccgttggacaatcgcgactggtaagttcgtattctttgttcctaaaatttttgtaaattattagggagttccaaagatatggacattgagttgccttgcggttattgcacacggctgaatatttgggatcacgatcattatttaaatatgtgttttgttaggtacttgacaaaatcatgactttgttttttctatgaaagtattaaaaaggattcaccatatgaattcgcatttattacacattttttgaaaacaacttcgtttgttttgacaaaatactgaatatcattgataatatattttcaatgtaattaaccgataattttagtgaatagctttgctttatctaattttgcgtaaagatggacaagccaatcaaactcgcgaaagtcacgcgtatccttggttcgttttataacatttagctgatgtactctctttttaggacgtactggtagccaaggccagtgcacgccagttcgtgttgagtttttggatgacacaaatcgttcgatcattagaaatgtgaagggccctgttcgggagggcgacattcttaccttgcttgtgagcaattaaatttgttttcgtctaatgtttaacactgaaatttttaggaagctgagcgtgaagcacgtcgcccccgataaatcaacactac

SEQ ID NO: 1848 - DNA, 8848 bp, Heterodera glycines
agttattgcaccaacgatgtggaaatattgatggcagctctggtcgcctttcgccgggaattcttcgaaatttcacggcgccaagactacgttgatgggattgacgacaaggagaaccacgacgggatcgatgtgttgcgtgagtgcatgaccatcgcaggggcatgcatgcgacacttccgcacaaaccacctgcccgacgagcacttggccattgtccccgagcgcggctatgacaacgcgcagaaccaaagcctaatcgccttacgcttcttccacgggtacgccaaggagcatggagtgcaagtgcagacagcccacgcggctggaggagagaagattgggccctactccttggatgggtggattgaggcggaaaggcgcgcaattgaagtcaatggtaattgagttaattatttttcaccattattataaaatgggcaattttaaggctgtacgtggcacgggtgcaaaaggtgttaccccaacgacaacatgctgctccccaatgggaagactgcgggacaagtgcgcgaacgggattccaagcggatggaatttctgaggggaaaggtcaaccggatggacgtctactgggaatgcgaaatccatcggatgctggagaggagcaaagaaatgcgcaaggcatttgacgactacgtcgatgatggcccgctggtgatccgcgacgcgtttatgggagggcgaactggaccactgaagctgctgcgcaaggctggaccgggagagaaaatctcctattatgacttcacatcgctctacccgtacataaagtgagcacagttaaagttgtaacaaattaacattgtttccttcacagcttcacaacccgttaccctatcggacagccaaacgtgcatgtgttgaaccaggaagtggattggcgcagtgcagcggacaacccctaccctttggcactgctcaaagtgtgggttgtgccaccccgtcgcgtcgacgtgcccgttctgccggttaaagttggagagcggctttgttttccgctctgcatcacttgtgccaaagagcatccgactggtggtgtgaatcccaactaccactgcgagcacaatgacagacagcgggggtgggtgagcacgtgcacctccattgagctcaacgaggcgttggacgagggttacctcgtcacaaaggtcttccgcgtgttggagtatgagcaaagtgacgacaagctcttccgcccgtacatcgctgagtttatggcccagaagatccaggccagtgggtttgacaacagcatcagaggcgatgcggagaaggaacaacagtttgtgcgggagtgcgcagagcagttcgacatcaccatcgacccaaccaaaatggcggtcaacaaagggaagcggtccctggccaagctctgcttgaacaacttatgtgagtactgtcgtccattattattatatatttttaaaaaattagggggtcgattttcgcttcgcaactttgggctcgctcaaacactcatcactgacgacccagcgactttggcggagtacctggacaacaaatccatcgaagtgacatcaatcgacgagttggacgagcagcacatactcatcacctatctgcagaagaaggactgggtggatgagcactcatgctccaacattggtgagacacacacactcacaataaattgttaatttttataaaatttcagtcatttcactatggaccacctcagcagcgcgcctcgttctgctcaaggcaatgcagaaggtggtcagatcaccgggctcggatctgttgtacactggtaagtcaaactacaaaaaaaattttgtgcacaaacatttattttagacactgacagcctcatcctcgtccacccggaggagcggtgcccgctgaaaactggcccccacttgggccagttcaccgacgaataccccgaccacgacattgtggaattttgcagtggcggagcaaaacaagtgcattttcagttcatttttgtttacttcaattttaccaccttttagtacggtctttgtctgcgacgcaagggcgcggaggcgggagcccaattggaacatgtgctcaaagtgcgcgggctgacgctaaattatgatgtgatcaacaaccaggggatgcgctatgagaacttcaaagaggaggtggtccgttacgcgacaagtggtgaatacgagccgataatcatcacataccccaacttccttcgtccaaacatcagggagggaggtcgggtggtttccatgcctatgcaaaaatgctatcgcccatttgtgggaaagggaatcatcggggccgatttcaatgtgctgaattttggacacacattgtaatttgtacattatctatcacacacacacacacacatatgactgtttcttttgtacctcaaattgtgtacattttatgccattttattagtttttaataaaaatttgtgcattattagtgaatggaagatgcaattatgaaataattaagcattagaagatgtcatttttaggtagaaaaagtgcataattaagctaaagaagacacaatttttgaaaaattaaggaatgaaaaatgcaatttcaaattaatagatggaagtggtcattttaaggaagaaaaatgcataattagtgagcaaaaacaaaactaatataacggtacagtactctgtgagcattcattgcgtccgctgtcttcatccatgtctctctcaaatattaggcgcgttgttgtgtcggatgagtttgacgacgattgtttgtcgtcaatttcagtgaaaagacggcccagccaatgctcgttgttgttgatgtccatgtccatgttgtcatcaatcagctcaagaagttccattgggagtgccgatcctcccctccccccgaaaagcgttcaattatgcacggtgcatacgggaagtgaagctttatgcggtgccgtgcataaaaatgtgccgccacattgatgttgaacgggttgcgcaattgcccataagcaggaagaaatgcggcgccttgtgccgaaattccagtgacgaagaaagttttggtcatcccattacggtcgttgtaggtggtgcgcgctttgcgcccaatgatgtgtttcagcacaagcgcccgatcctctgggtggttgagccggtcgcgcaatgacttgacagggcagttgagaagctgagcgcaaaatgtgcttacaagaaccatggcaggagaatgaaagtgggatgaagttgaaaaattttacttttatttgcgcaaaagtgtggccacgcctacactatttgaaaagagtcacggttttagacatgcccgcccactaaaagccaaaacattttgcctgccaaaaacccagaatcattttaccaatttttgtcaaaatgaaaagacgcattgctcctcttactactgctactgctcctgctgagcaacataaaataattggtcccgagtcgcccaagccacatgaagagacggccaaaaatgttgagcctaaggatgagttggcaacgaagaaacgcaaagtggacgaccgagagttgtggaaattggcaaaaggcaaatttttgctgaccacctatttgtgccatggtaataattaataacaatttcatcaaattttaatttgaatccataaattttgagatgattggaatcgtctgtacaacaaccagcagaaagtgaagcgcctggagggggaccgttttgccttcggctttgagatgtgtgaggaatgcgtgtgggccaactgccgcgcaaccgaccttttggcgccaatgaagaaaaagtgaactttgaccaaaagacaataatggattttgatgatgcaatccataatttgaattaatatttaattctgcacaataaacattttttgagacagtccctcaatttccttttttgtgtttgcttcagatgaaatctggggtgatgattaattggcttgccgaatttgaatctggcaaagacactgaggggggggggggggggggagggggggcacatggataaggacaaagcgagtggaaggaccattcatgtcttattacacaaaccctctaaaatataaaatgtccccgcgcaaatcttcaattgcaccatcgctggttggaatagcaagtaatatagttttgtcaaaaaaatttttgaaccaaattgttctgttgaaggatgcggcgagtgccattcggcccggtgcagggtgtgcgaaaaactgagggaacggaattgtgaaaggatgcgcatgggacaaccctacggtcgcatcagccgcgagtttgggccactgaccagagaacagcagctcagtacaacggcagcgcgcaacccaatggaagccgcacttcaagctggtagcgaaacgaaagccgtatttcgttgggggggacccattggcacttgtccagttccccgccactttgttgtacccaaatataggggggatgtgcttgtgtactatagggatggcgcaattctttggggcctgtgggcacgttggactatgccgtcagtgtttgattcttcatttaaaaatttcacccagtcctgataaatgtccctattgtcgagtgtgcaccacattttacatggaacattaaatatttgtcaaatatttttttcaatattatattttgaataaatgtacgaaaaaatttatttttaaatgatgaaaataaatggtgaaattaaatggtgaaataaatggtaaaatttaaatggtgaaatttaaattgtgaaaaggttcaattcggccggccagtgcactcatcactcatcagctcatacatttggccacgaagcgtcccagtttactcttggccttaggaaaggaatttttttttaaaagtgcatttgtgtgccttacatcctcaattatggttttgccctcggggctttccataagcccttttgcgaacaaaatattatactgagttgtcctcaatatgaattcatcttcaatgtcatccaactttgccaacactaacaaaaaattatgcaatttttaattcccctcactctccacaccttgtccaaatttagggttggcctggagctcatcagctatcgaagctgggacgctttcgcccaatagcgcaaacagtacagcatcgactgttgccacggtcccaaatctttcaatgtactctgtacagtcggtgtcctcggacaaacaccatgagttgcggccgcggtagcctaaaattgcgagaaaaaatgagagaagaaaatgggttggtgaatggaaaaggaaaaagaaaatttaaagtgaaatagcacgagaggtagcgaagctaaactgcgttaactcggcatacaccctcaaattattccgttccgaaagtggcgaagctaaaccaggttaactcggcacacgtttggaattttacaataaattttcaatttccttatccatccgtccaccttttcattcacacattttttctttcaatttcatcatcaaactcaccgagccactccaagaaatagcatttcctccccgatgcatgagtgaactgtgccaacacgctcttgacctggtactggcgcgattttgggttcggcagtacaccgggcggcacatttgggcaatcggcattcacatttatctaggaagtgaatgtgtgtgtgtgtgtgttgtgtgtgaattttcaaattttttcttaccggtacacgtccacttttgttgtaatttttcctctgtcttctggaggcatttgacgaagtggaagacagtgcgggcgacgctgtgcgcgagactgtgctgcgcgagccggacgatgtaatgcgttgattggccaccgcccgccgcaacaatttgttccccttcaaattaaaggaataaattttttgaaaaatcttgtgaaaaattaccgcttgcccaattgtgtcgtcattttcatccgcttccgccgcaattggttgtccgccattgttgtttgccgccaactgctgaaaagatttaaatataatgagaatttattaaacaacactggcccaaattttttccaaattaacaagttttttttcaatttagatgtcataaaatattcatataccatccggtgaatttttaaaccaaaagcgcccgcccttagctaacgaaaatacaaaaattgtacttgtccgccggtgccatcaattgctgctgctgccgccaccgcatcagttccgtcgttctccgcttgttggacggtgccattgtttgtcactggtgctgctgacgccaattgttgtccgtcattcgttggcaactgtgaaaataaaaagcatatgaaatttaaatgtgaaaatttgatggtgaacacaattcacctgtgcgctcggtccgttcaccaccgcttcgtcctgcccgaccaattgagccgcctttcttttgcgtcgtggtgccatgaaagtaatactgtactatctaacaaaaaataaataaataataaataaataaaacaattccattataaatttaatggtataattatgctaaaatgagcccaatttatttggagtatcgaatcaatatgtcaatggcattggtcagcgccccccttctccattagcaaaagatgatgctgttttggttctcaacccctcactttgtgcacaaaatttttctctgactgtctgtctctctactctctcacccaatgtttgtttcttctctctctatctctctctctctctcaccgtttcactctctcacttttgcatacactcttttctctttctccacgcgccgccgttcctcgctgcagcgccgctgaccaccagcaccccccccccttccacacaaataattaatcactctcccaccgccgcaacacattccattggcacaacttttttttaccaaaaaagtttgtgccccccccaatacatcaaaagttttttccatcccccccccgtccttgtcaaaaaagtttccactccaccagcacttcaaaagcgacgccgccttccccccgcccgtgtgccacaggcacacgcgcggtaaaaccgcgcgccgcctcactcgcaccccctcccaccccccgaacccgtgccacaggcacgggttcgcgcggtaaacccgcgcgcggcggcccgagcgcggctatgacaacgcgcagaaccaaagcctgctcgccttacgcttcttccactggtacgccaaggagcatggagtgcaagtgcagacagcccacgcggctggaggagagaagcgcattgggccctactccttggatggatggattgaggcggaaaggcgcgcaattgaagtcaatggtagctgaattttatgcacaattattttaaaatgtgctattttaaggctgcacgtggcacgggtgcaaaaggtgttaccccaacgacaacatgctgctccccagtgggaagactgcgggacaagtgcgcgaacgggatgccaagcggatggaatttctgagagagaaggtcaaccggatggacgtctactgggaatgcgaaatccatcggatgctggagaggagcaaggaaatgcgcaaggcatttgaagactatgtcgatgatggcccgctggtgatccgcgacgcgtttatgggagggcgaactggaccgctgaagctgctgcgcaaggctgggccgggagagaaaatctcatattatgacttcacatcgctctacccgtacataaagtgagcacagttaaatttgtaacaacttttaacattgtttccttcacagcttcaccacctgctaccccattggcactcccaaagtgcatgtgttgaaccaggaagtggagtggcgcagtgcagcggacaacccctaccctttggcattgctcaaagtgtgggttgtgccgccacgacgcatcgacgttcccgttctgcctgtgaaagttggagagcggctttgcttccccctgtgcatcacttgcgccaaagagcacccgacaggaggagtggacaacgactaccattgcgagcattccgacagacagcgggggtgggtgagcacgtgcacctccattgagctcaacgaggcgttggacgagggttacctcgtcacaaaggtcttccgtgtcctcgagtatgagcaaagtgacgacaaactcttccgcccgtacatcgctgagtttatggccaaaagatccaggccagtgggtttgacaacagtatcagaggcgatgcggagaaggaacaacagtttgtgcgggagtgcgcagagcagttcgacatcaccatcgacccaaccaaaatggcggtcaacaaagggaagcggtccctggccaagctctgcttgaacaacttatgtgagtactgtcgtccattattattatatttaaaaaaaaatagggggacgattttcgcttcgcaactttggactcgctcaaacactcatcactgacgacccagcaactttggcggagtacctggacaacaaatccatcgaagtgacatcaatcgacgagttggacgagcagcacatactcatcacctatctgcagaagaaggactgggtggatgagcactcatgctcaaacattggtgagacacacacactgagcattcattgcgtccgctgtcttcatccatgtctctctcaaatattaggcgcattgttgtgtcggatgagtttgacgacgattgtttgtcgtcaatttcagtgaaaagacggcccagccaatgctcgttgttgttgatgtccatgtccatgttgtcatcaatcagctcaagaagttccattgggtagtgccgatcctcccctccccgcgaaaagcgttcaattatgcacggtgcatacgggaagtgaagctttatgcggtgccgtgcataaaaatgtgccgccacaaagatgttgaacgggttgcgcaattgcccatatgcaggaag

SEQ ID NO: 1849 - DNA, 1856 bp, Heterodera glycines
aaataatttattattgagagggaaatggaaaaattaaacatttttatagtcacaaaaaatggaatgaaaaataggcaaaaaattacaaaatgaaaacgaagaaaaaaaaattcaaaaaaaaaaatagtataaaagtggttgctccaccgctattttcattattattttttcattcgtttatccatgataatgcgttcaaatgcttttctacatttacccttatctgaattttaattgtaaaaaacccattcgtcttaccattataaatttagctaatatgagttgcttatgcttatcttcaacaaaatctgcgtctgccgctgcttcctcttcttcatccatcgtcattggtgcaacaactttcgtcaccgtcgaaacttctgtgcgcaccgctggaccgtcgtttcagttttattatgaagttttagtggcgtagatcgatggggtaaattatcaaattaaattatgaatccatgggaaattttaatcttggcaactccggccaatggtaaagagattgatatgaacaaatttgtgagcaaaaaagtacacacacatagcacatatagcatatacaataatagtgaaatgacaattttctggatcacaaacattaatatacaaatacaatacaattagtgacaatacaatatgtaaaggtcagtttatttcctcgccagaacatcgcatcgtttaaaggtatttgtcgataagcatgtttgcggagttgctcatcatcgacgatttgacggcctggctcatctgcgttttggctgccgcctggctcatctgggttttggcggtgcccttctgcttttttgccacggcgtccttaaaaaacggaaatcatggtgatcaaatagaaatttggtacaccaaaacatacgcttagaagcagatgccgtgccagttgtttgagatccatgtccacgatgttggtgtttcggatgtgtcgaagtgccagcaatggaagacgacgttccagcagtgcgcacagtgccacggcgtccttaaaaacgaatggtgaatgatcaaatagaaatttggtacatcaaacatacgcttagaagcagatgccgtgccggttgtttgagatccatgtccacgatgttggtgtttcggatgtgtcgaagtgccagcaatggaagacgacgttccagcagtgcgcacagtgccacggcgtccttaaaaacgaatggtgaatgatcaaatagaaatttggtgcatcaaacatacgcttagaagcagatgccgtgccggttgtttgagatccatgtccacgagttggtgtttcggatgtgtcgaagtgccagcaatggaagacgacgttccagcagtgcgcacagtgccacggcgtccttaaaaacgaatggtgaatgatcaaatagaaatttggtacatcaaacatacgcttagaagcagatgccgtgccagttgtttgagatccatgtccacgatgttggtgtttcggatgtgtcgaagtgccagcaatggaagacgacgttccagcagtgcgcacagtgccacggcgtccttaaaaacgaatggtgaatgatcaaatagaaatttggtacaccaaaacatacgcttagaagcagatgccgtgccagttgtttgagatccatgtccacgatgttggtgtttcggatgtgtcgaagtgccagcaatggaagacgaagttccagcagtgcgcacagtgccacggcgtccttaaaaacgaatggtgaatgatcaaatagaaatttggtacaccaaaacatacgcttagaagcagatgccgtgccggttgtttgagatccatgtccacgatgttggtgtttcggatgtgtcgaaggtgccagccaaatggaagacga

SEQ ID NO: 1850 - DNA, 1196 bp, Heterodera glycines
tttgagatccatgtccacgatgttggtgtttcggatgtgtcgaagtgccagcaatcgaagacgacgttccagcagtgtgcaaagtgccacggcgtccttaaaaacgaatggtgaatgatcaaatagaaatttggtacatcaaacatacgcttagaagcagatgccgtgccggttgtttgagatccatgtccacgatgttggtgtttcggatgtgtcgaagtgccagcaatggaagacgacgttccagcagtgcgcacagtgccacggcgtccttaaaaacgaatggtgaatgatcaaatagaaatttggtacatcaaacatacgcttagaagcagatgccgtgccagttgtttgagatccatgtccacgatgttggtgtttcggatgtgtcgaagtgccagcaatggaagacgacgttccagcagtgcgcacagtgccacggcgtccttaaaaacgaatggtgaatgatcaaatagaaatttggtacaccaaaacatacgcttagaagcagatgccgtgccagttgtttgagatccatgtccacgatgttggtgtttcggatgtgtcgaagtgccagcaatggaagacgaagttccagcagtgcgcacagtgccacggcgtccttaaaaacgaatggtgaatgatcaaatagaaatttggtacaccaaaacatacgcttagaagcagatgccgtgccggttgtttgagatccatgtccacgatgttggtgtttcggatgtgtcgaagtgccagcaatggaagacgacgttccagcagtgcgcacagtgccacggcgtctttaaaaacgaatggtgaatgatcaaatagaaatttggtacatcaaacatacgcttagaagcagatgccgtgccggttgtttgagatccatgtccacgatgttggtgtttcggatgtgtcgaagtgccagcaatggaagacgacgttccagcagtgcgcacagtgccacggcgtccttaaaaacgaatggtgaatgatcaaatagaaatttggtacatcaaacatacgcttagaagcagatgccgtgccggttatttgagatccatgtccacgatgttggtgtttcggatgtgtcgaagtgccagcaatcgaagacgacgttccagcagtgtgcacagtgccacggcgtccttaaaaacgaatggtgaatgatcaaatagaaatttggtacatcaaac

SEQ ID NO: 1851 - DNA, 936 bp, Heterodera glycines
  misc_feature (901)..(901): n is a, c, g, or t
agacgaagttccagcagtgcgcacagtgccacggcgtccttaaaaacgaatggtgaatgatcaaatagaaatttggtacaccaaaacatacgcttagaagcagatgccgtgccggttgtttgagatccatgtccacgatgttggtgtttcggatgtgtcgaagtgccagcaatggaagacgacgttccagcagtgcgcacagtgccacggcgtctttaaaaacgaatggtgaatgatcaaatagaaatttggtacatcaaacatacgcttagaagcagatgccgtgccggttgtttgagatccatgtccacgatattggtgtttcggatgtgtcgaagtgccagcaatggaagacgacgttccagcagtgcgcacagtgccacggcgtccttaaaaacgaatggtgaatgatcaaatagaaatttggtacatcaaacatacgcttagaagcagatgccgtgccggttgtttgagatccatgtccacgatgttggtgtttcggatgtgtcgaagtgccagcaatggaagacgacgttccagcagtgcgcacagtgccacggcgtccttaaaaacgaatggtgaatgatcacatagaaatttggtgcatcaaacatacgcttagaagcagatgccgtgccggttgtttgagatccatgtccacgagttggtgtttcggatgtgtcgaagtgccagcaatggaagacgacgttccagcagtgcgcacagtgccacggcgtccttaaaaacgaatggtgaatgatcaaatagaaatttggtacatcaaacatacgcttagaagcagatgccgtgccggttgtttgagatccatgtccacgatgttggtgtttcggatgtgtcgaagtgccagcaatggaagacgacgttccagcagtgcgcacantgccacggcgtccttaaaacgaatggttgatgatc

SEQ ID NO: 1852 - DNA, 3055 bp, Heterodera glycines
tttgcggagtttctcatcatcgacgatttggcggcctggctcatctgcgttttggctgccgcctggctcatctgggttttggcggtgcccttctgcttttttgccacggcgtccttaaaaaacggaaatcatggtgatcaaatagaaatttggtacatcaaacatacgcttagaagcagatgccgtgccggttgtttgagatccatgtccacgatgttggtgtttcggatgtgtcgaagtgccagcaatcgaagacgacggtccagcggtgcgcacagtaccacggcgtccttaaaaacgaatggtgaatgatcaaatagaaatttggtacatcaaacatacgcttagaagcagatgccgtgccggttgtttgagatccatgtccacgatgttggtgtttcggatgtgtcgaagtgccagcaatcgaagacgacggtccagcggtgcgcacagtaccacggcgtccttaaaaacgaatggtgaatgatcaaatagaaatttggtacatcaaacatacgcttagaagcagatgccgtgccggttgtttgagatccatgtccacgatgttggtgtttcggatgtgtcgaagtgccagcaatcgaagacgacggtccagcggtgcgcacagaagtttcgacggtgacgaaagttgttgcaccaatgacgatggatgaagaagaggaagcagcggcagacgcagattttgttgaagataagaataagcaactcatattagctaaatttataatggtaagacgaatgggttttttaaaattaaattcagataagggtaaatgtagaaaagcatttgaacgcattatcatggataaacgaatgaaaaaataataatgaaaatagcggtggagcaaccacttttatactatttttttttttgaatttttttttcttcgttttcattttgtaattttttgcctatttttcaattccattttttgtgactataaaaatgtttaatttttccatttccctctcattattaaattatttccaataagatttttattcattcatttcccaaattcattttcattggtactttgtgtctcttctgttggtcggctgtggcaccattctttggttcttttgggacaacgtcaaaaaacgacgacgccccaacaaaaaagaaatgtaaaaaacaaaaattaaattaataaatcttcttttttttcagcttcatctctgccgactgttggctcgaagtgttcgctttacttccgccttctcagcttggcctcggaatcgctctgatcagtcgccgattttaccgccgcgtggacaaacatttcaaagaacgcaaatggatattggacaccgaattgcgaattcaagagaaagagctttggtttggcaggaagcaaatggaaattgtcaatgccaattgaagcgtttgccaatcccacaaaatccgttgcccaacaaagtcatcggatttaaacacattacgttcatgtaaaattgacaagtttcccattggtttgagataactttttcttgttttagttacttcgaccacaatattctcaaatttgtccgccgttttcaccgctttttcactttaattacaacatctttaggcattatgagtgaaaatgttcgcatttttgagttcttcctgtccaccatttggccaatttttggtgactccattcaattaatgtggttgaccacttctggtttccgtcgaatgcgccaattagtcccgtccattctcaacgactgtccatcccttcgtttcgtcaccttcaataatttccgcccgatggcagtgccaatgcgacggatggtcaagtggtggttaaatgtttgttcacgcctcgttcgctaaatttgctgaatttccggaaaaaaccgaaaaaccaaaatacttgatttttaaatttttgataaattttctagatttttttcctaaaattagaagaaaaaaaaatttgcggcgacgtttcggcggcgggcgacgttttggggtgtacccgggacggacggtgccgaaataaaccggcacaacaatggcaaaggcaagtgcgccaacctgatgacggaggatgaaatttggtcaaattttgtgattatctagttgatgagatgggacggattaaggaattggcaaaatgatcgattgacgaacaagacaaatttgttgacattttgactggcacatcaaataaaatggcatttgttgtaatattgtaaagagaccgagaaaggcaaaaatcagtaactaaaagaggaggtggacttcattttttttaaatttaaattaaaccaaagttttttcaacagaaacaaaattatttataaattatataaccagtttatcagttaaaaaattttgaacgctttttaaaactgaagctgagtttttagcaagtatttacccatttttgtcaactatttggggtttttttaaaaagtaaaaactaattattttggcagtttttagcaactataaatacaaatgaataaaaatacattataaaaaatacaaatatttcattggacaaattaaacaaaaagatgaacaaaataataaacaaaaggacatcgccacaggcattaagtaaatttttaattgtttatatgcatttaaattaaaatttgtcaaaattttttttttgtctattaggggagaaatatttttgtacttttagccaatatcttaaaaattaaaaaaaaagatacaaatttgccgattggaaattggccaactgatcagctgcagagacagatcacccactgattgacagatcacccactgatcattaatcactgatctccccttttctctcatggatggccatcaaatggcacgaacacatggattagggatgaagcattgtccaagagcggacttggactcaatttcattggcggctgttctccgactggcaaactcttgaaccgttttggcgacggtggtgttactccagcaactttatagtgcaagcagtgaacttcgtccacccgaatgatttctttggtctccggcttactgtagccccaaaaacttacggtacctccatcggccttctgtaaa

SEQ ID NO: 1853 - DNA, 1969 bp, Heterodera glycines
  misc_feature (1962)..(1962): n is a, c, g, or t
ttcgggatgccctaggatgcccttcgggatgaaaaacaataagaagaatgccccgggatgcccttttggatgactgtgaaaatgcccattaggatgataaaatagtgaattttgaatgcccttcgggaagacaaaaagtgaaaagatgcccttctggatggctaagaaaaatgaccattaggatgataattagtgaaaataaaattcgaaatgtcatgaaaaaaaattgaattgaaattaggaatactcttcgggatgaaaaatgaaaatgcccttcgggaagacaaagtgataaattgaaatagaaatggaaaatgaccggaaaaaaatttgaaatcagtcaatccaaaaaaaaaaaagtgaaaattcaaatgtgaaattaaaaacttaaaaaaaaaacggaatacaaaatacagtaaaaatacagtaggtccttcgggaagccaaagagatgattgaaaattacatacaaaaaaataaaaataaagaaaattataaaaattataaaaattaatttaaatcatatacagtatacaaaagggactacagtactcaaaaaaaaagggggaattttgccggacatgttgatgagcaaagtacgctcacagcttgcgttatcgttttggcccatctgctgagaacattgctcacttaacgttagcactgcgctctctctctttcttcccccccccccggcgctgctctcttttgtcaatcggaagatctgttgcaattcgtagcgtcttttcacattcatcccttcttcgttgctcttccttcttccccccccccccccggcgatgaagggcggaggatggcgtcgcttggccattcatttatgagacgccaataaatatgcggatttgcagcgcatttttcattcttcactaaacaccatccttcattttgtgtcattcatttacgtcccatttgttaggaatatttactaatattttcaatgtatattaatttgtttttttcattttaggcattcaaattttcaacttctaacaccaattaactcttcacttcaaatcgttgaatattggactcggcatcggcacacttctgacacaactcaacaaggacaattggcaaggacattgcgcttcggcatctctctgtgagtttacagtaataggtactgtactaattaagaggggaggatttctcaagcctttgggacccttattggactaaaaaatggtgagacttcttacaattcgtaagtcttattaatcctggtaaccctaaaatttggccaaacaaaaggtgccttttacttaatagtctctggtgataattcgactctcaaattgtaaattagtggggtccaaaaggggcataataaatcatttatattgtgctttgtgaattataggggttttaactacggtaaaccgtatgtcaagtaaatgacatttattgatatttcgaatactgtttcgggttctaccttttctggactctgctggactgtgaactgtggactgaattagcgtttgcttggacagtttggacggacaattacgcattgcttcggcatttttctgtaagtccaacagtactgagcatattgtaagttatgaattaatttttcaaatgtaagctaattaaatttattgatcgcgttaattaattaattattacagattcctaaaaccacagtaatcaaaattgggttaatcttttcaaatgtacagtaatttccctatgcttttggttttctttggtcaaatttgagtattattggttcaaaaacgatgagttagcaataaaaagagtaactgttgacattttatgattaatgttttacttttaaccacagattcattaattcgaatgtgacattaatttcaattattaatttctgtgaataatttcaggtttctgttcgcatctgactgataaatcggactttgttgtgagccttgacatctacaaattgcctttgaagcccanattaagt

SEQ ID NO: 1854 - DNA, 1066 bp, Heterodera glycines
  misc_feature (39)..(39): n is a, c, g, or t
agcgagagaagagatgatgtgtaggtgtctcatagaaanagttagaccgaaatttcagcgttcattacagcttgtaggaccacttattgggagaaaggactttcagaaactgacagcatacattcaagagttagaagtctcaattgaaagggatgtgagaaatgagagcttcggcattcacgcacttaatacaaatcctagtcaagttccacaaggcaaatttaacacatggggaccttcgaacccctaacaatgttcaacttgggcacagaacatttagaaatgaaaatcgtgatcagtcagacaggagacccaataatttttcacagaacaatagatacaatcagcaaaggagggattggggcccacaaaatgatagaagatggaacaatcgacccgtctgtcattactgtaagaaaaccggacatgtacaatacaattgcagggagagacagaatgatttttctgggcaatttaacaatcggaatcaaacacgatggcaacctccgccacaaaattcaaatagggacaattggtacacaaatgagtcaaaacaattaaaaaatatggtagaagacttagcagttcaggtgcattaaatgaaaatgaataaaaattacgcttcggcgagccaacagaacattaaagcattacaaatgattcatacaaatgaagaaatacagaaaattgaaccaaagaaaaattttgaacccaaaagtatttcaagttgggagaataagcaagggaaatccaaaacattttcaaacattttaatgacaattacgcttttaaatattttaacaactgctataggcaaacaacaaattttaactgtagataagcctatgatttgccaaacacaaaagcaagcaatgctttgggagctaccaattattcaggggtgtccgacaataaggttaagtgtagataattcacctattcctcaaaatcgtcagttgtttatccccaacagcattgaattttcaacaaaagcttgggcttgtaggaaaattaagaaaactgttagaaaatataaaagactaacaggagtaccgatggaagagaa

SEQ ID NO: 1855 - DNA, 2140 bp, Heterodera glycines
cttccattccttctaaatcgcctttatacatcccattatgagcgctaaaattatcagagtgccgaaaatcgcatgtgatctaagcctagaaaaaatggtctaagtaaaaatcgtaattacgctcaaaaagcttcttaaacaattttagcgcttccaattccttctacaatcgcctttatacatcacattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattactgtaagagagagagtcgaagttgtagggttttaactcgtttaactgccgaagctctaggatttcactattttcacatttatttctttttgcatttaatttccccttttactaattgtaccgccctcccagcgataattgatcgatgacatttcatttttcacttgtatttaatgttcgccttttcaagcgaacggggttcagttgtcccgagaataaagccacttattgtgtgaccagcgagtgtgggaaggcaaccccgggcttgatcaccccgtggacccatccttcgggaatatgtggcacctttccctttccctccccattccgaattccaattcccaacgccagcacgtccaccgcgctcggccgcgctactggtagcaccggatggttcacttttgtgaacttttcatcaacctgggcggaagaggaacagcgaaagggaggtgagtttgagtgagggacactgaggaggcgcctggtgtgatgaaaaggagaaaaagaaaaacgcttcggcgatttaaaatgcccccggggatgaaaaatggaaaaaaaggcactaaataagagaaaaatgcctgcaggtgagacaaatatttaaatgcccccggggatgaaaaatgaaaataaaaggcactaaataagagagaaatgtctaattgttgcctgcagatgtactaattgccgatggcagcacaaaataaaacgcaaaaagtgccaataattcctgcgaaaaatgcctgcagatgagacaaataaaaaggcaaaaattatgcttcggcagtttatatccctccggaggtgacaaaatacaaaaaaaaaaggaagaaaagaacaacaacaaaaagaaaagaaattgggcataataaataaagagcaaacaaaattagaggaaaacaattcataaaagcccacagaataaaaattggcttaacaaatcctaagcgccaacagagaaagaaaattgagtttaagaatcataagcgccctgaaatctcattaaaaaggaaaaactaatatttttagcagaggacaatgcctgcagatttagcaaagtcaaaaatagtagaacaaaagcaaaacggaaaaaggagagggatttggcttcggccgtaaatgagttaaaataatttgggactagcaaaataaaaggtcgaattttgtgactcaattatcatataaaatgacttagaaaaattacgaaatatgcttcggcagttttacagtcaagagtgatttgaaatttttggcaatcctaagaaaaagggcttattacagtactccttcgactacggtaaacaatttggttgttcattcaaagtccgccagaggcgttaaaatgggactctgcccccccccccctcttttcccttccatcttttccgtctgctgctcttcacacaattcgct

SEQ ID NO: 1856 - DNA, 7718 bp, Heterodera glycines
tttatttagcaaaaagcaattactttcaacaattttcttcaatcaccacaacggaaaaagaggcatcagcagcaacagacaaaatcggacggaacttgctggtggacattcgacgggcacaccagcaaccagtatgtttaaagggtgaatgaccgctaattgggacggtaactgggactttgcccattttagtggaactttgaaattgagggaaaattagtggcaattaattttcagagtgtttttttttaggcgtcagtccttcggcatttttttggcaacgagcaacggctctgtgcttcggcggactcaaagcgaattctgaaggaagtccgaagggcggaatatctgaatcggtatttcggtgggttttgaatttaatgctgaggaagtggacacttaaaatgaagggtaaaccatcccaaaagcccaaaagttgcttttggaattcaggagaccaaaattttgagttcttccttgtctagctttgcaatttaagcacagtcttggcatttcttttagtctttcatgttagacacttacagtatactgtgagcaacctaaaatttgtcataaaattagtcactttttcagcaagtttggttgattgaaagacacattaatattatttttaaattgttaggcacatcgacggtgcgttcttccccgcttcggcgatttctacggatctgtgctgttcgactacgtgtgatattggactacagtgatcagcgatcagtgacaagacagtacttggcagatcggtgatcagaacgacttgtgagtacggtaggagaaatcaggataagaaatacgaatgagttaagcttatggcctataaattgggatgagtcgatttttttggcacagcaaagcggaaccaaaatcattttaccattctattcataagttttggttttgttttgtaattgggcgacaaaactgagtcgccaatctcttgtcttatccatgttaagccttatgctttaaacagcatcaattagtgaccaaaattcatagcaaatcatttaagttcttataataataattgttcaagttaaggcgcttggcgaatctgagtaagagagctttgagtgtggtgcggaccatcaactgtgttcaacgcttcgacggcccaaaagtgtgacacatttcgcattgtgtgaaaactgtgagtatgagtggaaattgtattacgagggccgaacattcagctttgcttaacaaacaatatgcttttcatttgattaaccaaataaactgcgctatgcttttaattaattgttaaacactaatgcacttttatggtccctaaaattttggaaaataattagtatttaattgatctgatgtgtaaatgccggttaaattatacactcttggtacaattgaaggcgtttaggaacattgttttgttttggatttcaacaaatcattttggagaattacaggtgaagaacgacatcagtggtgatcaaacgcttcggcggattcaaagtgaacggacaaagctgactgatcgaacggacatttgacttctgtgggcggacaaagtgaatttcttttcttctattaatcaattagacaaaaataaacaccaaacaaaaccaagtaaaataaaaagggggaattgaaataaaaaggggatcagaatcaaaaattaggtttgcttcggcagttcaaaagcatggagtacacagaccttgcggtctgtgataaaaggcttatggaaggcaaacatatgactgcgcaggcaaaaatcagtgacctttctcgggtccatgatgatgttattggtttagaagaagggatcaatcgaaacctgagggctataaataggaaagtgactcaagtagtgggccgagttagtgacatcgaagccgatgtgaatacaggttttggtacaacagcggcaagggttgacacacttggggaagtagtcatgggattggaaagcaaatttgacacatggaaaaatgagcttgagttgagagaaaatatggaattcgatgaattaaatcgaagcagtggggttcagaaaatcttaagcttaggcaagcagttgacttcgccaaggcctatctttccgccaaccccacccccaactcaaaatgcaattaatagctttggcatctttcaaagtacctctaatgtacaaaattcgaataataccgcaggcgatcctgcaaatggctccatgactaatcagtcgagactcatttcaataaatgagtcaggggaagaagatgatgtagatggtaacctgaatgccctaactgacatgaatacgtccagtacacagcctggagtgttctgtggtgaactcgcttcggcatttgatgactgggaaattaagtttagggattatgtggatgtttttggttcggcttggagtgaagcagataagttgaaccgacttaaattgcacttaggtgcgcaagcaagaactatttttgagaatttatcgcctaatgagaaaaataatttggcaaatgcactcaaaaacattagatctaagctggatagccctcactttagagaattggcttataagaaattagctgcatgttaccaaagagagggagaatcagttagtgagtttgtgaagcgcttggttcctttagtgcacacgacttcggtccatattccgtctaaggcgagaagaggtcctctgtcggtgtctcatggagaaagtgagacctgagtttcagcgatcgcttcaattagttgggccactcattgggagaaagagttttgacaaactcacagcatacattcaggaattagaggtgtcaattgagaaagacactagggacagcttcggcattcatgccataagtgggaacactgggcaactacctcaagggaaatttgcatcatggagtgcttccaattccaatagcactccgcttggacctcggtcgaacataaatggtaataggggtactccgaatcgattttacggtgagagaacagggcgtggtggttactataacagggatagaagaaattgggcaccacagaatgacagaagatggaatagccgacctattgccacttttgtcgacgtaccggtcatgaacagtacaattgtagggaacgacgaatgaattttaatgggaatcaaaattcaaacaattcccggtggaaccaacaaaatagaaatagggagccaaaccagttggaacataaaacggagagattagaagggatgattgaagacttagctgtacaaattcatgagatgagaatgagtaggaattttgcttcggcagaccaacagaatgttaaatcgctccaccccatggaaatgtcagaaggggagagtcaaccaaaatcagagtccatcaaatctgaacccaaacgaattaaaagttgggagaccaagggtaagggcttgagctcagcaacctcaattctttcaagtctcatggttgtgtcgttattttgttcagttaattgcgtgaacaaggcattagttccttctaagccaatgatttgccaaacacagaaacaggcaatgatttgggagcttccaaaaatgccaagttgtctgcctctcagtctagtagctgagcacactcctgtggctcaggacagagaattgtttatttcaaacagcatcgaattctctactaaagcttggacttgtagaaaaattaagaaaaatgctaggaagtacacaacaatttcgggagtgccagtagaagagaagttagactcagaaaatttggacataagcattgatgagtgtcaacaaattattaaacatagaagttgtagcttaggcgttctcaaaaatcaaactaatttttggcaaactgaaaatagcattgacctaactccaagaatgtggctatttgggtcctttggttggaaaaatgtgtcaaatgaaaattgttttctatttgaaagtcgaattgactcacacttcggtggttcttcaattgttactccgcttgggtcaccaaatgagtgtccttatgagaaggggagttgtattttggatgacaaaacggtacttatttggaaagtggataatgccaagaaatgcaactttatttcaataggaatcaaaacgggaaaaacaatgggtaaaatttggctttctgatgatggacagcttggtcttaccttcgggaactcatcaaagttaatggattgtggacagaatattactatctctgaccaggggtttggatcaactattgtgcaggcacctgagtctcatagtagaattgttcggagtgtgaagaaatccaaaacattaagtgatggaatagtcacctcatctcaattagcctcacaacttacttatttggatgcggcaatcacacaaacaatgacatttgcctttcatcactcatttcaatcattttgtcaatttattgaagacaataaacgctgggctgagtcagcattcttctcaaatccaactgatctcgctcggtctgtcttctctaatccgtatgtggtagctaaaagagcagcgagaactcttttgaaagtttggccatgcgttcctcttgatgagaatgaatacgaatttaggccaacaaaattgaaagatgaatgttttgaatatcttccaattataattaaggctgaaagtcgggaccatttggcttttgttgatcctacgacaatgatcataagtccttattccaaaaagggttcgtgtgaagaattccgaagaattgtgattcaaatcaaaaatcaaattcttgagattgaccaaattgaaggcaaaatcacttcggcgactctaagtaaaataaaagcgaatgcgccaaaattgagcatcactgaatttgttccacaaattgagtcacatgcttttcatcaattggtgcttcttaatctgactgacattaagagtcatgcatttgtcagcaatatggttagaacaagtcagatgacttatcaaataagagaaaaggacacccaaattacggcaactgtgtcgcaagagtgggaagaagttgagaatcaaatgattaaagctgttgttggtgactataggaaaaattggatgatcatcatttctgtgatcgttctgattttggctgctgatttcactattagatttggacttagcctagctgagatttatgctggaaatggtcgcctaggcaatatgttatttggcccagccattcaaaaagcgggaaaaagggtcatagaaatgcaaagcattcgtcgtttaaattctgaaagggatgaattatatgaagagccaaataatgcagcttcatggccgccacgtattaggagaacgggtaatttgttatctcagtccttgaaaaggctaaataagcacaatcccagtagaagggcaactgcaaaaccagaaaatatttttgaatgttcggcaattatgggtcaaattggggcattaatgcagcgtccaacgactgtgaccacacaggtcgcactcaatggaattcgaatgaagtgtctaactgacactgggtcaagcacttcggtggctccaaaagcactagctgaatggttaggcacaaaaacctacaaagcggaagcacgtctcatgagtgcctcgggtcacgcggttcacgttaaagaagcaactagagtaaatctgagaattgggaatgaatcggttaatatagtcattcatcttttcgaaaatgatctatcatggacaatgaaggactatgactttattttgggttgtgatgcattggcactcctgccacccatcacaattgacatcaaaaatgcaagcatgtacattaatgatgtatgcatgcctattggtaagtcagccaacaataccttgtacggactaaaagtttgtgcttcacaaacagttgagcttagtccgaatgaacaacgagtgcttaaagctgaagttagagcaccgcgtacgcttcggcatgatataatttttgagaatttggatcagagattaggtgatcaaggaattggtctaattccttctatttctaagcttaattcgggtcaaatccaaacggttttaaccaatccaacagcaacggtaaaacgaattttcaaaggaacatgcctaggcagagcaaatgagatattagcaactgaacatgattcaatttataaggaagctaatcatgatgaaacttatcaaaaattaaattccctcgggaagtctgaagtggaaattgatccaaaattcaaaataaactttgaaaaatcgtctgtaaaaggagcaaatttagacacgcttaaagcattatgtgaagaatttggggatattttcagtaaaagtcaatatgacttaggaaattgtgtggctggtgaacatgactgtcggaactctgggattccgactgccgatcaattgatcagcagaattgaagaaaggaagtggcgacccttccccctccctttcacatgccccgcgcaccccgttccactcctctgcccccatttccctccaaattgttattgtttttctgcgttccttccatgccccgcgcacaattaatgaccaatttgtcaaaaccgcaacttttctgccgccgtccccaacttggcgaatcgactccaaagaacgatgaacccccaaattcctgttttccgtcaattttgtcccctcgctcattttgtggccccgttttttatcatttccccaatttttggcccgtccccgttctgctcaatttcaccattttttgttcaattttgctcgtatttaatgcgacaaatccccaccaattcccacaatcagaagcaccagcaaaggcaagcaatgcctcttccgtccctctctcagtccccctcatttcattgtccttttcccccggcccaattgtccgttccatttctgtcattcacccggtccccctcattcaatgatcagtgattggcccttcacttctatcccatttcgctgtgatttgccccaattgtgataatttccagacccccggttttggtctttgttctgtggccccggtgcccttcaattctttcccatcccggtccccaaatcatttgtgattaatcccccggtgatggcttttttcctgtgatcaatttgtgataattttgttcaccatttcaaatatttggtttaattacccaagtttgaggctttttcccggaataaattttgcttaatcaattctcggcatttgatttggccggtcctcgtccctgcctgcccctgacccccgcaccgtggaattcatttggcccgaccccagagcaagtcgggacaaattaacaataatggtaagattaactgtgaaggacggattgactcgacgaatcccggtgacacaggggaagggaaaagcaaattagagagcctagacaaggaccctctgaggcttgtctagtgttcatagtttcgtgtagttattgtcctccgaggcataacttcacgagggacatagcagacttagtacttaccctccgaggaagtgcttcgtcttagcaaagggtagaggtgtgaaagtgttagtgcacgtagtacttgcccttcgaggaagtacttcgtacaaaaagggtgttcaagcgcgcacaaggccactgacaaataaggaaaaaggcaaactaacagaactccgaggctttagtttagccataaggcaaaagacaaacaccttgtcctccgaggcaggtgtttagtcacagaaggtccaggaccaagaccagtctgatcccggaaaaatctaaaagacaacaagtgcaccacaacacacacacacgcacaa

SEQ ID NO: 1857 - DNA, 3887 bp, Heterodera glycines
ttctgcaacatcaatcattgggcatgaggaatgccaaaacgtcgacacactcaaccaacggatcagcatcgtcagagaaaagaagctgtgcttcaaatgcatgaagccaaaccaccgcgcatcaaattgcgctcgaacatctaagtgatatcactgcaaacgtcggcatcccacggcactctgccgagatcagtacaaagccgagaatggcatcaacacgcctagcacctcttgcagtgaagagaagccaaatgccaacgatggcaagcgatcaacagtgatcgaacaacaacaaatgtgtaatgccatccaaagcaaggaaaccagagcgttgctaatgacgacaaaagcaacgatcttcaatccgtcacggccatccctcagcatgatgggaaccatcttcattgacccgggaagccaccgatcattcatctcgagcagtgcagctgaacaattggatctgaacgtcctcagcacggaagaatgctacttgtccagcttcggtgaacgagaaccgaagcgatacataagcgaccgcgtcgcaatcggcattttatgccccgaccaggacaggttcattttcaacctgaacgctttgaagttcctgctgaatgatttgccggtactacaactaaacgcattggataatgacgaacttcaacaaaagaagctttccctgccgaatgagtcacggcaaccggacattctcctcggaatggacgtttggcaccagctgaatgttcaaccaattgaacaactgccaagcggatttacgatttgccaatcgaaaatcggcaatatcatcagtggaacagggcgaatcgagctcaagcaaccgtccaacatctctttcgtcctaatggtcaacaacgatgaatcgccacaaagcagtaaagcggctcagaggcagaaaaacattcaacaaaaagaaaaggacgaactgagacggcatcaacgcaacaaactcttgtccagcattgcaacattgcgatcaagacggaagagagaatcggctcccatcagctcaaaatcaatcgtgattgatctttcatcagacagcgacgcatccggcattgagatcatacaaaatccagtcagggatagacaagccaaatcaccaaatgagcattcaacggcaccaattcctatggcagtgcaacggctaacaccaacaaggaagagttcatcagttgccaagcgaccagcattttcttccagcaaacaaccaaaaggaaaagcagcgaatcccgcacaaacaagccaaacaaataaactcaacagaaaaatgaaagccttgtcgccaaccgcaagtggatcaggcgccaaccatcattgcgtcgctacattggccagaagctcggactcaacaacagtaattgataagggcagtcaacagaattgcccaaacatgagctcggcaacaatcagtaagacaccatgccaacagcactcgtccgagaagacgttaaactaagctaatcaccaacaattgtccgcaatgacgttaaactagcctaagccatcaacaactgtccgaaacgctaatcacccggctgccacgagtccggaatgacgttaaactagcaaagcatcggccaacccacacaacaatcgtccgcaataacattaaactaaagaaccaaccaaacaacaaatgtccgcaaagacataaactagaaaagcaaacaaaacatgtccgcaatgacgttaaactagagaaacaaaccacgcaaagtccgcaatgacgttaaactagcaaagcatcaattgtccgcaatgacgttaaactagcaaagcaccggccaccaaacaaccattgtccgaaaagacgctaaactagcaatccatccgacggtcagggccgaaatgacgtcaaacaagcaacgacaattggtccataaggacgttaaactacgtcaccaattcaagcaaaagcactcgagcatgcagctgacagcacgtttccggaagcaaattcacatgtcctcaacgattgaggaggttcagcagcgaatgaaccacaacagaccgcaaccgcggaggtcacaacagaggggactaaggccaactcaagcgcctaaaatatgccaatccgggatggcacagtacaagcagggtcgagggatccgccttcacactgcgtcttctgcaatggcactcactggaccacgacgacgactcagcgaacaacccttgcaacaagagcaaggacacgaatccagtacgtcaccagggcgagaacgcagaccacgaaagagccaactacacgccccagatcgcgtaagcacgatttggaaactcaagagcacggaaaattcacctttttgccgtcccccgccatcactcactgctcaatggctcaacctggcaattgagctcttcgcaaaaaatcatcaagcccgagcagatcacctttgcatggcattgctctgtaaaacgcaccacgaagcgttattacactaatcttttggccgataagttcgtcaccatcgagaaggaatttccaccggtcaacaagcggatctgcaaacaaatggccattcaccaggaatgcccattcgccaagtctgaaatgacgaatcacgaagcacaattgtggtcaacgaatgacgaattggaagtcaacttccctggaccaatcaccggacttttcaaaggcgaacaaatcagcacggcgacaaactgctttgctcaaccagcaacacttttcaactgtcaatatgcaaccgaattctgccaactgcccgacaactcaactctgatttggaaatcaacctgcaatggcaacgaatgccaaacatgcgactacgagaaggcggaagccatcaacggaaaattcactgcggcctacggagaatcaatggccacttggatctccgaagatcacaaaaaggcattaactttcgccaaaaatgcgccagaactcatcgcctgcgatggcacacgcatcgtcatgtccgaacagaacttcggaattgccaggagcaatacgacgacattgtcagcaccacgacaagatggaaataggcatccgaccagaacagctcgcatcacagctctcggcatcccaagtggcaacaagcgttgcgttgaatcagctctacacgcgggagtgtcagcgaaacacgagagcagccaacccaactctccaagccagacgcttactacgacagccaaacgtccaggcgcgctggatcggagaaatgacaatggaagtgtttccatgcgtcaacgtttcgctccaggacatctcctaccgaccaatgaacgattgccgtgtctacatcccagtgacagtgcatttccccgaccgagcgatagcagcatttctggatcccgaattgcgcatcatttctttgacggcgcaattggcaagctgcaacaatcaccgtttccatcatcttcaactgcgaagcaatccgaacatttggctactgatcgactcacgaaccgggattgcgcgtcaaatgccaaaggactacacgcatgagctgtacgaaacgacactcaaccagtccaacagcaacatcgagcttcaccctctgatcttccacgcttggcagctcgacaacgaatcagatgcgacacgctttccacacatcaacgagttcgtcaacttggagcagttcaaagagaagctggaacaacacatcacggcgagaacagaggcattaggtgccctcaagggtggcatcgaaggacttaccatgcgctggctgaaaagcatggtcgacgaagtcatcaaatggtggatcagaatcgcctgtgtctactcaaccttcctgttcctacgcgacatcattctcccatgcgcgctcgcctacttgttcaaccctgttcgagtcacatttctcagcctaatgggagttcgacgtcagccgcttcaa

SEQ ID NO: 1858 - DNA, 5340 bp, Heterodera glycines
  misc_feature (5272)..(5272): n is a, c, g, or t
tggtactgaaaattagcatacaacagagtacctaagtcccggttttgaccagttttgaccgggacctggactagtctcggttttttccccgttttcccagccaaaaagtcccggtttttcaatccgaaaattcccggtcccggttttggttaaaattcccggtcccgctcaactccagttcaaacacataattttttttttcttatttgccggtgcttttccctgggttctgttgtgccggcattcaaattctatatgtattgatggctctattgcagttcacaaggccataaaaattgaaacgagccgttttggcatatcttttgtctttgttagttcgacgaatggcactaacaaaatactcgcgcactaaatcatgtgccattgagagcacaaatcatttttgaaagggaaacaatttcttggcatttcaatttttaccttttatttttaaatttttcctaaacacttttcaaaaccaaacaatctttggcctctgttctcacggaaagtgtaatatcccccttctgccccttccctcgtcacgtttatcctttttatctctcccccttatgcactcatccgtcgtaacctctgatcacgtgaattcataagtggaggacattgaggcgaacttctggcgccggatatgcccacggcaatatttgtgttcacagcaaaaaggggatgaaaagcgtagtccccccctgaggggggggggggggggggcgctttgatcactttcccagggcaaagcagcggctgtaatcgctcaaatcactcagttcgatctctgtgcccatctccgcccatcactttacatgcataccatttcatattaataattatgcagcaaaacaacaaatacatatggacacaaattaaagagataaatgtggatttattttccattgttttatttaattaataattaaatgcattttttatattttatattattatgctaatttagcttagttaacggggcttttcctttcttttttgctgctgtcggtcatttcgcccaccccgcttttgcataatccaaacagcaaatagcaaatcgacaccaacgcatcagcataaaaaaatgtaaataaaaatgaaaataaaaataaaaagaaataaattaattatttttaattgcagcgaaattaatgaccgttctcctcttcctcatttgtctgctgatcgcaatgtttgccatgcaatccatggccaaaagtgtgccaaaggcgagggacagcgaaattatcgattatgtaagaaataaatgtttttttaaattatacaacattaatataggaggaatggaactgtggtgccaccgattttgagaaaccgttgtcccatcagttggccaaggaggactgcccgaaaaggatgtgtaagtgggggaggggggaagtgccaatggatgatgggatgggaatggcacacgaccaacaatggcacttttagttgaggcggacttgtgctgtcgagtgcacgacatgtgctacatggaggagcagaagagcagggagcaatgcgacgaggcattctgttattgcttgcagaggacggtggcacagaacgccaaccaaacggtgggaggagcgccaatttgaaatttgaaattaaattcaaatgtcaatttcagacgaacggatgtgccggggtgtccaccagtttctgcgaaattgtcaaaattttcgggggcattgcctatttgtcgtcccaagaattgagaacgaagcagcaaaaagcgatggcaaagttcgaagagaaggaaaagcagcggaaaaccatggaaatgagcagcagcacaacgccaaaaccgacgacagaatcaacgaagccaagcagtacagacagagcaagcagcataacccaaacagaacaaaccatttcaagcagcacaatccaaacagcacaagcaacttcaagcagcacagcttcaaagccaacgaatgacacaacgccaatgccaaagtaagcggaaaattttaaaatataaataagtaaatttattttgaagtgcttctccaacaacttcttttcctgctgctgtccattcgactgtttctccggcggaaattggccaatttgtgacgcataaattccccttggaatgcttcgacaacagtgaaattatattaatttaattgtccttaacgagttttaatttcataatttgtgcccatttcagcgctgtccttttgcacccgtcaattgcaccgctgcgtctccgagcagcacagccgacggaagtcggcctcatccgacggcggctcagaggacgcttttttgctcagcgttcaattggccgagtgttcctcccaattctgcgcctgctcgtcggcggagagtgcccgcgctcggttggcaagcgtgccgcggccgctgctgggcggcgagcagtgcgcgcaaagcttggcacaaatttgctcacaatttgaggacgagcagggcagcaaacagtacactggtgggtttgacattccctggcgggggtcgggaggatttgccacaacaatttgccatttctatgccgtttaggccccacaaatgtgaactattggtccgtgtccgtcaattacagcgccttttccgctaatttgggcctcgtcgtcacctccgttttgctcatttcggttttaatttcaaatttttgcttttccatttcaatttttgccaccattccccagttgtttctgctactgctcgtccgactctgctcaaaagcctgttttggctcaatccaaaagcggcttcatcagcagcatcagatgacacaccgaaactacgcttgtcggccgagcatccgtcgtgaaactttgacggcactgcgcagtgtcagcggcggcggagcacagcacaactgcgcaccgcattatgtacgtcttctgagtctcttaatttttcttccgttattcgggctggatctccgccatgaaaaatggacaaattttcggtctccaatttcctctattgctggtaattgcccaccgtaccggcccatttagttgcctctcggcaaagaatccaccgtttcgtgccccgcttcgaccgccgcttcaacgccctcttcggctggggacgaactgtgctcagtgctggaaggaaagcatttgctgtgcccgcacaaacaatcgccaaaaagccaccagcagaagaaactggacagcggcgatggcaccaccacaatcagcaacaaacatcacaagaaggccaactcggagtcgaacaagcagacgccgttggtgctcaactcgtcccaggtacatcacggacggcacgtggccaacttttgaaggacccctaattaatggcacttagtctgtctaaaaagttgtgcttgattagcatcagtgggtcactcccccgcccccgaccaaacaagctaggttatgtcaacatccaaaatgattaccgtaaatgatattctactgtaggcacggaatattatctctatttacagttataattgagcaaattcaaaacttcgagaactttacctaatttaaaatgcactttaatgttaaatgatttgccaacttttgccaggtccatctgatcgccggctccggcaattcgtccagcactttgtccgatgtgtcctcctcctcctccaattcgtagaagaaatatgaaacagcgaaaccaaaagcggcaaaacttacgctacaaaagcaaacaattaagcccagaattaattaattattcattcaccaatttataaatgttctaggggaaaagagaaattaatttttagaattttttcaaatttattttttctcttcccttaattaatttaatttaattcttattcattttcctctttttttgcgattagtacaatttttttattcacaaattgtttattttaattaccattttgtagaaaataaaatttgtagattaaacggagataaaaaatttattttttataatctttaaattaaaatgaattgaaatgcgccaaaatcagcagaaaaacaaagaatttatcatcgaaacgttcattaaattatggccattttttaatttgaacgtgcattatttaaagcataaattaatcgaaaattgaataactaaacccttttaatacgaattgaattgactgaatgcaacatttttgtagagtacggtgaatgtatgagattattgtaaaattttgatatggggaggaatcaattaaattatggtaattacaattggattacaacaataaatgagaaatgattgagcacgagttggactaattatatgttttgaaaatgctaaaattttgctataaagtggagaaacaatcaaagaaaaatatatgtaaatcctaaaatggatgtgaatatgtacccaaatttggaaatttattaaaattaaagtgacaaattatgccattccccacaaattttcaattagatcgtaaaaatatgcttttaagcactctctgtttaagctgttacgaggtagtactgctgctgctgctgctcatttcggacgacaaagtgttggacgaattgccagacgaatgcagacgaatctgtgagcgaaattgcgatcattaaacaacactttgaaggcaaatgaaggcaatttgcaactgattagctgtagcaaaattggttggccaaaataaaatgttttgtgcatacggtatgtttgtttatacaaggggaatcagttggttacggtatctttttcagtgggctaaaaacgcaaagtttcgagtccggaatcgtagtccttcatagagtaccgtagtttgtaaaaaatatttctaactcctactgtagcatttgttgcttttttatgttttttttattccaatggacctgcgatgagttcagcaccagtggcggagtgctaatcccagtccgatcatttgtcagattgctcaaccgattgaaatgccaattttttcgacccgcgggtcgattaattggaaacataaaatgctgttgtaattgttggcgttgtgcatctccgatcggagatgaagcagtggactcttttccgatgggaaacttaaaaaaggggaggggacaaaaatgccaaaaaaataagtatgggcctcacataatttgtgcttccgttagcatcgtaatgtctgcaagtggaaagccggtaaatccgctttcgaatggtcgaaatggcaatttgtggacaaaggcggacgagcagtagcagaaacaactgaagaaataaatggtggcaaaaattgaaatggaaaagcaaaaatttgaaattaaaaccgtaaatgagcaaaacgaaggtgacgacgagncccaaattagcggaaaaggcccccagtaagacggacacggaccaatagttcacatttgtggggcctaa

SEQ ID NO: 1859 - DNA, 1660 bp, Heterodera glycines
aaattttaaggcaataaaaatattttaagcaatttgaacagattaattttggtcgaaaatgttgcgatttaatttttgactccacgtgttcagctgttgatctgcccattttttgatcatttttcttgcgttgtgcctaattttggctttttgacacatgatttttaaaaaaaaattcccctgctggaaatttggtgaaaattttcttcttgagaatggaattcggcgatggtggcgcaaattcacatttgttcattcattgttagtgtaaagaatgcgttccatccattgttgctgagatttgattgacaacagcagaaaaatgcatttgacagtgcaaaacaaaacacagcccaaggccattaataattaatagcccaagaaaacttgttaaatgttgcgcacagaagtggtggaatttaaaatgagaaaaaaggctgcgttctttacaaaatttggaaaaatggagtaaaaaacgcccaatttaaatgaataaaagagattaaatgaatattaatgacacattaattaattaattcttaattatttatacaataaaaacgcattgaccaatctgctgctattgtctgcttaccagaagcagcctgctaaaaacacgaattgtcaataagcgaaactcagccgggaaaaaaagagtccgagacttttgtcgggcccgagactctcgagcgcaaccaatgaatttagagagacagagaggagagagtggggcccgtccatgggcgcggcgccttttaaattgctcttgcattccttctttgctgatcatcggatcagcccatcgcccgcccgttctctgatcactttttgtgttgctgttgatcagccaatttgctccatttatgggctgttctggccttgacttaaacacacaacactaattagtggtgatgatgatgatgtgatgggcgtgactgacaataaaatgatgacgccgaaggggggggggggggagggggggggcacggctgaaattcttggggaggggaccgaaccgaaaataaaatgcgcaaattgaaaattaaattatttttattacagccaaattgataaaaaaaacaaacaacactttgtcacctcaagtttaaagcaaattctgtgtttttacaacagcggatattcaataaacagatgttaaaattgcattttcaataaaaaagtaataattactaatattacattttgtttaattgctgtttaacaattgaatttcaaaacaagagattgttgttcttcactattatagaggaagatgctaattacttcattaacccttttggtaattatatttttcaaaagaagtgaataaaatgaacagatcattttaaaaattataaaaattcctttctaaattattagttattaaaagtccattcaacagattcttcccaaataataatcaaatttttttggtgatttttgataggttaaaattatagcaattttaaagtccgacggagccaatagaagtcgccgggagaaattttgcaaattatgataaggcttttttaaaattcgccccaattacttcagtggatttttgggtcaaattgaaattttcgtggaatttttgagccttgcttgatttgttcacagattttacccataaaaggtcattttgtaggtctggcttaaaatt

SEQ ID NO: 1860 - DNA, 1165 bp, Heterodera glycines
tattttgtaatcattaagcacataattaccgaaagcacctcttgttcggattttgccgtcctccttttttcagcccacttgataagtctggccaatgattttccctcatatcccccaaccaatgagtgttttctgttccatcatcttttggctaattctgcccatggacggcacccgatcaaatgggcggcaattgggccaactttcccaattattttggggtgccaaagtcggcaaacactgactgttttctgcgcatccccggaggggcaaaaatgctactcctttcccgggtcaagtgccatttggcagggcttggggggtttggccacttctcgagtctcgacaaaaataaataaacaataaacaacccacaaccaattaacagtgatcaacaagcggcgcaatgcttgtaccttgtacacaatcagcagaagaagcatcaatgaaaatgaaaaaaaactggatgcgcttggctgccgatttttgagcacccccccccccccggtgggggggggggaaacatgtcgagagtgagttgagtctcgacgccgctgcactttttggtccatccggcgatatataaacagcgcaaaaccaagcggaataaacacactgttcagcagcaacaattaaactgacatttcggagtcacttaattatttcaataattttttatatataatttattattaattaattaattattaaattatttttgcaagcaaaagtcaagtgaaaatgctgtccaccaaattgttcgtcgcttcatgccttctcaccgttttcctcttcaattgtctgctggtgggacaaactcaggcatattggtggccatactacggtatgtctttaatggcgcctaattacgataatacagtatattcgatccgtgttttaaattatgcaggaagtagttatggcagtatgggaggctatggcggcatgggtggttacgggggcatgggcggctatggcggtatgggctacggcggtatgggttacggtagcggacttggatacggcggcatgggttacggtggcatgggcgtgggcaagagggaggccgcgtttgtggcatcgccaccggctccgccgccaaagggacaatgaaaagaggcacgtacatttatggaactgctgattgatgatttaccttttttaa

SEQ ID NO: 1861 - DNA, 2566 bp, Heterodera glycines
tgctaagaattggagattaaacataagcttaaaccttaatctccccggggggcttaagttacgcctaagcctaagccggggcaaaagttaagccaaaaccttagccgaacggctgtgccggggtgtccaccagtttctgcgaaatcgtcaaaatttcggcggcataaagacgaatgtatttagatatttactatagaacgagttagtatattattcgcgtagattaaaaaatcctttaatttaatagcaccataaagtcccgcgccatattgactccgagtcgtcatggttttgttttgctatttttcaaaaatttggagaagacagaggacgccagcggtgccgacaaaaaatgccaattctttatactttatattatataaaacactcattttgcagaggctacgaaatacgaggtagaaaaataattcattaacttgccaagttagcacaaattaagtgtttttaaaatgtcaaaacatgtgatttaaaatattaacataaagataattgttaaaaacacactttttaaaattattgtaaataatttcgtatcaatacagaaaaacaataagctttatatatcaatgttcggatctgatacctaaaaaaggagcaaaaaatcattggcactgaatttcaaacggcacaaattgtgcacggcaaaaggcaacccgaaagaatgagttttgtacgcttatcgatgtaattgtccttcaaatgtgtagatttgctgtcaatttatcacgaaaacagtttttgatctgttgttaaaagaagaaaattaattaatttaaaatatattaaaaaatatataaaaatattcatttttttaaaattttaatgttattgtttatagaatggggatttatattcatggaaaaactccaaatattaaaataaatatttagaacatattgaaaagggccaaatatcaatgaaaatattaacaaaaaagaaaaaaaatagtgcaaaaaatttaccgaccgcttataagcaaattcaaaaattaaaatgtgggcatgaaaaaataaaatttaatggataaatttttggaatattttcccattttaaaaaaatatataaatccacacgataatttttaatgaacaatacctcgttaagcactgcccagcctaaaattttatttttatttttttacttttcctacacaagctttaatagaagactcacatggtaaatagctggcatccgcctgtactcgtggtgcgtcagggctcagattacaaaatgccaaaccttcaaaatttagcgcttttcaatttatttttattttatttttgtacatttatttccagcggaagttcgctgcacctttttccccttgcagcaatccttcaaaaaagaacattaaaaaatagtaccccaagataagggggcttgagacaacgcttttacccgacaatcggaatttccccgggacgcgaaaatcccgcaaaatttcatgaaatttggcacactttcaattccggtcgctgtttaacgacaaaaaaacactagacggactttccctaattccgaatttcacttatcccccgaaaatgccgtgccctctccccgtccaatccgccgcccaatgcgttaccgtatggtccgagtcttgtgctgcacatgtgaaaagctccaaccctgagaaaaaaacttttaacttttacagattggctttttcattaaaatgccaaaatttgagtgccaaatttaaattttaaatgattgcccacttcaccgtaccgttctcggacggacatttgtccgtgttcagaaacaaagctgtaagtatttttttgctcaacacatcaaaattctgcaacagtaaaacaaccaattaattgctaattgccaaaaattaatgtgtttacgcatcgactctcgcacgattttggcactctcttggcacggcaacagctcaaaaagctttcgttcggattcttaacggagacgaacatttatgaattgataaatggacacaattaattatttattctgttggttgggccgctacgttttgatgtttagtcattttcacattgttttattttatttcgggtaaaaatgtcctgaattatgcacaagaataattaaaacctgaggagtacaaaaataaattaaggatatacaatgtaaacgggcattaatccaaaaatatattttttggtctaagtaaaaagaatttaagcgattaaaagtgctctcatatccttccttttgaaatggcatcattttgccatacctttggcgttggctttgctgccgcattcgcagctgttgccgccgtaagtcgcgcgagtgttgaagttacagttgttgttattgtgggtcgtactgtagtttccgttgttgttacggtcactgttattggtggtggtgttgtttcgcttatactgctactaatagtcgaagaaatcgtcgagaatttggtgaattcgtcaaattgaaagttttcgctctattaattacaaaaataaaatatatttttttaaatttatttcttctcacatcgacgtcatgccgttgatgtgccgttactttttgccgcaaaagatca

SEQ ID NO: 1862 - DNA, 1129 bp, Heterodera glycines
aattgccgattcgattggttgttttgcaggtactgcttgcgaatggggaccaatttggggcggcgcaaacgccggagggccaactgctggtctttttgtggcgacgagcttagtctgagcaaatgagtttttttttgtgtgcaaaatttatgggaaaagaatagccaaatttttcaaaaatttgttggaatgaaaaaaatgcaataaattttgctaattatttctacaggaaaacttaatatttttagcaaagatttttgaataaaatttgtttgagattttttcgtgcttcaggggttacctgctgatgacaaaaacgtgtttgagccaatttttaagaaattttattcccttccctgggacctcctgtctaaaaataatgcttttcgagacagaaatttctcgagacccaacactgctcctaaaacagcgctctatttttctcgagtttacgctctatgggctagactctcgaacgccccaaaatccatccatgtccaactttgccaatggccgatcccgctgttgttgttgttgttgccggtgtcgtcgacgttgttgttgttggccccgtcaacagcaacaacttccttaactgctgctggtgttggattccgtttccatttgtgcccaatttgttgttgttgccattgttgttcagcaccaatgcaggatttgttgctgctgttgcgcctcctccccctgccggaaggcgtacagccgcagtagtgatgcgtcgtcgtggcccagtgccgccgatgccaacattattattattattattgttgcggttgttgcctggcatttgttggtggcgctgtgttgcttgaactgctccaccaccaccattagcagttgttgttggtcgagagttgctaaccgccaccctgtgctgaatgtatttcagaataaatcgtattttgtggtgataggccgccaaaaaacctccccatggattcaatcattcttaatttagacaggaacaaacatttttaccgtatttatgcaattataattccccctgaattagagccctccaccttaaataagggccttctttcgaggaggctttgaaatagagcccctggggggctctatttcaataaaaacggtattccgaactcatggg

SEQ ID NO: 1863 - DNA, 2139 bp, Heterodera glycines
  misc_feature (51)..(51): n is a, c, g, or t
  misc_feature (54)..(55): n is a, c, g, or t
  misc_feature (60)..(61): n is a, c, g, or t
  misc_feature (65)..(69): n is a, c, g, or t
  misc_feature (71)..(71): n is a, c, g, or t
  misc_feature (92)..(92): n is a, c, g, or t
  misc_feature (2078)..(2078): n is a, c, g, or t
tataaattaatttataatttacacttaattaacgaaaaccctctaaggagnaannaaatnntaannnnngnagagaaaccttaaagggaggnaatgggatgggctttctgatggaaccatgtgtgaacacggagctggtcatcaacagcaacaaatttcatggcatccaaaatgtagctttgctggtccgaaatgcacggtacaaacattttttatttaatgcgtcatactgtaatttttctaattttttttccaatttgaatacggtagataaccctaggcatcgatatttctcaaaatttctttgtttcatatagggcctctattgttgaaatgactaagaaatattgattaaaattatcaaaaagtatggtatatgggacgaaggttacagtatcacaatttttttacctttcaaaattattaattttgtctaattaatttattaacaagcagatggcctcatttgtccgcgctgccggctcgtgtacaaatagcaaaaaatgacatcaaaatgaacactgcgcaattcattgtttccattggtcttaatgaggatgcgccggaacaatcattagtgttcaatcaacaaaatgaagcaattaaattttaaccttgttatttaaattattatataaaaaagttaaaattattgaaaatttaaatctttattttttccctttttcactaattgcttaaatgaattatttattaaaaattattatttttttaaaattttttctaaataatctatgtatgtttaatgaattatttttattattctaaatttcctttcattaattaattttatttaaaatttaaatcttattaattttctttcactattttttcctttatctaaatgaattatttaatttaaaaaaagtaaattattaagaatgtttaatttttcttttttttcggtgcgcggcaacacggtgctgaacccgttcccattcttgaagccacgttcaacaccatatgcagcgttggtggtctcgtccagcaatgtgctaatccggcacaactgttttcgcaatcaaaatgccgattttgaaattggtgagaaaaaaaagtcttatatcaatttttattttttttttattttattattgctcaacctgatcggggtcaaaaaaaatggatttcctgcatccaggtcccccccccccattcatggtactaaaaaaggaaaatttttggaaaaaattatcattgatttgctcaatgtgatcaaattttacatttcattgttaatatcctttttttaattgtctaaaaaatttcaaaaattactttaaattacaaaccagagcagatagattttcgaacattaaattttattggatatttttctaatttttgctgctaatatatgaaactatttaggtgtattgaatgatgcctaagaattaaaaatttcgttgattttgagtaaagtattttctattagactttttctacaaaagtggatattttttgtacccccccccccctccggaaaaattgctaaaataagattttttttaattcataagtttcaaatttctctaatataaaatacaatttcgtaatatttaattaggaacagaactgatggaacacgcgaaacgaattgatgcgcgagaaaacaattggggcgatccgcaggcccacaattttatgcaccgaatttttgaccaattcaaccgttactcattggccaccattgaggcaacaaatttccaattaaaattaaataatttacattataattaattaggatatatttttttaacttattaaattcttattataaacaacaactatgaatacatcattaatctatgaaaattgaattaaatttgtttaatttaaatggaaaaataatttattatgaaaatcaaaatgaagtattgttttttaattgaacttatataattatttttatgttaaaaattagaaaatatatttaaattaaattttattaattttaaaaaaattgtttttacatttcttaaacaaattatattattatgaaaaaaatagaaatttatcttattttcatttattcaaaacaaatgtttaattttcttatncgaaattaatatacattttaaatttatttaaattaaaaaatattttataaatagagaaaaa

SEQ ID NO: 1864 - DNA, 6520 bp, Heterodera glycines
  misc_feature (22)..(23): n is a, c, g, or t
  misc_feature (6467)..(6467): n is a, c, g, or t
  misc_feature (6471)..(6471): n is a, c, g, or t
  misc_feature (6506)..(6506): n is a, c, g, or t
ttattcaaaacaaatgtttaanntttttttatcggaaattaaatatacattttaaatttatttaatttaaaaaattattttataaatagaggaaaaatattatttttattaagattaatccttatgctgctgtttgtaatcaacgtgctccagcgcttacttttctgcaacaattctttcgacaatttcggcatcaaaattccccatttttggtcggtggcactgtatttgaaaacaatgacttgccggctggaaaatatatcgtacaggtccttccttgtttgatgtactgtattattaaaagtaattatttttatcccttaaatacatgtcataattattgaaaaatactatcatttcggcatttcatagatttattattttttataactatagtatattcatacagtacagtaatgcctgtagccattcccccgaaatgaaatttaagaaaaaaaaatgggcattttttgaaattgcaaaaaatttttcccggcggcgcctaacggcaccgccagccagacccatcatgttttttgaaatttgaccccaaaaattgcaaaaattggtcatttttggcgaaaagcggctataccttttatatggcgtgttgaaattgtgaaaatttgcaaaaaaaaaaattcaggacgatttgcacattacacctggcgcaaagctgaccctagcgccgggcacaaccttggaattcatgagtggcatcggaatgcttgtccaggtagaattttttttttgaaattttcatttaaaattttaaaaattttccagggtgaattgttgcgcaatgatatttcaagtgccggtccattcttgccaattgtgttcacaggcaaagcattgggccgaaatctgccgaagcttgaacatgttcgacttgtggacgaatttggcgacgaaaatgtgttggcagggcgtctagaagtgcggcaaataatttccattttgaatttgtgccaatttaatggaatttctatttttttttaattgaaagcgaaatgaaattttggacacttttttaataaaagaatcaactaagccaatttttaagcataaaaaaatttctgaaaaaatatgaaaaattttgaaattgttgttttcgatttctttttataaattaattaacatgtaaatttttgtttttatataaaaattattttaaaattttattgttttgttagagaaaataaaattttggcactttttttacgattaagcgaaattttaattaaaaaaaattcttaaaaacatatgataaacttataaatttttcttttccattcttttataaatttgttggcgttgtaaatttttttttctatttttataaattattattttgaaatttttatcgttttgttcaaaaaatccctaagtaaattttgattttgattttttaaattttggacggattggataattaattatatttaattttaaaaaattgctaacaatttccacaaggttcgtcttgagcccgatggacagtggggtacggtatgtaaccgttcctggacggcacaccatgcgcagctcgtgtgcaatcagcttggccttaccatggacccgcaacactttgaaaattggcgcattttcccgtcgcatggccaattcccaattgtgatggacaacattcgttgtgaagagcgtgaatgggacatcaccaagtgtgtaaagaataataatgatgggataattaaaataataataaaatatattttaaaaatttagtaattatttaaaaaggtttaattaggtctaattaggtcttttaagatttttcaaattttggctttcgtttttatttgcgcaaaaatagtctatttggaaaatttcttttatttcttcgatttttatgaaaatttattgcccgatcagtgtgttgatgctcccctacatttttttaaatacccatccatcccggacaaattttttgtacgggaatttccaccctacgaaccccgacttttctctacccctagggttggggataggcgtcgcccaggaaataaaaatttttgtgaaaattgtcaacaattttattgtttaaagcgaattaaaaaaaaacaagtaattttattggcaggcatttcaaaatattttttgaaaaactaaaaaattcagaatttttcttaagaattttcataataattatgcatttatgaaatggaaaaaatcaaatttaagttttgtgaatacagcaaaaacttatccaaaaataaaaaaaaattaattaataaaaattttcaaaaaaataattggaattttttttatttttcattaaaagaatttgatggagagttcaggtgccgtcatgacggagcgttgcacaatgtgcgttcgtcatgccgcccaacagaagtggtcgggttacggtgtgccccaccgtattgggccggtgtacggtactcattgttggccaacccacccacaatgaccggtcaaccgacaatgagcaactgggtactggaaaaggctggcctgtttgacttcaggacatcaacattcagtccagcattgcaggtgttcattttttttaattacaaaaccaaaaatggcataatgccaaaaataaaatttaaaaaattgagagtacttacttttttgtatacccagggatggatgggaaccaggggtgtgcgaaaactaaaaaaataatttccgaaaagaaaacgaaacgaaaacatttatttttaacacgaaacacattttcataaccgaaaaatgaacaatttttgtaattttgagccaatatttttgaaaaaaataaggacaattggaattcttgatcatttttgacatattttcactgaaaattgcaattttaagttcaaaattttgaaattttagaagagttttgggggccgggccggcggtgccgacatgcgccgccagggagaagtaattttggaatttcaatgtcaaaattccaaaaaagccattcttaagggtgtaaaattgtttcgtcttttttcctccaaattccgtctgacgaaatcgaaaacgaaacgaaaattttaaaaataataatgaatttatatttaggcgtttcaaaagtaaaataccccttttgaaaaaaatttttcactatttttgtcctgtttttttttttaccaaattttttgacaacttttttggcatttttagcataattaagtcgaagccatttaatgactattaaaatgacaaaattttaattcaaatgaatacaataataatattatgggatgaaacatttttatcatatgtaaatatcaaacataaaataatttatgggttgaaaatttgtacaaaataatataaaatacaaacaacattaaattctaaatagacttttttttttactaaattaatttttttattattattattttcttaggcacaaaatacattcatcattatgagaaatttatgtaagcaaatggatttgcgttaaattagagaaaataaaagcatataattaagtggatttctgactattttcattttatgaaaaatgaaaattaaaatatttttattcattttatttcttaaaaatttaaataaaatttatgctggtggaataaaggaagaaaaaagctttgacgaaatatttggccaaagatgggaagaaaacgaggaggaaaatttagagaatgaaactgatcaaaatggaagaattgaacaaatggatggccaaaatgaggcaaaaaatgatcaaatttttgatgaacattttgaagtgaaagaaaaggatagtgaagaaatgtccacaaatggtgaagaattggaacaaatgtcaagaaatattgaagaaatttgtgatcaaaatcgaattttcaatgaaaaacagaagagagaaattgttgaaaaatttcataaaattaaagagaaaattatgcaaatggaaaagaaatattcaagaaaagaatggaaaaaaatagaaagaaaaattgcaaaaaaattgggtgaaaatcggaagaaaatttacaaatggaaaagagaatttggaatgatgaagaacaaaaattattcagttgaagaaaaaagaataatgttaaagcaatttgatcaaatatatggcaaattaaaaacgaaattaaatggaaaattggaaggaaaaaggacaaaatgccaaaaaataatagcaaaacatttgggcacaaatatcaaaacaattttttattggaagaaacaattaaaagatggaaaattgattaaaaatcaaaataaagatgagcaaaaaagagaaattgttgaaaaatattttaaaataaaaattaaatttatgcaaaatggaaaacattcacgaaaagaatgggaagaatttagagcagaaattaaacaaaattttcgtgtggcttatacggcaattgaaaaatgggccgagaaattaaagataaatcaaaacatttcaaaaagtgaattttaaataatgttttaaaaaatttttgttttttttcaatttacagagcgaaacatgttatcaattgctgaaaaaatggaaaagattaaaaaatattatcaaatcaaaaaacagaatccaaatctatccgatattaaaattgctgatattttaaacattccaacaagttcattacgcaaatacaaagctgaatttggcattaaaccaaaaaacaaattgctataattaggacgatcaatattatccgaagaatatttggaaaatttcagacataaaaaatattcaattttttacaaatgtttttataaataattttttttcggtttataaaattattaatcctttttcatcgcttataaaaaatatttgataaaaatcgttgattatgctaataacatttttaattggtttagttgaaaaaccaaattaatttttcatatttatttttattttgaaaaatgagtaaatatggcaaaaaaaagtaaatttttagagaaaaattaattaattaaattcaataaaggcaatttttaaccaaatatttttatcaataaaaaataattaaattttgggaccaattttttagaaaatcttttcattcttaagggagtttttttcaattttcaagtagaatttgctgattgtgagtgaagttatgcagtaaatccgaataaattgaagaataaaaccaattataaaaagatttatattcattttaatgattttttattcagaaatctgaaaattaaaataatatttttaatattaattttcataaatgcaattggtaacatttatgctagaaagataaacgatgaaaaaaactttgatgaaatatttggccaaaaatgggacgaaaaattggaggaaaacggagagaatgaaactgatcaaaatgtaataattggacaaacggatggccaaaatgaggcaaattatggtgaaaatatttctcgatttaatcaaatttttgatggaaatttggaaatgaaggaagaaattgcaacaatttatgattcattggaacaaatgcatttttcaaatgcaattgacaaaacgaaacgagaaattatcgaaaaatttaataaaattaaagagaaaattatgcaaatggaaaagaaatattcaagaaaagaatggacaaaaattgaatgaaaaattgcaaaaaaattgggtacaaatcaaacgaaaatttacaaatgtaaatcaaaaacagatatcggatgatgaaaagcgtaaaatattaaagcaatttgatcaaatatatggcagattaaaaatgaaattcaatgaaaaattggagggaaaaagagaaaaatggaaaaagcaaaaaactgatgagcaaaaaagagaaactgttggaaaatatttaaaaacaaaaaatgaatttatgcaaaatgggaaaaagcttttcgagaacttttcaatcgtgtcgccaaatccaaaatcagtgactacagatggcaaacagatcggctgtactccaagaagcttcgagaaggcggcgttctcaccaaggaattatgtcttgaacgtgttgaggttggacgacggccggtgcagcaccagcaaccgcagctgagttattgaagtgacataaacataatgacacataattcaaaacgcatctcccgataagggtagaagaggaatattatagatatatgattgcactttaataaatttcttaaaaatttttcaaaaattagtccgctggttttcatagtgcaatctgttaaaaatcaatccaaaaattccaatttttcttgcggtggatcctaccagcactgcaagacccaaaaagctccttttttgaatagaatttcattaaagtaaatattattaataatgaggaaagaattgcgcacaaaatacatttatgaaatgaattttcattaaatcaataagtaatttataaatgtttttataaaaaatgaatattaaaaatatttttattcatattacaactacaaaatttaaaaaatatgcacaaaatacataaatcatcatatttatttgagtttggaaaagaattgttataaacganatanaagcaataattcaaatggatttctatcattcattntatgaaaaatgaaa

SEQ ID NO: 1865 - DNA, 4218 bp, Heterodera glycines
atggtgaagaaactgcgtggaacgatgatgccaaccatgaacaaacacaaagctgttgtagtagatgtagaaaaaaaaactgtggtatcatcacgctattattgttgtgtaaaaaacgatccgtttttacctcttttcgggaaaaaactggaaaaaattcacaaaaaaaatctcacattgtgcacccttttctatcatttgtggagtaaagaattttcgggaaagaaaacaatttgcgtcaaatttttttgctgaatttatgcagaaaacagcagcagcagcaaatccccatcgatatctcagagcaagatcatttaggacaacagtcaaattcgtgatcagcgagctcaaaaagcttataaactcatttttcgactttttaaatctcaaaaaaatttttggaaaaggggctacaccggtggtactcttacccagaaataatttttggaaaattttagaccaattaatgctttcataaagatgattttattgaaattagccaattaaaaaaaaacagtgacgaaatgattggtaacatttttttaaatttccattttaaagggattatttttttgagtttaaattgttttttgatagtctataaagttaaaatttttaaacttttgaatttttgactttatttataattgctacgatttaaaaagtttcgaatccagaaaaaaagtatttattttgttatattggtattttgaaataaagaatatgctctaaattctttccattcttttcgtgaatgtttcccattttgcataaattcatttttttaagatatttttcaacaattttagttttttatcattaatttttcgatgtttcacagaattcccattttttaattgtttcttccatttataaataaatacttgttaaattaatgcccaaatgttttgctaatattttttgacatttttctacttttcattccaatttttcatttaatttaatttttattttgtcatataattgatctaattgttttaatatttgaagtttttcctcttccgaatatttattattcattacaaattcactgttccattcaaaaatttttagccgcgaatttttgtgcaatttttatttcaattttagtccattctttttttgaaaatgtcatttccatttgcttaattctttccttaattttgttaaattttttccacaatttcttttcttttgatcaattgcttttaaaaatgatcagaattaagtccaattatttgttggcaattgttcaatttgatcactatttgttgaagtttctctttctatttccaaatttaatggttttattcagaaatatgaaaattaatataaaatgaatataatttataattacaaaaaaccttaaaaaataaattgatttccttggattttcatcaaagtatgattacaagaaagccctaagtagaattttgaaacatcattataaaaaaataagtagaatttgcttaaataattagcaaaaatttgagaataaaaccaactagaaaaagaatttttttattaattttattcagaaatatgaaaattaaaatattattttcaatattaattttcataaatgcaatttttaatatttatacgagaaagataaacgaagaaaaaagctttgatgaaatatttggcctgggacgaaaaatcggaggaaaatggagggaatgaaactgatcaaaatggaacaattggacaaaaggatggccaaaatgtgacaaaaaatgatcaaatttttgatgaaaatttggaaatgaaggaagaaagtgcaagaaattgtgatcaattggaaaaatgcatttttcaaatgcaattgacaaaaagaaaagagaaattgtgaaaaaatttcatagaattaaagagaaaattaagcaaatgggaaagaaatattcaaagaaagaattgcaaaaaattgaaagaaaaattgcaaaaaaattgggagtaaatcaaaggaaaatttacaaatggaaaagagaatttggaatgatgaagaaaaaaaatcattcagttgaaaaaaaaataataatgttaaagcaatttgatcaaatatatgcaaaattaaaaacgaaatttaatgaaaaattggaagaaaaaagagaaaaatgcaaaaaaataatagcaacacatttgggcataaatatcaaaactatttataaatggaagaaagaattaaaaaatgggaaatcgttgaaaaatcaaaaaactgatgatgaaaaaagagaaattattgaaaaatattttaaaataaaaaatgaatttttgcaaattgggaaacattcacgaaaggaatgggaagaatttcatgaaaaaattaaacaaatgtttggaatttattttagaacaattgaaagatgggcaaaaaaaataaaaaatcaatcaaaatgtttcaaaaggtgaatttaaagatttattaacgtattttttttaatttacagagagaaaaatgttatcaattgatgaaaaaatggaagtgattaaacaatattatcaaatcaaagaacaaaatccaaaattcaaagaatacgaaattgccgcaaaattgggaattccaatgagctcattagacaaatacaaaaccaaatatggcaatgaatccaaaaacaaattgctataatgaggacaattattattattatcccaagaagattaaatgaaaaattacaatgaaaaaaatttgaaactttcaatttttttcttgagaatttgtttaaatttgagtttgtgataaaagtttaatctctttttttcatctgtttacaaaaatattttaatcattaaaagcgtcgaatggtctaatgttttaggtgattaagtttaaaattatattaaatgttcatattattttaatcttgaaaaattgacaaaatatgtaaataaaaaattgataattcaatcaattaaaaagtaaaaaaaaaatttataccaaattaaactcactcaattaaattaatagttttaattaaacttaaattaatgaattaatgcacccatctaataatataaattattgcttttaattgaaattgaacttaatgcacccatccaataatataaaattaattaatttaaattaaattctaacccattttttctattttacctttccaatggcgagcccatccagtgaaagttggccttccccaacaataaatgccaatgtcgtcctcaccttggcacaaattttcggacaacggaatctgttctttgtcctcaaagcctggacagttccacagagagtcttaaatttcaaaaaataaataaaattaaatttggcattaaaattttttaattttcccactttggcgttgtgtacatttgggcgccggcatttcaaatgggtaagtgtcgttgttgcgccgaaaaaagcgccaaaatgcgccgtcatcatagcccatggtacggcacgcggtgcccgtgtcaatgctggtccaatttgtcatttgggtacagacggaacgccaacggtcccgaaagcgaatctaatcaaaaaaaaaattttcaaaaaatgtattacgcatttttaaaattaagtttaaatgataaaaaggcgttacgaaattaaaaatttaattttttttttgttacttaattacaatttttaattttttggaacaaaaagatgaaaaaatcatttaagaatcattttagtggtaaacgaaaatttttttattagtttttttagactgtaacattcatagttaatttcaaaaaattccaacattgatcaaatcttgatgacaatgaaaaaattctgaaaaatacgctttttttatttttgatcaaaagtctttttttttgtaaaatttcagctcaattagacaattattttaaatggctttaaaatgtaaacctcgtattttttatttttaactcaatgtttttttttataaaaaaaacatttttaattgaaaacgaacttttattaaatttcataaattattttttgaaaaaaaatattaaagaaatttgcctgcagacggccttgcctgacccgtgggaccgtcaattagccgtaattctggcaatttgctatcgtacaccagctgctcttggagcgatatggtcgatttattgttgctgagataaaatcattatgtatttccgatttattacgcttatcaaaaacataattatgggcaaaataaaatctttaataagttacagcataaattacacaaaattttcgggtggcttatacgacaattg

SEQ ID NO: 1866 - DNA, 1933 bp, Heterodera glycines
  misc_feature (17)..(17): n is a, c, g, or t
  misc_feature (42)..(42): n is a, c, g, or t
  misc_feature (51)..(51): n is a, c, g, or t
  misc_feature (81)..(81): n is a, c, g, or t
ttagttagttaaatcanaatcaagtgatcatatttttatttntatttgacnaatgagtaaaaatggtaaaaataattaatntataaattcagagaaaaagaaattaaaattcaaattaaattcaaataaaaaataaaaatttttgtgttattatttggggtgctctaattattgcatctttttttttgttagtttcaataattttcgatatgtggttaaaaaatcggaatttgtaacacgtagaaccttatgaaattttaacaaaactatttgggtgaattttgatatccatttatcataacggtaaaaatattttatttaaggaaatcattgccgagattgggaaaataacatttttaactattggcaaacattttacaaaagatcgccatttttttgttggtttgtgaaaaattcggaatgcgcattttcgaaagtatttacaattgtaacctaatttccttaaaatgcgcattttcgattgtatttacaattgtaacttaatttccggaaaatgctggtttgtaaatttattaccggaaaatgcgcattgttacgatagtatttacaattgtttaacatttaattttaccctgaaaatgcgtattttccgataatatttacattgtaacttaatttccggaaatgtgcattttcctatagtatttacaattgtaacctaatttccttaaaatgcgcattttcgattgtatttacaattgtatcaggaaaatgcggatttggaaatttattaccggaaaatgcgcatatcagatagtatttacaattgtaattttaccctgaaaatgcgtattttccataatatttaccttgtaaccggaaatgtgcattttccgatagtttttacaaatgtgacttaatttccggaaaatacgtacgaaggtatttacaattgtaacttaatttccggaaaatgcggatttgtaaattaattaccggaaaattcgcatatcagatagtatttacatttgcgacttaatttccggaaaatggggtttttaaatttatttccggaaaaggtgcatttccgatagtatttacaattgtaatttttaccctgacttgcgcattttccgataatatttacattgtaacttacggaaaatgcgaatttgtaattttttaccggaaaataagcattatcacgatagtatttacaattgtaattttactcagaaaatgagtattttccgatactttttgcaattgtaacttaatttccggaaaatgcagctttgtaaatttattaccggaaaatgcgcatatcagatagtatttacaattgcgacttgatttccggaaatgtgcattttcctatagtatttacaatttggacttaatttccggaaaatgcggatttgtaaatttattactggaaaatgcgcatatcaaatagttagtatttacaattgtaattttaccctgaaaatgcggatttcgaaagtatttacaattataacctactttctttaaaatgcgctttttccgatcgtatttacaaatgggacttaatttccggaaaatacgtacgaaggtatttacaattgtaacttaatttccggaaaatgcggatttgtaaattaattaccggaaaattcgcatatcagatagtatttacaattgcgacttgatttccggaaaatggggtttttaaatttatttccggaaaaggtgcatttccgatagtatttacaattgtaatttttaccctgacttgcgcattttccgataatatttacattgtaacttacggaaaatgcgaatttgtaattttttaccggaaaataagcattatcacgatagtatttacaattgtaattttactcagaaaatgagtattttccgatactttttgcaattgtaacttaatttccggaaaatgcagctttgtaaatttattaccggaaaatgc

SEQ ID NO: 1867 - DNA, 1936 bp, Heterodera glycines
tggcgttggaacacacgccgagcagcgaaaagccaaaatgggatttaatcggacttcgaattgggatggaggggcacgaagacggacacggacagcagcagaagggtgggatcagcaacagcaattggggaaacggattttagaaatataaaaatgaggtgtgggggatactgtacaatataggagatgatcaaaacggaggattgggagaaaaatgaaaaaggggagaattattgttgggggggggggggtttcccatcaaattgggacaaagctgacatcctctttcttcagcttctcctcagtttgtccactcgcgcgttttggccattcgcatcgacccaatggcacttcacttgcgaaatcatagcgaaattgcaattccccagggcaaaacatacgttctgttgagcaggtgccgaattaagtctaatccggaccgggtcagtttagtacggccggtttagtacggccgttttagtacggccggtttagtacggccggtttagtacgaggggtcggtttagtacgagggtcagtttagtacggcaagctgtttttgtccaaaatagattctactgattttttccgaaaaaatgtttaaaattaataacataacataccgtatttgctctttttatatgccatggtatattatttttcaacctcctcagaaaggggtagataattggagaccggcagattaatggagactggcacataaaaagagcaaatacggtatttatcaatgtgttaacaacaaaaaaaataacaagcattgaaaaattacgggcgcatttcataattgcgagaaataccaacgagcaaattgatgatattatcgggattacgttgaagttttaaaaaaaacatttgtaacagttatggacaaaaacagcttgccgtactaaaccgaccctcgtactaaaacggccgtactaaaccggccgtactaaaccggccgtactaaaccgaccccgaccgcatattttggcatttttcaaaaaaacctctattagaacggcccccagcagctaaattagcctttttgagcccaaaacccgaaaaatttttcaaaaaatcattttttcgccaaaatttctcgagaatattgaataaatttaaattttcttaaaaattaataaattatgtcaaaaataagcaaaaaagcgaaaatttcgcttttgttgttgattttgcgctaaaaaaattaataaattttagcttttatgttttttttcttttaaaatgattgcacgtaattgccgaaaaaattcgagaccaatttccgaatgttgaccgactaattgcaaaacgaaagccgtctttgtcaaagcgccttaccgagtcaaaaaatttggaaatgtatctcatatgcaatttcaaccaataaatttgaagaaattttacattcagttttgaaaaatttatgtccatattttgacatttttgccatttatgtccatatttcgcgatttttgccattttatgtccatattttgcgatttttggtccatattttatggccatatttcgcgattttatatccatataattacacgccctaattattcgtaacgagaaatggtacttgttaagggacccacgcgtttacggcgctggcgtttcagcgccagctcgtttttccacttaagcttttttctttggcatccaaatccaacaatcttggtatcattcgaaagctcttatcatgctctattaaccttacaaaaagcggatagattttcaagcctgtaaaaaattttattaagaaaaaacttcaaaaatttcgaattttcatgtaatcgcgaagcaatcgcttagaaaaagcttctaaacatgttaagctttcgaatgatatcaacaatgttggatttggattacatagaaaaaagttatagccaaaaacatgctggcgccgaaacgcagtggaccc

SEQ ID NO: 1868 - DNA, 4906 bp, Heterodera glycines
  misc_feature (541)..(541): n is a, c, g, or t
tggagcgagtgctgttggagtaccagcaattagcgttgggtgtgttgttcccgccttccggcgcgtatgtccttccgtacgttccggcaacggagcaccaaatcaaaaatgtgctgggactgctcaaaaaatgtcctccggccccaccaattagtccgctaattgaccttggcagcggagacggacgcgtcgtaagtgattttctttttattcagataattaaaatgtatttcaattagtaacaattacataattgctcatcattttgtacatttaatgcgcgtgcaatatattacacacctcctaaattgttattgttgttgctgttgttgttacaaaaccacaaattgtaaacggaaatgaaatttggggaacaattagctagtcacttgacgccagagtggcgcaagcagtacatccgttatgaggagctcaaatccatgctttacgatttgatgttggaggcgccaacggaagcggacgcgcgtgatcagtaaaaatggcctaaaacatttaattgggaattaatgttcaccatttntaggtacgttacccaaatggacgagacattttttgcggaatgcgagaaggaattgacgaagatcagcctgttctttagccaaaaaatagcggaggcccagggaaagtaccacgagctgagcgcggagctgaaccttttcaaggagtcggtcgaccaccggcaaacgcccctcactcagcgcaaaagtgtgcgggtgcgcttcaattcggccacgaaattggccccgtccagcaaattgcaaaaggaacaggcgaagacggcgcagcaattgaaactcgcgttcagtgaattttacctcaatttggtgctgctgcagaactaccaggtcataatttttggaaaaatcaaacaattatatgacagaactcaacagttaaaccgttaaagtattttttaaagaattttcctggatataatggtccaagactaacctatttgcggtgtcaaaccttcacccgaaattaaaaaaaaagttgctgttgacaaaattcttttttttaaaatttcgttttgatgttaaattgttttggttttagcaattgaatgccaccggattccgcaaaattttgaagaaacacgacaaattaatgctgaatgaccgtgggatggcttggcgaataaatcgggtggaaaagtcgacgttctttctgaacgctgacatcgagtcacttatcaacaatgtggagacgactgtgatcaacgaattggaggggggcaacagacaagcggggatgaagcggttgaaagtcccgcctctgagcgaaaaggtcggcccggaaagagttttataattgggcatcttttagcaaagtgccggaacaaccttttcgcttggcatgttcatgggcattttcatcgttttggcgattgccatcgttttgtccctggtcggactgcagccaaaggacaataaccagccaaaatgggtcgctgttcgactcttccgtggcttcttcctcttcttcctttcgatatttctttgtggtttaaacatgtgtgtattttataattgggtttcccttcatttttacctttaaaggtacgggtgggctgctgcaggggttaatcatgtgctcattttcgaggtacatttaaatcggtcatcaaaatataaaccaaataaattttttgaaaactctttcacttttacaatatggaattcgttaaattgaatacttccaatttgaaatgctttgcaaatttaatttttttaaaggttttcaactcccctccttcaaattgcaggtcgacccccgcaatcacctcacctatcagaccatcatgcaaatctcctcctttctgatgatgctttgggctttggccgttctcggctttctgtacgcccattggcttcttctgccgcccttccttttccccctgctgttgatgttcgtctgtgtgctgtttctgctcgcccccttcaaccgtcccactcagttattccaccgcaattcgcgcttttggtttctcaagcattgtttcaactgtttcaccgccccttttcattttgtcactttctccgacttttggctgggcgatcaaatgaattcgctgacgttcgtttttctatttttcatcaaaattgcatgcctttttctaccatttagtacttgttttctcgacttacagtatttcatttgcttttacgccaccgaagttgactattccggcgcccaacttcacgtccgcacgctgaatgttaccgaggggtcaatcccttggggttttgtcgacgtgaacaccggccaggacatgtgcatgtcttccgttggcattcgatccgtcgtctctgtgctgcctgcgctcgtccgttttttgcagtgccttcgtcgctaccgggacagtcgggcgtggcacccacatttggtgaacgcgggcaagtacgcgaccacctttttggttggtttccacttttaatgtcgactttaaattgtttcaaattcataatgtctttgttttcggtcgtcgccacgaattcgctcagcaaatggtgggcagtggaaaagccgtctgacaccacctcacttttcttctatctgtggattgcctcgtacataatcagcttcacatacacatttttggtacagaatcgagggcaaaatcagcttcaatctcaatttcccagtgggacattttcatggattggggcttaatcgacccgacggcaccgaaggaggcgccttttttacgcgaggaaatgatttatggaagcaaatggtattattacttcgcaatcctggaagactttgtgctccgactctcctgggttatgaatgtttcgctggctgaagcatggtcggcatattttgtatcatcttttttttatcttttcggtttttcaggactttgcaaggcgactttctggtgtgcattatggctccgttggaagtgatcagaaggtattttcggtgcattttgatcattaatctttcgataccctccgatgccattcaatctggatttactttatgaaataaactgcaccgataagtatcacgtcattttttaatcttcaggtttatctggaactattttcggctcgagaatgaacacgtgaataattgtaatgctttgtccatgctgccaaaaacatttcaatttgatcatttacaatcccctaaaggtggccaattccgtgccgttcgcgacattagcgtaaagccaatccgaaagggcgacttggagtcccttttggccaagatggaccagcaggacggggtcacccatcggggccaggacttgcgcgacagagtgaagaagcagaagaaggcggcccgggacaaaaagcaaattctgaaaaagaaccgaatcacgcggatcagtctgcctgcaattcatccccaaccgagcaacacactgctggagacgatgcattgaggaagggggggggggattagacagtcaattattcaggttttctcgataatctaaactcttaggtattcttttttttgtcttggtttcagtttttcgtttatcattcagcaattgtatcattatcattcattgaatgactgatacgaatctttccgagaaagctccgccaatcaaaataatttgtccaacattatctgtcccagtgaattttgttctagccaatcgcttttcagtgtgtgacattcccttagtttttgactactcattatacttttaactcatggtttattgtctgttttggtgtacattttgttgttgtgcccttttattgataaatttcttagcaggaatttttctgcatttttctaaaattaaaataatattttttgttgattaatatcccaaattcaggtgattgaatgtgctcgagtcggtcacaagagctgtgtgggtgttgagctgaactaccctttggtgatcgcatcgaggttttccgcatggcgcaaaggcttttcgaattcggcaaattttgtccgtggtgacattttcaaaacggatctcagcaaatacaacacagtcatcctctttgggactgaatcactggtgctgtcattctgtgcatttccgatgatttaataaccaaattttaaaagctacctaaattgcattttatttgattttttaattttaggtggagcattttgccctaaaactcaatgagatgcgcaccgattcaaatttggtactttgccggttcccattgcactccgacgaatcgggttgggaattgcgacactcggaaggaatcggctgtgaccaagcgtggctttatcgccgaacagggaaacagtgaccaaacgaaataacattatcggttgggtaatattatacaattgctgtcccaattggaactgtttgtttttctttcatgggatcttaggcagaaaagtgtggaaggagtggagcaaaatcactcattaagccctgattataatcgctcttgggacttgcattttatcccagtccgtgaaaaaaatatgattttccatcgggacagcaatcccaaatatcaattacatcggatgctttacatataatttgtagcgcaaatgttgattttaataaatttatatggccaattgggatcaggttaaaatttatctactgtatctggcgggatcatggacatttacatatggttaattgagcacacatttcagccagagtaaaaagcgtacagctcaccttaatttgctagcaatgcttcttcccatcttttcttttcccgtgcaaaatatccacacatttttctgttttccgccgatggatttccttccatccctcgccttcctttcctcttctcattttgttttcattaggccgtctcatccctcccttcctcttcctcccattctcatctttcgttctctttcccttctccaattccctgttgtccgtttttctctttcccctcacaaatcgattact

SEQ ID NO: 1869 - DNA, 4074 bp, Heterodera glycines
  misc_feature (4012)..(4012): n is a, c, g, or t
cgaaataccattatggatgggtaatattatacaattgctgtcccaatggaactgtttgttttctttcatgggatcttaggcagaaaagtgtggaaggagtggagcaaaatcactcattaagccctgattataatcgctcttgggacttgcattttatcccagtccgtgaaaaaaatatgattttccatcgggacagcaatcccaaatatcaattacatcggatgttttacatataatttatagcgcaaatgttgattttaataaatttatatggccaattgggatcaggttaaaatttatctatctggcgggatcatggacatttacatatggttaattgagcacacatttcagccagagtaaaaagcgtacagctcaccttaatttgctagcaatgcttcttcccatcttttcttttcccgtgcaaaatatccacacatttttctgttttccgccgatggatttccttccatccctcgccttcctttcctcttctcattttgttttcattaggccgtctcatccctcccttcctcttcctcccattctcatcttcgttctctttcccttctccaattccctgttgtccgtttttctctttcccctcacaaatcgattactcacacttcgccttcccatttcatcagcagcctttgctcactccaccaccaaacattggttgtgtgcacacactcactcgccctcccctcttcctctgctgcccttcgtcatacgactcccttccttccatccattcccctccccttcgccttcgcagtgtgacatttctttccttgctctcccttccctcccacaaaccaatttcgtctcttccctttccctcgtccctccaactgtggcgtgctcccttccctcccttttttctcctctcccttccttcgtcactttgtccgccgccaaacaaagctccccaagcagtcaaccctcgctcacactctttcccctcctccctcccgtgcttactctcctctcctctcaattttcttcctcacagctctttcatccatccatcctctcctcccaacccttttctttccaacaaatgcatataaacgctatttcatcccgctcacttctttcataaatcgccctttctcccctttccctttcttctgtcgctgctgcctcgcccctctgctccatcctttactttaattctcaacaacataatttcctttagtgagattgctgctctgtttcatcaactcccttcttctgtcttctcctcctcctcacaacctcttcccttcatccatccgttcaccctccgtaagtcccttttatttcctctacttttgcttctccgtccgcgctgatccacccgttctcatacattccttccttcccctccttctccatcttccgtgtctgttttgtgtgttctgctgcagttccattgtaagtgtctaatattagcgggttgggtacgtataagctgtgaatagtgtgggcagagagccattcccaactgtctctgttgtctgttctgtggtttgctacttctacacacatacatatgtagcaagtgcgaagggagagattttgcactgtgaaatattcgaaatggtcaaatacgctttgttattaaaatataacacatgcatagcgtggcttatagaaggaagtctggaaatacaaagccgattcttaaaaaaaattgtgtgtcatttaaaagaaatacataattaatcaaagaagtttttaagtcaataatttagttaaaaagttaaattgaaggggggtgacttaattttcttggccgggtcacaaaaaaccaatcgctttttttgtgtccaaatttattcattataagaagtttaaatgtttacaacgaataaagaagaggcagttaacgaattaactaattatgatggcacgggaaatttaaaaaagaaggaactgctgcaatcaacaaaatctctggcgaaaaaacaaaacaccaatctcactattctaaatttatttaaaattaaaaaaccaattaatttattaccaaggctgagtttttaaaggctgcctattttatgtgttccggaaaaccttaacgttaatccgcctgataccggtcctaaaaattttatatatacctattctttccctaaaaatagagtttttaaattcatccccttcatttatatgattttttatttgcaaaaacccacaaattcatttttttagttcaaatctgttaaaatatggccataattctcaaaatttcccccgggcgcctgtcggaaccgccgggcctttccttagtcggtccgatcaattcttggtgcaatttaaataaaaatgaatttttctttttcttttttccttttattaaaaaaacatttttgaaatattgcatgctaattagggttatcgaatgatgtcacatatcaacgaacaggtttttattagttgactctgagaaaatatggcattagctatgtatgttagctgttctttcgtgatcattgcttacaagaatttctgctttgatactacctgaagatgcgtgcgttttttctcaaacatctcctaattcgtcgcttcttcttttctgattccacacgttcctctatttatgaaattctgccttgtctttttttctaatataatttttgttgtatttatacgttgtatatatatatatatatatgaatacgtcatatcttttttaaaaatttctctccaggcaatggaacaacaaaatatcacttattatccgactgaaattgtccacggacaaacgaacggcgattcgcaagaacagtttcacagagaacatgtgtttcattcggatgcaaatgttaattttcacgcgacaaacgatacaaattttggtggtggtggccgccgagcagcttttgtaagaaaacaatttggaaaaagaatacctatttgtctaatcaatcatttcattaaaatttgactcaatgtgacagaccatttaaacatgtattcccattaagaggccaagtcagttgcagcaacgtcaacaacacatcgtggttcaacaggggccgacttcaattccgcaacgggtcagcaccaccaacattccggcgagtactgcaggacaacagacggtgcatgtgcagttggtgccgcacaatcaacagggaaatagcccaatccccggccagcaacaacaacaacgccaacaaattgttgttcaacatgcacctacctcaatgccacaacggatcagcaccaccagcattccgacgagcactgcttctggtcaacaaacggtgcatttgcaattggtgcctcagcaagggaacagtccgattcctggccaacagcaacaacaacagcagcaacaacacattataatttcggcgcaacccgtccagaccaccaatacgaccacagaatccgcagatgggaatccgattgctgcgtttatggagtactttgtggaacaacagcaacagccgacgtgttccacgaatactttgcccaacgttcagaccattcagcagtacgggtcgccagtgttggactcgaagtgggctctatttgcatcattaatatacaagggggtctcaggccatgggccatatgatggacgattgattaagggggggggggggtgtctcgggatcaaatttcgatacggaggtgcgaattttacatcggtgtgaccattacgcacatcaaatcagaaataaaaaaagttacttcagtttttaacctataatttcttaaccgcaaattttggggaattttcggggaaaaaaaatcataaaaatttttttgttctatattttcaggtttaatttccgtggatctatttaatatattgtgtttaaggttcactttgaaaaataagctgttgagcggaatggacaaaagttcggagaaggctgaacgggaagcagtgaaacgggcacggcaagcagaggcagcacgacaacggtgggtttcaaagaattaacactcagattggcacccagaatttttaattaattcaaatttattaaggttcagttaccataanctgactccggagcagaacaaaaaggagagcttaaaaagaaccgaggcccagaagcggaagaa

SEQ ID NO: 1870 - DNA, 2921 bp, Heterodera glycines
  misc_feature (2582)..(2582): n is a, c, g, or t
  misc_feature (2844)..(2844): n is a, c, g, or t
  misc_feature (2908)..(2908): n is a, c, g, or t
aaggtcccataatttacgtcgtcgaatgaaacaggcaaaacctgaagaaagcaccaaagaaatcgtcgttggcacggacgacgagacacagcgccggatgaaggaacaaaacgcgaagaaggccgagtcggcacgtcaacgttaccaccgaatggttttagtcgctgtataattgatgctttcctaactaatttaacaaccgtttgcagagcaccgaggagaaaaagctgtacaaccagcggagaacggaggcattccgacgtcgccgaatggaggaggaggcactgttggcaatgccaattgggtgagcgacgaaggagaagaagcgcattactcctaattaaacaaattcagaagaattaatggcgaagcgcttgaccgagcccaacaaattgtcatccgaaacgccaaacgggcggaggctgcgcggttgcgctatcagagaatggtgagaaagactaattgtaagtaatgagtttttcctttcattatcagacgccggaacagcgtcgagcatacaatcagaagaggtatatgccgaagcggaagagagacatggacatgatgatgagcatggattcgccgcttgggattgacaagaccgacaaaatggaacgtgaggaggacgaatttggtaggttatgcgattcaattgtccattgtttttggaaccaaaatgtaattctgtgtgcaatttaagacgctctctcgtcattggaacgcgacgtgcagagacgaacacaacaggcgcaacagacactgcgtcaacgccagtgggtggtgcaacagcagacgccgagcgcaacgacgggacaccattgaaatacctaataaagcaatgttgctgcatacaaagcattcgtcattataattcactgtttattttctgagaaattcatctttaaaaagtaatttgcgttttaattacacttaaatcgcattcgaattccgtattatgtggctcttcaatatttgtatttttgtttgttgatttaatgttattttttgtccactaattattgctttagtcgacctatgagttcaagcaaccgtcagcaaatttactaccaaagccgtcaccatccgcagccccaccgtgtccccggcttgtcattgccaattgcttcgtcctctcaccacgacattggctccatcagtcctcgacatgaccatcggcagatggtcatcgtgtccgggagtgactcgtgcacggattgcgtggccgattaccattcgtcgtgcgactgtcccgcttgcgaatcgaaaaatgtattttgtaatgttacaatgtttattcaagtcatccttttaatttttgcagcttgcttcggtcggacatgacgctgggctggacgaccaccagctgtactcgtactcactggaaccgacacagttggaggacgacgacgaggggtaagcaaacaacgaacgaatgtgatacttagtttattgaaatggaaatgccattcaaaacaggattgtgcacgaattcacaacggactctggcgaacgccatgtggtgatcatgacgaagaatgatgagcatttccaggagggcatcaccattcaagaaaggcaagttttgaagttgttttgatctgcttacatcgaattgattgcttgttataaaccgcatcaccaaactagtggaacattgcctctcgccctcccaactaacaatttttgtcccaccattttatagagttcgtcgtcagaaattgtctgaagccgcccgtagccgatacgctcagctcagcgatgaggagaaacgagcggtcaccgaacggagaatcatcatgcgacaacgacggaagcagaaggaacgcgagatggaggagttggaggcgatactccgcgcaagcaatggtgtgacaaaaagcaacgatttacatattaaatatcatttattaaagtaacacagtgtttaaataaatttgtcattgctcatattgtttgaatatttagacatcaccgacgatttgattcccctggatgaggtggttgcccaacggaagcgtgccaaaacgagtcgttaccagagcatgagcttggaagagcgtcgtgagtacaaccagaagaggcgtctgcgacagttgggagtgtcgtccgagaattttaaccaaattgagcccatcaaattggataatatccggagacaaattgcggatgtaaacgcacgcaaggcggaagctgcacggcaacgctaccatcgaatggcaagatttaattttcgaaattggcactttttttgacgccatatgattttagagtcacgaggagcgaaagatgtacaaccgacgaagaacagaatcgtgattactttctcgacaattcccattaatgcatccttttaaacaggttccggaagaggcgcatcgaagaagaaaaattgttgtctacgccggcaggccaaattacgccggaggcactcgagaaagcgcagaacatcatgatcaggaatgccaaacgggctgaacaagcgcgtcttcgttaccaaaagaaacagcaggaaaagggcatcatgccccgacgacagcgaaagcccaaaattgaataccgagcaagttccggagagccgagtnttgggtggctgtgcacttgggtagctaatgatgccatttgcttattattgcagaccgaatattggacacaattgaacgtgacgtaatgcgaaagaccaccgaagcacgccaagctttggtacgtaagcaacaagttgagcctaagaaggaggaacttggcgagcatgagcaagtgctgttcacttccgtggacgaacggcggcggtggcagcgccagcactttgcccgcccaactgatccaaacgacaacatcgggctgtcnggtctgaacgtaccgcacagtgggcaaaacgtggtccaatatgttcaggtgctcctcccattgngagtgaaaatcaa

SEQ ID NO: 1871 - DNA, 2744 bp, Heterodera glycines
agcggaattggtgaattgaatgtggctcgtacgtttgtcgtaccgcttctcaacagctcaaatccacaactgtcgtcaagcgtggaagtcaatggaatgacaaaaaagatccacccttttttgaactgggccattgaaatgtcaaatgaacgttccgagttagccattccgagtgcctcatacatgtcaacaaaggcgctgacaaagtgatcatttgaaaaatttagtttataaggaacagctgggtaaactacgccaccagcatgtaccgaaatctcacgcaaatcaaacggctcaaacatgaagggactcagtttgtaatcaccatgaaatgctgaatttcctaccaacgctattgtcacacgtcgaggaatggttgcactgaatacattgtactcaaattcgtatcgaccaacactgatgaatgacgacttgatttcggtcttgcgtactgcgtacgtggcgggttgtttttcaaggtttttgtaaaggttcatgtttagtgagggttggacctcaaccattttggcataaatcttgacatcgtaaactgtcaaacgatatttggttgaatcatttgcttttaaagtttgcaaaagaaagacatctttagccttgtaaattgtgaacagcaaatccaaattgtttaaaagataaagctcctggtttcccagatcaaagtcgagacgagagaggaattgtgcattttttccacccttgaaaattttacaacgctctttgaacccctcgtctgttgagtcatcttggtttatggtgtgataataccctgttgaaccaagaaaatttttcttggcatttattggaaagcttaactcattggtgatataggccttgaatgggtataggtttccgctatcgtatacttccgtattgccaaccgtaacttttagttgctggacaaatgtttgaccaatcccttgaatggcagagacactagtatccgcatcatctatcgcaacccatttatcgtttgctcccggtttttcaatggacagttcgagataaagatatatccgagataaatcagtccacaaattgtcactgtacagtcgaaacaggtacggtgattcttgcgtgattgttgctagcggaagcacctgacgaaagaatgaacgtacaacagaaacattggtcggtggaactaagaaaatgttcagaccagtgttaattgctagtggactgctgtcgctgattttttgtgggcaagtcatttttttaataggttcctaatgagtcaacacgaagacgtttatttttggtcttatcaaccattggtggcccgattgacgattgaagtttatttatattttttcgccttattttttcaattttgggagccgagtcttttttgtatcgcttaaaatcaaaaccttgacccttctgagtgtttatgttgttggctgctttttcgagaagattctttagtcctgccttactctcactaacgagagactctttgaggttttttccctccagcacattggtgagtactcgatttcctgtttccattccctgacgtccaattgcggagccaatttgctttccaatcggcagcaaatatctcataagacttctgaacactgcgccaactcccgctccacgctgatagggcaacccccgataaatgttgtatccaccaaattgcacatactcggacgagaatgtggaccaatccacttgtagaggatcaaaatcaacatgcatttttttttaaatttgacgtttttacattatttatattctttgaaaattttgctttttacaaaattgtttacgagcgtatccggttgcatctttccaaagtgcaaaaagctgacaattttttcaaaggtcattccaacacatcgacaatacaaaaagaaaatgacatgtcgaccacacgcacttgagttggcagactgaaggggaagagaattatattgaatttgtttatagcgtgacaaatgattcacaatgtaaacactgggcggtggccacaaccccaatgagtcataatactccaaatgcaaaggagaagcgcaatatatgcccacccaatgagaaccatgtgatgtgctggggtcaagattaaccaccatacagtggggaaatttgacaattacaccggtgggtatttgatctgctgcaaaacaaccaagatagtagtggcgagtcacgttgtttcttgtcaatgttttgttaatttccaacgtgttcatcatttaaaaataggacatttttctaaagtgtaatgttaatgtacatgttccgtattggaatggcattaagatgccgctattggtacgtatctcaatcagaatttcagaaaactcctttaataaaagtttatgatactgtatggcaaaaaattgttcttcaactacttcgtcggggtttccgcgtatggtcactatgcgcaacactggggccgtcacatctccaatcatcattggttcaataagatccggcgtgtaaacgtggaatgatgacacaccaccgctcatgtccggcatgaattttgcctcgttttcagattgaataaactccgtgttgttgaaaccgagaatgtaggcgagttgaaacgagacttcaacctttttaacgtaccgtgggtcagtgtttaaaacaaagcgatttttattgacgtcgtagttaaattggcagacaagacgtatttcacgatacgcctgaatccatgcttccgttcccatttcctttgtggcttaaggatcgcacgttcctct

SEQ ID NO: 1872 - DNA, 7760 bp, Heterodera glycines
gtcgtagtgaaatggcaaaacaagacgtatctcacggtacgcctgaatccatgcttccgttcccatttcctttgtggcttcaaggatcacgcgttcctcttcggtcaaatttttgatttcggcgttcaattttgtcatgcccaattcatcaagaatgttcaaatttttgtcacttaatttcgaaaagtactcatccaatttttcttggtacgaactggtatcatcagctggcattctcaacggtacattactcgttgcagcactcttttcgcgtgtcagaaagccttgggccacgctgttgaggtcaaccaatgttccagtatctgccaacatggcctgtaggagcagctcttcgtcacggacgccccgtttttctttagtctttcgcttaatgtactcttctctggcccagcggcgagccttgtttatcgtaagcatgaaagaattctgtgttgatcgtaccttttttgccaacggatcacttccctcacccaggagcctatataaatttttgctaagctcatgggggtttgtgacatttgatggcggaacttcgatacgtaccatattccctgtctgccactcaatctgtacaaattgttgctccacggtgcctatcgagggccaagagtggggatatacaataacggcaagacccacctcccattccgaattgaattgcaatttgcgcggtaaacgcactcggaaagaatttgtcctatttccttcaatattggtgtttgacggaagaacagcataaaaagaatttgaaggcattttttttaaataaattttattaatttatttctttttatatatttttctcgctaattgaatttacgggaatccaactactaaagcgagtgccataccctttccatttcacaaatgcataatccacaccgttctgcctctttttcttcaaaatcttttcaatttcatacttttttgctgtttgtcttctagcgttttgcataaatcatttgcgtaaaaccaaccactaataatttcattattgtcatcacgtaaccgataaacaactggcgaacgctcagagtgtacctctgccaccgtgaaaagttcattggtgaagcgtgggaggtaacccttttggaacacgtgcttgtacttttcaatgcgcacgcgatctcccacgcggtactttggctgatgtcgtacaaaattttcagctgctgcaccatgtaatttttgtcgcaatgcttctgcgtttttaaagttcacgtctgctgggcacattcgaatgctcgaatttggcgagtggttaattgcgtaaacaatgtcttgcacaacatcaatcgacttgtacgtgttacgctccgtaaagtagcggtaaaggcgctctttgatgctacgattcgcacgttctgccattccggcatgaaattggggagaagtgagcatacaaaagtgttcaacgtcttttgtgcggaagaactgctgtactgcgcgggcagtgaattcctttccctgatctgttaacaccttccacgggatatattttgatcttttgaatatacgaccaaatgctattatcatgttagcgctcgtcttggtctttacgggctcgacaaacacctgtcgactaagggtatcaatacagactaacaagtacttgtagccacggttttgtttagcaagtcggtcaaaaatagccaaatcggcctgccattcagtgtgtaagcctggtgccaatgttggcaatcgacggtagcgccgcttggcctgacgatgcagtgtgtatgtacgttgggtggctaaataattttggacatcggttcgattaatttttggttgagttttctgcgcctctctcagcagcggttcaacgctcgtgaatgcgacaggcgaacttagttccttgtacaaaaactcaagcaaacgaagctttttcaaatccataaagatggattaaatttcagtgtggtgtttttataaatgcctttgccggattggccttcgggaaataagtgcctactcaagagcgggatctgtcttgccctttcaacaaattctttgaatgcagttggctctttgttttggccacgcttgtccttgttcatcaggtgactaacaatgtcataaacactgctggttataaaaggccgcccacccgctctcaagacctgtccttcctcagacactccaagagattgggcgtttttataaattaattttaagatttccctttgtgtgggttgtcgtttatttgaactcgatggctttggagtttcatcatcatcatcatcatcatcatcaacatcttctagttgttcaacatttgcttttcgcgcacgcccaacctttaaatggcgacgcgtagcgacaacaattggtcttttgacgttgactggttttggcatagcgtcaaccacatcactcaaattttctaatttaacacccacgggacgttcatcctcgtcccgagtcagcttgttgagacgcttaagttcctgctcatatttgattgcccgttctgcctcatttatgccgtcatcgtttttgatttgtttaattctgttacgtaccagcccaattggtgttccgtcatacggtggcggtgatgccaaactctgataaatttcttcggggacaagcaaatagcgctttgtatgctgcattttactttttttttttactttgttgcaccttatttataattttcaatgacatccataataagcggaagagcaattgacgcaatgagccccacaatagagggaaggccctctccgtgctgtagcaaaacctttttggttgagcgagagcagcgtgtgcgagcgagacgacgaagcaccagtgcatgagctttcagcttaattattttttcaactctagtaataataacacctccatctatctttttagaatgaagactagtaaactttaaagagatttcacttattcaactttttcaatctaactgattttttaataatttattattaacacctttacactttacaatgtctttagacggatctatgctgttttttaatcaataagcttttgcctctctaccataaaaataattaaaacaaccctcattttttcattttccatactctttaggatctattcaatcttcccataaatgtttagattcatttaagactacaacactatctgtgtcacaatataatacagaatcttttaatatgtttaaatgttttattaaatatattcttgcttcagctgtgatagaagcagctaatggtaaatatgtgctattatatttttttaattttaaggatgacgtattatcactagataatatttcatcatccttaagtaataaacaatatttttctttattttttttataagttagatgattttttctttttttacaacaacatttttgaagaacgtatttctgtaaatttattctttgaccaaatttaccgtataaagagttttgaagaagtttagctttagttctaattataatattttgagatgattctttaagaatctttaatggtgataagtaatttaaaaatatatcttttttagatttataataatatgcttttttaatataccaattacctgaataggttaacttaaatagatttaattctggttgtgataaataataaattccttgttttaattcgttattatattcagctatttttgaatcattatcaacattattagaagaaataaaaggtttattttcacctattattttagcgttagtaatatatacttcaaaaaaaccatagttgtatgaatttgttggtacttctgatcaatcattaccataaggtaatctcatattcaacataatatacggataaagtgaatttatatctaaataagagacatctttacataactcattatttcaaactttaacaaacccacccctataccactttcttagatattcatggttacctataaaatctcatttacaatacccatcagattttttaaactgactatatgaataactagatattgttgttggagatgttttaaaagattgaagatgttcaaaaacagttaaacaatcatcttcacataattgtttatcgatattagtagctctataatttaaaggtttaacagcatcataatcatattcttgttttctttttaatctatcaggagtgattgtaagtttttttacagacaaagggagaactttaagagagtctttaaaaataacaaataatttattttttttataaataatatcagaatataatttaattcaaaagaaccctgattgaggtgtttttaaaaattttatattatctaactcaaagttttttattaaatgtcaaaaaataaactcaccatcaaagtttaaattatgaaaatatattgttattgattcttttttttttaccaataaaataagggtgtttaaaaaggattgaatattgtatccaattaatttatacttattattatcttgttcatatacaaaacatcatagatatactttagtttttctaacacctacacatgtttcaaagtctgcaacacctcacataattttattcatttattattttatatttacgtaatatatctaatccatctatagatatttttaatgaatcgctggtagaaggaattattgtattatttatttcttgtcatgcatcatttaaggttttttcgtagttatatgggtctaatttatatatatatttattaattaattttccagtatttttattaacaatattgacaacaatatttttttttaataaaagattattgaacgcatttttaataattcttgagtttaaatataaccaatatcctctccaactttttattaatgatgttaatctatcaccatcttcatcttttttacctcaacgtctctttatagggtttaacaccaacccctcttgaatatattttttatataatctcaaacaacgtattttaattctattgtaaatttgtttttttctatctttttcgataatcattgcaccataatttcattaatctttaagaataaaaccaaatttataaacaccacttttacttattgggtgtctttttaaaaatcctaagtatttacaaaatactgtggttcctacacgtatttctatatcatgaggaaaatataaaacttcaacattttttacatataacctatttattagtggatgtgatttatcacatccaccacaaacaatttctcttttatctcttaaaaaagttatctttttaattattgtttcaatatttttattcctcttattttcgatatttttatttttatcaatattattcatattttttactatttataatatttattatatataaatattattataaaactataataataaaaatattgataaaaatagcatttatatataagaatcagatacattgaaaacaaattagatacaaggttttgggaatataatgacatatttaaaatatggtatgttataatattatgtcattaacattaacaaatcaatgtgtgagatgtgcgtatttccgcagtatgaaatgtaaaattatgagtatttggtgtatatttgagtatatatttggtgtatatttgagtataggatggatatatgtgtgttatctgcaacgcccccgcagggtttcgcattaacactaaatagtgagaatttgtgcgcgcgacacgaagctctttgttgaacaggtgctgagttaccaaaatgacactgacgccccaattgtgtgagccacgggtgaagagtgcgtccaaatattgctgactcatacccaccaccaaatcatccagcaccagcaaggttttttcttttttggcgcactcccgcacttgttccgctcgtgggacgccgctatggatagtgactggcacattgccaactttgccggcgcgctgcagattcatcacatttgtgttcacctccccatagctataaataacgcgttcaacaggggtagagatcattttgtccacatttcgcaacatacgcattatccactctgacttcccacttcctgtgctcccagacacaatcattgtaaatggatgacgaaattgtccatctttccttttaaattgttggaaggcgtccattttattttttatggaattttctttttatttatagtttttcatttttatagattttaatggatttaattcttgccaccgattggataaacaacgcttatcccgaaatggatttacaggacaccaacaaagagaacaaagagccaacgaaaaaccaataggaggaggcggacgatcccagttggatcagcctgattgacgaggagatgaagcgcgagccgctcgctccaattggtgaggaggcgccagcaacaagttgcttttgttttcatttgtcatttaaattttaaattaggcactccgaaaaagtgtggttgcgccgaacgccgtcgccctgttccgctcgtggactacctctgcaagcggttcaaatgcagtgcccatgagctgcttgtgcttttcaaaagcctagagaaacgccgggacattgtggagcatttgcgctccgtccaactgcgcactgcccacctgcgcccgtccgcgcgcaattttccagtgcgttgtaatgacctgtccatcctagacactcactccgccccagcttaccgaggctatcttggcataacggtatttttatttgctttatttgtctgtaccataaaattttcatggtccgcatgcactactacataaaacacggtatccgcttgcgccaccctaatttgccgtgtgtagttgaatttggaggcgtagatcacaaaacttttttccctcttgaaattttgtccattgttttgtagatgtattcaatttccaattgtactgttgtttttaaaataaatgttcaacaattaactcgagagcaatttttggcaattgcgcaacgtggtgcaaacacggagtataaccccaggcgcttccacgctatcatcatgcgcatccgtacaacaacgggcaaaactgtggctgcattggtcttccaatctgcgcgtgtggtcttcaacggagtgtcccacccaagcagtgcaaataaaatggcggcacgtgttttgcgtcgcatccaacacacacagagcatcacactgggcatccaccagctgcgtgtggtcaacattgtcggtgttcaaacctttccccagcgaatcagtgtggagcgacttcaaaacacgctgggtggcatctatgacccaacaattttcccagcccttcgtagtaaattgttgaatggagtcacgtgcctagtttatatttcggggaagatcattgtcacgggggcccagtctcttgatattttgcaccagtcatttaccaatttgtctaatattataccaaactattttcgtgcgtaatttattggtcacattattttgtacaaatttaaacataatgaataaatatttaattaaaggaaatattacaaaaataaataaaataaataaaatcacaataaatcataacatcagaacctttccggtgcattccacgggaggggtgtcgttggtggacggagcagcacctcgcgcgtcaggacccgtgggttgcccacagggaagcgattggctttctgcttttcatcatgaatatgcgcatgttttaaaagaaaaaaccgaccatcacgtatgggtagaggctgacaatgtcaatgcacaatatctcctcgtcgtcactgcacacgtggagcagcttgaacggatcagtgcgccctcacctcagtgcgtcgatgcgcgggtccagc

SEQ ID NO: 1873 - DNA, 2081 bp, Heterodera glycines
  misc_feature (49)..(49): n is a, c, g, or t
  misc_feature (52)..(52): n is a, c, g, or t
  misc_feature (61)..(61): n is a, c, g, or t
  misc_feature (67)..(67): n is a, c, g, or t
  misc_feature (70)..(70): n is a, c, g, or t
  misc_feature (72)..(72): n is a, c, g, or t
  misc_feature (98)..(98): n is a, c, g, or t
  misc_feature (103)..(103): n is a, c, g, or t
  misc_feature (113)..(113): n is a, c, g, or t
  misc_feature (116)..(116): n is a, c, g, or t
  misc_feature (118)..(118): n is a, c, g, or t
  misc_feature (122)..(122): n is a, c, g, or t
  misc_feature (165)..(165): n is a, c, g, or t
  misc_feature (191)..(191): n is a, c, g, or t
  misc_feature (209)..(209): n is a, c, g, or t
ccgaatacaaccccaggcgcttccacgctatcctctcttcctgggcaanagnggtgtaaantgaggntgngntgccctttaaataggggagtgtggtnataanaggagtgtanaananaaanagtggaaataaaatggtggaatgagttttttggtgaatttaanatataaagagtattatgttggaaatngataagttgtgtgtggtnaaaattgtaggtgtttaaatatttgttgagtgaattagggtggagggaataagaaatattatgggtggtatttatgattgtactatttatagagtacccctttgtaaattgttgaatggagtcacgtgcctagaaatcacaacatcagaaccacccagagtggccgggctgtgtgggatcttgctctactaaatttctctttcttcgatgcgtccgttgtcctttgttcggctgtccatcatcctccacatagccaaaagggcgcgtctgcatcccaggccgaactcgccccttggcgtagaagggcctgtagtctttgtgggcttcctgcgtgtagaggtcggcgtacacattgcggtcaatttgcgggaagttgacgcggatggcacgatgttcgccgcccccgtacacgtaaaggtcgtcattgtccaaggcatcatcgctaaatttttttaaatttatttacaaaattaatgcttaattgcaaaactcacattggtccgtcaatgttgtacgtggccagcgtcaggttcttcattgcctcaaaggtgagcagctgctgcgcagtataggacaggcggaagctgcggattttgaggttggcgcgctcgtcggtgccgtcccgcgcagtgtggcggatgccgtagttcttggggccacccgcaacgaactcgacgatccgtcggtcggtgtgttcgcgcttcatctgccccagagcctcgccctctgctacacacggaccacccatcttgctgacgtagtagatggagtcggtgtcttaaacatttgctttttttcacaaaaaaaaaacaattcgtgacaaataaacataccgcagtagagcagctccgcaccgacgatggccgacacctgctccatgtagtcgtaaagatgaagccggccgtatgaggtgacaaacgcagcgaccggaaggcagttggtcggtggcgctctggcgaactcgggtcgcttccgcacaacacagcggtccatgtgttcggacacgtggacaaagtccaacttgtccagcgttgggtcgtcgagaagcgcgtggaattcagccggggttcgtgtgtagcgaatctccgtctggcccacgcgctgcgctagcttccccctgtgggtgtcattttttaaaaattataaccccaaaatatttaccacaaggagttagccaatgttttggcaatgaggcgcagtccggggttgaattccattttggtggagtccaatcggatgccttccgtccgctcaaaatcgtctacaaatgccttttgcagctcatccgtcacacatccttctggccagcccgtcgcctgcactttgagcccgacgaaggtgttgacgtagctgctgaacagcgtaccgtcccactcttcgtagtcccagacctaatttgtgttttcgtacacaaaattttttaatgagtgactttacctcaaacagatcggtgaccacatagccaagctggagcgctttgttgagctcgacgtgcgtgtaggcggtcacctacgagcgcttgtcgtcgtcatgtcggcacggccgctgctgccgacggtcggcacaccacgcgcacaaagggaaggtgaatcgcccgtcctttgtgcggtagccaagcaacggcacccggatgttgcgtggagcgagcacccgggcgagcagcagcccccggaagatgttgttttccggtgcattccacgggagcggtaccgttggcggacgcagcagcacctcgcgcgtcaggacccgtgggttgcccacagggaagcgattggctttctggtattcatcatgaatatgcgaatgtttaaaagaaaaacctaccatgacgtatggcggagaggctgacaatggccaagcaccattatctcc

SEQ ID NO: 1874 - DNA, 1208 bp, Heterodera glycines
  misc_feature (12)..(12): n is a, c, g, or t
tgcaggtcatanttagaaaaaaaatgaaagaaaagttcctttttatgacttctggataaaataattttatttttctcatttcgtcttaattatattttacacttctttttattatgttaatggcgtaataaaaaagtgcgattctgataaaattatattttttgatggaatattaaatgaagcaattaatgatgcagcagtttagcttgtcaattaatgttaacacttgttcgtttttgagtgatctttaactttttgtaaatgaataattcatgaaattaattctgatttttctctacagtagattaattttgtccaaaatgtgcgccaaatttcaatttcgctaatttgaaaccgccacaatttggcacctatgaaaaagcggttcaactgcagcagaagtgttttttcgttgcgtaaacgcctttttgtacgcagtccgataatccttgctaaattataatcaaattaatttatataaaattcatattattaaattccaattacacactttgcggtccttcctgaaatgaaaaatattaaaaaaacctaattaaaaattttattacattgttgtaattgttagcaaaatgatggaaagattgaaaatgatcgaaagtggtgtgaaaatgtttggcaacacaatccatgcggtcactggaggaatgattggatttttctcatagaaaatgagcacattgtcccgataaaaatccgactgaaacttataattaattaattaaccatttaattaaaaatgtctttttttaccgcaacttgcggcactttaaactgataagcgcattttgccaccataaattggtgcgtcattgagcttttaaaaaaaaatcccttgaagcttgcccttttattcgcactttgtctcagcacgattataattcataaatcagtaactgatgaatgaaattaatttaaatatttttttcttttttttttgatgaaatattcgaccaaattttctaaaatttattttgaatttaagaaaaaagctaaatgtttttattattggttgacaagcttttattcgtgaaaaaaataattaaaaaataaatatttttttaggtttttcaatacattgttggacccaatagccgttgaaaaattaggatccggacccggactcggtttcccggcaatacacgacacggtttttgccaaatattttatattcaatttttacatacttg

SEQ ID NO: 1875 - DNA, 1076 bp, Heterodera glycines
taatgtaggaccaaagaaatgagaggaacaaagaaatagtgtgccaaaaatttcactctcttgcccctctttgatcccatcattatattgtaataaaaaaaagcacattaaaacagcaaaatgagcagcgttcggttaatgctgaggcgcatgcttgcccgcttttaatggcgaaaaaagcgtaaagtgggcaaaaaaatttttggaacggcgctgcctttttggcggtgctctaattgttatttaaagttaaagtttctttgtggtataaccattgttaatcaaaaagactgccaaattaataaataatgattgtatttttttataatgttattcttaatcttcatatctattcatttatataaaaatttatttttcttatttgcttggtgttgttactacactgtttcaaaattccacccactcatttttagaaattgacctgaaaatcgcagtgttatgtatgggggttcagagtacaaaattatgaatggaaattggggaaaaggtaataatttattgtttaaattagagttgtacgggaccgggaattttgagaaaaattttaaattcttttattacaattttaataacaaaaaaagagagtttgccgtttttatgagttatttggttaaattcacaatttatagaacagacagaaatttcattttgtttgattggaataaaataattaatttcattaattaattggcagatgaattggtggaattattggaattgttttcattgccatcatttggctttaaattcaataaatttaatcatttgagcatcaccacaaccgccaattatgattcaaataatttaactgcaaaatttgcacatttggaagcgtcgaaaaatgtgaccactttttcgaatggtttttcagctcaatgatgcaccaatttgtgatggaaaaatgtgcatatcagttcaaagtggcgcatgttgcggcggtaaaaaaatacatttttaattaaacgggtaatttaaataattataaaatttgagtcggatttttatttggtcacaattacaacaatgtaattaaagtttaattttttaatattttt

SEQ ID NO: 1876 - DNA, 3306 bp, Heterodera glycines
caaatattttggttaatccatatctttaaagtattatttagacctaaccataaagccagtggatggatcaaacttagtgccaatttttcaggcttcaatttttcctaataatttgactgtcatttaatttcaaatttctacataatttacaaatacatgattttattatccgctaattggtgtaattcccatattatttattctgttatatgtggccctgctgtgcaatgaattggcgtgccaattagtactaatttgttgaattgtttgcgtgttttgaaacaattgaccactagcgctgatgttattgttgccaggaggtaagttatcggatcgtcgtaaatgagaagaaaatttttcaattctacagcaaatgcatcgcgatattgcaaaataaaaagtcaaaacattgtcccaattgtcctggtcggggcaaaagtcagccggtggcacttcaaacatcttttactgtatttacatataattgcgagcccttgtttttagcttcattcaaagtagctcacaattttttagctaattaaattctcggatttattcgttttattaaactcctttttgacttttcaccatcatttttttattgttcttcatataatgtttttcaaatttttggcatttttttacattatttcatggcattgtttaaatgataaattattacttctgaatgaacatattggcttcgacaacggaaaaaaaaattttggcacggcattttcaaaagaattccgcctctcttaaattcattttccaaattacaaacaaactcatttcaaaaaagagaaaatctcgataaaatacaactaaggcagaaaagaaattatttttgttaggcaatttaaatttatttttaaagttattctttgtgaacttttttgattgctttatcccaactaagaacggatacagaataccaataaaaacttgtggccaaaaatgaaaaatcaaaaacttagagattattttattttcaaattttttgacaaattatttgatttttcaaatttttacgaatctaagtgtgtggattgataaatgcttcgagtcttctagttgatacaatagaagcattaaagcgggcagcatggatgaggtcaggtcgaggatcgggctcgttgggcaaaaaattgtctgctgggatcgggcaccacgatcgacgaataatgaaaaatttatttcaataaggaattaatttttaactaatactagtgaatgggtatgggctgaacttagaacattttaaggtgctggatcgttttgtaaaagccgctattttagctaatttttcgacaaaacatggtataaaactttgcttaaaagtaacaaaattttatattcttggtatcattcgatagccaaccttttctttattagcttgcaaaatttcaaataaaattaccaaatttaaccaagttatggatggaatagaaaatttttttaaattttgcaggctaatagagaaaaagctgcactattgaatggtaacaagaatgtaaaatttaattgcatcttaagttatgccatattttgtcgaaaaaatcgctcaaatggcggaatgtacgcaacgacctagcagcgatttgaagaagggctcctgctggcgtctcagatagtcttccattggaaagtttgaaaaatttggaccggttttagcgagaatggaatttttgttggcaaattatttttaaaagcatattcaaaaaattctaaaaataaagtcagttttaaataatttaggccctgttttttcggtcggggtcgttttcgcgtgggaacgttttcgcgtaagtagctgtttaggactgaaattggtcggatttgtgcaaaacatccatgtttcgaatccgaacccgcatttggacaaatttcttaactttttaatttttttatttctttcggctaatatcttctacaataatttgtcagtttggtcggatgtgcgtcaaacggaaaaaataattaaaattttataaaaatataacaaaaaataacaaatttcagaacaaactaaggtcgcatttcatagtttcgggaaacaccagtgagaaaattgataatgttttcgggattcacattggcattggcataattgtgatcattttttctcttttatatgcaaccacgcgaaaacggccacgcgaaaatggccacgcgaaaacgtccaggcccgctgtttttttataaaggaacgaaaattttaaattttaatattaatatagttttcaaaatgctttcgaataggataagacgattcatttggcccaaaggaaaaaatgatgaatttttattttaaaagatcaatttgtatttgcatgtctgatggattatttttttctttaaaatttagttttatttttttcatatttattgcaaactaaaattatttcatggcaccgttgcataaattttgacacttttttgctgtccgagcagtaattgtactttaaaaaaaattaaagtaacacatttaaatgtgattggaatggctgagaattgattgtttttaaggggaaaacaaaacattttaatttatcatttatgggcatcaaaaatagttaaaccggaaataagaactaagttaatcaaacaaaaaaaaaactaacaagaaaaccatgagagcctcgaaaatctgaatcaagggagagtaccggtgaacacgtgtgtccaagtgtgttaaaaacagttttttgggttcagggttcaaatcttccctgtccagaaaatagttggtaaaatgaattttttaaaaaccaaaaatttcaaaaaatttggcaataattaaatttgtaatgcttttttgtcaaaccctttttaattactctgtttcacaaatctgcgctttacactgtgtaaaataaaaaatagagaaatttcaacatactttttaatcaatttttttttttctaaaacacctcaatttttttttgaaaatgagaatttttcaagttttcctggcaaaaaaaccaattaatttttttttgctaataaattctcgattttatttgaaaaaaattaaaaaattcaacggcccccaaaaacgaaaaattggcattttttgtgataaaattttcttctactcattgcccaatcgggttttctgctccatcccagtcaatcccccgacctggcttcccccgtgctccacgagaatttcttccccgatgggtccggcttaaccatggttgaaagatcaaaaaaattctcaaggaaatttttaaaattttgttatacttctttggcaaaaaatccataatataaaataaataaattttacataatgtaaaa

SEQ ID NO: 1877 - DNA, 5660 bp, Heterodera glycines
  misc_feature (5581)..(5582): n is a, c, g, or t
  misc_feature (5619)..(5619): n is a, c, g, or t
  misc_feature (5637)..(5637): n is a, c, g, or t
aaaaatttgaaaaaatgaattgttgatttttttttcataaacaatttttatttattttttgctttttttttgaaaatatatatttttttagtctattttaaattgtttattaaaggctatatttcataattaaaaatttatcatattcaagtaagaaagaaaaaagattaaataaattcaaaaataagtgttttttggttgcatttggcattttgatctttttaccaaacaaatgctgttgaaatgctcatccccatcatgccaaatcacaattggatcatcaaccaattcccaaatttgtttatatttatcactggtgatattgttataatcctgaaaaatttttttaaatgtttaaaataaaaattaaatttaaaaaaattgccgtttgagtaaaattagaatgaagaacaatggcagtgtgttgtatgctgttaacgagcgcaacattacgctaaaaaaagtagaagcaactttttttgtaactatttttcatttcctttgttaaccaaaatattacaaaataaaactaatataaccaattaatttatttttagcaccaattaagaagtattttatgcaattaaactaaaaacctggtgctaattaattgtttactttcatgattttaaaaattttgtggattaaatttcattccgaaggcagattcggagccaaatctgatatatcgataaaatttttagaatttttcgaaaaattcgtgattaaaaatgtaactgatctattgcttgagaattagaaaaattatgtcaagaaaaatttaagaattcaaaacttatgcaaagtaggagaatatttatttacggccaaataattaaccctaattacttcgagcctatatggaactttgactaaattctgttaattttcttttttttcattgcatacatttaaatggattgccaatgcatagcattccgcaacgccagcataatttctgttctttaacacgtaataagtggcatattccgcaatgctattatggtaattagacattgaatcgccttcagataaattagctcggattattgctttcattttgtttttgtcctcggaactgcgtgacgagtcctgctcaaattggattaatgactcagcagcagctttgcgcaactttttatgcgctttgccatcatcatcgtcatacagtgaaacggcaaatgaccttgaatacaataaaatcgcattttaatgaccggaagcgtagattataatattaattagaaaattatccgctgaatctattaaaacatcaatttcttttcattttgagcattctatctaagactgaagatatgaaggacctaattcatcagaaaccaaaaaattttgggacataaaaaatatatcaaaaactttgattatataccgactaatatagaaagatgtcgatctataatatttattattgatttaaaaattataatatcaattcatgaaaatttctaaacctgaacagacaattcccatctccatacacgtttatcttcttagcctcgatattgttatttaaaataaatttttgctaaaaaaatttttactcaattaattccaatggtttatttatattatttggtcctacagatacatttattgactcatttgagttttgcgttgttctaaattcggccattgacttggaatgttttaatagacgctcaggcacttttttagatttctaaaataattattttttaattaattaaaaatttctgacttgatttttcgatgttgatgcaacagttgattgctgactgttcgcatggttatcagagaaaaaatgggattcagtttcgaactgtcctggttttaatggcaaaatgtctaaaaagtttatcaatcagttataattttaaaaataatttttcccgtgaaacatgtaaatataaatattatttttcggtaattactttgccccaatataagaggttttaccctcatttgtggcttaaataaaaatttataaaaaactttcaaagattgccatttaagcggcaaaatccatcttagatctggttatatgataattttttctgaaaaatggcttttttgcctgagatacgcggcttttctgattttcatctttgtgctaatatacctgcttttgactgaatgggccccaattgtgtgacaccaacttttttattttttaacatttcatcaatgattttctcattccttttgtcccattgtccagaaatagtgtttttgttgatcaattgtccattagtgtattcattgatttccaattcaaactcaattggcactccattgggtgatgatggtcggctaacaacaagtttttctttcttttgccccccatcatttttcgatgctttctttttggcatttttctgttttggcacatcattcggtttggcaattattgtttttggcatattgaatggtttttcaattttggattttggcacatccttcggtttaccaattgtttcttttggcaaatcatttggcggatcaggaagcgcaagcttaaatagtaaaacattataaattctctctatatatgtacaataaaatagaagtaaattatattaaacacatgtcggtttttcgtattttatatttttaactccaaaatcatcaaaatgggcgttactcaaaaaagcacccaaataaatttattttggggccaattaaaaaaccaaccgcaagagaattgaaattaattgaattgaaatcccaaagtttgtctccattccatgccataaaatcaaggatgtccgcataattgacaaattcactgatgatgcgttttgcgttgtgcatattctccaacaaaatggttattttttcatgcgattcaatatttttgtgcaccttatttatccgtttgttttcaacaaaatcctttcgaaagttccaattaattgagccatttttatccgttttataaataaactgtttcgggccatcttaaaatttgcaaaatttatttcgtattaaatcgtaaatatccccatcaatataaatgttaaggggctgggtctggattgaggaaatttttttggtacagatccaccgaaaatgctgcctgcatcaagttcctgatcccggattgtaaccggaatattttttctttaacctaaataaatttctaaaatttctcttgcatttgacctagatcaattcgctagaatttgtcactcaaaaaatcctcctgttattctctaattggtgaatacaataaatttataccgtacgggccaattgctacgatcagtctgtattgtatgtttggtacaaaattgtatgtatcattggcattgctctccgggctttttttattaaatttactgaacagatgtccaaaaatcacagctggtataaatgccgtaaatgttgcagtaaaaccaaatgaaaaataaaatttaatgcacatattcgaaattatgaattgaatctcggatgttgtaaaaagctgaaataagaaaaaaaagtttgtgaaaataataattgtaatagcattaaataatcaaaaataattttatttcttaacaaagaaatcattaaagcgaatcaattattttgattattaagaaattctcataatattgcatttttaatttaaatgcatggtttttatacatttattttaacgtttacgaatagagccccgcctcctttaattattgtagttaattagggctaaggttaggaaaaaatatgctgacaaatgagctgaacctaaaaatgtatcaggacgaacctaataaagtatcaatggacgaactttaaaaaagctcaattgagctaataaactaaatttgacctttaaacataaaaataaatattatcaaaactaaaataataagcgaatactaatataaattataaacgcaaatttttttcaaaaagttttcaaataattttttaaatattaattattctccgattttgcaaagcactctattcctaaatatttataatttgatgaaaaacataacaacgcaaataatggtacccggatcatatatcatcattttgacaaaaattgcctaacattataaaaaaaaatatggtgcaaaattttgaaaaaatcttagtttcgggattttcgatcatcaacagcactagaaccaaagcaaacataaggcaaaaaactttgggcacttaacaaaattcaagaaatttcgtttatcttgctcattccggatttctttccttcaagccgaacattcgaatcataaaaattttcaacagcatcagcaaaaaattattcattttatggcttctttcagaaaatctaaaaaaaaacaaaagcaaaaatctttgtcagaagcccctttattcaaagcatatgcgttgaaaacatgcaaaaagttattttttacaaagaggcgtatgatttcacttttctaaattaattgaaattttccttttcctttttctttttttattgttatttaatatttattaaaataataaggaaatttttcaaatttcagaaagcagctcactaagacgttttttatacagctaattagtccatatagttcaaaatatttttttaaaggcttttttagagaattttcaattttttgttgctccaatttctatgtttttgaaaatttctcggtcttcagcagaggttaaaaaggccgcttaatattttaaaaaattttaatttacctattttgaaaataatttttttttcatctaattatttccttttaaatttttataaattaaatattataatatcaagaatgaaaagagataatttagttcctaataaggataagtgcgtgatgcaaatgacaagtcaatttataattaatggagttcttttctgaacaacacaaaaatgaaaccatttataaaagcctcattaaaagcatttaatgatgtattaaaaatgttgcttaaagttattcacttgacttaactctattttatttctgtgaatattaaaattattcatttatttcaatttaaagaacaaaatttcatcacaaaaatttcccaatgagtgccatatttggatttataatcaacctattctgttggttcacgtgcggttttttcttccccgatgggtcgggcttaaccatggttgaaagatcaaaaaattctcaaggaatttttaaaatttgttatactctttgcaataaatacataatataaataaataaatttacatatgtaaaataaatgtgagaaatcatttgtcaaattgtttcatttaaaattccaaaacgagctcttcatcttcttcttctgaaatatgcgttttaaaaatgttaaaacaaaaataaatacatatttataatgatcagaaagccaaaaatttgaaaaatgaattgttgatttttttttcataaacaattttaatttatttttgcttttttttgaaaatatatattttttagtctattttaattgtttatttaaggctatatttcataattaaaaatttatcatattcaagtaagaaagaaaaagattaaataaattcaaaaataagtgttttttggttgcatttggcattttgatctttttaccaaacaaatgctgtgaaatgctcatccccatcatnngcaatcacaattggatcatcaaccaattcccaaattntgttatatttatcactgntgatattgttataatcctgaaaa

SEQ ID NO: 1878 - DNA, 8159 bp, Heterodera glycines
  misc_feature (4570)..(4570): n is a, c, g, or t
  misc_feature (8147)..(8147): n is a, c, g, or t
atttgtcgactcgcgcatttccagtctcctccttgcttttgaacatgggcacaagagatttgtgatccgtgaggactctcgtcggcagcattgttataaactgagcaaatttctttgctccgaatctcactgctaacgcttctaattgggacagccgtaaccaacaaaagcagggggcaaaggcccatttttaaattgggacaatttcttaaaattttgccaaaattttcccggctgcgcctatttgtcacccatggaccggtgatttcctttgataatttttaattgaccaaatattctctgaaatttttatcatttttgtgcaaaaaaaaaaaacaattttcttcaacgccaactaaattttggggaaatatttcactaatttgtttctggttacgggcatggattgtgtgtttgtataaagtgaatttttgattttcggcaccgattggaccgccttttcccatcaaaggcccgactccctttgcccaccgtctgtccctttcgcttgggcttttgctgcccctttctcttcgtccccctcaatgtcgctctcctcgctgaccagctcgtcgtcgtcctccaccagctcgaagctgcgcaacggcttgaaaccctgcaaatgagtttggttttcaatttttggcacatcaaaaaaaaggggaggagtttcccttgggttttttaattttttaaagcccccaagtccctcaaccattttacacacagtttggtaatcacaaaaagacacatggaccaataacaatgctataaggtgggaggtggaaaaagaaaacaaatgacgacggtttttttcgataaatcccatttttacgacacaaaatttggatccagaaaaattggggcgtgcagaagcagcacctttctgtccattgcgtcctgctcagcgcggtcgaagcagaagcgccacagcaacagaaaaagggcacagcaaccgcaacacaacaccaaaaggagcaccagggcggacgagccgtacacaaaattgctgtacccttcaaagcgacgggcatcgtctgcgaattcgaaagcggaaaatgggggaagcgattataatgtaatgtgtaaatttaaataaatacaaatgaaaaattcggaatttattttaattgacttatgtctcggtttatttacgatttttaaaatttaataagaaaaaattattaaatgtatgtcatttgaaaatacaaatgatccgcctgaaattatgcgataaaattttgatattgtcatggggtttatattttttaaaaagttttatgcattaaagtgggtcaaaaaaaagtattgccctcccaaattttccgtgcctttgccatgcccgtctctctctccttttttaccatgatttggtgagctcaaatgcatgggattcgccaacatttcgcgtccccgagcagcaaaagactctttggccgcttccggttggatttccaatgaccacaacactccttccccgttggcaatctctccgacataaacctgtgtcaattagtaaaaattttgtttgtttgttttggcattttttgggtttttgccgaattccccccttttttctgattgccaatttccgtcacctgattggcccaacagcgcaaaacgtggggcagtcgaaagggcgcgaattggccacggaaagcgtattgaattttgggctgcgtggcattgtccgagtcggcctgcggcaccacaaaaatcgcaatttcctgtgcctggccgtattgagtgtacaacggagtgccgggcactaaataaatttcggatgaatttttggtaaaattttccatagtggtgtatttttctgagatttttcagatcgattcttagggttgtagttttcattttaattgcatttttgttaataattttttaaatgctgaaatttattagaaaattcctcaaaaccagcaccaaaatgccaaatcagcacaaaaagtaaaaatcgagaaatagcaaaaaattggcatgaaaaaagtcgacttagaagcctaaacccgccccaagtttgcaaaaaattccatattatttaaagattattatttatattcttttattataacaattttattattattcttcacgaaaaacattggccatttacgttcatttgtccatttgtggccctaaagagggccgtttgggttaagatgttgttgcctctcctcctcactccgaatcagtagcgcccgcatccacagcaaagccgagccgtcttttaattgtatctaaagatgctctcaactggccaatattccttgccagctgccgcaaattctgctcatcttccaaagtgatgacatcagccccaaaaacgcgctcggcaagaacaactgctctgcgctcaaaatgctccttcaagccaatgaggtatctgaactcgcggagcaacgctgacaatggcaaagtgtcgagttggtcggcgctgaatcgtaggtaggacatctgaaaaattatgcttccattaataaaagcttaagccacgcacactgcgctaaataacctttttcgaattggaggacaaagtgcaaaaaatgaaaatattggaggaaattaatgaattgagagtgaataatgtgcggtgattggcgtcctaatgggcaattaatgaccaattagtgaccaatgatcaaagagcacaacaaacgacgccattttcaaaggaacggcatggaatagatgaccaatgagcaattgagataaacgactggggggggggagggggggttgagaatgttggcctctgaaaatgcagtggatgcgacgcgaccgatagacgccaaaaatcagcgcaatggcattcaaagacaatttaagagtttcgacgactgattcaatcctgctaggctgaaatatttaagggatttcgagtgtgactaattatttggtaaaatgattgcttagttaataattataaatgcggattcaaaagtcttaaaattttcgataattgtaaaaaatttttgaattcaacaaaatgttgggagtcagatttggctcaaatagacacctctgcgaaaagggattttttttaaataattcaaaatattcttggctaaaacttggatttatcattgctgaagagcctctactaaattcgagactgatgacattaacaagaagcgaaatctttccaagattcgtgaaaatcagggcgacaaataatctctctggatggcaaaaaacgaaacaattggcacgccccggagggtttcacggagcgtcatcggacagcggcaccgtcagtgtcgatgtcccccactccgccgacttcgggcggacgcggaatttgactttgtgggtgtggcagtgattaaggaaggacccaaatgttcagaaccggcgcaagatggtccttacccattcacaacccgagtacaacagtatccaattgaccggcaccaggccgaataccatatgtatgtgggaagagtaccgtcccaatccgtcaataggatggttctgaaaatcccgaaatttcttcagagagtttgttttgcatttttacaatttaatttcaaaaagccaaaaaatccggaaccaattttaaaaacgaaaatagtgcacaaaaggggagccgctcacggtgggcattaaatgcagtgttaagcaaaatttaaatcgaaagtaacttttgtatatttttttatattttaatttcataaaaacagacaaaaaaaatttgataccattttggaacgaaatagtgcataaagaagggaggggtagacgaaaagaaaaattttagatgtccaattaaatttaatttcaaaaagtgcaattcattccaattttgcttcgaattcccattttgtccaatgtccatcgtcatgttttgaacaattcgtccactctgtggtcaaattgggcgctgatcagagcaatgccaaagccaagctgaaaggacggcagcaaatcgaacacattgagccaacagtgtgtagagatgaagcagaaaaaagaattaattgccaagtaaaaaccaaatcaaacaaaattgaaaaagaaatgaactgaactgaaaaaggattatccaaatttaagttgacgatagtctccgaaaatttacattccccgaatacaaaatctaacactcatctcatcaatgaccaatattttctattggttcaaaagctgcgaatttatctttcctccgccgaccaccgcctcatttcatctgctgcaattggtcaaaatcaacagcaaagccgggttcggttgtgacgtcatcttttggaagaaagtactgaatcgcaaatcatcgccacataatttacggcgcctcggacatcgaattttcggacgaggccatgcgcaaggctgaacaattcaagtgccagggcttcgccggactgcctggctcgagatgagcaaacaatttgaatggattattcttccgattttatggtggcaagaattgcattgggtgaacaacggcatttgccattgttaaaatgttcatcaaattaaattatgcttaatttaggccattgtgtccaccaacaaacgaagaagcgggacaaagcggaggaaaggtcgcctaattatttgnggatcaattaattaattgcattagacaattgccgatcatttcgaataatgttgatttgtatttgaaatttgccattttatttttaataattcattttgttcaaattttattgctgcgacggcacttttcaggtgagtttttccgcttctcggcttcgctacttctccctggtgatcgatcggatgctcagcgtggaaatgagggagaagcagcagcgatcggtcactttgaacgaattgggcattgacatggaccaattttttgattttcttctgcacattcgtaaatgcactgcaagaaataattcttctaaacactaaaaagttttcaaaattcattcgaaaattttaaacaaaatttttttgccagtgcaggtcaaccaaccccaatttctattgtatttccataagcgacagaggtcgagagttccttctccgaatccgatagtcattcttgacgaagtttactgtctaaggttcatgacatcatactgtctgattgggttcgcttttgaatcaaaagggcaccattcagagacgtgcgaaaaccaaaaaaataacttccgaaaaagaaacgaaaaaatatttatttttcacgaaaacgaaatgaaaatttaaaattttagaatccgaaaacgaaagttttttgttggcgaaaacgaaacacgaaaaatttttgttaatttcagccataatcaagaaacataaaactttaaattgtattaccaaatttaagaaattgaaatccaagatattttggaaaagagtaaaaatgaataaatcaagaattcttagctagatcataatccgaaaaaaccggtcaaaaattcgccggatcggaccggattggcattttcaaaaatgaccggtttccgaacccggaactctaatcgcctccctaatcatcagttgatcaactctgactgactctcgaggaaatgtttccgtttaaacagagggacccgtgggaaaagaaagggaagagaaagctgacaatgaaaaaagagaaaatgttttaaagcgaatgtggataaatggcgctttacaagaacaataccgcactttcactgatcaaagaatcaaaatcggaaaggatctttttcctaaaatgctcgtcaattcgtcctcctcagtccaacaatttctttgccgtttcgtcaatttgtgccaaaattttcgcttccatttctgcgcacaatcgcaccgccgcttttcgcattgcgtcctttccgttgggttcggccaaactcaaaaaggtttgcgactttaagagtttcttttccacagatgcccaacaatttttgttctttcgaaacttttggaacactttcagtgccaaaatcatttcctctgtcgccgccgttactttgggccgggtatctttctgtaaatccggcacattttgaggaggcaacggtttgttggcagtccacagcttcacatagcctttctacaaaatgtttaaacaactatattcattaatgacgcttaaacgatttccaacttcacctgaatcattttgttggcgtccatttggtcctggaagaatttttttccataatcgcccccaatgccggctttttgtccttgcgccgaaacactttccaacacttgattttcccgtacaaaatcatcgattgagattttgtgatgaaatttgtaattgaccacgtccttggccaacatcagccgttagttagccacgccgacgatgaagtgtcgcggtttcttggtggcctatgattttatgagaattttatttgctttttcttgtacaatgtgatcactgatcagacattcattcattcatttcccattccatcctttttttgttgtttcataaattctgaatcactacttttaatcgctttttgttatatcattgctttctaattttccctaattaggctgttcagaaatgagcgatcatttcgaagcattgacttctcgagattgagaactttctgaggcttaaggccgagaatgtcctcaagactgacaatgggccctgatgagtcccgggctacgcacggttcacagtccggaccaacaaaaatattttagagttcgattcacacggagttcagttaaatcgaacatttttttcgggattcatcatgcacatcagccaaaagttaaatcacttttgaaattgcatatcaattagagattaccactccatccatatcaatcggcaattcatttttctaattaatttttgtatatatgaattgtttaattacccatttgctgtaaataaaatgagtagtgaaagtgtccgtttgctttttttttttttgcacaaatgcgactattttgggtgatcaccactgatcagaacaaagaaaagaataaagaacagtgacaaaagaataagcgactgatcggacgacggtcccttccccccccccccccctccgttttttacggaaacaaatcgcccaccggtccaaaagcattcattcattcattgctcgtctttatttgcgcatttcgttcgcctttctttagtcgctggtcattcatttcctcacactttaccatcactcattttttggtgcttttccttctcccctttgaattttcattttttaaattttctatcacttttcattaaaattttcgattttaacggagcatggacaattaaacgcatttttcagttgtttaaagggcatccattacagtcgcgccctgtcgccgctttttcaacgattttggcaattttacatcaaaaataaatattctgtcttaatgttgcggcatttggccatcctccgccctttgttcgttctctcttttttctccgtttctcgtgcccatcgtcgcttccgccatcgttgccactgtcaccgcgttactttacatccgccgacagagacaacgaaaacccgtggataggtcagtttaagtaaaatccgaatttaaaatgtcaacaaaaatgctaatacattagtggatatataagcaacagaattggaatgtcagattaaaagttcatttgaaatggcattttgaaggtcattcgagggaaagaaggccatcctttccttccgaagattgctcgctttgagacatttgcttatttatatttcaatttttggtgcgtttcccccatcctctctttaattccataatttaatccatcctcatttagcaaatgcatcacatcaaagaccaattcatttgggtcgggctcagttcgtcgccactaattttaactctcttaaaaacgaaaagggggacccatattctgacgtcacttttgaccattcccgaatcctgaattaaaccgcatttttcatctttttatgggaccaataagtggtgtttttggctctagtgcactttatgagtccaattaattgacaatcccgggtttttatacaataactttgttcatattcgaacaaaccctatctttttggtaacattcgaaagcacaaagtccaacgaagctaaaatatataaaatctcaacgtttaggcaattacgaaaaaagaactgaccaattaagcaatattgattattttcgtttgtaacttttttgaaaagttagaattttcttgttttcccgntattattacatt

SEQ ID NO: 1879 - DNA, 873 bp, Heterodera glycines
ttaagaaaaaaaattgcaatgaaaaaacctgaaattcataatttttcgtgtatattcaacaacaattttttgtttattgcctttgtccgagaatttttttatacaaaaacaactgtgtactttaagctctcctcgatcaaatcaaaacacacactgggcacaaaagtcgacaaaaaattataataaataaaatgtaaattcacaaatggatgataaaaatttataaaagagaaaagccggatgtttttttaattaattatttttttattaaaattttatcccatttattccgacctttgcgtagcaattcggctgacacgaatggttgatgaaccgcgcgaaattgccctttttggtggcgtcaattacctgcgaaaaaaatgtgaaaatagattagaattaaaacactcttaagcttcaaactgcaaatgaattgaaagatcgtaatattaaagcgaaagcgtaagaaattaattttcatgaaaaattccaaaatatttgatttggaattaaatttttaaaatttgacaaaaatttgtaagttccgattcaacacaaaagtagacgtacattgtggtcgtcaatgcggaacaggtaggaggagccgatgccctgccgctcgtaggccaactcacgcacgttgttatttaattttggagaattgataaatccataaaaaattgccgataaaacaaaatttctgatttttgaaggggtgcaaaataattaaaaattttttattcctcataaacttatcggttgtttttgtattgataatcaaaaaatttcttaaggttttcggcagtgaagctcactgttgacccactcacgcatccattcagatttggatttaattttaggcataatcaaaat

SEQ ID NO: 1880 - DNA, 3023 bp, Heterodera glycines
gtgctgtacgtacgtacgtacgtttttaaatttgactttttattgacacgatctctttattttttataaatatatgaaattttttgctgacaagtattttatttagggttcgaattttttaacaattttttacaaatttttatgaaataaagtaaatttgcttatgttttttaaaatatttatggtttagtggttagttcttcaacattaaccatactttttgttatgagttcgacaccgcgtttacgttttcttttgattttttttccaaataatgcagggtttttctatgttgttatttctaagaaatgttctggttttggggttgtaccttattctcatctaaaaaaaggaaatttctaaaaaaaaattgactaatttctaacaaaattcatataaagtcttaaaaattttccgcttgcggcgccaatcggcgctaccggcctctcccctcgcacattcaccaagttttttgaaatgtgccgcaaaaaatgttaaaaatctgatttagtgatcccgaatgcactgaaatttatgaaaaatataataatagaatacatttttgatcgaataaaatgtaaaaatatttgaagcaattttgcaaaatgttcttatttttgaccctaaaatcttattttttggcctttattcttattttgaaaattttgaaatagaaaccctggatttagacaaaaacacccataaaaattgactattctggcataattttaatccttaaatttggtcatttttagacaatatctgtgcaattataccaaaaaagaattgaatcgaggcgatatatcgaataaaggaatgtggagccaaacacatctttcaaaaaaaattttttgtgagattttttggagctaattaaaaacaaacccccgcccccgtccccgggggcgagaaatttctcacccccgcccccgcgactctgacccccgcaatcccccgcccccgcgaaaagctgcccccgcccacggggtccgaaccctatttttcccaaattagacgggtctcttgatattttgggcccaactaacaataagccgggtattcaggtctaagtccaaacagaaactagtacacgtttaactctacgtttaaacatatacgaattaacgaaataagattgccaggtttccatacttaaattttttaattttcaagaaaatacaagtttttaagcacaaggtttgttaaaggttactaaattttaatgatttattaacattttacatatttttttgttttatttttttgaaatccctccttctggtgcccaaacttcccggtgcccaaatttctggtgcccaaacttcatgtcgcctttgaccggcggcccggggcggtatttttaggcaaaaaataaaagtgaaaaatattaagtatttcaccttaaaattgggcaaaaaaaattttttttttcgtattttggtactgaaaaaatcaaatggtacatcgaaattgttcatccgatgactcatcaatggaaaaagggacaaactttagcaaatttattctctttctatctgatcactttggtacatttaattgacttttttattcagtttcaaaacagatcaaaggatgcgccttataattaattaacagcaaattgaccaattctctttttttacaccaattttttgtgtgcttcttaattacatatttatagtgatggtatgctcgcctaataactggagaggcgggaataactgtgagaaaatctattgtttaaataataattttttctttatcaaccaaatcaaaaagcctccgcagttggtcggtcgttcagtttttttacatagcttaaggataaattaaaacaagaaaaacattcgaatgacttcaaatttattggatttaattgatgagaagaaaaaagttatgatgacaaattgggtcagtcggcgtcgtacgtcccccccccccccgcccaattagtgatgctctgatgctaatggtccaaaaaaacaagagtcagaccgggggccaaagtcgtggtgaaggaaatgctaaacggaaattcatgatcaatttttgcctagggaacagggatgggccaaatcggaaaataaaatgcgaaacgcgaaatttgcgaaagtaaaaaatgcgaaatgaaaataaatgcgaaacgcgaaattccaaaaaacgcgaaattgcgaaacgcgaaatttttctacaacttttttaatagtcaaaatcataaagcattttgtaaaattctatttcaaaataaaaagcttttttgcggcgcgttttttcaaaaaaaattttgggaagtgggggcaggcggcgccggtagacgccgccgggaaaattttttaatacaatttgttaatagattttcactaaaaatgttcaaattttcaatttttggacaatttttctgtgaaaaatacgagtttttggggtcccgcggtgcctataggcgccgctgggaacagattttgaaaatttgagtgtattttgttaacagattttctccaaaaaattaccaaattttgcgattttgggccatttttctttgaataaatagaagttctcggggcatgacggtgccgataggcgccgccggggaaaaatcggaaattttgaccatttttaaacaggttttcactgaaaattagccaatttataggtccaattttgaaaatttttgaggaatttcatccctcattcttaggggtgtaatattcgcgtttcgcgccaaaatgcgaaacgcgaaagcgaaagtgccaagaaaagcgaaatatgcgaaagcgaaacgcgaaagcccatccctgctagggaactcggtattcccgagccttcacttccatctctgaagaaatttgcgacttttttcgaggcgggtgaactcaatgattaactgtcaaaaaacaaatcggtagcagaatttcgatgctaatgcagggctcgggtctgtcctgatttgtccggtttgtcctggtttggaggtaacgatcaaaatttgtcctgatttcttaaaattcttcagaaaatttgtcatt

SEQ ID NO: 1881 - DNA, 1974 bp, Heterodera glycines
  misc_feature (115)..(115): n is a, c, g, or t
caaaaatattattttatttacaccaaatccggtagccggactggttggaaaaattggtacccggacccggcttttctggacccggcaaacccggaccgggttttgcataaacacnccgaccgatcctgccccattttaagtgcatggtttttttaaatttagtttatatttttcaatattttaaaatataaagaatgacggggggtcaatagtcatgtctagggccgcgaatctcgaaatagttaactaaaatagtgcgggaaaatgccaaaatagtgacaaaaaatccgaaatattgacgaatagagacataacattcagccaaaaattgaacaaaaatattacagttgtaaatgaagtactttccaaattttgaggcaaaaaaacgcatcagattaccgaataaaaaagttttgtaaatggagaaagtcctttgaaatcgcaagaagtgagaggcgcgaatttgtaaaatggaattatggtgttatggtgaggggaacatcacaatacggatacgatttttaggttctaaaaaaaccacaaaatatgtgctaaaaatggaaaaataggtgccaaaaagtttcaaatttaggggagtaaaatcgtaaaatttcatccaaaaagcaacaaaattaacaaggacgggcttttctggcatataaaatcacaaataggcacataaatagtcaaaaaacccagaataagcacaaataattttgctattttctggcccgcttttgccaaaatgatttataaaaagcgtatttttctattaaaatctaagacagaattaatcacaaaattataaatcaaaatttttggtaaagaaaaaatggaaaaataaatttttatatgatattctgaagaaccgttctatctttgggtgtaatttttggaagttttttttttgctcttttgtgattaataaatttttcaaccttcacttaagaatattattttggttttaatctgtatgaaaaaatcccgtcgctgctaataataaggtttaagattttccttccttcctccaaaagtttaaataattagtcaaatgaaacatatctcgtggcaaaataaatttgttgcagaatttgccgcttcccttcactttgttgattaaattattgtgatttggaaaagagggaggaattatctcttcggcagtttttttgagtgctttggcattttgtatttgcaaatccttttaatatcgtgagtgcaaattgggtggagatgggcattttctattgaaccaccaaagcattttatgcggctgtcacattttgtaagggatgccaccgcgcggacatgtgccaagaaagcaatattcttgttggcataaaattgttggcataccacggattaattgggtaaaaatgaaaaattggaacgatgtgcttgttttggtgaaatatttgctgctggaacatcgacagagatcagctgacaaaatgagaatgccaatatgtgcacaaaataatatgccaaagaagaaaaatggcattaatttgagcagaaacaattttggaaaaatgccataaattgcgtgaaacgtgccgaaataagaaaaatgacatttcatatattgaaacacacgaacgcaaaaaatgccaaagaaagcaatggaaatatgccaaaaatacaccaaaaaataccttcaaaagaaaaattgcatttttcgtaatacaataacttaaatataatattcaataagaattatttttaatttgaagtcatcaatttacataaaataccgtacccttgtatttcgtcacattccaaaactggttgctgtcggtggcgtggtcccactaaattcgtacaaaaatgttattggaatttcgtaaatgggaactccataaccaaaatgacaataaataatttttgtttggttttttaatttccattcacgcccattaatgaattcaattaggtaggtttttgcgggtgtttctcccatttgcgcggtcgaat

SEQ ID NO: 1882 - DNA, 2516 bp, Heterodera glycines
ttccccccattaatttttatggtgtggctgccggggacacattcttatggctgagttcgatgctggtttcatttgaaaaaattaatattaaaagacgtttcaggggatgaaagggcgcgcgaaataataggggggggagaagagattatatgtcttcaatttatccttaatttttctgttcttttaaggcttgttgaaaaaatattggactttcaaattaattaattaattattctattttcaaattgattaaatcgattaaaatctgtgcaattaaattttattttcaaaaattttatttcattcgttttgtatatgggcattagcaacaacaaatttgctattaaaaaagtaaaagccgaaactaaaactacaaaaataatcaaataaaaaagaaaaaataaattaaaaaaagctaaaaggcgttatttatgctgtgctctcctgtcaatggtacatcagcgaactcagtgcgcttcctccccaaaattcgactcttctcgaaacctaaaaaggcaaacaaaattaaaaaatttttttttgattaaaaaatattttgcctaaataaaagttatgctccattttggcacctttaaatgtcaaagctattaattacccttttttaaattatttgttttttaatttgtcaaattgcccaccggctgtcccgtgtgccgtcgttttcgtcccgttgccccgcaacagtacatgcgctgttcctgctccgccacgtacttctccagctcggccagcccgctgaacagctggcgcttcctgcggcctcctcctccacctccgcagcagcagcaactctgctgaggcgggggcggcggcggcgccgcctgttgctggcagcagcagcagccgccaccgctgggcagccccgtggcatcgatggccggcggacggagcacagcgagcagttggagcagtacaaacagcgacagaacgcacagcagcaacggttgacgattgaaatgatttgccatttttgtgtggatttctgatagattttattcggttgctcaaaaagatgaggagagtgtattgacagtttataagccaaatgaacaagtgattcttatatcataagagcaatttttatattccctctatttgagccaccctccaataaatttgcttttccagggggggggttgaaaaatagaacccatgtggctctaatagaggaaattcagcacaacagggcagtggcatgtcatgcactaatattttctaaggcggttgacttgaaagctttgtgacggaaaatattaattgctatttctagtatttaatctgcgttgctaaatttttctcgcgtgttttgtgcggttcaattggatggaattaaataagagttaaagccgtgattagcgatgaagcggttgatggtcaatgcccttttatacagtgtttgattcttattcgtgcatccgcccgcttataaaaatccgatcagatccgccaccaggcgcctcaggcgccagtctgatcagcataaagaattgatgcacataaatcccgttcgtaccacataacaaatcccatgccacacaaaagttcgttattagaaaagtgcaagagaagcattgcattgctttaatggttgggcggggagggggtaattggattatgcttatccgaaagtggaaaaaccaaatctaattaatcccaaccaagtcacaagttggatcattaaaaacgcatccatggtaatttgacagcaaaacctttattgtcatctaaaagaaacgattggacaagttgttgatcaaacttgttcggactgcttcaacatctagtgttcttaaacgaaagaatattaagcattttagaaaaattaactattgacctttttcgggaaattagctattttattttccaaattaatttaaattgtttaaaaaatcctgatttttcctattggccttgaatttaagatacacaatctgaaaattaaacatatctacaggattatgtatttgaatttagtacatgttggaataattttcgaaaagtatgaatttaaaataaatttcaaaaataccgagtttccctatcggcgcctgcacttggcccttgcttgccccttattcagtcagaacttttattttttttttggaaaatagcgtaccgtaatataaaaatgctacgaaaaggaaaaataaaatattttttaaaataaaaaaacatttaaaaaattgaatttggagtcaaaatctgaattttatttgtcatgaattaaaaaataatctattgcatgtcatcgtaaagcagtaatcggtcggttaacgacaaaaagaaataccggtggtaaccaagtgtggcaaaacgggttgcatccaataagcgtggcacaattttaaaccggtccagtcttaccctagtttttaccttcatacttatggccaattcattctgaatcgggtcgattactaactcaacaattcattattttgttgttttgtaaatatgttttattcattcaataattattgtaaaaaggaactaaa

SEQ ID NO: 1883 - DNA, 3428 bp, Heterodera glycines
  misc_feature (66)..(66): n is a, c, g, or t
caggcgacgcgtcgctcccactccattagttcgctgagcacgccctggcgcttgcggcgcccacanccagctggacgggggcggcgccgcctgctgctgacaacaacagcacatgcttttcatcggcagtccggtggcgtcgatcagcgcgacagcaaacgcaagcagaaaaacggcgaaaaaggcaacagcggagggggaggaaaagcgcatctgagagcaaagacacttttattgaattttatttaaaatgaaatgtcaaaatgcaaaatggatttaaatgagggccaaatccaaaattcgtgccggtgtgtgaaagcctataattctataaaatcggaaaatttaaaaatgtccattcttttgagtaatccaaaagcataataggagcttagctggtcaattttcttcaataaaatttggcataataacacttgtctaatcgctatttggattcatgaaagagttgaaaactgatttggaaagatcaacgatgtgataagtggcactccgtggcgaaggatcgctcatttaaaagcattttgccgtcaaacggtctcgttttttgtttcgcagctttctcgactgactgactgctgactgttggttgatcggaaatgcatggttttgggatgtttcgccaccaattgatccaccaaagtgaccatcacattattaaccagttttggtgaggcgcgaaaatgcaattgctaacggcgaaagcattttgacgctaatattttcccaaccaattagcaaaaagcgaaaattaattagcataaagcgaatgctctgactgataattgtggtgaagctgcgggaacagcgataaacgataattgccgaaggcaaattatgttttaaacttccttaataaaactgcaaaggaaaaggctaaatggcaaaattggtcaaatctcatattaggggtgtaaaaaaaaaattttggagatgatttttgaaaaattttttatttcttagtgtattgaaaattttgggctaattcttaagttattttcctttttattgcatttttgttaataaatttgttagctattttaaagattttcagaaaattccttaacaaaaattcaataaaataaaaaagtacaccctaagaattggactttgttaagcattgcgaccaaaagccacaatagttaaattttattttcaaatttttggtaaaaaagctttaaaataactgctcaagaacggagtagcacagaaacagcagccataaaaaatatcaattaaaaaatccgtttttatttataagagaaaatatttttggaattcgctatgtttcgaatccaaagtataaaaataccaatttttttttcaaattttttcgcgttgggaaggcaaataatcatacataaaatgggtaaattaataaatttaaaaaaataaaattaaaaataaattattaaataaatataatatttaaactataggctcctcggcatttgccggttccgccgctttgtacaacgcgtcgcaactgcgcgttttctcctcgccctccccgttacagcagctctcgtcgcaccatttgtactcctgcgattcgcacgttcttctcgccctccactcttcgtcctcgtcgtcccctttggcggtgtacagtaacgtctcattactgtacttggtcctttcactgtagcatttcatcgtgaagcatcccttgccctcgccacacactcgcgcgggcaatcccaccgcactgtcacccgcgttcaccttcccgctcagacaggcaatcgcttcaaaataacgtaatttatatttagatacaaatttttagagtcggggtcgttttggcgcccacgttttggcgccgacgttttggcgcccacgttttggcgccagggtcgttttggcgccgacgttttggcgcccacgttttggcgcccacgttttggcgccaaaatgtagagaaagggcgaaattgtatatttttttgttttttcttggagtggggcaaagtctataaaaggagcaccttcctatgtagtagatttagtattttttttattttcattcttcaaataacgcatttttgttttttcttgtttaggaaatgatgaatcgtcaaattgatacaaaaaagcaaaagcctaaaattacctatgaaggccagctttacaccttcgataaatcaagtgcggacggaacgagaaaattttggagatgcgaatacaagaacaactattttttcaaggattctgctgtttgggcgtgaatcttttgggcgttgggctcagctgtcatcgcattagacacggagtttgggaacgtcgcggcactccgaccgctcattgactggttggtctcatcattatcagaagtgtacttcaatttttgtgcaatttttaggttgctcaacaattacattggacaaccgcgaccaaatgggacttggtctcaaccactcttcccaccagaacaatggaacgtctacactcgcacactgaacggggaagaaaggacgaacaaccacgcagaggcagaacatcaccgtcttcaaggcgccttcaactgccgtcatccatcgatctggcacttcattgacgttctccgccgtgagcagaagggcaccgatgggaagtatgcgtcatttcttgctggacttgagccaccgcagaaagctaagaaatacctaccaagcggctgatgagcgcctcttcaatttggtgcagaattacatcccggtgaacccgaacaatgaaaatgatcacaattaccacataaatccaaattttcatattattttggaatttcttcgtggcatttcgcgcaattatcatatgaacccgtgaattgttgttattttttcattttgttaaattttacttatatttgaaaaaaaaatctttttcctttttgtgcaacatttttgaaatttacgtctttccctttttaatttttggctccgcgccaaaacgtgggcgccaaaacgtgggcgccaaatcgtcggcgccaaaacgtgggcgccaaaacgacccagtccaaatggtagagccgctttaattgtttttgagaatttttattttaaatgactttttaaactcataaaaatttaatttaataacagcaaattaaaatttctttggaatttgaaaattttgagaaattaaacggatttgaaattttcaatgcgatcagaaatttttctgacaattgatatgagaggaccgacgagagaatttttaacccttttgctgataagcaataggtaagtagataaaattatttcgctcatagagaataaaaatgaaaaaaaattttattaatgttaaaaagcttaaaactattttggatatgaaaaaacaaaaataattatttgcagggttggggaattgaacttcaaaaggaaaaaaaagaacggaaggcatagaccactgggccagagacactcacactgg

SEQ ID NO: 1884 - DNA, 2269 bp, Heterodera glycines
cgaaataatgcttgtggggaaagaacgctgaaaatgtggaagggaacgcttaaaaatgggaagggttaatgttcactcccaggtcaaatcgataatccattcctgtgctgggcaggaatggatgcgcacagagaaaagatgagaaaatatccctctctaccctccccacccgctccccacaaaatttgaatttcccctcatctgtcactttggtgaccaatcaaaaaatttttctgtcaaaaattttcccctcccctcgtctgtcacttttgaaatcaatcaaaaaattttcacccccctccccatcggctgtcagtttttaaatcaatcaaatttttccgctcatcaaaaaagaacatgacatttgacacacgccccctcataggtttaggtttccctaattaattaattaattgctcacaccccatcacatatccgagtcggggtcgttttggcgcccacgttttggcgccagggtcgttttggcgccgacgttttggcgccagggtcgttttggcgccgacgttttggcgcccacgttttggcgccaaaatgtagataaagggcgaaattgtatatttttttgttttttcttggagtggggcaaagtctataaaaggagcaccttcctagtagatttagtattttttttattttcattcttcaaataacgcatttttgttttttcttgtttaggaaatgatgaatcgtcaaattgatacaaaaaagcaaaagcctaaaattacctatgaaggccagctttacaccttcgataaatcaagtgcggacggaacgagaaaattttggagatgcgaatacaagaactcctgcaaagggagaatttggacggatttggacgatcaattcattcgtttggcaactcctcatacctgtccagtgaacgcagcaaatgttgaggcgcagaaagtgaagacggcaataaaacgacgagcactcaccacgttagaaccgccagcagtgatccgatccgaagcacttcagaatgtgccatctccagctggacttttggttacgcaggatgcttcaaaactggtactgtttagtcgatgatatgaaaagcaatcacgaaagaaatcttaaggtaattaaaagggcacggcacgaagtcaatgcaccacctgcggttccacaaagcgttgaccagctgattgttcctcccgcttaccagacgtacgagtcaactgacggcgaagtggagcagtttctgttggctgactctggtgtgtattacgaggccggaaacgaaaatgccacgtttcctgcatgcgaaatccaattttgcttcttccatttcgtgcggaatttgcaaaaaaaaaatcaaggaacaaaatctctggcaggtcagtaagcatattcagtttgtttttgtaattttcgtgtctattcagagatactgtactgacacagtgttggctgagaatctgaggatgctcacttctgtcgcgtttctaccgctgagtgacatcaggacagctgtcatcgcattagacacggagtttgggaacgtcgcggcactccgaccgctcattgactggttggtctcatcattatcagaagtgtacttcaatttttgtgcaatttttaggttgctcaacaattacattggacaaccgcggccaaatgggacttggtctcaaccactcttcccaccagaacaatggaacgtctacactcgaactctgaatggagaagcaaggacgaacaactacgcagaggcagaacaccaccgtcttcaaggcgccttcaattgccgtcatccatcgatctggcacttcattgacgttctccgccgtgagcagaagggcaccaatgggaagtatgcgtcatttattgctggacttgagccaccgaagaaagctaagaaataccaagcggctgacgagcgcatctttaatttggtgcagaattataatccggtgaatccaaactatgacaatgatcacaattaccacataaatcacaatcatcatatcattttggaatttcttcgtggcatttcgcgcaattatcatatgaacccgtgaattgttgttattttttcattttgttaaattttacttatatttgaaaaaaaatctttttcctttttttgcaacatttttgaaatttacgtctttccctttttaatttttggcttcgcgccaaaacgtgggcgccaaaacgaccctggcgccaaaacgtgggcgccaaaacgtgggcgccaaatcgtcagcgccaaaacgtgggcgccaaaacgacccagtccctc

SEQ ID NO: 1885 - DNA, 1914 bp, Heterodera glycines
gtattaccgactgtaaacagaaattaatgtcactttgccatgcataggaacaagagacgtacaagccacactcaccatgggtggaccagagcagcaaataccgtaacgaggtaaaggcggaggccgagtcccttttggcctttttatctaccgtatacctgcctccattacagtacactgttggtgagccgcccgttgcccctgccgcttacactgccttttttgatgtattgcttttctccgtcccccccccccattaattggtgcccttcaaatttcaggatatggttgccaccggccccttcgccagctcgctctactcgacttcgcgtctgctggagcggtcccgttctcgcacccgagtgagtcgaccgagagccaatttgaatttgccgccatttggccaccgatttattccccctattaaaacaaacgttccattttaggaacgccgccaagcactccgttctcaaagccaagcgcgcaactatttccggtccgtcgagtttctctaccggtctctcactatttcttatccgcttcttctgctgatttgtgtgcttttcccaccgaaaattaattctaaaaaaaacttttccttaattcttggttagggcatcctttccccatgctttcaaatgcttttcctccccaaaggctttttcccccaaagcttttcctccccaaaggcttttcccagtgcttttcctccccaaaggcttttcctccctgttgtgtccccgggtttaaggctttcagccatttcaaattaccgttttaggagagaggaatttattataaggaaaagcattgacaaataattatgaattgaaaaccgggaatatgtttggctcaacaacaacctcagagcattttgggtgggtcagtgcaattggttatttgggaaaggattgccaaaggcaagaaatggcacagactgacccaccgcagacatctcgcagccccccgagggggaaattggatggacttatatactggcacaatggggatggactttggataggatgaggggtaatgacggaaaaacacaaaagggaataagagaaatggatggcatatgcaacagaggtgaataggaagaaatggcacgataacattggaaatgagagggataggattggcttgggatgggatgaacagatggataagtttacgacgggattgggtcgggagaaagtagggcaatgtacattatgcacaaaatatgaaattttaaatgctgcggatacagcactccccaatgcttttcctccccaaaggcttttcccaatgcttttccctatgctttctcctctcctgccgttcccttgactctctcccctccccgtgctccctcagatttgcctcccaataccccgccccgttgcgcacccgcgattactccaccccgccctcctcttacatcacgcgaacaccgaccgctgccagttcatttgtttcgttcattgacaactacggagccaagcagtacgacttggctcgcagtcagtcgctgcaccgaagctccgtgtacaacagcaacttggcactgagccgatcggcgtaagtcccggggcctccttttggcattaatactacaaaagtttggtttgagtccagcttcaagaccaatccggaactgataaagccgagactaaccagttgataatgagtaactctctgcctaattttgcccagttctcgtggtggtatcgactattatttgggctccggccgaatgtcccgcgtggattcctacgcggacgcactgcacagccgttacgagtggaacgtgccgagcagtcacgagctgtactacgcgtccagcccggggccagtgggctacccaccgctcgcccactaccacgctagaattttacactataagccgcaatctgatcatttttgaaaaat

SEQ ID NO: 1886 - DNA, 4464 bp, Heterodera glycines
gggcggcctccagcggagtctgtcccgagaacgatacgagcgcgatcgggttggtttttgcttgcaacatttgtcccctctcgcgattttctgctcattttccgattatcctttgcctgatcactcacttcttcttttgatcattccgtctcccctctttttgatcactctccctgatcactcactttaattttctctgatcactccctgattgctcactttctcctctctttctgtcactctcttccctttccctgatcacttcttccccctctgatcagttgcgcaacaaatacgcgacagtcagctaccagcttgaccaggcggtcaagcagatggacttgctgcgtagccataattactcctctgctcgctccggttccgcgccccgtacgtccgtctatgcccatttctacccctattactgaggatggccagctgcggcggcggcggcggcgaccgatgtgctaaaggatgcgatgataatgaccctaattatggtgataatatagggatggttcgaataatggaagcgcattcattcttcctattgtgccgtcgtccttcctttctttatgatgtgctctgtagaaacagatttacagattactgtagcttaccatttcatttcccttttgccttccctttccctttgctcaaatttctctcatccgttcacaatgcttaaaattcaaatttggcgtttcgtccacacaaataaagcgataatttacacacaaatttttgggtccaaatgcgtcaaattagcgttgaataatcaatcaataaataattagcatataattaaatgggcaattaaattatgggcgtcgtctttgtccgtcctcccctcaatgtctgctccttccgctgctattggtgctgttactgctcccacatctgctctcacactgttgcctcgtgccgaatcggttggcatttccgccacagccgtggtggaagaacactttgcacttcctctcctggggggggggggggcattattcagttcgatgccaaaaccactgggcaaaacaaaccttggcatcgaagaaatattggagatgggaggacggggacggttctcctgcggcacattgccgaccttttttgggggatggcatttaaaattgaaagcgactgagagagaaagggaaacagagaaagagagggagagaaagggaaatagagagggaaagagagagaggagagagagagaagtaagaaatggaattctttctctaccttctgtcgggcgaagtcgggacaaaattcggacggaagagtcccttttggatggtctgttcacctgcaaagtgccaacgatggtcacttcggtttgcctttacttcctttcacctcaaatgggtcctgtactccgatgtcgccctcccgcggctccgccgccgcattggtcacgccttaaaaacaattttaaaagctaaatgatttttagtgcctttttttctgattaaaaaatggtttttaaaattatttaaataatttttttatttaatgggaagaaatattttgcattataatataaaattaaatattaataatctttttgtacaattttattgttaaaaaaattatttaaaaaatattaaaaataaaatgcattaatataaactcacttaataaaaaaaatcaaaaattaaatttagaaaagaatatgaggtaaattacctaacctaaattaactaagcaatttaagtcaactgtaccgtttttacatattattttttgtctttttaaaaatttgctagcataaattaatttgagatactaaaaatttaaacgaaagaaagttgaaaataatgaattatgcaagaaaattctttcccaaaagttaaattcataaagaattaatgtttacattagtgaaattgataaattaaaattgcggtaaaaaaaactcaattttaaaaacaaaataatttaaaaaatcaataaaaccaatttaaaaaatttaatcttttaaggaatggcaccggagagaattaatacttagaatttttaagtgaataaacgcaccttttataaacaaaataatggattttcaataaaacttataaattttttcaaaataaacatcaaaaagcgatgaccagttatatactttattcaaaaaaaaaacacatgtaatgttatgttaaatttcctttacgcatttccgtacaattaccaagagaaataaattaattacaaagataaagatatattaataaaaaaaactttcgaacaatttttaacaaataaaaatttataaattttaataaaaatgtaatatatttggaaataatctaaaataaataaaataattaatgaaaacaaatttaatacaaatgattttaaaatttttcaaataaaagaataattaaaacttacaaactacttaatattaaataaaatcatttacttaatttaatccttttgtaattgaagtttaaaaatttaaaaaaattcaaattaatctgttttttttaatttaaagaatgtaattaacattattatattaactcacagctaatatatttttaattaaccattttaatttactaatgatattaattttgatcaagaatttggattgagatgattaataaatttttacttttttatgcgattgtcaggctcatttttttatgtaaatacatatttttttcctggattctccatagcctaattattaggaaaaacacattcttttttgtgtttgcgaacaaaagttgggactttaatttacatattttcggatttttctacatattacatatgtacatatttttatacatactttggactttttcgtacttattttaaatttttttacatattttaggatttctgagaatttatagaaatttttttgtgaaaaattgaaatttttgaaaatgtatccctaaaaaatctatttttttcaaaaaatgtgataccaaaaattaatttaaaatactaaaaagtatcctattttatggcataaaaatgatacctggtgattattagcaaagtaatatataaatatatttagcattatttaaattaatttaaaataattaacttttataataagccgcaatttttataaaaattaaaagaagttaattcatcaaggatatttagattatccagcaataaaacttaaaatatattttgaaactattattttattttatttttttcatcataaaattataacagttcaaacaaaaaattcaaaagatccccttataataataaatgagaatatttttaattatcaaatttttttaatcgtattaaatgtataaaaataaatcaatgtttattcacttttaaatattcgtaaataaacatggcaaactatgaacaataaatataaataattgatttaaaataaaatagttattaaaataattcacttctactaagttaaaatggaggactaataatgatatttacttaaattcaaaagtaatgaaatacctttaattaaatcaatttaaatataaaaagattacaaaaatatttgtttaaattgtcattaaatttaaattttataatttaacaatcacaaatgattgtacagaaaataaaaataataattttaaatacatgtgcataaactgcaaaattaatttaaaaatagtcaaaaatgaatcataaaaccaaatttttaaggttaagataaaaaaatataaacctttaaaataaaattagattaaacactaatattagatctgaaccaaattaaatcctccattcaaacaaattacacaataaaaattatattaaaaaataaaacaaacacaataaagaaataagacagtccaattaagtttttcaaaaaacctaacgattgcatgagagtaaagaatttaatattaataaattaaaaaatgctggttatgataaatatgattttaaaacaaaaaattttttccaagcataattctaattttaataaatgtaaacatgattttcttataatgatatttgataaaagcgaattaaacctatttaataccaaaaaataacgaaacagattccatgtcagaaaaatattagtattgtaatattgaagtaaacttctataaaaacatcgttttgaattccagatcagttgaatttcataaaatgaaattgaaattcataaagtataaatttgtgaatataataaagaagagaaattcctttatacagagaaaatattatttaattatttctgatttattctccattttacataaactaaaaatatggcgtgaatattaatttaaaaacatttttacgaaattaacaaattttcagttgaaaaaagtcgaatagagtgcaggtcaaaaactgtgagacgaaaataatctggaaggcaagaaaagaaaaaaaaatttataaaagtaaaaggatacgcaatagttttataatataataaaaatatttatatagcattttttgatatttaaagaaaaattcaaaataggc

SEQ ID NO: 1887 - DNA, 1180 bp, Heterodera glycines
  misc_feature (14)..(14): n is a, c, g, or t
  misc_feature (22)..(23): n is a, c, g, or t
  misc_feature (56)..(56): n is a, c, g, or t
taagtaaatgatanaataaatnnatcggaataagataaagaaataattaaaaattntaatgtatatttttattaaaatattaaatgtttatatatttactaaacaatctaatatcggtttgtgcaagaaaaataatggccaaaaccaaaatcctcattcttaaagtatctcggacaaatgtatcttgaaaaataatatattaaaataatttaaattaatatctttatcgtttaattaaattttcatacaaatttcccagtttacgagatggaagaaattttattcaaattaattaaatcattaacaaaaattaaccaaaaataattgaataacagaatctatatgtataattgaacttatataaaccaaaataaataatagaaaaaataatctatattctaaatgaaatttttatattcacaaaataaatttgctttttaattcaaagataaattttttgtatttatttaacgtcacattcattaaaaaaagaatattcaataaaaatttaatttttattttagtgtttgaaatttgggttttatttatcaaagatgataaattaaaatgtaatttaaaaaacttaattaaaaatgggtgccggagggggggtaagaccgtatcgatcgtgaactaccagacgggtcaattagactctcaattttaaacaagaataaacgaatattaaattattcgagaatttttttttgtatattttacaaagataatcaaaatacgataattaattattgatcaatataaatgaaaaagcaaattaaacagaaatagtacatatattaaaaagatctaagaaattcctgtacataaaagtaaatcgacaaattcattgtagtggtagcaaatttcattatacgagatataaaaaacaaaaattaataaaatataaaaataaaaattcacctacaaaaaatgacttcctaccctaaaacatacaaaatttcagcataattctattaatgttggcaaaattttaaacaaatcaaaaattgttagaaattttatgaaaactttgtaaatttctcaaaaaaaaacaaataaataaataaattttcaacgattctttacttgaaaatcagaagtccggtctctactaggaataattaatattaatatttccttaaatagcttattgtgaaaaataaaatctttaataaaatca

SEQ ID NO: 1888 - DNA, 2125 bp, Heterodera glycines
  misc_feature (2102)..(2103): n is a, c, g, or t
tgtcgcgattgcccttcgcgaaaatcaaataatttgattttgcaattgtgcacaaattgtgcaaaattgaattggccccaaataccaaaaaccaaatttaaactattttcaaatttggggccaatgttcgattgagtgatgtcggaattttttattcctatcgccgatcaatgatcggcggaattaagagggaggaggcccttcaccaatcccccgcccgccgcgcgacatgttttcgccgttccatccctctgtccccctttccttcaaattgtcaattgtttttgtgtgttcctcccccgccccgcgcacaaattaatgaccaatttgtcaaaccgcaacttttcgccgccgtccccaattcggcgaatgagactccaaagaacgatgaacccccaatttcccgttttcctcccaatttgttcattcgttcatttttgtgccctctttttcaattcatgcccaattttcggcccattttcgttctgctcaatttcgccactttttgttcaattttgctcgtatttaatgcgacaaatccccaccaattcctacaatcagaagcaccagcaaaggcaagcaatgcctcttccgtccctctctcagtccccctcatttcattgtccttttcccccggcccaattgtccgttccatttctgtcattcacccggtccctatcattgaattttgtgatttttccatttgccccatttctgaaatttctgtcccatcccggtgcccaattccatttgtgataattccccggtgatggcttttttcctgtgatcaatttgtgataattttgttcaccatttcaaatatttggtttaattacccaagtttgaggtcatttcccggaataaattttttattaattctgtgtctcgtccctgcctgcccctgaaccccgcaccgtggaattcatttggcccgaccccagagcaagtcgggacaaattggcgctcctggggtggatttgctgtgaaccacggactgaaatcgacggatcccggtgacaaagggggaagggaaaaagcaaattagagagcctagacaagaccctccgaggcttgtctagtgttcatagtttcgtgtagttactgtcctccgaggcataacttcacgagggacatagcagacttagtgtttaccctctgaggaagcacttcgtccgaacagagggttgaaaggtgttgtgtagtggacgaagtacttgccctccgaggaagtacttcgtgcaaaagggtgttcaagcgcgcacaaggccactgacaaataaggaaaaaggcaaactaacagtcctccgaggctttagtttagccataaggcaaaaggcaaacaccttgtcctccgaggcaggtgtttagtcacagaggtccatcaaaggccccagggccgagaccagactgatcccggcaaaagacacaaaacaacacacacacatacgcacaatcaaacagcacaatgtctgggccaatacaaaaagggatcatcaatgcactcaaagctctcgacaatgccaaaagcgccacttcactccttctacaccccgatccggacctgtcaaactgggaaaatgccgtcaacttggaggctcaatttgatcgcgtcgtcaaggaaatccgtacaatggaaatgcagatggacagtctacgagactcatccaacgcttggattgaacttctcgcccgcctgaccggagacgacaaagacaacggcgaaaaagaatacatcaaattcgacaaaaatgagaaaattgccgagcgatacgacgcagcaacaaccaaacttcgggatttgcgagatctcgaagcaacactcagtgccaccgctaaactgcacagaggcagagccgacagagaagcaaaggcggatcaattggccaatccgcaacaacaaccgcccatgccaccagcaatggcagcaccaatgacagtgccaacattcacagcaccgctctaccaattccagccaattcaactggataaatttttcggccaaaagcgaaaatggcccgaattctacgaatcccttcaatcggcaatcggcagtcaatcaatcagcaaagcgcagaagctgaacttactcccgcatctgctgnngcggagaagcgcgagaactcat

SEQ ID NO: 1889 - DNA, 3879 bp, Heterodera glycines
acctgtcaaactgggaaaatgccgtcaacttggaggctcaatttgatcgcgtcgtcaaggaaattcgctcgatggaaatgcagatggacagtctacgagattcatccaatgcttggatcgaacttctcggtcgtctgatcggagacgacaaagacaacggcgaaaaagaatacgttaaattcgacaagaatgaaaaaatcgccgaccgatacgacgcagcaacaaccaaacttcgggatttgcgagatctcgaagcaacgctcagtgccgcagccaaactgcacagaggcagagccgacagagaagcaaaggcggatcaattggccaatccgcagcaacaagcgcccatgctaccagcgatggcagcaccaatgacagtgccaacattcacagcaccgctctaccaattccagccaattcaactggataaatttttcggccaaaagcgaaaatggcccgaattctacgaatccttcaaatcggcaatcggcagtcaatcaatcagtaaagcgcagaagctgaacttactccgcaatctactgggcggagaagcgcgagaactcatagcgggcttccggctggaagacgcaaactacgagacggtccttcagctgttaaaggacacgtacggagctccggaggaacacatcagaagtcttcacttcgaactggccaatctcaagccgtgccgaagcctacgtgagaccaaagactttctgcttcaacttgagcggcttacaagggagctgaacaatgccggagaggacatcgagggaccgcaggtgttcctcatgctggagaagaagctgactccaccattcctacgaagcatcctcacaaagaaaggagaggatccggcaaactggacgacaaccaaattccgggatgtgctaaccgaagcagtccggaaagaagtccaaatccaagaagtgatgggagaatatggccatcactacgtccaaccaaaagcagaagtcgtctcagcagcacctgtacaagcaccgagaacaccaaaccaaaggtcacgaaggcctaaccaaccaatggcactgcgtgatatgacatttatcgcctcatcactggacgagggtcacagacatcaagggtatgtaagccaacagcacacgcaacaagcaaagaaacactgccaacaaatgcgaaaccaagtacagagcgtcaaaaagggtccgccatacccctgtattttctgcaacagcaatcattggcatgacgaatgccaaaacgtcgacaccctcaaccaacggatcagcatcgtcagagaaaagaagctgtgcttcaaatgtatgaagccaaaccaccgcgcatcaaattgcgctcgaccatctaagtgctatcactgcaaatgtcggcatcccacggcactctgccgagatcagtacaaagccgagaatggcatcaacacgcctagcacctcttgcagtgaagagaagccaaatgccaacgatggcaagcgatcaacagtgatcgaacaacaacaaatgtgtaatgccatccaaagcaaggaaaccagagcgttgctaatgacgacaaaggcaacgatcttcaatccgtcacggccatccctcagcatgatgggaaccatcttcattgacccgggaagccaccgatcattcatctcgagcagtgcagctgaacaattggatctgaacatcctcagcacggaagaatgctacttgtccagcttcggtgaacgagaaccgaagcgatacataagcgaccgcgttgcaatcggcattttatgccccgaccaggacaggttcattttcaacctgaacgctttgaagttcctgctgaatgatttaccggtactacaactaaacgcattggataatgacgaacttcaacaaaagaagctttccctgccgaatgagtcacggcaaccggacattctcctcggaatggacgtttggcaccagctgaatgttcaaccaattgaacaactgccaagcggatttacgatttgccaatcgaaaatcggcaatatcatcagtggaacagggcgaatcgagcttaagcaaccgtccaacatctctttcgtgctaatggtcaacaacgatgaatcgccacaaagcagtaaagcggctcagaggcagaaaaacattcaacaaaaagaaaaggccgaactgagacggcatcaacgcaacaaactcttgtccagcattgcaacattgcgatcaagacggaagagagaatcggctcccatcagctcaaaatcaatcgtgattgatctttcatcagacagcgacgcatccggcattgagatcatacaaaatccagtcagggatagacaagccaaatcaccaaatgagcattcaacggcaccaattcctatggcagtgcaacggctaacgccaacaaggaagagttcatcagttgccaagcgaccagcattttcttccagcaaacaaccaaaaggaaaagcagcgaatcccacacaaacaagccaaacaaatgaactcaacagaaaaatgaaagccttgtcgccaaccgcaagtggatcaggcgccaaccatcattgcgtcgctacattggccagaagctcggactcaacaacagtaattgataagggcagtcaacagaattgcctaaacatgagctcggcaacaatcagtaagacaccatgccaacagcactcgtccgagaagacgttaaactaagctaatcaccatcaatcgtccgcaatgacgttaaactagcctaagccatcaacaactgtccgaaacgctaatcacccggctgccacaagtccgcaatgacgttaaactagcaaagcatcaattgtccgcaatgacgttaaactagcaaagcaccggccaccaaacaaccattgtccgaaaagacgctaaactagcaatccatccgacggtcagggtccgaaatgacgtcaaacaagcaacgacaattggtccataaggacgttaaactacgtcaccaattcaagcaaaagcactcgagcatgcagctgacagcacgtttccggaagcaaattcacatgtcctcaacgattgaggaggttcagcagcgaatgaaccacaacagaccgcaaccgcggaggtcacaacagaggggactaaggccaactcaagcgcctaaaatatgccaatccgggatggcacagtatacaagcagggtcgagggatccgcctttcaccctgcgtcttctgcaatggcactcactggaccacgacgacgactcagcgaacactcaacctggcaattgagctcttcgcaaaaaatcatcaagcccgagcagagaatgcccattcgccaagtctgaaatgacgaatgacgaagcacaattgtggtcaacgaatgacgaattggaagtcaacttccctggaccaatcgccggacttttcaaaggcgaacaaatcagcacggcgacaaactgctttgctcaaccagcaacacttttctccaccaagttcagaactgtcaatacgcaaccgaattctgccaactgcccgacaactcaaccctgatttggaaatcaacctgcaatggcaacgaatgccaaacatgcgactacgagaaggcggaagtcatcaacggaaaattcactgcggcctacggagaatcaatggccacttggatctccgaagatcaccaaaagacattaactttcgccaaaaatgcgccagaactcatcgcctgcgatggcacacgcatcgtcatgtccgaacagaacttcggaattgccaaggagcaatacgacgacattgtcaccaccacgacaagatggaaaagaggcatccgaccagaacagctcgcaagtggcaaatagaaggattcaccatgcgttggctaaaaagcctgatcgacgaagcaatcacgtggtggattcgagtcgcctgcgtt

SEQ ID NO: 1890 - DNA, 2762 bp, Heterodera glycines
aaaaatgatttaaacacttggaaacattctgaaaaccacgaatattgcaaaataaaagatcattaaacccttttcattcgaaaaaagcgaaatttgaagtttcgactttttgttcggggttcgaagtcggggaaattgatgccagaatcttgatcaacgacaccctgaaaacccctagaaactttttcgaacgactttttaaattttgaaagtttccgccaaaaaataggggctaccatcttaactattccaattttttgttaatttttcggaatttgtgtactattacgaagaattcattttgctcttttcccaccgtgattctgtcgtgggaatgggccatcaagcctaaaaaattcgatttctgaggccccataaatttttttcgctaacagcccacaaactcacaatagaagtcactcgtgttttatacaattattccactttcatatatgttttccgattaacagctcacctggttcccttgttagccaaacgtatttgagctctaaaacattaatgccttttataaaattatttaagatagtttctccttttttaggtacgtgcgtcatcgctctggaacagcaaataaaaacaaaaaaaccactcctgtttatgccgtttacatatttaatgtaccagcggaagctactgatgacttggttatgtatcaaatgatttcgatcaattcaatccgagtgggtttaaaataattattccatatccgttttttacgttttctttaagggcaaaattacacacatcaatcggaatacgaattgcattgaagttgcttttgaggacagaaaacgcactttggaattcgatcaaaatgtaacaatcttttcgtcttatacaaccaattgaatattataattttgtttcaccaggcttgctattgtctcgaaattgaattcaacgcgcgccaatacgaggctttcatgtactcaatttattttgttgaacaacataaagtcgattttgtcgtttttcctgatgcttccgaattggtaaatgagggaaggtgcaaattgtcattccaaattgaaaaacagatgagcaaggaggagtttgccactcgattggtcgaattcaaacgcaagtgcaaaactgaccctaaactcacgcgctttgaccaacagcaacagttggcgatattttccattgtcaacggaatccatggaaccgtcccatttgtattgtggggaccgccaggttttttttaaatttttgttaggaattttgaaataaaaatccgaaaaaggcaccggaaaaaccgtcactttggtggaatgcgttcgacaattgatgcagcaggacgaaaaaaaccgaattctaatctgcactccgtcgaacactgctgctgatttggtcgctcgtcgtattttagaaaccaacatactcagtcccatccaaatgcgtcgttactacagtttgggcaaaagcgtagacgaaagagacagaggattggacacaattatcaagatggaaaagtgggtttcaaatgttgttgtttttttgcagtctctccgtctttttcggaatgtttaatttttggcttgtttttagttgctccatttatggcctttacgacgagcgtttcaaaattgacaactacgcaatgttgacgaagcagaatgtccgacttgtctttgctacgctcgcctgttccgcatacctcgaagaggaaattcgcgtttccgattttttctcgtcagtaattacactcttttgtctctgcaaaatctccgttattacaggcacattttcatcgatgaagcgggtcagtcaattgagcccgaaactctgattccgatcacacgcttcgcaacaagaaacactcgcgtggttttgtgcggagaccaccagcaattgggtgcgttttactcattatacataccgaaatgttagaaaatgggtctcctctcccccaattttaggccccgttgtaaaggcgcattttctcaaggcttacaaatcgtgccatttgtcattgatggaacgattaatgaccacaatgagagcagaagaaaattcttttagaattaatggacaaaaaagcgtttacacggacgggtattaaattgtttaattttggagtaggtatttaaactctttcagacggactttttgccagctgacggacagttaccggtgccatccgaaaatcattcatttttcttccgtcaatttttacgacggcactcttcgcgcagttaacgaagagaacagaaagtctttttgcgattggaagcatttgccctccaaagttttttttgcccatttgctgtttttttagtctcaatattttgcagaattttccgcttttatttcacgcactgacaaaaggggccgaagtgaaacaattggagggccgatcttatcacaacgaagaggaagttgaagtggtggagaaatacatccaattggtgagggaaacggacattgaggacacggaaattggggcgatcagcccgttcaaacaacaggtgacaaatggggggggggggtaatgaacctcattaatccaatccactgggaaccaccatcatttatgagcgtttagacgctgaaaatccgcgatcgtctcgctggctcaagaataaccgtcgactccgtggagtgctaccagggatcagaaagacgcgtgattatctttgctttgtctcgctccaaacagatcggctttctctctgaatttaaggtaaagcaattaggaggaatagcagaattattcttatctggtcaattcattcaca

SEQ ID NO: 1891 - DNA, 4862 bp, Heterodera glycines
  misc_feature (26)..(26): n is a, c, g, or t
  misc_feature (141)..(142): n is a, c, g, or t
  misc_feature (147)..(147): n is a, c, g, or t
tatgacaattctctttctttgctttntcattctcattttgtaatttgttttgtccagcgtctcaatacatctttgacccgagccaaggaattggtaattgtcgttgcgtcgttggattttgtacggaatttgaattccaanncatcnccaattaatattggatcaggtaattcaatacaaatgattcctttttatccaatgccttttcagttttattgagttttgcatagacaacaaagcctgttttggtggatgggtttgtcgatgagttgggtttcaaccagcaaactctgactaaaaatgggaattttctgcggaagtgccttaaagagagttttcattctgagtttacacgcatcgagagaaagaaaaagcccgaatttgctgtattttctgcaccaattcgaaaatgtatgtttctcttttataatgcaatttaaaatctgtttaagattctgattcggattcctcaacctccgaatcctgcgatgaggacgaaggcacagtcagtgatttgtcaccactttcttcaagcgacgaagaagggaaacaattttgggccaaacaaattccatggagaaagagaccgagtgaaaggaacactttgagagggcccaaaatagaggaaatggcaaatgcgatgagcaaactgaagaccaacgaatatacagaagacatacagtacgaggatttgacgacggatccgttggaaaattggcctgaggacgggggccaagacgacggttatgccaattggaactgtccatcaaaagcgacgacccttttgagcgatgaaagcaaacaaaacgacagtggaaatggctacggaagcggtaattttttaacaattctgaatgtgacaaaataatacttacttttgtccatcagcgcctttgtacaatacgaaaacggaaaatgttactgcaaaacaaaacgacagtaattacgctaattgccagcaaaaggttagcagaattcccgaggaaagtgtccgcgatcagccgacacatcggccgacgaatgcacagaagaaagactttttttcggagatcgcaacttccattgaggaagggagcatcggtgccgccagggggaagaatcccctggggagtgtccagcagaactgcaaactcatgtgattaacacccaacccatgccatggcatttctatccgggtttactcatatgttgatcgaagatacaatattcttgtttaattctttattatatgaattttatttctacattaccgaaaagatgctaaaacccgatttgttttttttatttttctgtttttttagccagatcccagtttctatcattgtttcaaataataaaataactaattgtaaacaaccgatggaccttgattaccaatttgaagaattagaggcaagggttgacaaattgctaaatgccaatgcaggaattggtggtccgatcacagacttcgcttttaatatggccaaagaggagggttactcagtccaattcgtcaaatacgttttggattcggttgacattcattacagagacgagaaactgctcagacacatggtaaattaaagcaacaaatccaagagtggaacgtcggcaccttaattaaggtacgatttacagcttcccaagtgaagaacacaaagatacccttttcggagtgtctctccgccaaagaaatccattcgatttctaatttttgctctgaattgaaaaacgacattgccttttcgattcgccctgtttctcaggggcacagccaatcggccggcgcggagtttcctttgctcacgcgcattgccattgtggccacttattgcgcgagttacaacccccaaacgagcgacaaagtgtttttcttcaaagtcggcacttttggaaagcactaacaaagtttttgatcttttcaaggggaaagacgttttgaggcgcaaattgcgaggggcggcgcgggaggaaaattggcacgaaagtgggccacgccctttcgaccaccagcgggcgctgttcattttccttttcttctgccgccaatttgacgaggcacttcacgacagtccctcggcttcttctgctggctttcacttcgattctgtttgatttttcatttttacgcgtattttggctttttttcatttccggttgtaagctcgggaagttcctacgatttcacttcccaaattgcacatttggtcgacgcgggattgcttcaggtcggaagtttataattccattcccaattataacgtttctcaaatgttccttccttttcaggtgattagtgcgccggaaaatttgaatttgccaaaatatcgttctctttgctcgttgaattttgtggaacaaattgcacggtccgtcttttctattgaactcaattaaagcccgtttttcagttcgatttcttccgatttcaatttgaagagttttctggtggacttcgcttctgaaaaatgatctcattgtctttatttttttcttttcaataaaaaataataaacattttattagtattttaattttgttttttttgagttaatttcctcattttccctattttttgtcatttgtttttcttttatttttaattattttccgttttttgttccgatggctgtcggttccttccgtacgtccgtttgggacccgtcgatgatcctttgccaaatcgtttgtctccaaagtgcgttttactctctcgagggttcactgatgttctcgtggagtttgttcacttccttccgtcctttgcttatgcattttttcttttctagggtgagtgcttttttaaattaaatttttggtatttgtacgaagaaattacatcattttaacaataagcatgaacggaagtagcatttgttgttttattttgggttggtttaggcccagcatccgatggtcattatccaattgatggcctcggcactctgtgcccttctcttcccccacgtcgtcgttcgttctcgtctctgtttggacttcgccgtcactctccattttgtgcactttctgatcgtctgtctttccaatcggtcatttccctcgcagttttcttggttcgtccgtcatttattccccccccccccacttaatttatccaattttacaatttcctcactttcaggtggcttttgcaggtgttaagtgcgtccttttgcacaattcttgctgaatggttttgttcgcgcagagaatacgccgaaattccgttggcacaaaaccaagcgaatatttcacgggcaattgacacataaaaagcgattgaagaattaaaaggtgtggccttcgaacggagaacattttgttggaaagggcaaatcttttgcttctctttctgttgccgaaaggcgtcactgatccgaatttgtatttgcccttaaacgggtgattttcccaaattgggcgagtgaatgtgcgcataattatgtctgtcatttcttcgttattcttttttcctcaattataaattttggtgctcgtttcccatttccttttgcctattattaacagtttgatccgttttgcatttgtattttcttctttctcttttttccgtttccccttttacttttaattgctttgccaattagcgcggttaatgaactcaattggttgcccttcctcctccaatggtccttcctccgctatgccttcttcttccgctgattgttctgctgatcgctctcttccgtcttcctcttccgttatcttccaacaattcacgatcgatcagcgacactttgtggacgaggattacttcagtctcgagagtattttcgccaccaatacgaatatttgctgcactttcgagtctaaaacgccccccggtgagtttggttttttttcggtcattcaaatgtttcagcgctttttcctctgctcggccggaaagcgcctgaggtcatttctgagaagggataccgtgccaatgtccccgcttggctcgtccccgccgtcgaccacatttgctcggtagtgccatactgggactcaaatcccgattttatagggcccctaatcccgagtgttattttaggaccggaattcgggatttttccaaaaaactaagaactaaatttcctaaaggatttaagggggggggggcttagcggccaaaaaagcgaaggttgtctatccatgtaaatcgacgagcttttttctttgttttaaagccatttttgcggcgcgttttttacacaaacccataaattctccccaaaacccaaattcataaggtaaagtttcgccatttttaattaaaattgttcaatcgaaacatcgggacctggatcatttataggctcttgggattggaaatcgggccgagataggattaccgaaattgaaaccccgattttgtctggatcccgattacgtccgagctctagtgccaactcagagacacgcatttaacagtcggattttgccatagtttcccatttctttcagtttgccgtgcccaccgtttacaattccgtcaatcgcgacgtaatccacgcgggtgcccaatcggtcaacttggaacagttgcaacgccactactacacattgggcacgttcatttgcaggcaatccctctcaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgataagtttattgcggaaaaaaagactttacaaaataaatacccctggggagaagggagtggggaacatgatttcaaaatttttggttgaa

SEQ ID NO: 1892 - DNA, 5159 bp, Heterodera glycines
  misc_feature (103)..(103): n is a, c, g, or t
  misc_feature (128)..(128): n is a, c, g, or t
atgggcaccgaagggaggacgaaggacggcaccgaagggccgccaaaaggaaacattgcggcggcatttcgacacttctctctgtgaaaaactgctgatcatntggcacatttctggcgattcgtctntcatttcctctttttgttcaattctatttaatttcgttcgcaataattctttttttttttaatatttgtttttatttacgcatcattatgttaattcgtttttttatattaattcattttcactttttattctttttattgcttcagttttctcttttcaaaatgtcaaatgattgcgaattggacggaaaattcgcggaattgcgtaagaaactacgcgacttcacccgtcagttggaaaatggcacttcgcaagtgaatgaaaattaattgttcgttttggttcattttctgttgctttttccagtcgtctgttgcccaaagcgcaaattccggcgacgggcaacaaccaatggccacaattcgcccgaaaatagcgcaaatgagtgccgaagttgtggactcaaacccatacagccgtttaatgtgcgggcattccgaataaatttaactttaaacaaaaaacagggccttaaaacgcatgggaattgtgcagaattatgagcaaatccgagagaaaactgtcgttgtggtgggcgttggaggggtcggttctgtggttgccgaaatgttgacgcgatgtggcattggcaagctcattctggtgagcagagaacggaaggcattttaacactgaaaacatttgggaaatcggggaccacgcgaggggttgggcagacggctcaccaacaaagggaaggacaattagggaaattttatgtttatttccactagtttaattttcacagttcgattacgacaaagtcgagttggccaatatgaaccgactgttttatcagccgcaccaaagcggacagagcaaagtggccccccccccctccctcctcttccccccccccttctttttgccgaatcaactcataaattcgccatcttccagcattttccatgcgtccgcttctcttccgtcccttcaatttatttcttctcttccttttcatatttttcctcactaaaatccgtcgtattattcatattcaatcctttcttgccgaacaaagtgtgcctttgcgggaacaaaaaatggccgattttgtgaagccattcagaaaagcaatgggaaatttgtaaacagacaaaattagtcattttaggccattgagagggttggcactgatcctccggccattgtcctccttaacaaagtttgtcatcctcttccaatccctccccttccttttcgattcgttcgttcagttcgccctcaacatcactctcaacttcgtctgcaatttgcgtcttttccccggcgcttctgatcgcctcatcgtcgttgtgttcgaccacatctccgaaaagactctgctcaattcgtttccccatttgaatgtcatccattggccccttttggctttggtcggtcaatcgaccgcctcaaaattaattcaaaaaatttccgaaaaaaaattttaggcggacaaattcggccccggggatggtcgctaccaaatgtttcagtatttccgtgccaaattggctgtttttctcacggagttggtgccttctttttggatggtgaggcgagtaaaaagaaggaaaatggcaaattaatgggcaattaggaagagaatttgaggtgcaagcggacacaatttggcgggaaaatcttttcgaattgatcggttggaagcgaaaattgtgagagaggaaacggagaaattcagatgtggacaatggcacgaatgaatacggacgagcggatttgatctttgacagtgaggggagcgacgggtaaatggccaaagaatttcaaaggaaattagataattactttaatttagattgctcagctcaatggttcgtccccgtggaattttgaaatttctcaatttttccgatcgccggcggttatttctttgtccgctcatccgtcagaagtcgcagttttttcgactctgtctcccgctttttgctgaatcacttcgctactgataataatgtgatggctcgccaatgccttcttggaatgcacggcgcaaaatgtgcgcaaatcccttacaggtcgctaattggcgcagaatttcgtgtcgaatcggacaattgacaaaaaatgcctttttgttagagttctttcaaattggcgccaagcgattgaaattaatgaaaatggagaggacgacggcgcggctttgttccaattcgatggcggggaaaatacgggggacaaattcgagaaaatgagagcggaaggccatctttttgtggatttgaattcaattggggaatggaatgatgaagaaaaaggaaaatgggagaacggagagagaaaagcgaaatgtaacggcagagggggagagcagaaagacgcgagaggaacagagagtgaggggcaaagttggagggcaacagagaagagaggagaagagagtgccaatcggacggaaaagaatcgcaatcgaacaatggtcgccgccattcacgcgttgttcgaatggatccacgggcttttccccggcatcaagcagtttttgattgtccgattgtttccccattacgcagcacatattctcttataaattaaattagccattgtgccaagaaattcttattgttaataaataaataaataataaaacaaataaattttaattaattattagccataatgtcccttttgttgtaaatgaccattcgaatgatcaggcgaaagaacaacaacagatgaatgcgtgcatgaatgagtgatcaaggtcagcgagagaatgtgcgccgatggcccttctccgtcgtccgatcgtttttcgttcggtgattgatcgttgcgcatgccatccgtccatccgttctctgtctgtcgttcgtcattcttttttttcaatactaatcacgagattctcgtcaccatttattcaatcatttatttctaattaaaccattaaataataatggcaaatgccccgacaaaattaatccgtttgttaatgtgtcgtccgactcattttaatgtgaaatacgaaataaacccatggatgaggccaggcgacccggtgaatgtgcaaaaggcaacagatcaatgggaaagactgaaacgcactatcgaggttataaaactgcacaaaaagacaaaatatttatgatttataatcatatccaaagtctctgttggggagtagaaaaaggccgggattcggctgaattctgattcgggactttaaggaatccggcgcccaagtcgaagtgatggaacccgtggtgagttctttgtggcttttgttccatcatttttcacattgcctcgttttttgctttgcccagggggctgacaattaccccgatttggtgttcacggccaatgccgccgtcgtccgcggcaaaaatgcccttttgagcaatttcttttaccccgaaaggaaaggtaattaatggccaaggcaaagcaaacgaagccaaatttgaaggggaacaacacttttacgaccgatggtttaagcagaacgggtacgaaaccttcaaagaccttcacgtgcctttcgaaggttcaaaaagctttcttcacttcgatctttgaaaatggcaatttgaaggtgccggcgatgctttgtggataggaaagtcaaagttattttgcggcattggccccaggacggacgtgcgggcgctgactctcatttcggaaaagctgcgcgactacggagcgcccttcaaagtttatggctttcgactcattgacccgcggtgtctttatttaatcagagttataatattttgtaaaagatcataggaaaaagggctaattagccccgaatggggtgggttcaaagccacgaacttcgaagccgtagtaaaagaaagtggtcatttgacaatggtcaaataaaaccacaaattattggcaaaaatataaccaaaaaatgatgatgtattaatacatataaaaatagtactgtttaagaaagtcagaggtatttagaaggcaattcaatgaagaaattatactgatttttaagattttaattcatcatgtaagaacagaaaagcactctaaatataaaaattaggaataaatttatttttaaatatttaaatttaaaattaattgaaaaatctttttgcaatttagtggaaatttagttatcatttactacgggtaaaccagcgtagttgtggttatctacccaaccttaacttttactatggtacccggtgttttttgttttgttttgttttttagatttttttaaacctaaaccagtgcttctccgactagtgccataaactttggaataatccttaattcccattacaaattgatgggattttttgaatgggaaaaagacgagttcttcagtttttaccacatcgacacctgcttctgtcccctgaatgatcagatcgccatttactatccctacgcttttgatccgggtcggtcggtccgtcagtcagtcaattcgattttccattttttcagtggccaggcataacatgtccaatgaggtcgaacttgtgcccgtccacgaggaggacgccatgagattcgcctgcaattccatcgtaattggaaaaacagtaatcatcaataggtacggtagacggtgacaatagaaatgttaatcaaaaatggcatgccatccaagcggaactgaacacacggcgagtatggtgcagaagttgggctttaccgtcaaatttgtggatatgtccgaatttatgaaaagtggcggagcagccaaatgttgcacattgcaattgtgaagtgaaggaggaggacgaattagcaacaattggccaattaataatcaatcaaatgaccaaccaatcaaaatggccatcatttgatcactttttgctgtcaatttcttccaatcgttgcctttgcttttcttcatttttgctgcttctctttattagtgtcagcatttaattttgtcatttgttgtgaaaagaaaaaagaccttctgctgaaaataattaattaatattttaataattattaattagtaattctttattaatcaataattaataataatttttaattcatgcatttgtattacctaggatttcctt

SEQ ID NO: 1893 - DNA, 3722 bp, Heterodera glycines
  misc_feature (26)..(26): n is a, c, g, or t
gaatttgccatatgcgtggccaacgnctgtgccaaaattcccagctgtacctttggccaacaatctgtgcggtcggtcgaaatgcttggcccatcacttcgtcactggccaagtcgggctattcaagtgcggtgtggctgaagccccgcgttggaaaggtggcgaagccgacttggcggttctgtcgcaagtttttggtgcgcaatttttttaatgaatttaaaagaaaaataactaaattaccccaggcgagaccaggctataaccgactgattttgccactgctaaagaagggagcgaaaaaaatggcagatttgcctgaatgggccgagtcgaacagtgaaccgagcgaagcggaagacaatgacaccgcacgagccgaggaggcgggcacaagcgcggcagagcacggcgagacatcgtcgagagtttggtcatggacaacgcgaatgccgaaggcgggagaaaatgaagacaaaggcaaaagccaaaatacggaaaatcgagcaaagtctgagaagccacggaaaaaggagaagcagaaaaataaggacatttttgatcagttgcttcaggacgaaacggacgacgaagaagacaaatgggcgtgatcagaagagaatgaggggggggggggcaaaaagcaaaagcaacaacaaaggcattcttttgaagagtaccgcccccctcattaattcattaaacgaccttttgtggcgagaatttttatcagaaagtgaacgatgtttcaactgagaaattgcagcatttttctgtgtttgtttttattataaaaatggttttttaattaatgcgcaaagatttaacctcaaatacaaatcatatttcttaacaaattgtgatttttaatgtttattttccaattctgctgcttctttaaagtaacattttttatgaataagcgccgaaatttccattcacaaaattcgcactgcgaaatgcaattttggttggcactctgttaacaaatatgagaggtgctatgtcattatttaaaaaccatcattatgtgcgttatttaaaaaaccatcaaaataaaaattgtgcttttaactttgcattaaacaacaaaatttttaatccttgctattattcgatagaactaagtgtttttatgagcctgtaaaatttcaaaaaaatttattaactttaaaaaagttatggccaaaaatgttcgaaaaccaaggttttttgcgttcctcaagctataacttttttgaaacttaataaaattttttgaaattttgcagactgatagagaacacttagtactatcaaatgaattaaaaatttggttgcttttgagcaaaattataaataatttttcgacaaaaattttcataatgatggttttttaaataacgactccgccccatatgagagtagggtgggaatcggggaatcccgcggggaaatgcgcgaaaatcccgttcccgaactttttttctcaaaatattaaaaattagaaaatgagaaaccgaaagaaacgatttataaaaaatattcaaacttttttaagatttattaatttcttctaaataaaaatgatgatgatcatataaaaaaaacaattcatttgaattaaaatattattattcaaatatgcgtctctatgttttaaagaactcatatcctttcgtattttcccaatgttttctttttccgctcccttttaattatggtttcaggaataaggattttgatgatgatgaagctttgatgattaaacttaaatacccatcatccattaaacgttcttttgctttcctaaaacggcaaaatgatgccaatgcattttttgatcaaaaaaagttggccgaaagagggaaaacgggggaatgcttctgcttcgtcatttggaaaggcaccaatgcataataacatcttcaaaaaaaatactaaaaagccaaccaaatcaactaaaatcagggtagccagatgaaaattttcaaaagcctcatttggcaggcaaaaaagcctcattttgggtcaaaaagcctcattttcacaaatttattcaaaacacgtttaaaatgttcaaatgttatatttttgattgtccatgattaatttgagcattttttttgttagaaataagcattttttgggattctgaacatgaaaaacgaagttgatttttttgcggcgcttttcccaaaaaacttttggggcgcacgggggggccggcggtgccgataggcgccgccgggaaaaatttcaatgatgttaacagattttgtccgaaaaatgaccaaattttgcgattttgagcaaatttttgcttgtaaattaaggatttttacggtccggcggtgccgataggcgccgccgggggaaaaattaagaattttgaccatatttttagcatattttcatttaaaaaattctttaaattaccaaacattatgccaatttatcaaaatttaaaagattctgaggattttccccaaaagcctcaaaatttctcaaaaaactacaaaaagcctcaaagcctcattttgaaaatttagcctcattgacctatcaaaaaaccacaaaatgaggctaaagcctcagatctgcgaaccctgttaaaaacggtagaatcgatgtaaaaaggttcgatatgggttggaaaaattgaattagggacgcgcttgacctttttcaggctgaaaaagtgccagaattggagttccaaactcagctggaaactcaagtggccgcactataaaaagcactcaaatgacattttaaatttctaaggtaatttgtggcgctgatcacgaatatgacctttattttgcaaaattccgaaccccgaacccaaattcgaacaaaagcttaattttaattttgtagaaaattaaatttaggtttttgttcgagtcgtggaaacatcgactttatagaacaaaaaaattttacaagggaggcaatgatttttaatttgattaatattggtaaatttattggaaacggcatcgaaacaccggtggcttatttatatacacaccgtttcaattttggcctcccagttccaaaaagatttgcatgtgtggcgaagtggtttttgtaagattgtaaagggacaaggggtggaggttcgagtccgttgtgctacatgaatatttttatttatttttgtccaaaaaattaagaaacgttgacatcacagaaaagagttgtaagactttgaaattttcataatggtctcatgcaaaaacgggatgtacaacctaaaaaaacatttgataagttcgatgtgaaatttttttctctatcgatatgcaaaatttggtatgcatttaacaagtaggaaaaaagttaagcaggatgaagtgaatgttgtttttcccgggccaggacgttttcgtaccgccgttttcgtacgagtggatatgcaaaaaaaattgcattcaaataatttgttatctttttttaattacttttaatgttttgacagttaagcttttattaactacaaaatgaaccagcagcaagtaattaaaacaaaactaaataatgataaattggtgcatgatggtgcacagaaaaagaagtatcgcgatgccgacgcacggatttgtacaaataaaaaaaataaaaaccaaattttaattataaaatagcagtcgaaaaaaatgaatgaaatttctgcagttcacttttaattgggtactaaaacatttatataaaacagaggtccccaagtttttttt

SEQ ID NO: 1894 - DNA, 4278 bp, Heterodera glycines
ttaattctactgagtctgctaaacttcttgacacctatgatattgatgttttactcttgaaaccgccccatctcattcagtgaccaattttatttatttattttgttttgatgtcggtgtcacgcttttgcgtataaattgattgattgacttcaatcccgctcttggcactaccagctccggtactgatcagcagacagatcaatcaaccccggagaaaagacccacccattcttttatttttgcctatcattgctaatgatcagggaacggattttaggcgctaaaaaacgccaaatatgtacatatatatgtgccaaaaaacccccaaaatatgtgctaaaaaagtgctaaaaaataaatgaattcctcaaaaaagtcattttttgatcaatttcgctagcaaaatgcaaataaaaccgtttcaatacttttggtgtaaccttttttctctcgctctctaagattgacttatttttctaaattttcttagcgaaaattcaaattttgccttaaaagcagagttcccaagtttttttttttcaaaataagacaaaatggcctaaaaactaagattctgaccccaaaaataagatttttcgaaaactaatatttgcgtgaaggaaacgcaataaaaacatgaaaaattgacttaaaacaatattttattagcgtaaaaacgaaggcctgtcaactgaaaattttgtaaatcagcattttgaaaaattttattcaaaatttaaaaattaataatgtttttgcggcgtgctttttccaaaaaacttttgggaattggggggccggcggtgccgataggcgccgccgggaaaatttttgaaattttgtatgtgatttgttaacagattttgtataaaaaaagaccaaatttagagattttaaactaatttttttaagaaaaattgggattttggtgtccggtgccaccgggaaaattttttcaaattaaaatgaaatttgttaacagaatttcaccaaaaaaatgaccaattttgagattttgagcccatttttatgaaaaaatatgcagacgacacaaagggcaaattcttcgccttttcgacttttctttatatgccggaattcttttgcgtagctttccaaataaacatgtttacgttttggtggcattttgtgaatttcactcaaaaaatgaaataaaatgtaatttttttttaaaatcaaattaattcaaatattcgcttcagaaaaaaaatgaaaaatcaaaatagtcattcaaatttttcattttttattttcaaatccaaaaataagcacaaaataagcacgtaacgctgaaataagcacaaatcttagaaataagcacatttttactttctaagatccgacccctcaaaataagcacaaatcttagaaataagcacacttgggaactctgatataaaaagatcggaatagtagagttcaattctggtacgattcacactttaataaaacagccctttttaattcatttacaaattttagctataaaaaaccaaatttataataaattagtacagggttatattgaacaaatctctatttttctcattttattttgctaacaaaatgattatgtaaatgggtcggcattcgatggcctgccccatttgtcacaattttcactcgtcaccatcattttttgatgatgatgttcttatccaccagtgatccatccctcatgaatttaccacccccaaatttgtcagtcatttagtcgcgcgtgttgttgcaaaagccgtccgcattttcgtccgccctccctccatgccaaaacagggactaaacaaaacaaaaaaccgaaaattctaattttcaaaagccaaaatccgatacatataaaatttaaaaccgatgtaatttttgtcagactaaaatttaacacaaaactagacccaaaaagtgccgcgaaaaaggggaccattacggcacgaaaaacgtgtgcatttcgcacgtcggtgcaacaacgacattgaatttcggttagcaaatttccaatgttttatttttgtttgattttaaatttataaaaatttctttttttttaataaaattcttccatttaatcaaatagattaatgtttttcaattgattcagattaatccaatgttgcagcacatgtaagaagggatttcttctcttttgcaaaaatttttttcgtctagtaattaattaaaataatttatctaatacttgaaataaattaatttttattgattttgtctatgactttttatcaagtacttgattttatccaaaaattttaagaaaattaatgggtagtaaaaactcataaacagatgttgtagagcttaaaaagagctttcgaatgagctattgaatttatagagaagtcaagtatttaattttctatgattttttaaaatttagttattaatctctaggggtcatatgagatggggtgtgggttcgagcccgcttggctgcagtttatttttttatgcttattggtgaaaaatcatagacaaaaaatgaaggttcttgtaaaatcagagctcagatttgtgatctacatatttttttaccccaaattcattggaaagagaatttttacagaagattaaaaatttaaaaaaaacaagtacttgataaaaagccatagacaaaatcaatgatttttcaaaatctgagttcagattcgtaatcagcatatttttctacctcagaaaaaatgctttttaaaattttactatttttcccatcgggaccacaattctacacctttggccaaagttggtaataagtaaaatattcgtttaaaaggatcggcattgtcctgttcgactctggcacgattcacactttaataaacctgatgatttttttaatttctgggcagtttttaattttagcttgaaaatttgccattagatgttcagaataaatacatattgatgaaatgattcggttaaatttattacattattaaatttattacatttgaaagatttacgcaattaaacaacaaaaaaaaaaatttattttatacattgattttaatagcaattattaattgcgctctcgctctttcacctcaaagtgtttgcgcaacttgtttcttttcggatggctaaaagtagcggaaatccatgaatttgtaccgagaatgtgtcacacattcattagcaaaattgttttggctgtgtgtgtactccttgcttttgatgggtctaccgaatatgtccaaattcgtcggaccacacccatctgtggaaacgacgggcgggacgagggctgcagggggcgggttgaatcgcccgcagaccaccgtgtccggacgaccccgaaaagacaatctgtccggacaacccccgaaaatgatgtgggagaacaaatttattttggacaccgccggtgacccgccccaatttgtcaccattttcagtcgccaccttcatttttgatgatgatctcccttaatgatccatcacttcctcaaattggccaccccaaatttgtcgatcatttggttgcgcgcttttgcaaccgccctccctcctggccaagacagggacgaaaacaaaacaaaataattcgggattgaaaataaaccgaagattataatttccaaaagcaaattccgaaataaatttaaaaatttaaaacaaaattaattttgctagactaaaatttaacactaaactaactaaactcaaaaagtgccgagaaaaaggggaccaggaaaagaaaattaccattcgagatccgagaacccgagagttcttaggacttttttcaattttgagactcttgaactagccgttgttagataaattcagaaaattggaataaaaatgtgcccatcagcgccagcaacagcagttaaatcggtgacgatgactatcttcacaaacgcacttttcattgtttcatttttgatcacattcagcttaatctttggtgaataaattataaattattattttttaattgaaaattataaattgttaattatttaagcacttgaaaagacgtcgaaaccaccgtggtaaaaatgttttatatgatttaatttttctttttataaaaaatctaaaaaatagagcttggaattttgaaaatgcccgtaactgtacataaaaaaatataagaattatttatcttaatttaagctgcatggacacgttgagttcgtcggtgtgccaacggttacggcacgaaaagcgcgtgcatttcgcacgtcggtgcaacaccgacattgaatttcggttaacaaatttccgatgttttctttt

SEQ ID NO: 1895 - DNA, 783 bp, Heterodera glycines
gagaaagaaaagcagcagcgaatgccacagcgaaacgcccacccaaaagaagaagcgctgaaatgggcaaaaggcacaaattaatggacaaatgccgggataatttaaacccgttttttcttaaataaaattcggatgctttgacactgactccattggagaatgccctttgctggaagctttggtacagttgcgggtggcgcagaatcatccgctgggaaagcggacggtcgaagaggccgagaatgatggggggccaagcggtgaagaaaacgttgaacatggcgatgatccaccgctcgaaaatggtcacgccagagaaggcggagaagaaggcgaaccatagcgcgatgatgtacaggcagatattcttgtagaaactgtcgaggggggggggggggaatggagagaataaatcgggagaacactgacatgagaaaattttttaaatttttctattgacttatttcatcgttttcgggtctttgatcgaatttatgatcacttttggcgacatactcaaaaaagccgaaatttacaatagcaaatcgactatggtctataaaagggcatttaaaaatgatttgaaagcttacagttaggaatattcctttgtagtttttttttgaaaaattgttccaaaatgaaaccgctcacctatacagaatgacttttacgctccgttcaaaattccacgtgccttaagaggagttttgtcaattaatttaatttcggtgtttgttgtcttaccgtgcactaaaagaagacgctgaagaaatggaa

SEQ ID NO: 1896 - DNA, 5273 bp, Heterodera glycines
  misc_feature (5227)..(5227): n is a, c, g, or t
  misc_feature (5239)..(5239): n is a, c, g, or t
  misc_feature (5255)..(5255): n is a, c, g, or t
acagacttatcaggtgcgaatgttcttgtaaattatcataaccactctttttcattccattctaagttgggtcttccatttgctgaaccctctccaaagattgcactctgtcgatgagtttcgaagtgccgttctttcgtccgattttttggttgtcggccatttttcattggatgtgtgtcatttttacccaactcactcagttttaattcgaactttttgcttttgagggccttcctttgcctcgttcttaccacgtttttctcaacacggcttttaaattggcaaactttcgctcgtccgtggcttttgccgtcgttctcaaccgcgcattggcacttggccaaatgggcttcgaaagtgacaaccaagttcacatgtacaccttttacgaggatagtccgtccatgggattaattgcgtcgacggaaattcagccgaacaatgcgaaatcgcaagaattggccgattgggtgaaggggcaaattgaggggaaatttgctgctaaaatagtgcacgaattggaattggaaggtgagtaaattgtgggggaatttactgctacttttttattataatttgatgttttttatattctgatttttttttttgtatcccccagaaactctctcaatttttcatttttttcccctcgtattttccctatgatttgccctccctttttctgttttgtcccatttcccctcctccttttggcaacagatttggaaaatgccggcaaatccgacgctctcttccgccgtttgtcctcttcctccgccactttggtccttttctcccattcgcttggccttcgttcgcttagtcaaagtcaaattgcgctgcgaaatgtatgaaatgctgggaaatccctccgtaaatccgcttccattttaagtttgtcaagatttttcatcattgtccaccgtttttggaaaatttagagcggcggtcgatggcggagggtttttttggcgcgccgtcacttggccaaatgttaggcaaaacccgaaaaacatgcgcattgagcgctgaacaggtcaaaagaccaatcgaataagagttccatttgaattggtcttccttcccctttaagttggctttgtgttgcgaccgattttcaaaaaatggtggaaaatgtagcaaattgacccaaaaatactcaaaagttgagcagcaaaatgaggaggacaataccgaaggggacattaacaaatctggcgcagagtgctcatcactttcggagggtaacactccgaaattggcatttccccttttcctttttttcattcaattcccccccccccccttagacaattcattccgtcgtttttgctattcccgcgcaaaaggcaatgcgtccgcccattccgtcgctgaacgaccctttgccttcctctcctggcaccagcgtttgatgtgcaaattcgaccgaatgctccgtcttcgtcagtccgaaacccatcgccaactgcacacagaggaaacacttgtccaattggactttggccaactgagtccctcccggcaatggctcatcggtgccggctgtcgagtgaacaaatcgatgggctttttgacattggacaaacgttttggacgccatttcatgcgcaagtggggcatttcgaccgaaggagacgaaacggcggacaaagttgccattgtggcgcgagacgacgagcgaatatttgcgatggaaagcgcggaaggcgtgacaatgtccggtgctcgtcgctttgcttggattctaattaagcaattaaattaattaattttgttcagttcgaagttggccgattttgtggacgggttttacaacaaaacgctgaaatggacgcccaaaaatgagcaaattgtcgaaccaaccgaagaagaggacgaggaacacttcttcgatttgagcattttgcagcgaatcaatcggcaaatgtttttggaccgaattctcaacacggtgaaaatgccaaacaattggcaaaatgtgccattttcacatttcccttcccttttcagaatcgtcccttcgatgccgttctctttttctccggcggcccttcccacggcccttcccaaactttgctccattttttccaccaaacgcaaaagtttttcgaaggctttgagcaattcatccaattttttatgttcgatcttccttttttattagaatattttcattggcatttctaccttttcagaatcgattcttccaaaaattccttcgattggcattttgactttgaccatttgccaaccgtcgcctttttcccagccaacaggtaaaaaaaaattaataaataaaatgcgaaaatgcagtaataagaatgctttttcaagccaggaaagtttcgtattccgtgccgaattcgccctttccgtgccgaatttgctcggtttcattttcccgcgttgccaaccaaaactccgctggctgttggccttttctctctgtcggggacaatgtttggagcgcaatttgcaaaggatcggacgaatgatcggaaaagcgcgggaagacgtacaaattttgcgcggaatgattcgcaaaatgcgtttaaaaaatggcgtcggacttcgccaatcggtgacctccgtccgccacttccaaattttaatgaaaaagtgcgtttaacttattatttttattttttaaattatttttttccatgtaaaggcgacgattacaaagggcgacgcttctgagactgtccgaaattgttgaagaattgagaacaaggcaatgggacgaaagtggggaggacgacggaagagcgagggaaggaatggcaaaaagtgccattttggccaattggcttctgacaataaacggcaaaatcgccaccggactttccccgtgataaaatttcccgtccacgcgaaatgttttctcaaaaatgctcattcatttctcacattgttaattaattatgcattgttattcacactgttgaattattgtcttttcatttaaaaaatatttcgttaagaatattttatttgataaatattaaaatgttcaacctcatctaaataataatagggccgtggaaggggaggaattatgcaaatgtgggtacttccgtgttttgccccccccccctcgaaaaattttaaaattcttattttggggttttcgaggtcactgatcacgaaaatggtgtttggtttgacatctgctgatgatatctggtcatagattaacaaaatatctatgattttttgaatttttaaaatttttcaggggggcgggggggggggggggtagcaaaacaagcaatttacaaaaagtgcaaatttgggcgcttcaaaaaagtgcaaaaataaaaaatcagattttttcaagatgtgtaaaaaatgataaaatgttaaaatttagaaaccccggtaacggcaattgtctcactgccagacactcaaattggtctctgcttttcaaaattttccaaaaagtgcgaaatcggccatatgtgagcctaaatttactaaaaaatgctatttccacaataagattttgaaatgcacaatttttattttgtcctccgtttttgcttattttacagtgacatcaatggccaatgtcattgtgttattaatgacacggtcacttacaaaggcttagttctgagttcgcgcaaatgccgtttaaatattttatagcaccataactttataggctcttctgtagtccttaagtccttaagatcgcaaaaaagaattatttcttgctaattattcgtcatgaagcgaaccaacgcatcaaacatcactccgcctcgcgcaaaacgttcaatgacacctgcactggacctggacccaaacactgttgcactcgcagagcaagaacgacaacgcactttggtgttcattggcctcccggaaagcaatgccattcgcccatcggaacgtgttcaggaagacagggaagccgccacaaaaatcctggaccatcttgaagttgaggcccaaccaaccgccgtctttcgactcggacgttacgacccgcagcgaacaacaccacgcccgctcaaggtggtcatgccaacaaccacacaccaacacatggcactcggaggatggaagcgcgagcgtgctcgactccgttctctacaaaacctgaaccgcctgttcgtccgcccagcgctgaccaaagaacaactcaaggaagaatatgaagcgcgcttccgaaaacgtcaacaaaaccctgctcccgtggcaccagcaatgcaacctcgccagacaaatgttccgactcccgtcaaagaaaatggaccaaaccagaaggaggccagcgacgacatttccaaaccgccggaaatttttgaccaaacaatcctcgtatgttatgaagcattaaaatcattaccaccaaacgacaaaattgttcaccaaattcaatcactcgaaaaacaataccctcgtcttttcaataaatagttctgtcagacctccaaacatttcctcaaattaaaaaaaatacatttattccattacttaaaatttctcaccaaaatttttcctcacaaaaaaaattttttttttctcttctacaaccctaaaaaaacaaacaaccacttttctctttgttggaggtctgacttttctaatttctgcttctccattcaaaatttcaattcttttatcattactttccatttcacctcatttccgccaaaagtgtaagtggcacatgcccttcttttggttatttttatttttgaataaataaatttactatatataagcttcaacatcttttcccatatcattccaaaaacattgtcccatcactagggttgtaaattatatggactaaaaaacgcgaaatatggacattaaatatggactaaaaaagcccgaaatatggactaaaaaggccaaaaatggccaaatatggaccaaaatatggataaaaaatgccaaaatatatgttgtaaacccccaaaaatcccaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaagaaatgttcgcaaaaaatgacgaaaatatttattgaaaatgccaaaatgacgacgaaactcaaatttttcgtgttttgtggggtgtaatttttaaaaatttccaaaaangtgatcatttangggtgtattttttcgnttttttttttcatttttc

SEQ ID NO: 1897 - DNA, 673 bp, Heterodera glycines
tttggattccaaagaaaaaagttatagcaaaaaacataaaaaattttgaaaatctgcccacagataacacacaagtaccaaaaaaaaaataccatacaaaaaagagaattaatttgacacgggttgtagtcaggtgcaaattaacaaagaagaaattgactaaagaactcgcagaaaagactaataatgaaaagaacggacacagggaaaaaacaatggacggaaaatcgaaagggttaactactgtataaagtcaacagcatacggtaaaacaaaagcaataccatttgtgtaataaacggaaaaataagtgttaaaggggatgatgggtaattagtcttttgccataaatgcgacgcaacgaatttcccaatttaaatagaaaaaagaaaaactatattcgaggttgactattatattaaaaaattataagaatttactggaccggtctaaactttaaaaaagcaaatgctaaaaatgtgagattggcgaaaagggaggagcaattcggaaacagggaaaagtcgggaaacctaaacaaaaaaataataatgagcgaaatgtcagtggaggaagagcaatggcattaataagtgaaacagtaaaataacactagaaattgatcaaattgggaagggatgcacaaactgcaaaattcggggggggggggggg

SEQ ID NO: 1898 - DNA, 3057 bp, Heterodera glycines
  misc_feature (3003)..(3003): n is a, c, g, or t
atgtgcaggattccccgtttcggtacccgaatcgggaagttaccggattttgaggtttcagtcacagttagtttgtggggttggctattttttaagggatatttgccgtatagtcgcgattgccggtaaaatatgtcactaagaattatagatagaatcgagaagaaaaccgttgtggcgctttaaacttaacgtacgaaactgacaccgactccggtcacaaattacgggaccaaaagccaagaatttaaagtcgatcattttccaaatcactctcattagacaaactttggaatgctctatattattttcccatttactccgtgcgtttctcccgttcgttcgtcaataatgatcatttccgatcattttattgctcaattggtgtttcttttataatccttaattaaaaatgttgctctgattatttcttttctaatcaattaaattggtaagagcgttttatttattaatatttcagggtcattaaaaatgttattgctttatttaagtggatttaaatttattttttttcaatccgtttcttgaagaaaatattctatatttgaaaaattttatgaaactaaaaatttttaaaacattcgatgaaactttttaaaatttaagcctaaacggataggcatattttaaaagcaattataaattttaaaaatttttattattcaccctttttcgtattataagcatcagagagccttatcaacatgtaaataaattttggtgcatttcagagcactttctgaaaaaatattaatttttcataaataaataaataatgaaaaatcagaatttctaaaaaaattttaaaaccaataagcattttcattttttcaggttagccctgtaccggggagtatgcctagagctaggttctaaaaaataatttgtcactaactgatattaagtctgccaattttcattgaaaaaaatcccaaaaaatcaaatcaattcaaaatgtcaaggtaatacagttatccagaatagaggcttgacccccaaatcagtgacaaatatctcctctaaaaatggacattgaagagcattttgatcccaacgtttgctcacttgtatttctaaaaatagttttaaaattgatcggccccttctaaatctcccggatgatttcattctttcatcccaaaatccaccactgactgcctcccgaaatggatgacatatccgcgcccaatcccccccccccataacgaaagtgggatgaattgggtgtaccacaaggtgaataaggtcgcgccggtgcggaggggggggggggaggcgtggcgcgaccttgatctgtctcgcgcgagttcctccgcgcgatggtcgttgtcgccttgcgggcgcccccgcgggggcgtccgtcattttgacaagctctgtccactacaaccggcatagcgccgcggaggaggacagcaacaaaatcaacaagaacaacaacacaacaaccaggtaccagaactggaacaactccaatgaatgccgccgacgaggcggtggcgctcctaattgtggtggcggctttcgcgccggaggacggacgttagccgattttcacaggacaatcattggaaatggcgatgggcgtaggcgggacggggaaagccggatttcgcccaggggtacgcccttctccaatgactgaccgaccgtcggcggtcagcaaagtcacaatttttgttgattcctccacaattatttgggattatctttgccttcaggagaaatggggcacattaatcaactttatacaattttttaaaaagaacgtgctcgtttaagcaataattaaccttaatcatatacccattaactcgctaattttttgtcgttcattggtgacctgattttgtgggtccttcttttttaattcaattagagtagaaatttggtgatccactggcacaaaaaataaacttttaaaatgggagaagccttcaaattttattactgattttcttcttggatttaagttttgttgtccaatggaaataaaaaccaccagtaatatatataataagtgattgattaattcgccacatgactgaaatattttaattccgatttaatttttttattttcccccttattccatcagtctattgggtgaaatatataaggggactggatatatccggcgacggatcatcttcaccacaattatcgtgtacattgcgcggctgacaccagcgaaataaatccacaaaaattatggcggaatgacccaaattttgtggcgacaaaacatcgaaaagtcaagccaaagatggagaatagcatatttaaatttttttaattgtttattttttattatttatcccaaagcggaatttgaaattcacttattaaacaattatttatttttttgattattaaaatgaaatataaccaacttcattcatattacatagcataaaataaataatacgtaaattaaactataaaaaatttaggcatttccattaaatcttaaaattaatttaaatttttttttcaaaatttgaaaataaaaaacaattttagacaaaaaaaattgtacttcaaacccattttatgggaaaggtcacatgtacaaacaatgcaatacaacacaattctctttattggagtacaatgtgtcgtttttctcttcacttcactcatcacaaatccgcgttcattttcgtcaccaaattcttttcctttattcgtccaatttggttgagaatctcgaaaaaactgatcaatcgaatcattactctaaaccattttaattactattattttattatatgaatccaaatttttaaaacggattttggaattttatcgtttctaagaattttgagtttttgagtaaagccaatgccaaaaaaatcaaaaattagctaattaataaatttactatattcaaaatttataaataattaatgcgcgaaaattcctctctctgttttaccgagaaatgatcccacggatttgtacacttatttggtgtattanatgatcaaatttaattgcgcagattatttcctgaaaaaatacatttttttatga

SEQ ID NO: 1899 - DNA, 6741 bp, Heterodera glycines
cagcctttggttctgcatacatttattcatattcggaatttaattgtaaaaatgtcagcgaccgttgttttgccatcaatgccagcaaaatgcccattgccggtgcaaagcattcctcgcggcacttcggcatccattgaggatcaaaatggtacaaattatagaaaaataaaataatggaaatggtaatttatttgcttacaattaatttgaacaactattaattcaatctttcgatcgctgactgacttatgctttcaacaggaaaagcgtcacttaaatatttgcaaagttaaaatcgtttttacggtgaaaatcacagaattaaaacaaaatttccactaaagcattttctcggctttttgataataaaaaataaattatattggtagtcgattttctaaattggccataattactatttaataaaatttaaaattaattccaattattaattaatggttacataaataatgaaaattgattcaaacttttaaattacatttttccaggcaaattggtggcccattgtgtgttggtccaatgcaccaagggacaagcgtatctgattgtccaacaaatggacgctattgtggcaccaaaagcggtcacattatgtgtgccggacatggacaaaccgtttgacctaaaaatcagcactatttcggtgagtggaaaacaattaacgctaattggagtcaaaaagagacgtacggtaattacaaaatgtgctaatttacttggtaatattggcatgccacaaatttcattggttgatgtcggctagagcgaaatattataaaaatattgttctttattttaacaactaaaaatatttacaggatgtccatccaaaccgtatgcatctgccaatgtatatccaggtaactgtattttaataatttaggtaaaaataactacaatttttaaattattttttatgaaaattaattgagtaggtccattataatccggaacatcgctacccattggaacatttggtggatttgttggccgaaactgtgcttggccgttacaattttgaattgcgcaaaaacttgacaatcgatttgttcgattcggtatgttaaaatcaaaatttttactttataaaataaaatcattgaaatttaaaaaaaaaaagtgttatttgtagggatgtaaaatttttgtacgaaaaatcgcgaaatatacaaaattccggaatatctatgaaatatatacaaagtcctccctaaatattaaaatatgtaaatagcaatgccacaaaaagaactaaacttatatagatgattttttttgactttttaaaaagggataacaatttttaaattaaagattttagtggtgcaatgttatttatttttttaaattttcataagaattttctttaattctaaaaacctcaaatacgtattaaaaatatgtacaaaaattttcacacgcataagtaatatgaaaaatatcagttaatgtgtttatatgaaaatttatatccctattggcattttaattatccattttttgaaaggctgcgaatgcggcaatccgtgacggtgccggattcattgtgtcggatcggcatcgctttcagcagatcagcgttggcgcaaaacaggcacgagcagtgctggcaccgacaaacggtgaaaatgaattgaaattaaatgatagtattaaaacaattgcaaatataaattaatttaaattttagaaatataattgaaaaataatttacctatttttgaagataaaccattaggagaagttatcatcttatgaaatgattttttaattttgattattttttccattttcaagtcaaaatcaaaatcgatgacttaaagttcaaatttttcactaagtcattaattaattgttcaaaattgcattttatttatcgcaaaagtcgtaagtcaaaaacaacgaaaacacattatttattctttttgtaaatactcgatttgaagagacaaaggttgaattggtgatttgatcatgcgtcttttgctaaagtgaatgctgatatttttaattttatttcgttggggttttaaaaaaaaatttgtttcagaggttttgatttcgcttgtttctgatgatcattcggaactgctcaaatacgatgcatcactgagcaaccatcaacgagcggactttttgaattttttaattaaaggtaattagttatatctaataattaaaagtaatgaataataacattaatattagctcatttcattaaaatgaataaatcttttaatttacttaaattaattaaaaattggatttacaattgaaaaaaattgtcagtgaaaaaaagaagataactaatgaaaatatttaaaaaatattttaataatgaaattcttttattaaattaaccaaaattaagaatgtaaaaatgtgctggtggcccattggagtcctgcgaaattggcggctgacgctaaagaaaaaggcacgaacaaaaaaaaattattggtcttttaaaaataaaataataaatttaaaatgtattcatttattttcagacaaagaaaatgaaaaagaatcagagggaaaagctgaacaaaaaggcgaaaaggaagaagccgttaacactgtggcaggatatttggtattttgaaaaatatataaaatattatttaatagaaattcataaatttttagattggaatatttattaattttatgccttatctaaaacttttttacagattgcttcctctgagcgcgttctgtgcctttatgcggaaaacagtaaaattgccgattctttgttggctgctcacattgacaggagcaatcagaagggaacggtaaaaatttaaatataatttccaatcatttaattaatttcgcttaaaatcagaatgtattttttctgaatttgatcacaaattgcataattttgttcataaatttttcaattaaatacataattattttttgttttaaataagcttttattcatttattatttaaattatattttaaaacatttattaaatatttttactaaatatttctcattatttttgatcaacttttgctgcattgcctccaaatgggaccatttgcgtgcgctcgccaccctccgcacgcggcccatttaccgtcggcacacgcgcgtggtgccgtccaacatcaaatatgagaagctgttcgccatgaatgttggcatcaacattttctgaacattgcgcaaaaaaagagggtcatcggaacagcagagatttgattgaacaatgaaaaaatggatttattacattatcaaatgaacaaagtaaagtgatcagaaaagtttttattttaaattataaatgggtggaacgcttcaaataattttttgaaatgcaacataaaataaagagagaaagagagataaatgccaagataaactgtttttatgaaattttaagtgctattaaaaaaattgaaaacataaaattaaaatcgtaattcgaaattaattattacatttcttaatcttttaaaatttaaaatagtggaagttatgtaatttgtaattttttcaactggctcggaccagacgctgattcggtatcgaaattgcctggaattcctggattttcaggattaatcaactgaaaatattaggaaagaaattttccttggatatttcaacctgataattctcataaaattattaatatttaacctttaatatagaacatgtaaaaaaagggaaaaaattaaatcaaatatttttattcaaaacacgtataattttattagaattatgaaattagctgatttatttgcttatattttattcaaaaacacaatcaattattaccatttgaaatacaaataattttaaattatcattcattcattcttccacctcgcttttgcttttggcaatgtttgtcaaaataaggggcggcagggtaaggtagtcggggattggcacagaaatgttaatccatgtgaaaggaacacccaaagggcatatatcgaagcagaaactcaaaatgcacacttacttgcacccattggtcttgacagatgggcaggcttaaaaaatatgaatgttttacatttaaatgccttttatcggaaataaccacaataccgtcgcgtggggcttagaaacagtggtggaggcacagatgagcaccaaagcgaggctggcgaagaaaaaagaacgcattttgggagtttcaacgcttaaaaatttgaaaatttgaatgctttagttttaacgctgaaaaatttaaaaatttgaatgcttttagagttttcaatgattaaaattgaatttctatttaatttaatttatcaaattcaaaataaaaggttgcgcctatcggccccggtaataagctgagaatttcgtttcgaagctggcgcctgagaaattttatgaaaaaacatatttcagggctggttgactgaatgttttcgcttgtaagtactagggctgggaaatttaggaacgaaaaatcgcgaaataggtatttaaaaaggtagaaaaaagctcaaaataggtattaaataggtacaaaaatcccgaaataggtagaaaaataggtaaataaaatttttattaacgattttttagtggaaaaaagcaaacaaagggggaaaattttggttctatttctttgtaaacgaataattaaaatatttttaatatgtttttagaaaataatgacattttaaattaaaaattttgttaataaaaataaataaataaatttttgggggaagaatttttgggaaaattttccaattcttaggggtgtattttttgattttattgcatttttgttaaagaattttctgaaaatccttaaataggtataatgggtagaaaaactccaaaataggtaagaataggtattataaaagtcatcgtagacaccccaaactaagtggaaaatgcttattttgtgcttagcaaaattggtcagatataatgagcagaaatgagtccatttcatcacatatgtcgtttttttcaacttttatatatacgcaattacaccataaagaaatgtataacaaattttaaatttaattgtttgaaatgtgaaatttgctgattcattttgcttattaattttattagttattacgaattaacaaatattttaaatttttatgctccttccaattctcttcacccttccatttattcttcctgctcctcgccttgggtaatgtttgtcatgttaaaggaaggcagggaaatggcgtcggggattggcacggaaatgttaagccatttcacagcagcaccattttcatcgttcttggcaattaaattgaattatttttttagcacataaattctgaacccaaagttttataaacaaaaaaatgccaaccttggccttagggcaaatgttgatgcacacaacgacaaagcacacttgatagcaacctttttcattggtcttggcagatggggcaggcttaaaagaaaaaaaattacagttaaatgcattttcaaaaatgaccacaataccgtcgggtggggctttgaaacagtggtggaggcacaaatgagcaccaaagcgaggctggcgaagaaaaaagaacgcatttttgggagttttcaacgcttaaaaatttgaaaatttgaatgcttttagagttttcaatgattaaaattgaaaaaatttgaaaatttgaagtttcaatgcttaaaatttgaaaattttagtgtttttagagttttcaatgattaaaattgaaaaaatttgaaaatttgaagtttcaatgcttaaaatttgaaaatttgaagtttcaatgcttaaaatttgaaaattttagtgtttttagagttttcaatgattaaaattgaaaaaatttgaaaatttgaatgcttttagagttttcaatgattaaattgaaaaaaataaaaatgtaaattctttcagagatttcaatgctaaaaattgaaaaagttgaaaatttgaatgctcaatagaggtttttatttaaatatatggtacaatcgggggaacaatggcatagcttcaaggaaaaaataatgcttttggagatttcaatgattaaaaatttgaaaaatttgaatgctttccgagttatgaatgattaaaattgaaaaaatttgaaaatttgaagtttcaatgcctaaaatttgaaaatattagtgttcttaaaatttcaatgattaaaaattgaaaattttaatgcttttggctgtcttattttacatttttatagtctctcatctgcttccaaatacattctttgaatatacattcggcatttatttttcggcaaaaatcatttgaaaatgtcagaaattaattcctctaataaccattgggaaatgatgaaataacccttttaactattctcagcaattcgaaaaagaaatcggggtgaaataatattttcacttaatattgaacctgggacaaaaaggcaaaatatgagaaaaaataaattctaaatattttttatttttaatttcatctaattgcccacaataattaagctcttcagagtgtccctaggtctcaatagcagggtctttctaagcaacgctctaccatgaacagcgtgatattgtttgtcttcgacagaaagcaatggacgtcacaacaaatcctcccccccctctctctcctccccagtgtctctccccactctctctctctctcttcgcctcgggcaccaaaatcggggacgacgagagaaagcggaaaacttgagcctatgcaaataattaaatta

SEQ ID NO: 1900 - DNA, 6777 bp, Heterodera glycines
ccaatttgcaatttattatcaattatttttgtcgctaattttcggatttctttcttggattttgaaatatttctttatctttcttaatttgtcttcaacgaattaaacggatgaatatataaaataaagaatctttgttttgaggtaatttaattcggtgctaggtcgtttcttaaaaaccgccacattgggcgtttcttaaaaccgccagggcgtttcttaaaaccgccagggcgtttcttaaaaccgccaggtgggcgtttcttaaaaccgccactttgggcgtttcttaaaaccgccagggcgtttcttaaaaccgccaactcatatgattatgtatgtatatccgttaaattaaatattcaataatatctattaatttttatttgttgtgcaagtaagtgtcagccggaaatattattagtctagcagtgacagactaaaaatctttattaaattaatttacaattatttacttaatttttatttggttgtaccaattacgaattagcaattttatattcgaaaattttgcagttgataattgttgctataaccacgatgtgtgctacataaataaatatcagaaacgttacgattgtgatattaaattttgcaattgccttaatgaatatcctaattgctttctaacaaaagtctgttctccaactcatatcttaaatattttattttttagaatatattatgctggtcagttcatatttttggagaacgttttaaagaaggataaaaataattattttattttaccgtcaatagatatgcatatgtattttaaattttttattgttatgtaaacttctaatatatatatatttatatacataatcatatgagttggcggttttaagaaacgccctggcggttttaagaaacgcccaatgtggcggtttttaagaaacgtcccagcaccgatttttaatatgaaacttaaatttgaattttaaaaattgtcaagtaattattaatttacgtcgatagggggggtttaggtgctgaaaagcgtttgttgaagcttaaatgaaagccttccattccattattggttcttccaatgttttgcgaagacggaataccaacaaccttttgaaggaaaattactttaatttattgttattaatgaaattagcaccgaatctttcgtacaatagacagttaaacatttgtcgccactgatttcgaagttttcgtgacaagcggtggcatcccaataattttttgggaattccttaaaataaataattgcttttaaaattattttagtccaagtcttgaaggactgattattttatatgaggtttagctaattaaaaatgtttacttgtcaaaaaatgaattttatttaattttttctctttcgcttattcaccattctcttctgcttctcttctttatccatttcgctgatttttcgcatcgtttcttctgattatttttaattgtgagatttgttcctcagcagcttaaaattaattaattattgcaagcaaacggtgttatgacgttactcaaaaacaatcaaaataaaaaattgacagaaaatcattcataacttcgccgaaaagaatcagattttataatcttgataatattcgatagccctaagtgttttctgtttttatgcaaaattaaaaaaaaattgtttaagttccaaaaaaagttatgaccaaaaaggtttgaaaaaatttggttttctgagttcctctaagaatagatcaatccacgccataaaaaaacatagaaaaatttcaaaaatttcaagaaaaatactaaaaaaatttaaagctttttttaaacttacatagatattactaaaaataaaattgtgaatttccagaaaaaacaaaaaacttaaattttcttaataattgctaagtaactaaatttttagaaatttttgaaattgttgagaatttatatgtattttttggggcgatatttcggccgtgcatatgaaagcgatggatggatttggattagacaactaattccgaggtcatgaagaacttacgaatcaattactctgtaataattcgattcagggaagttgctcgtctcggatctcgtatttaggcactagacacgagactttcgaagtaatgtgtcaagcaattcacttttttaaagtttcttgtaaatgtttatagaaaatttcaaatttcgcaaaaattggaagagtcaaaattttttggtttgcatttaactcaatagtttttttcgagtttataaatatcattatgaattttagcagataattggaaaaaaccctattttttgcaaattttcatcttttagtcttaaatacccgggaaacgacaaaattttccgattattacagaaaaccaaattttaattgaagaataaaaacataaaaatgaataaaaagagcaaattgatcgaaaacattagtgaataattaattcttccttcagagagtcgccaaatcgaatttgaaattgggcccaaaattcgcctcaatttggtcaccagagccaaacaaagaaacgaatggataaagagaaccatcagcaaaagatggagcaaccaaaaaatcagaggtatctgtgaaaaagttaagggatttttgattattttaaacataaaataaattagataaaatagacaattaaccaaattgtaatttaaaatcgtaaaattatattatttattatttgctaacccaaacgaagtccatttttggtgaaaatgatctgtcgagtggccaaatgaacgccaattcctacggtatcgccaacaccgtaggaatattgggcatttgattcatttccttttccgttaatccgaatattgccataattgtcaaatgcataagtgcccttttcccatcgaattgattcatccaattttgtctgctgtttaacagcgaatccgaaggtgatgatgccccgactgaataaagaaaaaataaatattaaaatatttcactttttatacaaaattcgcttactaatttcgcctttcgttgtttttcataactgaaatttcgtagtaaaaaaagtcggacaaatgcttattcagcacaatcggatatttagcgaagacggagcgccaacctttttaagggaaattgaatttttatgtaaattttaaaaataccattaccatttcccttatgatggacaatgagacttttgtcaccaatgatttcgagattatcatgacaaaaattggcatcccaacaattttgttggaatttaaaaaacccctgaaagtaaataattcgatatttttaaataaatatttgtataatttatttaatttaaaatatttttaccgttaaatttatttatttttattttctcttccaattcattcacctttttctgtgtctgcttctccaattcactgactttttccaaaatgttcttctgatcattttccatctttgaaaattgctccaaaattcctaaaattaattttcaaaaattaaaattttataatttatttaaatgaaattcttaattcataagaaacttattcaaaaaaaaagaatttttaataagtgataaattattcttcgctaaaattccctcgcctttgtccgtgttttcgttctgtttttccatttcaccaattttttccaaaatctttgacaattgccccgcagtagcttaaaaatcggattaatttttaaatttaaaatggaaacatttaattcgattaaatattttttcattttaatttctcctcgccttttgtctgcagctgtttctgttctttctccatttcactgaagattctttccaaaattttcttctgatcattttgcgattgtaagaaccgttcctcagcagcttaaaatagaaaacaattaattatttatttatttaaatgaaaataaggaaaatattgatcataggccacaaactcaaaaatgcttaaaaacggtcagaatcgatgtaaaaagggtggaaatggataggaataatagaaataagggcgcgctagccctttttcaggatgaaaaagagccgtaattgaagagccgaactcgtctgggactcgagcgaccgtgctatactaacttctctcaatagattgtggataagttgtctaggataattcgtggagctgatcacgagtatgagtttattttgcaagattccaaaccccgaatgcagattcaagcaatgacaaaattgataaataaaaggaagacatatttttagggatttcgagtttgctgaacacggatataggcctaagctaaagcctagggctgaagcctacgcctaagctgaaagataagcctaatctgaagcctaagcctaagcctaagctgaagcctaaggtaagcctaagctgaagcctaagctgaatgctaagcctaagctgaagtctaggcctaagctgaagcctaagcctaggcctaagctgaagcctaagcctaagctgaagcctaagcctaggcctaagctgaagcctaagcctaagctgaagcctaagcctaggcctaagctgaagcctaagcctaagctaaagcctaagctgaagcctaagcctaagctgaagcctaagcctaggcctaagctgaagcctaagcctaaatttttgagtgaatatgcggtttctgaaagctcaatgtgttgaatttatgtcctgagtaataaaaataatttaatgagcgctttaaataacacggccacttgagtcccagctgagtttggcactccattttcggcacttttcatcctgaaaaagggcaagcgcgcccctaattctatttttctaacccatttcaaacctttttacatcgattctgaccgtttttaagcatttttgagtttggggcctatgatcaatatttaccgaaaataaaataaatttaataattattcctatgcttttagcattttttcgcagaatcggtcgagttttaagattctctctgattgtattaattctgctgctgccagtcaaaatgttctcaataattaaaggattcgaaaaatgttcaattgcgcagttacgaaagaaaagcccgaaaatttcattttcgttaaattgccctcgccttttgtctgctgttgttgctgcttctccatttcaccaattctctccaaaattgctttcaaatgatcttccgaaactgaaatttgaagcaattttttaaataaaattaaaatgttgttaagttagcaaattattctgaaaatgccttctaatatttgtatattaccatcttttgtcggagttttcctgtcttcttgctgttcttttccttcttcttcctccagactgaactgatcatcattcattcctcaaaataaaatttatgaaataaaatttaaaataataattttggctctattttaaataaaaaagttattttctaaatatttttggccattactttttttgaaacaaaacaaattttatgaaattttacagaataaaatttcaaaaccatttcttttattgtataattttcatactgtatccactcaattatacaaaattccctaccgtatccgtcttgtccaaacacttcagaactggcaacagatggctccattgtttgcgctcgattcagctcagcaattcgggcaatcagaacactcatttcctccgatgtgctcagatttggaaaaattgctaaaaatgaaaaattattaaaaaattacttttaacaaatttgaaaattaaaaaatgtttattattgcgttttaattatttacgttggagaggagaaaattcatccgctgatgaaaaagtgtttaatgatgacattttaattttaactaaaaatttattttaatttgtttaatgcacttagaataaataataaaagatggtttaattagggagaaggcttatatttttggaaatgaatcataattttaattcccttttcctttttttttggaagaaatgccgaccaaaagtgcttgtcctcccttttcagggcactttccggacccggaccaaaacaaccctggtgtcattagaaagccaagagtttgtagatgtgcccaaacatatttgttttttgaaaattgttgccttttttgaccagtttttcgaatacagttcgaagtggtctgaaaatcagggctcggatcgaaaatttttcaaaataagaacatcaaggccaaaaaataagatttttgggtcaaaataaggaaattgcttcaaatcagcagggcggaggacaattggaggaaaaagtgggaaattaacaggaagacagaatgaatgttggaaatgagcgggggtcacaaagtcggggaggaaagatgtgtttgaccttacaaaggcagcacagacacaataaaatgagagaaatagtgcgggagacagagagagggaaataacgtaaataaaataatataaatgtctctctctctcggggtcatcagtcgaacacagttatttttacaatttattcgatcaaaaatgtgtcatatagtatatttttgtaacgattttagtaattttggggaggaaattagcaaatcataaaattttagtgcattcgggataaaaaaaatcagatttttaacaattttttgcggcgcatttttcaaaaaacttttgggaagtgcgaggggagggggtccggcggtgccgaaaggcgccgccggaaaaatttttgtaatttaattctgatttgttaacagattttcaccaaaaaaggccaattttttgcgattttgagccaactttttataaaaataaggttttgggtgccggcggtgccgataggcgccgccggggaaaatttttgaaatttta

SEQ ID NO: 1901 - DNA, 1473 bp, Heterodera glycines
atttttgtccgctttgcaattgccgtgccaacaacaaccgtttaaaggagtgtatctgttcaacaacgtcaggaacacccataacaatgacattggcagccaacaagagcagcagggacaccaacaacaacagcaccaacatggtgaacaacgacgacgaccaccaaatggtggtggtggtggcatggcggaggagagcgacgacgaaatgatgatggtggtggtcagcaacaacaacaacaacggtaatgaccatgaccagcaacagagacgaatgacgacgatgatgatggtcaacggaagtggtgggcgtaatgatgatgaggatgatgacggtggtggtggtgatgaggatgaagatgaagacgacggcttttacgccattgatttgggccaaccaattgaccaacaacagcaacaataacaacaacatgaccagtgatgagactgacacatgaggagtagggggaggaggagcactaaaatctcaaacaattgtttttgttttttttgaatttttttgcacggggccggacataattttggattattttattggtttgaagcccaaaaatcacgctttgaacgccttcttctccacgctgtccaatgaggagatttggtttatattgtccattgggaactggcccaaattttgccaattttaccgcaaaatgccgaccgctaaaagcgcaaataaatcttttgttgttcttcggttcttcccttccccttccacctcccgccgcatttattacttattattattcattttgcatattgcttattagtatttgttgtacttcttcctacattattctatacttgaaatggtacttaaaattgaaatcccattttttccgttacttttttcacaaatattcattaaaaaatgggattttttgctctatttgaaagtgtttacttacttatccaccaccatacttattatattattaagcaaattcactctgcatttttcttttattttttcacaaattaattttattatttttttttgtccctcggtgcatttccattcattttatgtccttacacacaatttattctgcactttattacatattattgctaccgtatattcacaaaaaagaattactgtattttcatggcttatttctctctctccctctccccgtattcatacaagctataatacaaaaaagtatgttccgaaacattcagaatacaatatatattatacaaatttgttttattatttttattctacatatatctcaactattcgatattcaaacttagaaattcatgaaaattgctattttatttgttttacaatggctattgtgtaatatataaaaaaaaagcacccatagttattttacgtatattgaagagcaatctcataagcatattaaagtatgaaaaacaaaattttggtcttcattattttatgagtccaattaactaatcattattcttaattaattt

SEQ ID NO: 1902 - DNA, 2195 bp, Heterodera glycines
tcaaaagcatcataaattggggtcaatctcatgtccaagagaattgggctctaatgcacattatgagtccaatcaattacaatccccgggtttttaaaatcgcagcgttcaggcaattaccaaaaaagatttgattaattaattaattgctgattattttcgtttgtaactttattgaaatgttagaattctcttgttttctcgtattattacattattcagactttgtgctttctaatgataccaaaaagatagggtttgttcgaacatgaacaaagttattgtataaaaacccgggattgtcaattgattggattcataaaatacctttggactcataaagtgcattagagccgagaattgtgtctcaaaaatgtgtcagcatttatctggatctggatgatgagcttgggccgggcacaaccgccgccgttgttgtcgctgctgtttcgtcagtgttgtcgcccggtttttgcgccggcagaccctgatttaattacaatgattaattaaattaattatttatttgcaaattgtttttcccaggggcaggataaaacaatgccgtcgaaacctcgccacaaaatttgtaaaaattcaagaaaaaataatcaaaaattcttggctacctagcccaatacgaaaaaaaaattgtattaagaaaattcatggaaacaaataaaaatacaagtttttttccctggaaaatcggcaaatatttttttcagtaaaccaaggctctggaaaaaaaataaatttaaagaaaatttaaaattgcggcgaaattgtgtgccgacaacatttttgcggtgtacccgttttcccctgttttaccagtgtggtgcgcacgagtttgtgcgcaattcgctcaaattgggcacggttgtcacgccacattttggccgcgttcacattggccgcactttcgtcgtttggctctgcaaaggatggatgggcaaaatgccacgaaaaaagccaatgtcaacgccaaatcaaattggcaagggacggacccgccagcatggacaccaccgagatgagaatcttttccaccgactgcacgggggaccatcgttcggcactcgtctcgtaaccggtcgggtcgtcgcccggggtgtgcaaaatgctaaaaaaagcgcagaaattccaaaaattgaaaccaaattttatgaggttgaatcctcccatagaaatattacacaggcaactaactcatatgcaaaaaaattgaaattgttttttttataatacaactaaatttttttgtggatttccgttttaaaaaaaatataaaatttaaataattttttgagttttaaaaaaatcttgcttttttgttcaatgattaaattttaaaataattaataaattttgttgtgttgtgtatatttcttaaattttgttgaataaatgaaatgccaaatttcaaccagaatcaaacattgttgtgtacatgtacaaaatggaggccctttcccctcacctgatacacactttgccgtccgcgtaaatgttcgggtggaaaatgtcgcagagaaattgcattttgggcggactgagagggtaatcctgtagtaaaaataaacaaattttattatccatcggtcggcaaaaatgacacctcggagaatgtgagcttggctgggaaaatgccgtactcaaagcaggtgccctcggggccagaaatcagacagtgccattcgaaaaagttttcctcatccgccgggccggccacaatgccctccggggggttgtggcaaagctctgaaaagcgggcgaaaatcgtgaaaattttcagtgcaacaacaaccccttcagttatttggtagaaatttttcattgaataataaaatatttttgggcattttccaattaacgggtgcaaacacatcaaaaaatgtaagggttttttgtattcctcaaaaattacccgaattttctgccatttttaaataacttgacaaattaatacagcagcacccatttgtgattgattcagctgatcattttaccaaccaattaatttgtttgtttttattgttattaattgtgtgtaaataaatatatgcacaataaactcacgtcggtactctgtcaacaaacggcgcaatgcgacaccggccattattttactttccaattttaaataaaataattaaataaatttttaaaaattttaaaaataatttaaatca

SEQ ID NO: 1903 - DNA, 1764 bp, Heterodera glycines
aaatgaagaagccgagcaggtagacgagcagcaacatgttcaacagtccctcccgtgagtacgccgtcagaaaggggagcagcggcgagtgcatcagttcctttgtttttggcaaaaattcaatacaaaaactctggcattgtgtcaccaaaaatggagcccccccccctcaattttgcttcgaccgacttccggctgttgaatgtgtggcgtttgcgcacaaatgagtttggccagcacaatgtaaaggaagggagaggcggagaacagcaaacggatgctcacctaaaggaggaggggataatcagcatccaatttcagggggaaaatgaatcgatcagaaaaacttttaggtgcgatttcgttgccccctcccctccccgaaaactttttaaaaattagaattttttatttttcaaattttctttggaggtttttccagaaaaaatattgaaatgtatctaccccaaaaggggaggggggagatgtaaaatcatttagggaatgaggcaaatctgaaatttttgagaatttatatatttgccaagctacacttgcgcacacgcacctccacgttgtaaaagaaaaggccggacagtgccaggaacagtgtgtgcaacgcgaacggcaccagcgaacgccggtcactcagaatgtcgggcacagggcgcaggtcggtgaccaacagaccaacagtgtgcctgaacaaaatgggggggggggtcaattgaacttagttgaaaaaagccaatggcaacaatattgaatgggaattagtccaaattaatgggctaaaaaaataaagtttcattggatggggttgcgttttagggaataggcaggcccctacttttacataaaacattcaaaagagaattcagatttttttataatttatttccaaaaattgggattaattaaggaaaatttgattgatcaaacttgtcagtactgtacagtacagtacctgtaaacaccgtacatggcaatgcacagtgtggggccggcaatgacaaacagagggaatttgcgaaattgccaataggcgaacagaccgacctgagaatgggaattggtaaattaaaaatttgtgtattatcattattaacgaggggtaattaggcgtaattaattaggggtaattagcgagaataattagggaatgatggggaaaaacagggaaaaacaaatgtatttaaattgatacacaaattcacgtcagtcacctcccagtatttctgttgcacatgagcgtagaaggcgggcaacagcagagaggtggaaaatggagaaatgctgcaaaggaaaatgggggaaattaaaaaaaattgaaatttaattttatatgaaaacccaaaggaagccgagcaatttcgactcacaaaataccaaaatcttttttttgttttgtatatgaaaaacatacattaacaaggggtgcgccagtcagaccccgatacgccggacgtttggcgcagggggggtgcgccaggaccaatttttcttacgtcggcccctatttttccccggccactttttttttttttgctattcaaaccaacttttttttgcggcgcgttttttccagaaaacttcgtgggaaggggtgaggtgatccggcggtgccgataggcgccgccgggaaaattctttgaattttatatgggtattgttcaaattttaacttttttcccccttcgttacgaccccctcccctcctttacagccaccccccttacgacgcacgtgggggggggggggggg

SEQ ID NO: 1904 - DNA, 1986 bp, Heterodera glycines
aagtgagtataattcaaaaagctggccggacatctttaaaatggtaaaaaaaaaaaaattttcgcgctacaatttttccagtctcctttctctggtggttgtcctaccagcagtgcatgtacaccgtgacaatggcctctttcagatttccaccgttcagcaacaaggcaagtctgagcagcacaagcccattaaagacaaaaagtgcctaaaaatttcattttttaaaatttaaaacgtcgtaaatttaacacattgttcaacgccgtgccggtaatcaacatggcggagaacaaactcagtgccgagccggtcagttgctggaagagttggccagtcatgcgtaacagggcgggaaacagtgggaaaaatgccaaattggactcccattggtagccgaattcggcaatgtgcaaaaagtgccggccatcccaacaactgaggccggtcaatgtgccttggacgagccggtcgagcagtgtggcatctgtgttcaatgaattctcgatattttcacagtctgcaatcatttcgtaagatatctctactcgtaaaaattgttcaaataagctttttctatgtcggtgataatgaatctgagaccaatttgaaccaattcgtgatccgcacctaaattcaaaaaaaaaaactcgaactaaattttcgactttttgttgagttcgggttagtaattggtctaaagttatcgaattcctgatcaatgaccgcgccgaaaacatatgcgaacaagttttcacaagttattacgacaaaactaattttgaaaaccaaaggccctccattggtttttgacaaaattcaaaagcggcatttttaaagtagcgccaaaacactttttttgttgttttcttggccaaaaatcgtgaaacgcaaaataaatgtctttgatcagaccaaatgaacttaattccaagactaattaaaatctttttcgaaaaactttttgttggcggaatgcctttgaacgcgtcggtcggagcgtccaccataatccaattgatgcagcattggaaaatgagcaaaaaaatgcgactggcaatgagttgtaagagcaaaaagttgacaattttcggtgccatacaaatgtagtgggaaacagtcgaattgccatcctaaaaggcaaaaaaaaatcgttggcttttgaaattaaagccaaaatagagtcaaaatagataatttttccaacgaaaaaccgcttaaataccatttttttaaataaaaaatcgagccgttttaccgtagtggcaaaaaattccacaccattttcatcttcttggaattgctgttgaattgagtgacggaaatgggaagtgttggcgtcatctttgtccaaaatgtggccatggttttgctgctgcttttcggacggacgatgatggccccgttggcgatagcgtgccataatgtgtgtaatccaaaaataagagaaaatggggactgtaaaaaagaaaagaaacgggatttactgctccgtttagtgtttaggattctcgacggaaagaatttaaatttaggcccggaattttgaaatgaacgagcccgaaaccaggagtttagaaatggaccgggacgggggtttatcgggacaaaaaaaacccatttgttagcggcccagtccaggatggtttgcaaaaatatggggccgaaaggaccagttgcgtgccgggcccccggacccatccaggctgaggttggttgtaattctaactttttagaatgaaaagaatagacagtacattgaacaagagaaaaccaaagaaagcgagaagaatagaacgccaaaatgttttttaatttaaatataatttttgttgaattttttcattcgcaattttttgttttgtgaagacacaaaaagtttttagttctttttcatgtgtacacacacatgagaatcaaaagctttaatatttgaaatgtacaagtgttggataggatcaaagaatcacttacacctcatcactg

SEQ ID NO: 1905 - DNA, 3206 bp, Heterodera glycines
acttttccattggtttaggacaatacactgacaatttgaacattgcggcgcctggcgttgttactcagcatgtgtgcaaggcgtccaacctcaaccagttccagctgagtcagatcaattcgctgcacccggacactggcgttgtcggcgtttatctgtcgaccgaagggaccaaagttctcccatttgtcaaagccgctgcccagggcttacgcgaaatggcatccaaaccgatcagtgacgagcttctccaggtgagacaagcattgtttttggagtggtttaactaattacgaaacgaatttaacatcaaaaataccaattaattccatttaattaaaggttttaagcctatgtagttccgatttcacaaaaaaatgattgagtcctgtctttatccagacccttggtttttaaagattctttccttttattgcacaccattatttttatgaatttttttcatatgccaggcttgcaaattgttggccaagggaaccgcactgacacccgacgaattcattgcccttctgaagacagtgactgcggacgatgtgaaaaaggtgaatccaattttccaattggatttcatgagtacattttttgaactccgttaccaagcccgctaaaaattgagtttaattttttatttgtttttcaaatttcatcttttcaggctgcttccccaactttgcgccaaagcccatacttggccggcgaggttcaccaggccgggcccaccgacttggcccacgtggcacttgttggtcatggagcgaaattgacggacgagaaggcggttgcaatccaagcagtgctctgtgctgccattggtcaaactagttcgtctattttcttatccaaaaaatcagtttttgaagaaaaaacccactaaacattgaaattaaacgaaacatcttcaaattatcgactttccgaattttttttttaaaaatatcgcaaaattactaaacttttccattggtttaggacaatacactgacaacttgaacatggcggcgccgggtgttgtttcccaacatgtgttcaacacattgaaccaccagttcgcgttattaacaaaattaattgtcgttaaaataatcgtttaagatccgttcgccttttttccactacccatacggttgatcttatggttattttatgtgaagtacaaccatttcgaccacattccctgtttaggattttcccgtcctcgaagaacgcgttgaacgtgtccgcaacgaattgaaagtagaagcggccgagaaggtcgctgaaattgttaaagtcaatgcgggtgtggtgaaggaggccgccacatttgcgaacagtacacaacgctcggtgtataccggtgtgaccgctgtcgttggcatttcgcttaccctctttggtgttctgttgtcgctcctgtgggggttgttcggcagagtcggttccgtcgaggctaatttgagcgctctcaaagttgacgttgacgcccgttttgagaagctcactgactccgtggaccgccgttttgaccgaatggagcggggcatcaatcggcttctgacaaaaaatggatccggtggtattgatgactaatttgttcgcatatttttattgacttgcatataatttgttcgcatatttttattgacctgcgtaaaagcgtaaatttttttccccttaatctgtttcttataaaaattcaattgtttcaaatcttaaatattttattaattgctcaattctcactaatggcacccgaaaaatttccagccataatcaacaatgtattcacttttgcacgagaccgatggtgccacatcagtgaatttcagtgcctggggtaattttttgccgggtcctggcaagcagctggtcactgtttgtgcaaaatgcatcaaattctaccgactgaacccattttttgtgccaacggatggtttcgctggtcaaccaccaacagtccgtttggaatgccttctttccttcactctgatggcacctgtgcgcagtttggctgttgtgcgattaaaatgtgtgtgctctaataacttgagagaattggtcgagaaattgtgttaaatggcggccaaattcatagaattcgttttggatattgaaaaagttggaattttttacaggtcttcagaaagtttcattcattttttcctgtttttagtcagtgccgattgttacgactcgttggcgatgacttttgatgatgccaaactgtcaattgttggcgtgaacccggccacaatggcactgacaaccatttcgctgcattccattgaggacgaatttttgcgcgacggttacaccgatgagaacattcatcagcccgaacttcgtgccgaccctgaacatcggtgttgtgcatttacaggtgcttaaattattgtgtttttcaaaactgaaatgtctagaggcttttaggggacgacgatttaataaatgtgtcaaaattcgaacaaattcgaattcttatgaaatactaatcttttcatcgtttttttaatccgtattgactgacaaattatacaattctggcttttcacattatttgaatacatgggttctttacgaatataaaattttcaatccaagattcgtccgaactttgatttccaagggtttattttgctaaaatttcaaatatcaacattttccaaattttttggggtgttcgtttttggtgttttgtcaacccccagtctcatctctataaatttcatggactaattggacatgattggatacgtttttttttcgtatactcctaacttacatctccctgttcagtgtatggacgtcatttggctgttgtgccgtttaacatcgtcgaattggtgcgccaacaatcgtctgcagtcagcagcagggaggaggccaagctgtacaaccagcagcaacaacagcaacaaatgttgttgcaaagttacaccatcaaaatgcgtttgttggacgaacggttggacaatgtgctggacatgtgctttttgcatggttattatgaaccaacattgttgttcctctacgagcccatccaaacaaccgcgggacggtaagcgacaaaggacaaattgttgttttaataattgactccgctttgctaaatgatactctgttggctgggtgttccactaatacctggaatacaccccaaaaggaagaagccgcgtcataacgtcgccgtaaaaaaaatttaacaa

SEQ ID NO: 1906 - DNA, 1089 bp, Heterodera glycines
aaagtggaaaacaatcgcgcgtttcttaatttggtatgaattctaaacttggttttaagtgcctgtgttcgctacgacactgtggccatcctggccgtgtccatgaacatcaaggaccgtgtgcatgccgttgtgtggcactttgacggactgccaatgacggtggcgcgttgtatgccaattcgagtgccaattggcggtgtttgtctgtttggtgccaacgaaattgtctacctcaaccaatcggtgccaccgcgtggggtcagcctcaattcctgcgccaatgagttcagccgtttcccgctcaacgaccagcaacagttgcgactgtgtttaggttttttttgttgttggttggacggaaattatatatgaccagggattttaatatgtcggcaaacaaaaaaaattttttttttttttttggcgtattcaaagtcaaaagaaagaataaggcagctttaccaaatttgaattttaattacatttactattgaatctctgttaaaactgttgggtttcctttatttcgggagcaataccacccattttttggtttttaaattatcatgtttaaaaaaaaaattagacggaagtgccatccaaccagttgattctccacccaatgaccttgtggtggtgctgcgaaacggtgacctgtacatactgacactggagactgatcagaccagcatggtgcaaggaatacgcctcacaaaagcatttggtgtttttttgtaaatttctagaattttactaatttatttccccccccccccttcggttagaaacatcaattccctgttgtttgaccgtttgttcacacaattttttgttcgtcggctctcgtcttggcgactccaaattgctccgtttttctgctgtcgaaaaacgccgcaattcaatgtcttctgacatcggcacaaagcaattgactaatgatgccattactactaacaattacatcaccaacaacgtcacaggaagatcacttgccgacgaaaatggcaacggtttggccgctgtactgtttgacgaggacgacattcatttgtacggcaaagaattctgcaacagtttccacattga

SEQ ID NO: 1907 - DNA, 1843 bp, Heterodera glycines
  misc_feature (112)..(112): n is a, c, g, or t
cacttgcagcgcttcgtttgtcagcgacgcctttctgcacagaccgcgcgacattttcttcgacttggtccgcaaattgtccattttttccgaattttattgcctttcattntggtagatgaccgtctccggacatggcaaagattctgcactttgctttttccattcttcaatccgtccgcagatcattgccagcacaatgtgaccaacttttgaaaaaaatttcgaatttttgcaaatttttttagtttggacgaggctctccaaatttggacagttggacgccaccaacagcatcagtcaaataacattgatgccgattcgacggggaatggtgcgcatcgctttttgatgattgcacgtgagcggtccagcgcggtgttggagctggtcaacgacaacatggtggagctggacactccgctgttgttctgccaaacggagaccaccgtggcggctggcgaattggcggatggttcggtcgttgttcaggtttctttttgaaacctggtcatgtccaataaaaatgccaataaaattttttgaaaaatttgacgccaatttctcattaaaaatgggctacagtggctgggggtgtttaatgcgttattgcatagaaaagtggttggtcgcattcaaaaatcctcctgatttgataaccatttggatttggcacaataaacacatcctcaaacgaatagcacttctttaatgtgtaaaaaagcataataaaaggtgctgttcacttgtcggatgtgaaagtatttgtgaaaaacgcatgcttttatgtaaacacattgtccccatttgattggcatggctttgtgatcacaaaaaatgtacaaaaagcaaagttttaaattcattttttaaaaaacataaaatgccaattgccaatttttcttgaaataggtaaccccaacaacggtgctgctggtgtccgcaattggcgatgcgcctcaacaattggaagtgttgacggtcgactcgaacttcccggtggtcagtgcgtccattgttgacccgtttgttgtgctgctgacgctgaacggacgttttgtgctttatcggctgctcacggcaccgcatgtacaccttgaacaggtttcatgcaaattgtttgtttctttcacagggttaaaatgttggctgatttttgggaccatatcattgtttttaggtcccatggttccgtttttttaaatgattataaattttggttttttaggttcctatcctggaaaggctcaagcatgagaggtcgcctatcaccgcaatttgtctgtaccgggataagagcggtctgatggacctatgcatggaggaggaagaggccatggaccagcagcaccagatggtcaacaacaatgtcgtcacggctcccatgtcactgttgggcaaaaagccgtacgacggcggcattgttttaaatactgccggaattacaagctcagagtccgttgtttacgatgaaaatgtggacgcttttttgtatggttacgacgaggtttcggaaaagcagcggaactcaggttcggtcgaaaaaaataagccaaatttcttagagaattctgtccctaggccaataatacccatgaattttctatttatttttggttcccctcatccttaagtttgacatccctaaaattttcgataaaattaaagaaaataaaacatactctcaatatatttctttctcaattgctttataatatttattttaagttctgtctccgtttcttgtgtgcaacaataacaatatgccaccgtcatctctgtcgaccagtacaccattgaacatgcacaatgagacagcatctgctcacaatctacacgacgc

SEQ ID NO: 1908 - DNA, 6306 bp, Heterodera glycines
aaaaactaaaacattcaaatttcaagagcgaatctacaaatgaaactaatatataatatatatatatatatatatatatatatgttgtaatttcgaggatcattattcataaatattcattatttttgggtgtcattaattgatgttttgttttatacatttttaattgcttcagagtcccgaagtttaagaaaaacatgttttttgacacagtccttccacgtgcattaataaatgtcggcgcattcttttcttccattgcatacttttaaagtgattcatcattcaatcattcattttgtgctgctttttgacatgctgctttcagcaaacattttcggaatttttttttctcgatttggcaaacgaaataatttattggtgcacagttgaccaaataaaaagcatttaatagcatttcaactcattttatcaaatggaattaatatttattggaattaaaatgattgaattataaatacattttctttaattaggtcgtcggcagaaattgatgggtctattggaaggagaaacgtccaacgggaaaggaggtggtagaatgatgaacggcagaatgtactcgccggtgtcggcgaaagctgcttcttccgagaaggcaaacacacggaaattagcggatgacaaccgatcagcggaaccaatccaagcgaaagtgaggcggaaaaaattccaatgagaaatcttgaaaatttctcaaaaaatatctcacttattttcaatagagcttgcaaatataaaaaacctattttgagttagtgcaaaaaatctcgactcacaatcagtaccgaaatcccccggtttcgggttctaccattttgtggctcaatccaaacataattacgaataaattttgcttaagacaacaatgagtgccgcaatgcaaaaaactgtgcagaatgcgtccctggtctttttgacattgcagcaaacagtttgttcgtgattctttttttgtatttatattttgaactgacttttcaatctattggttccatcggagaaagcgatttccctcacattttccctgtttttaagacccaattatggttcgacaagcacacaaaatatcccgagacaaaggccaaccgtccttcctaagttcaactgttgttctgaacacagaatgtaagttttttttttttgaaaattacaaccccctaaacaaattgtgttatttcagtggcaaaacttgccttgagctgtctgtatttaacgttttcatatggatcattcacaaagtaagtgttacagtaaaggcctactttttttcattatttcctagtttttcttcatttttttcagattttgtgtcgaaatttccgcagccttcttcaaaaacaaacgggaaacgttgaaagtgtgtgtgcctgcgctgatttatgttgtgcaaaacaatttgtatttctttgcattgaaacgggttgaagcaacacttttcagtgtaattttacatttctttttttttgtttatcacaaattcctccatttttgatatgtttatttttttttgtcaagatcacttatcaattgcgaattttgaccactgctctcctctcaattgtgctcctccgtcgcgttttttcccgcactcaatggggcgcactttgcatttcccttttcggtgtttgcctcgttcagtttgcctcttccaccacttcaggcaaagggtgagtgaaacggggaaaaaagaagcgaatagttaggattaaaaacagaaaaaattgtaatcataagagtggcggttatttgagccacaaattatgtcatgtgaaagtggtgctattacgttgctaaaatacgattgggcgatcctcaaaaaaaaaccaccaaaaaaatattttttttttttttataaattcactttggtaaattaacgcaataaaatatttttaaagaaatgctggaggagcattgtctgctggacaaaaggttcacgatgaacaattacttggccttttgaccatcatcattatgtgttggacttcggcatttgcaggtctatttcatttcataattattaaaataattttctacaaaatttattttgaaggcgtttatttggagggcgttctcaagcaaagttcatgtgatatttggacacagaacattcgtctgtcagtgattacgcttccattcgcttttatgacagtggtcaacgattcgaaaagcattcagaaaagttttcttttttttttgttgttgtttttcgccttttttaataaattgcctcacaacctaaatcatttttgtgtttacgggtttaagatggattctttgccggatggaattggctcctttggatagttttgttcagtgccgccgcttctggcattttagttgcggttgtgatgaagtgagtttttaatttttccagttttccatgcgctcttttattgttgattcggaaaattagtcataaaccggaaaagtatcttccacttcaacatttcaacttagaaattttagaaaatcataccataagaaaaaaattttgagaaaaacagtaattcatcataaaatttataaaaatcgctgaatttctaaaaatttttatattttcttatggaaaaatttaccaagaacttttcttacaaaatttctaaatggaatttaaaaaaaaaattctcttgggaaaagtcctgctccgtataatttgtcccttcacgactttccttatgttcaacatttgtaggtacgctgataacatcaaaaagagctattgccaaagtgttgcccttggcggcaccgccctactgtccattgtcatcggtgactcccaattttctgtgctgctactggtcggtgtttcgcttgtgattgcctccgtgttcctgtacacgttgaacccgccgccaagagtgaaaccgtccacacccgaagtgccagcgcatcacccacaagacgacgacattgatggcttggaggaacaacaattttccacggatgacgacgacgacgaaactaataatggaagcaacagaattgttgaactgaagttggacgacatcaaacgaattggacgagaagctccggctgacaatacttttctaagtgagtcaggggattaagtcatttagcaggcaaatgcgtgcctccgtttaacgtaatattgtctcagaatctgtggaccccgaaacgtcgcccggaaaaaaattaatcggtaaaatgcattacaattttgtatgcctctaattgtatgaaaaatggcaatttctttttctgaagaaacttttaaggattaggcaagtcttttattttttcccgcgacgttttgtcctgctccatgtcgaattacacatagttcttggccattatttaacaataatatgtgtgttaattttaatgaaaaaaaatttaacacgtaagcaaaaaatgtaaaaatgtgttatcaaataacataaaaatggggttcccatgggattctgaattctttccaattgtggcagatttgtttcttaatttaaagaaggcattaatccgagtccactcacattcaacagctaaaccatcggctgcatcaatagcgcgggaagtcggcgtccacctccaacgcccatccatccattccgcccacaatgtcacgaacgatgaaccggtcgccaatgccggcctctgacaactgtttgtgcagatgacacgcagccaattgcgagtcgttgccatgatggcacacaacaaagactgaacaggggcaaatattataaaattagttaaaacagattttttaaaacattccaacattccactttctactatatttttaatttttctagtcgttttaattttatttttggtttaccttttgttttcccattgtttcctgcaccgttaattgtcggacttttgcgttccatgctgttgtttatcttgtcaattatcatttccatttttgctcttctcaattcctcccagggaaaatctgttaattgtaagcaaataaatttatttatttttcatttggaataataaactttctgcttccggcaaatggcatatttcaaattcagtgggaggtcgaacgtctaacaaaatgaaggaaccgcctatttttttgttcctcaaatttaaatattccgttggcgacactcgttgttcagccgaaagtaaacataatgagcgaacctttaagcgcataaatagattaaaacaatgtgcagacatttgcgccatgtaagaatcgagtaccctaacatttgcgcctttctaagatcgggttcaaacttaagacggtttactacagttaaaataagtgactgcgtctgaatttgatcgtcagaattttagaaaaacatcaactattcaaacagcagaattaatgctcccaataaactatttccgttatttgaaaatttgtttatttttattttttgaaaattttaatgaatgattatcatattatcagacacacttaattattttatatcgcttattttatgttgtttaggccataggggattggaaacccaaattgaaccagatttttacctaggcccaaatgtccgaggcacaatgtcatgcaaccatttaaacaataattgaaattcaccttatctgatggatccgacctgcagaacttttgatagtcttgtaattctgtaatccttggattttcactgcaaatcgcacaattcgacattttctctctctataaatgtgaaaaaattaaaaaaacaacaacttaatattataaaaaaaataccaaagaaattctttttgatatgccttcaaacccgtcaaacatccacaaatttccggcaaatgatgctaaaatggaaacaaaagttgtcgtcaaaaatcatcaaattttgaaaacattttccgctgacagcaattttgatgatttctaaggcctgcaaacttccaataacgccaacaacggggccaagcacacccgcctctgagcaactcatcacatgttcaggacttgggggatcaggaaaaatgcagcggaagcaaggacaattcttaaaaagaaagcaatttaaaaaaacagacaaagggcttcgccttatttgtcttaattaatggctcataaaacctttaagaaaacccagttaattttttttagttatatatttttctttgatttagaaaaattttaaagaaaatctttttaaaaaaagtgccagaaactatattttaaatccgccttccaccccgccctcaacattttggtgcttcctcgcttcaaaccgttccattgttgtagacagtaaattggccctcccaaccaagcgcacttccatataccaacggttttccactcaacacacaagcatcattgatcaaatatctataattgaaaaccaatattataaaaaaaactcgtcatttttataggggggggggtaaggaaatttatggttggggaaacaatttttttttaaaaacttaactaaataaaaatgtaaaatgcaatttaataaacttttctgtaaatcaaaagagtaacctttcggttttcataattccatttaaaaataattattaacgtgacccgctctctcaactaaaaatttctaaatgcattcatttaaatttctgaacttttttctaattaccgagtggcaacattgtctgaacagtcggcaacaatatcataatcacgaaacaattgaagaacatttttgctggtgagcaacacgttataagccacaacattcgcttcattgttaattctaaaaaaaattcgatttacttaaagttttgatgaatgaattagtcgcgcagataaaattgatttccaatttggaaaaaatagtataattttgctggaaattcaagcctttgtcccacaaaatccattccaaattcataaaacaattaagaatcaattttggaaatgaatgacaatgttagggtgttttgtttgaccacctggacaatgattctttcaatgaatcggctttggactggcccacccgtttttggtcgtgcattgtctgccggtgcaaattgtcaatggaaacgacctgaacatacataaataagtcaggatttatttctaaatctaagtaagtacatcatggtcaacaattccaaggcgtccaatgcctaaatcagaaaaaaaacataaaacggcattttaatgccacctgccgcaactaaatacattgaaacgggacagcctaatcctccggcgccaataattagcactaaaaaaatttaattcaaaaaattcccacttattaaccaccaaccctttgtttctcgaatgcgttcttgtctttaaattttggttttaaataaaaataaaaatcaagaatatgtaacacacctgaa

SEQ ID NO: 1909 - DNA, 4000 bp, Heterodera glycines
gccgagaaggcatttttaagcagtttgtttaatttttacaaactttatgaaaaaaagctcttccaaatggcgtccttcaacccttttgcttgggaaagttttttctttggaaaattggatagaagcgaggccgaaagaatgttggcaccttgtgaaccgggcacttttctgatccgagagtccagcacagcgcaagactgttattcaatttgtgtgaaaggttgtggtgtggaattttcatttctttttaatgataggtaaattgtttttcttttttgaggtgtcggtgatcattccaatcattttttgattgaaaaattggttaccaatgaatctggtggtgctccattgtacagagtaatccaaaaaatatatgagagttacataattgatttaaaattgaattcccagatttcaaccctccaatttgccgatatgcattctctgctaaaccatttcaaagttttcgcattggagccagtcccgatcaagttgataaagccattggaaaagccatttttggagaaagtgatggccaaatacaaatttgaatcagaacggatcagcgatttgtcctttgagcgcggtgaacagcttgaaatactgggaaagccggaacagggctggtggttggcaaggtcagcagggagggaagggcatattaaaagtgaatctaaaatcattttttttgccaggaattgtttgggtgagactggcatgattccggctaaccgcgtgaagccggtaatcattcttttcttgtaatttttttttatgtgtgttgaatagagtgcagcgggaccgtgaaatttgagcaagaccgggaccgggactttttggccgggaaaaagccgggaatttcccggtcaaaaccgggaccttggtactcagttgtccgtgttcaggtcccggtcccgctgcactctagtgttgaattatcatttagttttttcgggccatatgtttaggggacactattttccttccactgaaacttttaaaactgaattttagttttctaaatttcttatagggtttttttctagtaaaaaaaaaaaaaattttttttttgattttttattgtacttcaatacccaatttttctttataaaatttattcgaaaatttgtgagtaagaccatgagtgatgattattttcgaacacagtgtgatgattgtgacgatgcactgagcgtgctgaacccgagcagtacaaacagcagcagcaatggttgcggttctgcgggcaatcggtcgagcgcacattctgtgggcgaccaacaattacatggagaggtacatttaattggaaaaacaaaattatagaaaaaaattataataatttgcgtatttttgtatttgtgaaaatttccaaaattaaaaaaagaggatgattaaaaaagagaggcgtaaaggcagcatttgctctatttaaatgttttctaaaaaaattaaaaaaaaaattctcacgaaatcaaaacgaaaaatttaaatcgagaaaacgataataaaatttttctgaccaataaaaaacgaacctaaaacccaaaaagtgccgaaaaagacgaaaaccaaatttcgaaaaacaatccaacttccccattcataaactttttgatataggcataaaacaccttttgtcaccaacaaaatttgattttctattaataaaaataattttcttcaattttgaacagcaaaaaccgacagacggagacagtacaacaaaattggtgcaacgacagcaacaacaattgcgcgagaactcgtgggtggtcgtcaaatttggacgtcagccaagcatttatgacaacgattcattgaccataaaagtgggaaacttgcgttctaaaacatttaaggaattaaaatcaagaattctttaaattaaaaaaatgagtttttcgagaattcaataatatttttttactttctactaaaaaaaacttaattttcgatttttttaattatatccaagggggctcctcttttatctatgttttgctaatttacaaattaataatgaaaatttagtaaaaacgggacacaatttgtaattaaacaaaagctccccttttagcgaggccaatttttgtatctccaagaaattttgtcaaatggaatgtgccgaggcacgaatgaaagcggaaaggtcggactctttccaatcacttatgtggaggcggccaacattgagccgagcgaaagcccgtggaatatttcagcgaatgcaaatccaaattgttagaatttattttaaaagttttgtcgcaaaacttttaatttcaattttcacaacttaagaatatggaaagataattaatattttttatgttttttgtactgcgacaacacttgataattattattggggctgaaatttttggattttaaccaatttttttatttctggatattattttgcgagagaaagcacagaaaatttggatgacgacgtgaaaaaagactgtcacccgggcttgggtaaaattattggtgctttttgagcgttttttgcttaccaaattcggcacctattgatgggtttttatgcggattttagcactttagtgcgcttattttagcgatttaaacacaactattaaattccagccttggtaattattttgtacatattattacatcctcctatttttatgtctttatttttattggcattgttttccatctatttgcctttgaatatatatttgcttaaatattcattatttttaaatttgtttaaatacctaaatgtcttaaaatgttttcaccccggctctcaatgttttctcttaaatcggaatttccacctgttgccttccttcctttctttgatctctcgccatgttttcaaatttgttcgacgtcctttaacaacaatttcattgtgacacccagtaaacacattgtgttgtgtgttgttttgtattcatttccaattttcacaatttgccttttctctacgccatatcatcatcattttgtatatatgtacacacaacaataaaaaatgtattaaacgaatatatttttaataataattgaatttgatctattttaaaatttattaaatgaaattttcattactactcggagaataaaaccatcaaattctacgaatttaattatgtagcagatgttacctttgcttttcatttcggttcaataaccattaatattaattgtgtattttgacaaattattgaaaaaatcaatccgctctatttggggccaggccgttttcgtacgaacacatgtttttggactataacttttttctttgccaaccaaatccaacattgttggtatcattcgatagccctatgtatcctctattagcctgcaaaattttgaaaaatttcgttaaggttcaatgctccaatggcttttttcttcttttcttgcttttttgaacaatttttgcaattttttgtcaaatttcttgcgaagagtttcatccaaattgccaaaatttgctttataatttcgcattttgtcctcatttagcaagataatcacaagttataaaacccaaattttcatcctcaaaatttaattatatgaaatttttcagatataaaaaatggaatattatggaaaatgattattaaataataatgcattccctactttttgcatatactttgaacaaatattcatacaaaatgtccaaataatttcgatatttttcacattctattaccaatatactttctaaattttcttcgaatttggcacaatcaaaattctgtctcatcaaatacagaaggccaagatacggctcatgcatttgcgcataattttcttgatttcgtcgaaacttaatttacgccaattgttcctttgcattacatcatcgtttttcaattcattccaaaattcttcaaaatttgactgacccataacaaattcggcaattgcgcgttcttcaatctgacaaattaaaatgacagtaaaaagtaattaacagggctgcaaaaaatatgaaaatgcattt

SEQ ID NO: 1910 - DNA, 1440 bp, Heterodera glycines
atgccaatggattttgaatatattgttgccaacgtggccgggccgggcacagattctgcatttcttgacgaagattttgagggctgcaattgtacggacggccaatgctgcacgtcggcagcaggcggttgcagctgtttgcccggcaaaagggacaattacaatccgatcaccggcaaatggattgatcaggggggcactgatcagcggcagggtgtgccacatttggagtgtcaccaggtgtgacggacggctgacaattctgttaatatgcataatttttcacgggtcaatcaatgacaactggtaaaaaggcaatttcaaaaaatagtggactttttataaaataaatttaaaaaaaagattttatttaaattcgtttttttaattacaaaagtgtattgtacgaagcattttgtattgccttttgtacaaattctcatgtcattacaccaatttttcagaattgtgtgtgcgcatgggagccggacaaatgcgcaaatcgtcaagttcaattcggtgtccgacaaccgatcagggtgtctgtcgataatttacaaaattgaacaattatctcttatttgccattttccgatcaatcattcaagcatccttttcgtcatcaacaggttgccccgtgtacaaatggcaaaggcttcggcgtttttgcttccgcgttgatcgaaattggcacttttgtgatcgaatatgttggcgaagtgcttggggaagaggaggcgcggcgccgaattaacattgttggacggcacgagcacaattatctgttcacaattcgcgaattcttcggaggtggagtcatttagaacagaatttttcttttttacactgatcaattgtgaaagcctcattattgataactagggctgggatttttatgtgctaaaaatcctgaaatatgtaataaaatatgtgctaaaaaacccaaaatatgtgctaaaaaccaaaaaaaggcctaaatatgtgttaaaaatgcaaaaatatgtgctaaaaattggaaaaaccaatggtatttttgcatataaattccaaaaaactcattctttatcatttttgcccgcacaattgcaaataaaaaacatttggaggtgtttgggggtaaaattagtccttttttgataaattgtttttaaagataatttttccatcagttgagtaagtgccagcaagaaacttcgatatccagtaacgaattaatgaagaattcgattttcggtacacgaaataaatgattgaaagagcctataaaaatggcaagaaagttgatttttaggggtgcatttttgaattttttgtgtttttcttagatatttttttcaaaaatgccaaaatatgtgcaaaatatgtgccaaaccccgaaatatgtgcgatatgtttttatgtgcgaaaacgccaaaagcaaattttttttttaattttata

SEQ ID NO: 1911 - DNA, 9547 bp, Heterodera glycines
tcgactctaatgcacttaatgagtcccaatcaattgaaaataccggctgcttatacaataactttgttcatattcgaacaacccctatctttttggtagcattcgaaagcacaaagtctaacgaagctaaaatatataaaatctcatcgtttaggcaattacgaaaaaagagctgattaattaagtaattgctgattattttcgtttgtaactttcttgaaatgttaaaattctattgttttctcatattattacattattcagactttgtgcttttgagtgctaccaaaatttaggtgttattcgaatatgaaaaaagttattacctttggactcataaaagtcaattagactcacaaagtgcattagagccgaaaaatcatgggagcgtgttctgtgcttgaaccaaaacataaaacacgttggcatccacctttcaggtacgttgaccacactgtgctagcatttctccgttccaatcagcaaatttgggacaaaggcaccaaattggacttgcgcatgtgcccggacgggccttgggatgtttttgtccgccaaatttggcccctttttgaagcaaacattcgcaaattgcacttttggagtggttctcatttggacaatttgcgtcgtctcatttcgcccacaattctctccgacctcaatcccatgtcaatttattccggtggactgttgaccgacgtgatcgctgctgatgacgggccaaatgcaactggtggccaagcgttggccaaatggttgcacattcggagaaaagatggacatcctaagcgattagcttgcagatgtgatgatgtgtctgcagcaaaagaatgggtcagcaatttcaagcaggtcgtcgcttcgggtgttatgtggtttcgtaaaaaataaatcattaaattgcttaaagcaactaaattgaatatccttggggtatccgggcccggcgatttttgggaaaatcggagttgaccgggttttgagaggctaggcccggaaaccggcattgaccggtttttaccgggttatgattagagctcgcaacaaggcacaaaaatcgcgaaaaagatttaattttttttattaaggctttttagggagcaaaacacgtaaaacttaaccaaaaaaattattttggtaatttatattatgaaatattttatagaatgtttttagaataaggaaaatgtttaaacctaaaatttttatcaagaaaaaataaaaatttttaaaattttatattcttaggggtgtatttttttcaaacgaaagttaacaaagcattaaatatcagttttaatggaaacgcaaacatttatgataagacaaatttttaaagccgtttatatttgtaatataggcaacaaaatccttgcttggcatggttttagaacatttgcggtcacagccaaaaacgacatttgcggctcaactttttcggccccaacaaaataaaaacttcagaaaattattttccatccaatttaaccggttttatgctctctaataagccgccgattcaagtcttctcgaaagaaaattcttaaccccacccaactagaagcaacgaagaggaggaaaagaatatcagcgaaacaagtcccaaaatgatgaagaaagaagtataaacattgctaggaaatctcaaatctctacagtttcaatggtcggtgcaagagttggtagactgactagcaactttcaatctctggtggggtttggacaaccccaatttttgaaaagaattactagattagttaaagttcggcgtaaattttaagaggaaaatgaattttcgataaattaacctattttgattggggtcgaaaaatttgggaagcaaatatcgtttttggaattaaaaaagtaattatttggcgttccgttgaccgcaaatgtccgatttccagcaggccgcaaatgtctggaccgcaaatgtcttatcacgcttggcattattcgttactccttaggtttctcttcatccataaaatttcaaaaaactacccaattcgaaaaaagttatggtcatacctaaaactcagatctaatttttgcaaatagtcatgattttatatagaataattctgcatggatatgagttgggcatagatttgtttgtgtttaggcatttctctgtgccacaaattgtgctcgctacacaattacattggacacgtcggcgccaattgagccatttgaattggtgaacgaacaaaccaaggagaagctgacactaaatcaagtgtgcgagaacgtatttttttttcgatggagaataaagcgacgctcaattattgggcggacggcggcagtccaacggaaagccaaaaattcgacaaacgatttgaacactgtcatcattgctttgcacggcacttatggcactaattgcattgggtaagaagcaagcggcatttgctattttttcaagtgttagtcgaattaaaatgcataaatttagtagagcacgaacaggtattcgagctggagttcggacagaaaaatcccgcgggtcgcgcattgtgtagaccgggatttaacccgggaaatcttatccgggccgggctatcccgcaaatccggggtttcaagcatccaaactcagtaatttaggtcattgtcgccaccgacagaaacgtgtcaaaacaatgaaaatggcatttgataacaatcacgtgcgccgattggttagcggagaaagaaacatgggaaatgattaatgatgatacggtcattttggattaaacatgggaattatctgggaatgattaatgatggatgatacgattattttggattactgtggatatgaaccgaagtgcttaaccaaagtctggcataagctttgtgtgttttatgcagtgttgccagatgtgatgatttatcatgattttgatgatttcaagggatcaatgatgattttatttttgagatgatgatttgctgatttgtgaatgtgatgattttcgagaaatttgatgatttatgctgcttttctctacatttatgagttcaaagcgcaaaattttcaaaatttgctaaaaatcatcaaaaatgctattttagccaatcgtcaccgccggcacccaaaattcatctaatttttgaaaattttacctataaattgccaattttcagtgaaaatctgtttaaaaatggtcaaaatttccaattttcccccggcggcgcctaaacttcgtagaaattaacaaaatttagcggccataagccaaattaggtatgctctatcaaaatataacagcacaaaattactgtttaatcagaacaaataaaaaaaattgtttttttgtgatttatgttgaatttcgaacgaaaatctgtcaaatcataaaaaatgacaaacaaaaaaataaattaaatcaaacccatcagtggttcaaaatgatcagtcatttctcaaatagctaattcacttcttttccggagacaaatgggtccatcattcattcagacgatcttttcaatgaagggaattttggaaaattcaaaaaaaaagcatagaaatcttgaatttaatatttttattttagctcagtagtttgaaaaaagcaaaagcctgggttccatgttggacctagatttcctggacaaaaatccagtccagaaaaaatccaggcttctcaagacctggatccaggccctggaccttttaaaagcaaacaaatgtttgaaaaaatagtgaaacgtggggggcccttcccaggatcgctgtagtccaaatattatccagaaatactttattgttccatctcaaacttgggtaattaaacctttgcttgtgaaatgtgaaatgaatggaaaatacaaatgacggatcgaaatggggaaggatggaactgatcgaaatgggaaaggatggagaaatgatgaaatgaaatgataaaatgctcgggaaatctcggaaaaggatttagcggagaagagaccagagaccaaacggggaagtgatcggaaatccactttacacctccatcccttgaggcgatcgtccccgatcgtttccaaaatttaggtaatttccaaaatataattcgtaaaattctcgcgagatttcatgaagaaagaaatagagaaatgagagggcgaattaattggtaaataaaattgtaagaaaacgaaaaatgaaatcaggtgcgacatcgttttgaaaagtgtccgatttttccgcatctatagcacttcacatcgattcttcggttgctgttcgagtttgacggggcttgttgggcggcttcggcgtatgacggcaaatattgtggcggatacggcgccattcgcgtacttggaccagggcaatttgaaggcattggcattgtgtgaccagcgatcatgttgattggaggagggcgcacagaggtgtcaatgatcatcattccgtgtgagaaagccggcggttgagcatgacccgaactgatcggtggaaacacatttgcctgagctgcgaatggcctgaaaccgcctgtgaaaaatggggaaggggaaaaattatttacgaaattatttattggtggctgatacgccaaactatcgtgtcttaaagtactgtccctttcggcataaaattcaaatgccatcggaactgtgccatccctttttgcaataaattttcccacccgggacggaaacggattggaaataaggtttaaatactccggggttaccgcaaccgtcatttttaatgtttcgtcaatgaaacgtctccacacggtccctttgtgccaaatcaacgacaaatctccgatgatgaccaatccaaatttgggacgggagagagccacggttgttctcgcgcaatccgcccagaattccttgccagtgtcagcttccgatgatcgtccagccgcggagcgagtcgtgatgacaaggacaagctcggcttcctgactttgaatcgaatcgactgtactcaccttgacatttggccaccttctccgttcgatttcacttaccatgtgtttcctctctgcttggtaaaaacacacaacttgaattaagcctggaaaggttccctggattattcccaaaaatccaagagctgtttcccgttgctctggattgtgagaggaaaatgagatactttccatttgagtcgatgatttttgatggattaaaatgatcggacaattttcggctacaatgcgtgggcccatataatttaaaaacgatgacatttcaacatccggtcttcctggtaccaaccgatcacctgctggagagtaaactcccgcgtccaaacaccgtacaatggcactgtgcgatcggtaacactttgagagaacggtgcgatcgatgccttttgctgtttccagcacttccaaaattgactcaaacccaaacttaccacgaataactgtcatttgactcggtaagtgtacccgtaactgctgtttagttacgttgcccaaatccaatgccaactcctcagcaagagccaatgtcatgaagtacactcggtatttggtctgtttcagaagcgcggcagtcgtcgttcgttcgcgtgcccgtcttggtgctgtgttaaagtcatcgacgtattgcttaaatgttttattatcactccattttttcggctcggttccttcagcggagggaacatttccatccctttgcacagcttcaactaaaagattgtcccccaggggcctgatcctgtccatgtaacgcccttttccttgcccagagaaaagtgccaacattgccaccttttctgacaaactttccatggtgtccttcaccaactcacacactgcgacattcaaaggagaaactgccaaaattgcagcgtcacggtcctttttgagcacgcttgcgatgcaggccgctactgacacactttttcccgttcctgccggagcctgcatgaaaattacacgggactcgtcgtccaaaaacaatccgtgagtgattcgctggtcctcgttcaacttaccgaccgcaatttcgttacttgacaacctaacggttggtcgttgttccgctccgtctttgcccattcccatcaatatttttaaaatttttgagacgggatattgcccttctgcaatatccgacgggactgaaagttcaaatgcctgttctctgaaagggagacctccgtaattaggaattggaatcacattagattccctttcatcgagaatggattcccaatcttcccatcccctgtcgtagccctttttagccctgtaactcaaaaacattttcacgttcatcagaaagttacccggagcggtttcatttactgacagttcaattactcggccaactgcacagcattgggcttttgagtcacgcgcaacttttgcttcgaccggcgtgtcctcctcccatgcctcaaggaaatcggcaaccgccgatttgttgttgatcaaccattcgaaagagacgcgttgtgcctttttcaaattcgtttgcgcttcatccggtcgtacttctggtctctgccagacgagttggacattgacagtttgcttcgccaatttctccatttcgaatgaacgttggacagcggccgcagctcccatcaatcgcactgaaaactggttaaagggaaaacagaaagagtccagactttctttggcaccaattaccaccgtttttccatgtgaacgaatttcatttccttttagaaaaggagttaccaggggtaaaatgtaattttcacccatccaccattcttgtggacttgtgattttggccaaattaaggtaaaggagttggttaagcataattcgacctggactgatttcggttaattgccgggcatagatggtttgagggcgaagcatttgcgcagaaatgacggtggctgatctgaaatccccacctctgtatcgttttaagttggttacaaaaccgggttgaaatgaaccaatgaccaattttatcacctccacctctatggcaacagcttgaacgttgatcctgccttgtactaaccacgagcgcaacgaatcgaccgggtttaagtcataggacaatctttcaaatccctccttccactcaaacttactgaccacaactgtgtctcccatttgaaggcgtctctcggcacttaccaaagtatcaggaattcccatgaaaaatggaccttgtccactcaatttcccaccaacgacacttttcacgtcggtttgacacaccaaatatttcagaacaccgccttccgtgccatgttcttcatttggagacattggcacaggcgaagcgatggcacatggctctgaccacgagacattggagaattgagtcgcagtgaagtcttgaatagtttccatttcaatattttctgtgtttctttccacgtactgaccttctcccaattccatgcctcgttcaaattcttcttcaagacctgcggaaataccacgagtcttatcggtttcaattactttctcgacggcaaacgccgtttccattatcaatcctttctgtgtagctgacgctacttcaaatgactccaaattttgcggaatagtctccgtctcaatcaattcaatttgctctgtggctgacgccacttccaaagactcaataatcggtgtggctgacgccacttccttaccaccaacagctgcgttcgaggcggccatgttttcgttccgacgatgggctgaacgttttttgaccattagaattagaattgcttggattagcacgaatgttgcttaaatttttttaggaaattattgaataaaaaaaaaaaattaaatcgaaacaagcaaactactggtcaatagatgaaggagaaaaatcaataaataaagaaaataaagtgcaagtgaaaaattagaagagagaaaaaaaaattattctaaaaatcgtgctggtcggtttaatttttcgcgctgtcttagaccatattttggcggtgttagtgatgtttcaacctcattattatcaatattgggctcattagcgggtatttcatcatcagattcacgatcaagagaagaagaatgttttggtatatcagtaggatgtgagtgacccggcaaattgtgaatttcatccgcttctaactctgcgagagcatttctctcttctgcactaagcctaggtgaagtgcaggcgggccctaaattttcataacacttcttaagctgatttatatggacacgccgtggatttgcttgaggcgaattacagctagtgattgtggcatatattccctcaatttctataattctaaaggcacccttccatggaaaatgaaattttttggatgtattacgtttaccatcataatttcttaataaaaccctgtctccaatctttaaattaggagttctcatagtcttatcgtattgaattttcattttctcctgtgcctcagcatgtaattctgcggttatcttccatgctctccgaagagaggttactaatttctgtttaaattctgtctcatcagtaaatgcaattggttctctaatcctaggatctattatttgatcaatacagaaaatcggatcacgcccaaacattaaaaaatatggggtttcgtgagtcgtggaatgaacagatgtattataacaaaaattggcatagtctaaaaattcatcaaaatctggttgctctttagtgacatattttgacaaaatattgttaaatgttctaaaagttcgctctgtggccgcatttccttgcgaccaatgtggaactgcatatttcttattaatatataataacgagcaaaattcacgaaagaactcagaagtaaatgctgtcgcatcgtcactcactaattcggtgcaaccaccaaacttaagataacaattactaagaaaagctttggcaattgtatgcgatttggcatcgggtaagggaacggatattacatatttacagaaccaacaaatgatgtttaaaatgtatttattgccacgttcagtaataggaaaaggaccggctagatctaaaccaactctggcaaataaagtattggcggggaccatttgcatttctgccctgaatgcaggcgtcggtgaatgtcttagctgacaagtaatacattgtttgtaccatgttaaaatatcagaatataggaaaggccaataatattttcgacatttcttcaatgtcttttttaaatccatgtgccctccaccaagaggagaagagtgaaatgagtcaaaaataagagatcttaatgagattggtatataaattcgtggtgactgatcctggtacctaaaatacaaaattcctgagtcaataacgaggtttttggcttgatcagtaagagattccatggtctgttggtctatttcattcgaaaatttgccagtttgtaaaaaattaataaattgagagatttgagggtcggccctttgctctttctttaaatcaatattgtacgaattaccatctttgcctctaagaattaatgtattaacgaatggatcaaaaactaaccgctggtcaattgataggcttaaacaaattggaaactcagcaatgtcctcaagttcatctaagtccagtacttctttgaccgtaatattttcctgtgctctgacaga

SEQ ID NO: 1912 - DNA, 2409 bp, Heterodera glycines
  misc_feature (156)..(156): n is a, c, g, or t
ggagggggacgagctgttgttgctggaacgtgacgtaggcgacgggtggacacgggtgcggcacatgcagtccaacgcggagggctttgtgccgaccagctatttggtcagtcatcggcgaaattccttacactcctacgaccgattttaaacatntaaaaattaattttacaattagttttgaaaaattggacggtgtttttctttacattttgctcgttttatcaaattttgattagaaaaaacagctttctgttcttcaaaacaaatattgatataataagcaatattaatgagagtttatggcaaattttttctacaaaaaaatgacggaaattttgggaaaaaataataatttcatggaggggactcgaacctccctccacccccctatttttcgtgttttgctaatgtttccatttatccattgtttaaatttaaatttttaaatttgtatataaattttcctaaattaccccctcaattttgcaggaatgcaaatggtattcgacggaggacaacaattgcccgaatgagtgaataaatgggcgatgaaaattgggaggaaaaaaagtgcggcgccaaaacaaaactttgcatacaaacagaagaaacaacacaatacaatacatacatatattatttgcttttccttccttttttgatttttaatttcttaagatgcaatttgataaaaaaaaaaaaattaccgtaccgaattaccgtaccacgaaaagtcatccatcctttcatttttgttactgtattatcattgccgtcccctttttgaaaatggcgctttgttgtttattgtactattttgcatttttgtctgtctgcaccggttgggtgtttgttcggcacttttgtggctctaaaaagcgcaaaaaatggcaccgcccttttttggcgtaaccgaaatttttaaatgcgatttttattgaaattttggcaagcccaaccatgcattgatgtgcttttttttgttttcttctttctgccagccgcttttcctcccccttccgcgctaaccctttttgctcaattgacccctcagaaaattgaaaaatatttctcttttttgagacattttttttgagaattcgtgtgccctcctcccccgccgtctcttcgtcaaattttgtcattttttcggaaaactatgttttttctgtgctttgtaaaatttcgactgattattttctggcaaaatgtcttctttctctctctctctctctccttaatttaagctacgaaagtttattttatttttttcgcttccaccacattactactgtactttgttcttttgtattgtgctcgagctttctttctcttctctcctccgccaccacaaaatttgtcgaaaaaatgttttattttattgctatactataaattttgtttttgtatgtgtttttgtattcattcttacgagaaaaggaaaaaaaacgaaaaacaaaagtgaaaatgttcaaaaaaatggggttaaaatatttgatgtttcgggttggtaatgcaaaaaaatgaatgcccttgagcatatctaattataatggaatttttaaagttttgatgaaattgaaccccaaaggttctaaatccgaagtctttcttttaaattaaagaaaaattcatttcaaaaatataaaatatagtaaaagttaatctgaccgccagcgatagatcagagattttcaattctgaacagcgagaattttaaaagtattaaaaatgataaaaaaaacgaagcgatgttaaagctcaatccgactccaaccaaatacaaccgggtaaagcgagtgaacgacaaccctcagctagggcggatcggctgagttcccccttaatgaggacaaagaaatggggtgcatcatgggacagatcagagagaatatgcatttttttacacactatttccttggtactctagtttctttccggtgcactctctcgccccttttatgcaacttttttttcttatgcccgacgcccaaaattatgattatttaacacacaattttccaggtatctgttgacccctattccccaactgtttcctcttttcaatggtgaaatcaaaaggcaaattttaaatttccgaaaattggtgccgaagttgcggcaaaaatacacccctaaaatcgggttctaaacgacggcgtggtgccaattgttcactttttcccccaaaaatttctataaattatccaaaattattgaactttgatgaccgcttttctgatttacaattgaatcggataatgaatggactccgttttccattcattttgccaacagtcaattaatgttttttggcgtccatcggcgaattcgcggcatttttcaccgcggcattttgcaatggccatatattgaatgacattgtgcttgtttggtgtccatcgg

SEQ ID NO: 1913 - DNA, 1609 bp, Heterodera glycines
tatcttttgactaatctaaagatataaaaaagcataacaattaaattaagtttttcaatatttacacatcaaaattttagatacaaaaaattggcgtcctattctcgtttaaaacaaaaaagttttttaaatttttttatagatggcccaaaaacctaatttaaatttatttttctccgagcaccagccgcccgctatttgtgaagccgcacaaacactgcgggatgccttcatcaagtggctgttgtgccagcggcttaaaatgtgcgcagtgaaaatgtttatgcgattagaagacgacgagattgatgccaggccgctgcaaccgcctcaaaatggtgcccaggggcagctgctattgtcttcaacagctggggatttaactcaatacaagaccttgttaaggttggtttatttatttatttatcgagcaaaccaaaggcacattagtgcttttacatggtgccaaaagtaagacaaagaaataaaattgatcaaattaaaaatacaaaatgatgtaataaatgtgaaataaaagtaaatcaaatgctaaattctcaggtgattatttataatgtaaaatgtggcacagaaatttcctactcagaactcattgcttttagtaaacccctgaattcctttgccttattaatttgcaccgctaaaactggaaggctattccagtttcttactatcctatggaaaaaattattttgagttttggccgtgtggcgctttactcgcaaaagtaacggcctcctgggcctttccgagaaaaagaaacttttttcagcatcaaggctggtgaacccttttataattttaaaagctcaatttgtactgaaatttaatcatttcagttagcgattgacagaatgaaactgttcgatgaaaaggagatgcgctcattaagttcgactcaacactacatgaaggtcctgcgaagcttcatttcctttctggagacaacgttcggaagaaaccaaactgatctcaaccacgttgggccgctgctcagcggaatgaccataattaagtatcgaattcgtggcattaaaagccgtgcaatagcagaaagggagcaggcaaggcgtacatcgacaaaacaacagacaaaccctcagcacataccatcatacgggactgttatggcgctgatcaaccacccccagattaatgcggcacacaccaacttcagaaacaaatacattcatggggcctctgctgctgaaactgatgatgaatggccgacttacgaagaatttaaattcataaggtgggttcaccatattaaggaactatttgtacatttacaagggtaggtaccaccgaaggtgggttcaacatattaagaaactttactgccggcggagaccattgcttttgtgcaattgagtttcccgacaacaaaactgggcagctgcaattcttaattttggacgctcgtttagaggtcaaaatcgccatttctttgaaaaattgaaagttaatttttaggatcttcttttatgaatacgctcgctgtgccagtttgttcttggaagctgccgggctgctgcgcaaaccgaaaggctatttcttcttcaaccttcatgcaaaaattacccag

SEQ ID NO: 1914 - DNA, 6380 bp, Heterodera glycines
acatgtgggccgctgcattcttaagacgttttttgatttgtgatcatgccctaactcatattttagtgatcagatttgatacattgtttgcatagttaccttttaactactttgttatcaatattatctttttacatattacaactacttatcaaaatatccacatccttgtagagacacatgatactttataatgttgcctgcctccttttctcttcaaaagtgtttaatttagtaaaaaatgaacgctgaagacaacaataacccaagcccaacggacccagaacacgacattagcaacaatgatgatggcacagcttcggtcgtggacaaacacgacttgatttggcggaccaaagagctgttcgaatacatcagcaagcgggccgctgctggccgcctgacgaccgccagtcgtcaaggaaaagtcacattgggacgggaattcttcgaggaggaactcgaaaatattgataaaggtcggtactatgggtacatttacagagggtacccctataaatgtactgttagtattagttgatattgagttagggtacccctataaatgtactgttagtattagttgatattgagttttactagcatacctattcagaatgccatggaatctacttgaacaagacagcggccgaggctgccaaggactggaacggtaacatgaaacatcgacacgctgccagttgggccactgccatgcgcggcactttttcaattggagcgcacgaagaaaatgcaacatcggaccaccgagttgcaatgcgcgagctgacaaaacgacgggccgctgcagcgacggagaaaatggaaattgaagcaaaatcagcggcgatcaaatcacagctttccattgaaaacgcaaaactcgggctgttgctgaagaagcaacggttggccaaagggcacggcacgtatcacaaagatgtgatcaagtatctggcatcgaccgctaccacctcaaaacggtaaacggtgatgagaaattatacatttatgagcggtcgcccataaatgtatgattgttaattgctgctaattaaataatgattatcgtgagttaatagactcaacgactgtccataactgtaggatattaagtgctcaattaaataatgattgtcatgagttaataggctcaacgactgcgacgatggcaacgaggacggcaacaacgtcacattggcacgcctttttcgagtcaatgccaaagtggtggctaaagacaaattgaagcaaaccaagctgcagaagttccttcgtccgcacaacattgcagaaaaatactcctccggcctcggcaaaaagaaggcaagtttttaaatgagtattccattcaaaacgtacaagtcaactcgtacactgttgtacaaacgcaattcgtagaaaaatcaactcaaattttacaaaataaagcctaggcttaagcctaaacctgaacccgagcaagcctaggcctaacataaagcttaagcctaatcctaaagcctaggcctaacctaaaaattgtacgtgtttcctttgtacaaaaaaacagtgtatgagttagccttttgtacgagttggcttgacaccagcagttggagaagtgccagatgagagaattggagcaatctggcaattgtggtgtactagtaaaattaaaaattactggtagatttctttggcagatgccggacgtacgggctgaggaatgtctggaagagatatccgacaacgacgacagccatgtcagggacgaggcttctcggcatctgccaaaaccgtcactaccgtcagcgtcagccgtttttaggcgtagctttgttgatggtggaaacgagaattctgaggagttcggaatttttaaacgtggatttttgggtgaaggagacgagaattctgaagtcattttcattgattgaacagttacagtaaatttaaattatttatctttttaaatttatttgcctccattttttcatacatttatttttttttgtttaccgcataaaatcatttactcattgttagtctcatttaaaactaaaagatttctttttaaaaatttgtcattagaaatttgcaaaatatttttaaaaatttaaactttcatatttggagttaattaatcttctctttttttgtgtttttgacaagcgccgcccggaaatctttttttttgcaattttcagcaacaccgctcggaaaatgcttaatttaaatgaaaggcggtacaattgcggatcggcaattgcggactggacaattgcggacgacagttgcggaccgtacttttgcggacgacagttgcggaccgtacttttgcggactggacaattgcggaccgtacttttgcggacgacagttgcggaccgtacttttgcggacgacagttgcggaccgtacttttgcggtcgacaattgcggaccgtacttctgctgaaaaaattaactggaagggtgggcctcgtcagtacgaccccttccgtattgcaaattcaaaaacctaagtgtgtttcggcccttacatagacagaccaaataagaaagctcacagcaataaataaataactgacaatttgaaagcataaataaggagcagaaaagcaaagcataggattataaaatctataattatgtttattttattggcttgctgaaggcccaacaacagcttctacgaatacaacttattaacacaaaaataactcaagactttttccattcatcaaaccatacataagcaatatcgacattgcttttcgtgatcgtccaatttttctatccccaccatctttggctaaattacttatttaaattatattattgcaaattttctcactgtaaaagcggctccgtccggttatgtcttcaatcattgaaaaaaaatttgaataattgaagtctggattctagcaaaaattaaagccaaataagttgaaaatctgttttaagaactcttctggccataacttttttgaaccttaatgaaaaattttcaaaactttgcaggctaatagtgtatacttagggctttcgaatgataccaagattgttggatttcgttgacaaataaaaaagttataaccagaaacgtgttggcgcccaaatgtgccggcgaccaactgagcgagtccgttttctgataattaagttacaattgtaaatgtgcaaattcctccaaaagtgcctctgttccatcctcctcctctttttcattttcctcattctcttctctaacaaattcctctcgtttattcccctctttttcctcctcttcttcctcctcctcttccccatcattctcctccaaaatttgctcctccttccgtcctcctttctctcctccttctcttccttttccattttgtttcttttcctcttcctcctcctcttccccatcattttcccccaaagttgactcctcccctcgtcttcctttctctcctccttttccattttcttccgtttcctccttctcttcagtccgcttttcctcttccccatccgttgtgttgttgttttgttcaaatttctgcttcaaaaattggtcgacaattgctttgatcagcaaaagtgtaaggcaaacggcggcgatcagaagaaatgccaacagcaaaaaatggacaattctttgatcagttgcgattagaagtgactgaaaatttggggatgaaatttgcaattgttccaattataaatattattccaattcttttagactcccccccccccccccgccgtccaatttgacccctaaaaagatttattcaccacctcatgtttggccattttttcgtcgatcgttgcgctgagaagcgactgaaaatatgcaaaatttttgaatttgtcattaaagagtttaaagttgtaagcaattaaataatttttaaattcgaaatttcatttttgtaaatttttgaaaaaaagacattttttttattaatgcctccaaaaaattgtgacttaattactacataattagcacctgaatttcttttgcatttgccaatttggccatcgcctgcggaaaaattggaatttaaatttaaaagaatttaaatcatttttcacctgctgttgctccaatttgacataaattctgtccattttctctgtcacaatttccggaagttcagtcgccgttttgccaattaactgaaaattgttttttgaattgattacttttgtacttatcaaatatttacaaaaaaaaattgttgaaatattcttgtaaaaatttacggaattgaagtcaaattgaaaaaatcaaaactaccacaaaaagaagaccaatcaacaggaggagcaaaatgcctgctgtgttgcgccaaaatgtcattcttttccaccacggaatggcatttttgtccactaaatcggcacacccaatgctggcgggccatacttaattaggcaattaattaataaattatttatgcaattaattaataaattagttaattaggcaattaattagttaattaggcaatgtaatttattcagctttacgtgtgtcgttgaaagattcatgtacaacaaaattatcatcagtagacatattttgtggtaaaattacgtaaaacaaatggcagagaaacctgtgcaaaaactttaaatatatcttagaaaaatattttcggcataaaaatggggcactataattgactgagaatgagccgtttaattggacagttttgcaacaatttattttcgcaattaggggccaatttgtgaaacgctaatcaaagaggcaccaataaaggaaccacaaattttgaaagaatgcgcacggcttttactgtataaattacagtaagccaacataatcaaatggtatttatttaatgaatgaagagctaattgaaatttaattaaacccattaaacaaatgaaaaaactaaaacatttgagtaaaaatgagggaggaggggtaaatggcgattattagtgacccgttggactctggtggacaatgccgtggatgcgacgcgaccgatggacgccaaaaatgactgcaatggtggcattctcattcgttaattggccattggcaaaataccccgatggaaatgccgcgaattcgccgatggacgccaaaaaagacattaattgagcattggaaaaatgaatggaaacggagtccattcattcattatccgatcattatccgatccaattgtcagtcataaaagcggtctcaaagttcaaaaatttggaatatttgtagaaaattttggaatttaagaaaatttgggagtcaaatggccacataggaatctccgggtgcaaaaatggaatttcttaaaaaaaaatttcttgaatttatcatttcggcaaatcggaggccacaaccaacagcttcaatgaatattttcctgaaacaattggcaccacgccatctgctgaggggtcgtattgattttctacctatatatatatataaaattaataatgcattattgtttaaaagatttaatttataataaaaaaaatatgaaataaaaaaaaagtatttttaaaatatatttttgacttaattatatgaattattgttcttgttttatattaatttaattttcttaattttaccaattgattattatgttgaacaaatgaattacccaaatgaattcattttttaatttttgatactttatacgaaaaattacaaaaaataagtgcaaaataaaagaaaataaaataaaaaaaaatgaaaaaacaaaacaacaaaaatggcttaaccaattaaattaattttaatttcatcatttctttccgcactttgtttttttgttcaaatgcacacgcaaattgcgtttcagggcaaaagctcggccacattcggggcactgaattgatcagaaatttaattcaattttatttttaaataaatttaattcactttatagggctttactactttgtaattagtggggttccaatttttaagtgcctaaaattaacaagattttatttttttgtaaattttgaaaaaacaaaatccaaaacttaccacaaaaactaggccaaacaacagggtgagcaggaaaatgatcatgaacacgcgccagaaaacttaattaattaggcaattaattaatcaattaattaatataaattaatttttaatgtaattgtacttgtgccattgatggattgatggagctcaaaaattgaatcagcagaagaagatattttttgtggataaatatggtcgaaaataaattccggtgaaaaaaaaatgaaaaaagcaaaattcttagaaggaaaataaataattaaaattgcgattggtccatttcaaaaatcccgggaaagcaccgccaattttgatgagtgcacacggcttttacagtatacaaattacagtaagtaaactc

SEQ ID NO: 1915 - DNA, 2981 bp, Heterodera glycines
aaaattacaaaaattttttggaaaaagcgccgcaaaaaatcaacttcgtttttcatgttcagagtcccaaaaaatgcttatttctaacaaaaaatgctcaaattgatcatggacaatcaaaaatataacatttgaacattttaaacgtgtttagaataaattttgtaaaaatgaggctttttgacccaaaatgaggcttttttgcttgccaaatgaggcttttgaaaattttcatctgccatccctggttttatggcactttaccatttaggggcaccaaaatttaaaaaaaaatcaaaaacaaaagcgcccaaattcacacagccgcgcacaatattatttagggagaataaatgtgacaattgctgataatgtcacgatttgcgcacctttttttattttcactccaaaaatgttaagaattatatatttgtgaccatcgagaaaggactaaagaaagaacatgaacaggcaaaaaaggagtttccagaaaaacattattgttaatgtttacattttcaccccttcacgttgattgttgatacccataaaaacggcttaaataaatctctgcgggtattaaaaaattaaatattaaacaaataaatatttatatttgcatggctttgttttgcggttccattccaatcgatcggccaactgttgtcgacaggcggtataaagtgtcgacttgacagagtgtcgaaattaagtttggtcccggcttgtattttccataggactgggcccgatattcggatattttcatgtttgggtcaagttttttcaaaaaataaaggtcgagtccgatcccttttaaccctttaaaatatagaatttttctccctatgaaagttaaaataaaataatttaaatttgcatggctttgctttgtgccgccgagcccgactgtatggtgccaattggacagacgaaggcgtgcatttacacgccaactgctccaaatttgacttgccatcggcaggatcagagtctggcggaaattctccgctacaacatggaatatcgacaacaaattgagggtttgtttttgtacaggacggaacaagcctttaaaaaaaacaaggcaaccctaggaaaatcacgtatttcctaaaatagagacagaccccgggggctctatttgaggggagggggcggctctaatttaaggaggggactgtattttaatgaatacaataagtactggtgaggttggaaatatgtgtatacaagtacatatcacccatttccgtcgtgatgaaaaattcaaaccacgagcccataacaattttgattgcttattcaaaacttaaattattttagttggctatttaaacagagaaaaccaactcaatttggaaattagaatataaagttcatttaattatatatttttttgattatgtaatattaaaataatggtatttgcctttttcaaaacagacccatcatttgtgacccacctgagccctgcccatccgcgcagttcgaaccgaccgttgcaatcatcgggaataaaaggattttttgaattggaccgtcgtcataagttcaaaggttctgcagctgaatggcttcaaaaagtccggtgttgctgatgaacaaatatcaattcctcacgtttttcaacaaaaaataatcacaatttcaacgattacgattttttatcggtaaaaacattacaaatcgtaattggcaactgaccaaaacgaaccgaattttgctgtttctaaatgaaaatatcaccattaattcgctttctcattgtccttctttttgtccattataatttctttcattatttcatcatttttcaattatcgtgataaattcaaatgattgggttctcactcagatttcatcttgatttttcattcaattttatgatgtttgaggcgaaaaatgttgtggtgaataatagggacatttcttcaaattttaatccaatgcttacaaaacatacgtttttagtataattcagtagttaacctgggctaccaaaaaaaaaattctaaggcctaaacctaaacttttaaaaatgaattgatatgttttttttgaatttctaagccccacctaaaagagacacggatggggtgcgcccttttataatatttcccattttaattttgcaaaaaaaaaaatcaaaatttctgtttatgattaacaaataataatcaaaaaaagaaaggaaaatttcatcataaattttctttagaagggaacggattagtcgtgcaaatagcgcacttggtagtagcgcagccacaggggagcgatgcaacgcgggttctgtcccgggagcacgcaaatagttttaaaaatttatatttgattatataaaactatagcaccatttaaatcatattatacaccaggggtgtgacttgtctcagaaaagacgagagcgagagtttggcgagaggcgagagtccccaaaaagacgagagcgagagtttggcgagaggcgagagtccccaaaaagacgagagcgagagtttggcgagaggcgagagtccccaaaaagacgagagcgagagtttggcgagaggcgagagtccccaaaaagacgagagcgagagtttggcgagaggcgagagtccccaaaaagacgagagcgagagtttggcgagaggcgagagtccccaaaaacacgagagttggcgagaggcgagaggacgagaggcgagggtttttcaatttttttctgtagccttattttttaatttaaaaaacttcaaaatcgtatattaaattaggggtacgggcctgggtatttgggcaaataccgggtcagggtattgccgggtacagaaagcccggtcagagtcctagttttttaaaaccgagtccaagtcatgaaaaatccaaacaaaaatctttaaaattttttcatgaaaattaaaaaatattttcatgaaatatatttatttttaaaaacaaactttattatttttccatttttccccctttttttt

SEQ ID NO: 1916 - DNA, 2766 bp, Heterodera glycines
ttttcccccctttttttgcggtgcgttttttaaaacttcggggacagttggggtcgggcggtgccggtaggcgccgccgaaaaaattttgaaaattgtcttcggatttgttaacagattttattcaaaaaatgaccaaaacttgttttttaaattttttgtttttaagtcgctttttttgtggcgctgtttttccaaaaaaaaatttttttggaacattgggtgcggggtccggcggtaccgaatcggcaccgccgataggcgccgccggaaaaattctaaaattttgagtgtaatatattaacagaacttgtcaaaaaatgatcaaagttttggttaaatttgcagttttaggctgtttaaaaaaagaaaaaataataatttttaaattgaaatattttttattaattaaaatttcaattgaaaataatttaaagaaattattaaaaaaattctgtaccgttggggaattgaacccaagagaaaaataatgaaaggcagaaggtttagccagcagaccatatttgaattggagctatccaaaaatagagaaaacattaaggaaggaaagaaagagatttaagatttttttttcgcgtaaatttgaaaatttttctggctgctcaaaagttcaatctttaggggtgtattttcaactctcgcctctcgtcccaaaaaacgagaggcgagagacgagaggcgagagttgtcccacccctgttatacatataaatttataattttgaaagtggccattctgggtatttttttccatcgaaacaaaaaaaaattcttcgattttgtgtccgtattaaacgactttacatctaaagatcaatgtggatttttaggctaattataagtttaaaaaaataaaaaaatacttaattatttattatttttgatggaagtaaaatttaaagtatttaaaaaaaaattattcagtgtgtgcgtattaaacgagggcaaaaatggaagaaagacttgagggttagccactttgcgtttaaaaggatttttacagggttcgcatcgccctaactcggcttccaaagacggctgtactgatttccaatgacataacgggcaaatttcatgattccaaggacgcgtaaaaatttttgtcatatgcaatggaaattcattaatttttattcaaatgatttgtgtttatcgctgaaatgaattttcaaatattttttgtttctgttgttattttcttcatttcatcgcatgtgcattgggcacttcgtcaattttggtgctcataaatgcaacgggaaaatgaagatattttggcgctcacgattccttttataatcgtcttgaattcaaggatatttcaattttcaagcgggagggcccaatttcaaggacatccttgccattcaacgacgaatgcgagtcctgaattattttattttttctctacattttccttctctcaatttccaatcaattactgaaatatgagatgagcaacatcactgaaatgtatttctctgtagggtgggaggttttgtggaataattttccatgaaaaattttaaattttgttcaaaaataaatcaatcttcttttttccaaaaatcctaacttcgtcctgttcaagaatttttttaagtcatacagcttataaatgccagagtaaaaaagcaaagcttttaaatttataattaaatttgaatgtatgtatatattgcttaaaataagaattaattaaaaattgtgcttttttggtttataaaaatagtcaaaatttccatctgatcaaacaaagcaaaactgagaatttaaataaaaagtaatcgattcataaattcacaaatgcttttaaaaattccattatatgtcctttactaactagctggattttgggtttttaaattactagagattgtcatattttgtaaataaaaattcaaaaggtaccaaaagaaccaaaattttctgcatatttttattttttataaatatttacaatccatattaacattgaaaagtcaaagaaatattaaattttaagcgatgtccaactttattttatcacaaattccattttttattgctttactatccttaatatttctttttattacctacaaatacggttttccatatgaaaattcgtcgttatttaggtaatttaattgaaattgttcatatttggcctatttttgctaactaaaacttcaaaaaaaaattaattcgcttatttctgagttttaattattaataatttagtttaataaagttaaaaaataatttatataataatgaatttttttttatagttttacctatacaaaaaacaacaacggagaattatcatcagaaaaatgcttcggtgaaaatgtatttaatttaataattttcaaacaatttaaattattaagatggtttacactttgaaaatgaacgactcgcgaataattcgtggcaaaaagtttaattgctcattaacatggcttttggagcgctacaaacttttagacaaatacgcaattaaagagaaaattgaagtctgttttttaatttttattttacattaattttaatcatttttatgtcaaatatcctggccatcccaaatttgtgtttgtgacagccgccaatgacttttattatccctttattcggacggtaattgcaaatgttaaagaaaattttggatgcaaacagaaaataattgcttatgatttgggaacagtgacaaaaaacaaagaatgggtaaaaaatagttttatttattttaaaattaataatt

SEQ ID NO: 1917 - DNA, 1077 bp, Heterodera glycines
  misc_feature (18)..(19): n is a, c, g, or t
  misc_feature (41)..(43): n is a, c, g, or t
aaagtcaaagaaatatannatttaagcgagtccacttattnnntatcacaaatcccatttttattgcttactatccttaatatttctttttattacctacaaatacggttttccatatgaaaattcgtcgttatttaggtaatttaattgaaattgttcatatttggcctatttttgctaactaaaacttcaaaaaaaaaaattaattcacttatttctgagttttaattattaataatttagtttaatatagttaaaaaataattaatataataatgaatttttttttatagttttacctatacaaaaaacaacaacggagaattatcatcagaaaaatgcttcggtgaaaatgtatttaatttaataattttcaaacaattaaattattaagatggtttacactttgaaaatgaacgactcgcgaataattcgtggcaaaaagtttaattgctcattaacatggcttttggagcgctacaaactttcagacaaatacgcaattaaagagaaaattgaagtctgttttttaatttatttttattatatttttattaattttaatcatttttatgtcaaatatcctggccatcccaaatttgtgtttgtgacagccgccaatgacttttattatccctttattcggacggtaattgcaaatgttaaagaaaattttggatgcaaacagaaaataattgcttatgatttgggaacagtgacaaaaaacaaagaatgggtaaaaaatagttttatttattttaaaattaataattaaaaataaataaattttgagtttaaataacaaaataaaattatttaattaattaacaagggaaatttgaactgtaactgttcaaatcgcttaaaaccgcttttctcgtgtagagcatagtcgattttctattgaaatgttcggctttttttgcattggcccccaaactgatcagaaaaaatgaatcaagtttaaaaaataaaataactgaaaaatgaaatgctagatggaataatacttttgaaaaaaaatcaaaataattcagaaagtatcgagcggatccgaaccagagttgtgccggatca

SEQ ID NO: 1918 - DNA, 1765 bp, Heterodera glycines
  misc_feature (1751)..(1751): n is a, c, g, or t
gatgatttatcatcaattgctgatttcaaggagtcatggatgattttttgagatgatgatttgctgattcttgagaaaatttgctgatttatgctaattttttgaaaaaatcaacaaaaagggtcattttttggacatgttaacaaatcgtattataaatttcaaaatttttctaaaaaaatttttaattgacctggagcccgaatcccgaaaccctacatttctgtcccgaaacctgacccgatgatttttcggccgacccaacccgaattccgacccgatatttttcacgtcccggaacaaccctgatccgaacccagatgaatggccataaatgcaagagggtaaatcgcattaaattgatgtttttttgctattattttgatttctagattttttgctcagcttgatgatttagtccaaaaatgattaattgtttgaaataattgaagaaaatttgtttgaaaattttcattaatttaatttattaaataaaaaaccaaataattttgtattattttcacttgatataaattaaaatttgattttttttttaatttttaaaatttttttgaatttttaaaatttcccggttggtcccggttcccggtttttcttgcggtcccggtcccgaaaaaaaatcgaggtcccggtcccggcttctcaggtcccggcaagtcccggttttggcaaaaattcccggtcccgtggcactctacttttttgtatgcaggatttattttgaatgacctccgaaaaagtctctcgcatgaaaatctcgaacggcttatttttcttcatcataatattatcctttacaattttgattattgataatatgggaattttctaattatgcttttacaaatgtgcgatccgcggcgttttttgcgcgatccgcgatccgcgaccgcggcaaattgaatccgcgatgcgcgatccgcgaccgcgggattttttttgcgcgatccgcgatccgcgaccgcggcaaattgaatccgcgatccgcgaccgcgggatttttctgtgcgcgccccacccctggtcgtccgtcactttccgcagctgtaccactgaatcgtcgatagattctcttacgaggtcctaaacaatagaaatcggcttgtccaccaacaattggctttaccttcataaactgatcgtctgcgctaattgcatccaaaagtgtgtcttcctggtccaccgggctcagatccttgaagccaggcttctccgccacttctctcagctgcttcttcaccttttccacaagctcgtcaataggggtgctctgcaggactttgaactcgttagcgggtttggcgccggctcatttttgccgtagacggcctcacgcttccgttttttgcccaagtcgcaaatggcggtgtggaacagtttgcagccagtatcaaatgtaaatttgccaatgtcgatcagatcaccgatgaagcgacgtttgcgaagggcaacacgatcggaccgtgctgttcgcaaactgaaatttcaaaaacgaattcgcacaggcacggcactgagttgatgcgtaccctgtttcagcattggcatttgcctcggttgtgcagtgatcggactgattgtgccccttcaatgccattgtgccgccttttatagcggacgaaaggggtttttgagtgcaatttgggaaatgagcccatcaatttggcaaatttgttgtccattctcaaggtccaacatggaatccaggtccaggtccaggcttttttcanaataccgatctcta

SEQ ID NO: 1919 - DNA, 2893 bp, Heterodera glycines
  misc_feature (40)..(40): n is a, c, g, or t
cccggcaatatgagcaccgacgaaattcggtaaacattcncctcgagttcaactaattttggctcttttctaaccaaattttactcgtgtaatgcctaatagtccgtgaacttaccaatttcgcaattcgttgcggccctttcaatttaacctgtttgagagaattgtcgctacattcccatcgtccctttgctttttacattttcattgggtttttttttcaatttgtgcctttcgtgttcaatttcgcatgcttcgccagcattttgcaccattatgtgggccttgtctctcaaacacacatagcacttattcttcttcatcattctacaaccatgcaatttgcttcccaatttgtcaacaatcaccaccaccgcttgtttatgtgtccacatagcattcgatgggatttaccattccgaatatccaaaacggtgttacaatatgattataccgagaactgtttcacgagaacggatttgtggggagtttgcgcggtgaattttgatggcctgtgcttatcatacctatagaagagagaagtgctccttattccggttgcccataatttggtgacaaatatttatttaccacaatggttacggaccggttttgactgatcggattgattggttgattgatccaattattatgcaaattaatttatgcaatgcaatgggcttggtgagtttactgggcaacaattttgaccattctgcaaaaacaaccgacaaatgcttttttggggaaagataaaaatgtttcaaattttagtgaatttttcgagaaggactttggcgcttgcacgttcgactttgtcaaagtgtcccctgaccgtaccaagttgtacattgcagtccgatttgacagcaaagcggcggcacgtaaagtcatggaaaagtcggcacaattcctcactgattagcgtctctatttccacacaatttcagcttttccactgacggagaattactcggcttcaaggttgagatgacatggttccgtgacattcgccgctatttggcccattgtgctaaacaaggttatattgtttgctgtcccttcttttgctctcacactctaaacgcgttccgttttgaggaattcgtccaagccgttttcgtggccgttccgactatcgccgggatgacgagcagtacaaagggcgcgggcgttcaaggcaagttggaggcacaaacggggacgtgctgcgtcatccaaaaatatttaaaaaccgaatttggctgctgaaaattttttccagcggaggccccctccaagtcccaaaaatactcattgtcaaacctgcgggttcgtcacatttccagacaaaaattagctggcaattaactcaattttgattctgatgcactcgttcaggtcacctactcggtcccccgagcgtgaagagggcgcgcgcagtcgctccgcgtcggccgcttcgcgccattccaacgccaaccgccgtcgttcgcagagccgttcacactccgcccactcacactcgcacagtcgttccctctcgtcgggcggcgaagtgcgcggggctcgcgacggaaatgcgtcgcattcggagcgcgagaaatctttggactacagcgacattgaagaggcatattttgaaattctgtttttttttggcaaactttccccccattttttgtagaaaaaggtccgtctttcgccgccgcgcgttctttcgccctctccgccgcccctaaaaaagtcgaagaaagagaagcgaaagaaggagaagcggcagcgccgcagcaagcacatgtcgccttcgttggccgtccaccgccagccccactcgggctcggacatggaaatgggcggggaggaggaggacggactgtccaacggcggagggcgcaaaatgctcaaaatggagtcatcgtcgcccgtcaacaacagcaaggcatgtggtcaactgggggaaaacgagccgaaccgcggaatgggtggagaataccctcttgcgttttcagatgattttcattggtccggtcaagcccattgtccaacagtcgccgactgcaccacaaaagctgcccaaggtggagctgcgcaaccagtccatcatgttggacctttccgatgttggttgggctaggggagtggaacagactttattaattggcatacaaaatcaatacggacaaacccctaaaaaattaaggccaattggtcacaaaaacagctacttaaaaaaaagtttttgccagggtcactttttgccgatttttttctttactttttaaaagtaaactccccgtctgaaaatgttgcactttccaataaactttttccagccaaggactgtttcgccaccgaaattcaaaccgattggcgaactgtcggactatcagcagcaaatcaacggatcaaaaggcatgcaaggtttgtctattctttttagtactttgtactatttttcttgaattttagaactttccaacattcgattggccactcctccgccacaaccgccgccggtgcttcgcaatgttccgttgcctcccgtgacgtcgaataacaacgaaatgatggtggaccgcaattacattgcaaaggtgccgttgccacttttctaatgtttgttagtgaatgtctacttttttgcttttcggacacgcaatatccactcgctatcttctattaaaatggatacgaattttagcggaggaggggggcggggatgtgtggcagactcaatgcatataatgggttacgaattacaaattgaagcatttttggacctcccttacggatttctattattgaaacgcagttacgttcagccctttctgtaccctttacacatgtttggtttcattcggtttcaaaacgctattatttttatttgtctgattccatttgtccgaccatt

SEQ ID NO: 1920 - DNA, 4035 bp, Heterodera glycines
atgcgatttgttaacagaatttgtaaaaaaatgaccacttgattaagttttgggttttaggatgcttaacatgaaagaaaaaagttggaatattttttaaaattaaaattttaattaaaataatggtaaagaaaatgtgaggaatattctatccaagtggggaattgaacccaggcgaaaaattatgaaaggtagaaagtttaaccactacacaacatgtgcatgtgtgtattccatgactaaatgaaataaaatttaattttttctcaaaaatttctccttcttcaccaatttcctactcttttctcgaccagacccccattcttaccagtgcaaatttttaccggcggtaccggtactagaaaaaccggtaacggtaatttcatttttgaaaaaaccggtaccggtaccggtaccggtaccaaaaaaaccggtaattaccggccagtaccggtaccggtaccgctcaaccctagttctaaacaattaattgtttgacgtttgtttaccattcgttgggcattaaccaactttttgaccgttgtcatgacagtacaataaattctcagcacagctcgcaatcaccggcttctccccccccccctttttacgcccccatttaatcctattttgtttaattctgtcatttctattcaaaacgctttacacttcgtttttcatctgatggcatccgttgttagcccatcgtcccgttcaaattcggcactttcggtggcacttttgccgtgcttatcatttcgcccctttatgccttcgtccgttctttttgttaggttttcgtaagggtgcgtcccctcggccaaacggaacgccaacgcggtgcctttgaatgtgtccgcgttgtgaatggtcaggtcgtcgtgccctataaatacacttgtgcctttccgtttttcattcatttcgcctcccatttgtcagagtcttctattagttgatcccgaaaaattctccggaaacgcacttcgccaaaatcgaatgcacgaaagggaattccgttttgaggcgattttggcaccaaaaattgaggaggaggaagtgcaggcgctggtgggcacggagggattggtggacggactcgtccgattcggacgcaacggaaccgtacttgcgtacggaccaacaggtgaacaggacacaaattaaacaaaataatgataaagcgaagagtcccgtggcataatttttaaccctaaggcattttaattattggagggagggaaatccaagaaatacgataatttatcagtgctgttaagtgataacgctcatttagggaccggcaaaacctacacaatggtgggcagccgcgaacggcccggcttgatgagtcgaatgacccgggcactttacgagcaattggccgaaatgggcgacagcgaaacccgcgtttacatttcctttatggtctgatcagcaagcttgatcacttactttgtcagcacacattttcccaaaaaggaactttacaacgaattgatccgcgatttgctgagcacagaaagaaacggtccgttggaactttttgaggtgcggcgaaatgacaggaaaacaaaagccaaacaaacgaaaagcaaattggcaaatgatccattggcctccctttgcgaaggatgagcgtggcaatgtccatgtccccggattgagtcgcgttcgcgcgtcaaacacttcgcgacttcttcaattaatccatggaggaaacgcacggcgaacgaccgaaccaaccgcggccaattcgtaacagacaaagggacaacgaaacgagccaaaactgatcattatttgtaataagtacatcgtcccgatcacatgcccttctgatgatcactttgtggcgagacaatgccgaaaaggggcgactttttctgatcgatttggccgggtcagagagagcgacgaacactcaggcaagaagggcacggactttgtttgacttatcggatcttcagaatcaaggacagcgactaaaggagggggcggcgatcaatcgctcactgctcgccttgggaaatgtgaaatttcaactaaaaatataaatattgtctgattgtttctttttggcaatttaaattcaatgctaattacccccctcccccgagggtcactttattaaggtaataatcttaggtgataaattcgctgtcaaatgcttccgatggccgccgacccgcttatgtgaattaccgcgattcaaaactgacgcgacttttgaaagattcgctgggcgggacgggcgaagacggcgcgggacggacggtgctaatcgcacacatttcgccctcatcgacggcttacaacgaaacgtttaacactttaacgtgagaggggcgctcgctcaaaaaggatgaagatgggctaaaaacgattgatccttttaagatacgccagcagagcgaagggaatcactcgtcgggtgggatggaaggatgccaattttatctaaggatttcctaatttgaagctgccccagcccatccgaagaacagcttccgccgaccggctttactccgacgcggtggaaatgcttcgacgcgaggcgcaaagggcggggcgggcggaagggacggacgcaattgcgcattcgtcgtcactgggaatacgtaaaattagaatggcattccaatttggcattttcgctgggacactttcatcactcctttagtgccaacggatggcaacagagcgcggcgtggaaccgtggccattccgagccgacccttgcagggccattccttttcgttgtcaccgtctatccctccgctgttgaataacagtaattcacttcccggcggccgttctcggccttcaaatgcaccaccagcgaacaacgagtcgaatgccgccactccaaaagtgccgaaattgcctcgcctcggcacttcgctgttcgactctctgcgcgaccaacacttggccaatagcgaacgtcaacaccgccttaggtcagaaaacgtttttgtggttctcatttcttctgtttagagagcggctgctgcaagcgaattccgaacattacgaattggaattggcactgaaggggaggagggccattctgaaggcatgcgaagcgcagcaaacgcacggggagacggagaacgcgcaaaagtgcgaaagggtggcggagagagtgcggacggaagtggcggacaaagagcgacggacgagcgaattggccgacattcggcacaaattggagagagctttgagacggggagagcaaacgctgcagcaaacggaggagcgaatgaggtaaagccgaatcaaagcagaagcgaaaggacgaaagtgatcagtcaatttcagagggttggccaaagaccagcagcaattgcaaatcgtcgagttggtccactcactcgcaacacaacgagcggaaagagagattttggcactttttaatgagtgccatttcattttccattcgattttaggggcggcaattcactcggatttcgctttacaaggcaaacgtttacagaaacaagagaaccaattgaaacggataaagcaatatgaaagaattgtggacagattaattggggcagacaaaaatttggagggtaaaaaaagagaaaaaaaggatttaaagataaaatggcaaaatttaggtgaagaaagagcaaagctgcacagggaatatcgccttttgagaagccaattggacagaatgttgccggtggacaacggactgccgtcgtggaacacacaaatattggcggagagaaatgccaaagcgggacccagcaaaaacgaaaagccgagactgagacaaagcgaaagcatttcgcttaatgggtaattagaggatcagtaccaacgactaaataccggacgagttttttgaagcagtaacgaggagttgaataaaacattcacaattgtacggccgaaagagtggtaaaacggtggagaagcgagcattttgccggaaaataactgctggaagaagagatattggaagattagggaagaagcaaacagaataagagggggagagataaccggtgatatgat

SEQ ID NO: 1921 - DNA, 3166 bp, Heterodera glycines
  misc_feature (3004)..(3004): n is a, c, g, or t
  misc_feature (3016)..(3016): n is a, c, g, or t
  misc_feature (3018)..(3018): n is a, c, g, or t
  misc_feature (3020)..(3022): n is a, c, g, or t
  misc_feature (3034)..(3034): n is a, c, g, or t
  misc_feature (3038)..(3038): n is a, c, g, or t
  misc_feature (3047)..(3047): n is a, c, g, or t
  misc_feature (3051)..(3052): n is a, c, g, or t
  misc_feature (3062)..(3063): n is a, c, g, or t
  misc_feature (3065)..(3066): n is a, c, g, or t
  misc_feature (3075)..(3075): n is a, c, g, or t
  misc_feature (3102)..(3102): n is a, c, g, or t
  misc_feature (3105)..(3105): n is a, c, g, or t
  misc_feature (3108)..(3108): n is a, c, g, or t
  misc_feature (3115)..(3117): n is a, c, g, or t
aatttctcgatgaaagattagtcccaatccttcttcttcctcctccttctccctcccgtcgctatgtcctccgttgtcccctcttttcttcctccactcgttctcctccgacttccttttcgtcttccgctgctccattccctcttcctcctcctccttccgctcttttctgatcagcttcttccgctgaattcgtcctcccctgccgcttctccccgctgtccttcccgctgttcgtgtgcccattccaccgtaatctgtgccgggttggcgcttagtcacgtgccaaaggaaattcccccgggcaccactcgcctgtacatactttttctctcacatttttagtttcaaaaatttattttagagatttgcaagaaaaccgaattcgtcaaattcgtctgggcgacttcgatggtctgaacgcacttcgaacattgtaaaattagtcgaacttcgtcctattttggaaaattcgcttttttagacacatcggcgacaattccatcgaacaaatcgaaaagggctctttggatgcattgacttcgttggaaagattgtaagaaatggtcggactctgtctgaggtgactctccaattcgcttcttccctcaggcgcctttcccgcaacaaaattcggactttgcccgagggcgttttctcccacaacaaaagacttcgtcggctgtacgtatttttgagcattttgtgcttttgccccttttttggttctgtccaacctctttctctacaatttttttttgttaaattttatcttctccccttcctcattttataattatgaaccctttttagcccaccaacactcatcccccattttattttatctccccaatctctcgcccctcttcccccccccccctcggaacgcccctatggcgccgtttctttccatcgattcacgcgccaattagtcaaccacattaattaggcatggcgaatatgtttattggaagaagaacgcggaggaaaagtggaagaggggaaacaaagtaaaacagaacggaaagaaagacatttggaagaattgacggaaaaaaagaaggggaaaaagaacggatgggatgaagaagagaaaaggaagggaaaagagcgggaagagatgaagaggaaacaggctcaaccttagtgggagccgcgaatgccatgtaagcgcagcttatttggacagaaacttggtaatggtgctcatccgtcgtctgtgcccttccatgagtaccctctccccccgtccagcttttcattccctccctcgcttttcctatccccgtttttcattccccgccttttctgtccccgctgtcccttcttcaaccctttttcacttcatcttcatcatacaccactcatttatttatccatcgttcatctccgtcacttggacatattgcctttgctttctgccaagtaatgatttcctccgcctttctctgccgatccgtccgatctgatctgatctgatccgatcactttgctctcttctgacaacttttctgtccgtctcccctcctccgtccccattcattcatttccgagatgaatgaggcgataaatgtgcttcttttgctttggcctccgattttctttgcttaagtgatcgcatcgaaagtttatttaagtctgatttgtggccacggcaaaatggaaagggatgggcagcaattgtctctgaaaatgacgaggagagggggaagagaggggggggggggggagagggtacgcgttattcattgccggagaggagccaccaccaaaaagcgaaagtttttggcgacagatgaacgaattcttaatttggtgcgcctttacgtcccgatgaatgcaggcaacatcaaccatgatcacaattaccacaatcgcaatcaatttcacattattttggagtttctccggggaatttctcgcaactatcgaatgaacccgagaatttctgttaatttttacattttttattgttaaaattattgttgaatttatttttaaactgtttattttacatttttatgctgaaatttaaaaagttgtttttactgtgatttttcatttttctgtacttggggcccaaacgaccctggggcccaaacgaccctggggcccaaaaacgggggcccaaacgcgggggcccaaaaactggggcccaaacgcccccgactcgttaaagtctttacaaatcacagtttctgatgaatgcaattctttatgccgtcagaacatttacaagcgcttaattttgacaataaaagaataaaagagtgaattaccaaatgaaaatttgttagtttagtaaaaaattaaaattaattgagatttaattgtttgagcggactattttttgtttttccaagaaaagagagaagaagaccaagaccattcgtcatcgttttccaacagactgttcagcgaagaataggttctgctccgtaacatttttacgtagtcggaattggccacttcttcgggaatttccgaaataatttcattgagcagctgctgccactgggcttcagtcatcttcttgtttcgtgccattgctgacgtggacggctgacaagtcctgacctgctgaggcactgttgacaaggattgcggcaccgctggcacaatcgacggagggggaggaatctgacaaaattaaaaaatataatcatttgaagacaaaacaattaattatagattcaaaactaggcataggcaccggtggcactgaggacgtggaaagactatcagctgacaatggcacggccaacgaataatgctgaattcgcgatgccggagacagccccttgaaagacagaacgatcaaacataaacattttaatttgcaagacagggaatatccaaattgaacaaattggtctgggtggggtttggcttggcacttttttggttaaccttctgtcaaataattccgagtttttcaattaaaaataattatagtaaaagttaataggttatcgggttaaaatcgtgttttataaaaacctancctgcgatagtntntnnnttggcctttttncccnttgtgcggnttgnntgctgtcgtnngnngcttggcgnttttgcccgataggttcttcctgcgcntcntcnccctggnnntgctggactaatgggcgaaaattgcacaatgtcggcatatgactttatt

SEQ ID NO: 1922 - DNA, 4565 bp, Heterodera glycines
tctttccccccccccctcattccgtcactttttcaggcgcctctccgacaatccgtggcactgcgattgtcgccttcgttggctcaaaaggctgaaaattgccccccaaattcgctgttatcggcccacccatttgttcggccgcccattgaatcagatcagctcacaggcaaaacaaacaattttaataatcaattttaattctttttaaagcaattgaaatgttccggacttgaaaaacgcgccagcggaggggggcgaaagtgccgcgacacggaaaggtaaagtgccgggggggggggggacgacgcgaccgcaccacacaggtttggcctttgagatgtcctccagggtgcgtctgcacagagtcggccccggacgcggtcgttgtcgactgccacgaccgcctcttgcgcgccgtgccgcaacgccttccgccaaataccgtggaactgtacgccctaagaaaattatagagaaaaaaggtttcccataatttattcagtcgtctggagcaaaatcgaataagccgattggagaatggttcgttcagccatgtgcccaatctgatcagactcgacctcagcaaaaatgccatcgaaagggtggagcccgcggcatttgcaggacttggccgcctcagttcactgtacggagggcataaagccctttttcacagttacactttcaattttaagaatgctattctccaataatctgaccgatttgcccgaaagagttttcgatggcattggcaattcgttgcaagttttgcttatgaacgggaatcagctcgagtgcctgcgaaacgaagtttttagaggactgaatcagctgaaggtcaggatcaacacaaaatgtcactcatatcctccgatcgttgtcctttcttctggtcactctatcattttacttttccccctctctgatcattcccttctgatcactctcaatttgactgtttggctttgcttatcctttccatccctttaataattttttgatcactttaaatgtaatctgattcagtgcttacccttttccccataattcagctgctgtccctttacgacaacaaaattcgctcaatttcccaggcgacgttcgcacctttcgccctttctcttcaggtgcctttgcgattcgaacttttctacccctaatttattcagactttgcatttggcccgcaatccgttgatctgtgactgcaatttggtgatcagaatcatttgcttttgagcaaccatgctgacatagctgtcgttttttccaaggtttggatggccctccttttggtcgaccgtcctgtggagacgagcggtgcgcggtgccattctccgaaaagagttgcccaacgacgaatcgccacactttctgccgatcgttttcgctgtgtgggctcggaaagattagtgactcagcgggcgggacaatgcgaagtggacagagaatgccctgaggagtgccaatgccgagggacgacggtcgactgcaggtgggcgagaggagagggataaaaggcaataagtaaaggaattaattgataattaacggaatggagtcgggaatggcatttgccttgcttctccctttagctcgcttcatctctcctctctccctgcggcttttccccgcttcaccacctctcttctgctccgctccaatcgcctttctccccggggctctcttttgccgaacgccgatttgcccaatttggtccatttggacctcagtgataaccaaataaatgctcttccgcctgatttcctcagcagtgttccgtctcttcgcgagttgtgagtattattccccacattcgtactgattaatccgacttctgaagagatctcagcgaaaattccctccggcaattctccgcccattcgttgggtccgtccgcgcttaatttgatcactctgtgagatgattaatgactttgatcgcccgttaactcttccaattttagtcagcttgatgggaatgccctccgctgcgttcccctcgaccaatttccttctcttcgttcactgtactctttcgccccattctctgtctcaccgtttaatcttgtaatttcactttcctttagatctcttcgacagaatccgctcaattcgcttgatggtcccgtctttgaacagctcgaacttctcggtttggatgggtcggcacgtttcatttgcgactgccaacttcgccctctcatccgccgactgcggaaaatgggcaaaatttggacaaacgaatgggaggaggaggaatttggaggaccgcgatgcgcagagccggaaaatttgagagggaagggactaagcgaattggaggaggacgaactgatctgccaaggctggtttttaatcatttgccaatttaacggttaattcgatgcctattgatccattggctatttgccaatggttaattagggcaccgcttttttagagggaattccgggcggacaatgctcaaccgaaggtgagttttgtccttccggttgctcttgcgttcgtccgtcctccgcttcttcttctgtcgctgtcgtccctcctcttctcgttgtccgatgttctggccttggcttaagtcgcgttccgatcggaattccggaggataccaccgaattgtttttggataacaatcgcattgaacacctttccggcgactcttttgcccgttttccccaattgatcaaactgtaattgccctcccccattttaatgatcgttttaattatgccccaagggatctttcgcataatttacttcggcacattccctccggcactttcgtccatctttccgttctttccacgctcattttggccttcaaccgaattcaatgccttcacaacggcgctttcgacggcctttcccaacttcgcgtcctttcccttcaccagtcagtgcccttctccgatcactctttctttggcaatttcattccgcttcagaaatgatctctcccaattgtctgaagcgactttcgccccccttttggccaatttgtctcacatcgctttgagtgccaaccctttttggtgcgactgccaaatgaattgggccattcgatgggttcgctccaaatttattgagccgggttctttttttcttatgatttgttgcttttttgtattgtgtgttcggtttaggaattgcaaaatgcgaaggaccgctccatcggaagtgattaattttttttcaaattcaattcaatttttatgggtctttcctaattcaggggcttttttctgctgagtgccgatcctctgctgatggaatgcccttcttcctcttctcctcctcctcccattagcgtcctttccaaatgccgtccttgcctcgaccgttccctttgtgccaatttggcactgtgccattctctcgaaaatggcaaattccgttgcgaatgccctctcggcttccatggcactttctgtgaacatccaatggaaaattgcgacacaaaaaacgaagggagaaaatgcaaaaataaaacggcaacgcaatcatttgaactgattggagaaaaattgacagcagagagaaaaatgggggcagaacaacggggagaggagaaaaataataatgaagttatggaagaaaagaaagggagagtcgagagacaaaaggaagaggtaagagcgacagagaagaagagagatacagaggagtaagaaagagggcaaaaagaaggggtaagagagacagagagagaaagaaagagtaaaaagaaggggtaagagagacagagagagaaagaaagagtaaaaagaaggggtaagagagacagagagaaagaaagagagtaaaacgaaaacagggaggtggtaagaaaaggaaagagagaagagaaagagagacacatagcgatagaaagagagaaaggggagggagggagtgagaggaaggaaaaagaaaacagagaaaggagggggagagagagagagaggagagagagagagagggtaaaaataaggggtaagagagacagagaaagaaagagtaaaaagaaggggtaagagagacagagagaaagaaagagagtaaaaagaaaacagggaggtggtaagaaaaggaaagagagaagagaaagagagacacatagcgatagaaagagagaaaggggagggagggagtgagaggaaggaaaaagaaaacagagaaaggagggggagagagagagagaggagagagagagagagggtaaaaataaggggtaagagagacagagaaagaaagaaagagtaaaaagaaggggtaagagagacagagagaaagaaagagagtaaaaagaaaacagggaggtggtaagaaaaggaaagagagaagagaaagagagacacatagcgatagaaagagagaaaggggagggagggagtgagaggaaggaaaaagaaaacagagaaaggagggggagagagagagagggtaaaaagaaggggtaagagagacagagagagagaaaacagagatttaatctggaaaataactttaggataataatagtcaatttgaaatggaaaaattattcacggatgatgtcgaattgaccatgccgatgaaa

SEQ ID NO: 1923 - DNA, 1033 bp, Heterodera glycines
  misc_feature (969)..(969): n is a, c, g, or t
  misc_feature (991)..(992): n is a, c, g, or t
atttcaaatactaaattataaaaaaaatatttttttttttcttttttgggcaaattcacttcgtttattttaattgaatctaagactttgtcggaaaattatttatatttttcaaaaaatttctaagaggagcctaggtgctagaaacgactaaacgatccaaaaaatgcgcggcaaagtgcttaaaccgcatccgctgatctctatgattccacttaagaaaaatgaaagacagaatgccattgcataaactaggtattaacttccgatcattttcctgctctgctaaggatgtaatataagcagcagtagaaaaagtaatcttaacaggatgctgcatagcagcccgtaattttttaatacttattttacccagaacccttgccttaacccaatttttaagttagtgaaccaagaaattcagctgtcaaagagcaaaaacagaaatccaaaatgcattcttgcccatggtttgtgagtcatctaatgagcctaccccagggtaattaatagggttgtaaattatatggactaaaaaacgccaaatatggacataaaatatggactaaaaaagcccgaaatatggactaaaaagctcaaaaatggccaaatatggaccaaaatatggactaaaaactgccaaaatataagttttaagcgctcaaaaaatccgaaaaatggatttatagtttttaaatgccaaattttatcaaattctagcttcacaattgaaaaccaaatacatttcaattttttggttaataatctcattctttgtcagcaaaatttttcggaagcgaagaaaaaaccaaaaaaattttccaaaattttggagaaattctcattttgggggtgtatttttaaaaattccccaaaaagtcgatctttatgagtgtatttttctctttttttgcatttttttgtggaaatttgctaaaaaggcaaaaatggcgaaatatggatttattncccgaaaccccccaaatatggnnattataaaaattgtgactctttattcagcgtgaactcaatt

SEQ ID NO: 1924 - DNA, 1579 bp, Heterodera glycines
  misc_feature (65)..(65): n is a, c, g, or t
ttcccgtaaaaatcccgtcaggcaaaacagtatttttcttaattcccgcgccctcccgcgggacncccgttcccgccctactctaatttatatgaattcagttaatgccaaattggcaaattcgctaatttacttagaaaagggacatgtcaatgttgaatgaaattcttttcaatattaattaaatgataataatggcaaaaaatttttttttattattttttaaaatttattgtttaatttaatatatctttcaaaatgaaaaaattattgccattttcctttaagtatgaatatgaagaatcaaagcctaatttaagtaaacactaaatcaaaactcttttctgttcatcagctgacattgatacccgttgtcatacccaaagttaattttttgcaaatgcatattttttcctggattctacgtagtctaattagtaggaaaaacttctttttgtgtaattgagtataaaagcctggacttttatttgaatattttgggtttttaagcatattttagatttttctgcatattttgccattttttatatacattttaagattttttgcatattttgccattttcgtcaaatattttctgatttgaaaactcctttaggaaaaatttgattatgccaaaaaagtgagcttcgctgccgaaaaccttgagaaatttttggtttgcaattgtaaaaacaaccgataaaatttatgaagaataaaatttctaattaatttgcccctaattttcaagttttttatgcatattttgtgcatatttaacgactttatttgcatgtttatgcgcatatattggccatttttcgtgcatatttatggcattctgtcttataataaataaaaaattaataatagaaaaacttttttaaattttataaaattcgtataaatttcgtaatataaaatatgttttatttttgagagagagaattttaaaatttacttagctgtaatccttctgagattttacgaaaattttctgaactttaaaaatcgccagctcatatgattcattttttatttctgctatgcttattttataattttgataaatcttttggcgaaaaatccataataaattctcagcaaaattctaatgtaatattttaatataatttcaaattttaatgaatataattacgtgattccgttgtcaaaaagtttttaattaaaatttcattttgggatgccaataattagggaccgttaatcaggtgcatttatattatatttttccgtccatcataaaagttcctcagggaattatgaaagtaaagcacggattaatgcagaacacgatttggaaaattttgccatcgtaaatacgaaaaatttgaaaaaacacatgaaaaaataacataaattttaaattcatacaatttttctaaaatttcctcttaattgccaaaatgtggactaaaaaacgtagaatggcaaattatggatttattctacataatatgaattttttataaattataaaatatttaatgaaaaaaaaactgccgttttcgcattttagttccaacaaattccgtccgatgtgttgtaagttttg

SEQ ID NO: 1925 - DNA, 2598 bp, Heterodera glycines
tcagaatttttgatcgacaaaatattgacttattcattgataaagtgatccgtgttaaacatatgaccacccaaaattaggggtggttgcactttttctgctcgcatatcggccaaagagaattaattgatacatatgtatgtgctagtcaccaaaaggggggttccaggttcgaatccgatgcatgttaacttcacaaagatgtttgcatccaaactggccaatgtctcatactttgaatcgttctctgaaaatgggaaatgacgggtctatacaatgttaatgatgttcaaaatccacgcaacactcactcggaacaaattgaaccccagcagcagcagcagtttgtgcaggtgacagtgccacgggtactcctccgaccattgtaaattgcgttggcggcggcggcagtgtttccccattctgctgaaaaaaagtgataatcattttgtgaaaagggtaattaattaaaaggctaattctgctgggtgtgtgggtgtggcatcaaaaactggcctttttcttacagcaaccgcagcattggctgaagatgatgaacacaacagcgctcacgagcatcaacagaagatgaacgggcagcagcaaaaagacagcggaggaattctgaaccccggacacaaattcgaacaaaaagtgtaaaaatttttttttttacaaaatccacatttatgcaaaaaatcacttcagaaagcacgaattaatgagcagagcccgtgacgattgggactcccacgggatttttatggggattcacggttcagattccattttttgcacagtgggatttttacgtgattcccagtcgcgctcccgtcaatttttcaaatcccaaatgacccaatcgccggagaacggacgttcggattaaaaactcagattaggacacccagtttttttttcaaaagtccacaaagacccccctaaaagctcggattaaaacttcaaaactcatttttcgcttttattttttattcgttttaatacatacagtaagtacagaggcatacaaaaatgacaacattggaatacagtaaatggaggcatacgatatagacaatgacatttgtaagcagtcacagcgttgaaaatggaaatctcatatacaatacgaataatatacacacaattacaaagtggcaaaatgtacatattttatcggtgaatcaatttctgccgaagtgattccctcggagcggctcgtcttggcttgcgggcgggcacatcaatgagcatggcgtcagacacggcgctccgcaaatcgctccatcatcggctgcacatagttgacgaagcagttgtgcgcaccgtacgtctgcgggaggagcatgtagacgagcacggccgtcttcagcagcagatacagcccgaacggcgcgatgaagtggtcgaccagcgagaagagggcgaaggcgcaccagtaggcgagccattgggtgtcgtccgctgaaaatgggattgggatattaattaaaatcaaaaattggaaaaattgactcacttttgctttgcgatcggatggtcatcacgctctggtagaacgggtaacttttgactgaaaaatgacaaaaattagtggaggcggtgaagacaaaaaaaaaggcgaaaacccaccgagcacattgctcacgaacatgttgtaagagccaaacagcaggtagaacgtcaacagggcgaccacggtgaagaacagctgaaaagcattgtaaaattagagcggggaatgtcttccccttcccttcctttacctgctcgcggtccatcccggtctgtcgctccacagtgtcgatgatcggatggtgcaactggtcgagcatctcccgcagcaccgggcgcacatccttgaagctgttgataggcgctgagcgtggctgaagacgtgtcggcgctggcggtggcacttcctgcgcttgcgttggcgcttccttggtcgtctccggcgctgctggtggtggcacttcctgcgcttgcgttggcgcttccttggtcgtctccggcgctgctggtggcggcacttctgacgcttgcgttggcgcttccttggtctccggcgctgctggtggcggcacttcctgcacttgcgttggcgcttccttggtcgtctccggcgctgctggtggcggcacttctgacgcttgcgttggcggttccttgggcgtctccggcgctgctggtggcggcacttctgacgcttgcgttggcgcttccttggtcgtctccggcgctgctggtggcggcacttcctgcgcttgtgttggcggttccttgggcgtctccggcgctgctggtggcggtggctcgtccgacatttggttgctgctcacttgtgcttgaagaattgtgcggcaagtagattaattgttgttgaagaaaaaatgggggaatgaaaatttagcgaatatttcgccaatttatatgcaatttttgtctcattttcgccagcaaaaactaatgtgaatataaagaggaaaggaattctacgaattttcattccctgcttcatatttaccttcatttttgccatcgccaccaattgggggcccgcgtaaatttctgagggatgtgtttttcgtttggttt

SEQ ID NO: 1926 - DNA, 2211 bp, Heterodera glycines
attttatttgtcttacaatggatcgaaaaaagatttaaattcttcaaaaatgtcgtgaacacaaatttttggatacaatgacagcgaaaacgaagggaattctgagcaccacgaataaaacgccaaaatgatggatgtgacgataattttgaagaagaatgcgccatcatcaacttcgaactcggaaaaacaaaagcgaggcatttgtctttggtctgaaggtgggaaatttgatagagaattatgaaaagttgtcaaaggttttcggtacacgcacgaaaaaaacgtccgatggaggtgcactgtgtgtgctgccatgcccgcgtgacaattgcggacaaaagtgacagcagcatgtccggttttctcggacaaaaagaacaatcatttgcctaagcccccgaaacaaaatgtttgggaggcatttaattcattagacaaagaagaatttaggcggaaattcgacggcaaaaaactcgagcgcgtgaaagccgaaccccgaatcaggacaaattgcggctggatggcgaggacatcgtgctatacgacagtcgcactgtcagaattggaacaaagaacgttgtgctcgtttttgggtgcgaacgggttgtctcattaggggccaaagacagaatttatatttaattttttagagtttggacatttgagcaaaaacagtgcaagatggcatttggacgggacaatgatgccgagattcacgatgtcattacggatcttggtctgcaggtcgaaggatacgcagaaaaattgaaggactacgaaaacatggaagattcaagcatggatgttgcttaaaattgttgaatcccaattttcaccctttttattcattcgctttttgaaatattcctttttcatgcaaattcgcggcgacatttcgacgcagcgacattatgacgcagcgacattttgatgggcagcgatttttgtctcattgtcgccagcaaaaactaatgtgtatataaagaggaaaggaatttctagaattttcattccctgcttcattattcacattcatttttaccatcgccaccaattgtgtgcacgcgtaatttctgaggcatgtgtttttgttttgttttttgccatttttctgattttattttaaaatgatcaatttcgccataatttgattgattttaatgcatatttaagaaaaaacttaaaatttctgttcgaattcgggtcctggtttcggagttggtcaaattcgagttcagattcattatcaacaccttctaaaatccccaaaaacttacctaaatagggttaaaaacaaaatgaactttatgaagaaactgccttgtattgcagtttaatgtccaatcgaattctacgagttcagactttttcttactttgccaaatcgtacatttttggtatcaatcgaaagtttgcaaccaaaacctgcgcttacaaaaacaaatcaaacatttatcttgaatatactcgaaaaaacagctaaatttcggattttctattgtaaatcttttcaatatttgcttttttcttttacgcataaattgctgagactttaaaccttcaactgatacaaaaagtgtaggcaaatgaaaaaagatatggcctgtaaaactgagaatggtttgattgaacgcgtaaactgcaatagagccaccctttcattgtgtcgccccaattgtgatcaaatgaaaaaggagaaacgagaccaaaatttctattcactgcattacattttcaaaattgcaattttttttttatatttcttcttaacttaggatccaattcactcaaaagctttaacataatgagcaacaacgaacgcaaccgtggtgacgcgaacgcggacaatgccgaacgacgcactgacggcgaacagatgaacaacgatgagcccgacaccgttgctactggaagaacaacgacaacccaagaggttttgaagggggcgaaacgggttggaaaaattgaaatcggtagttaatttaccgccctattttcgaaaaaataacggatttttttgggtcgctggctgataacgaagctaaaaataagccattccggtatactgcagattgtacccattttatctataagggattcggggtcgctgatcacaaatccggcacccattgaaaacaatttgaactccgggtccgaattctaacaaaaagtcgaatcttcaatttttaatgtttcgaatttttgctt

SEQ ID NO: 1927 - DNA, 2253 bp, Heterodera glycines
ctcttaaacatcaatcaatgtttccgtcaaaaagacatttgttgtctcatttagcaacagcagcagcagacggcggaggggacaatgcccgcccatggcagcacggaacaaacagatggaggaggtacattttctggtgtataagattgatatttgttgttgttaaaacaactctttcgaaaattcaaatttttcgaattgcattttttgctcaaatttgtttaaaaacacggaaatggactacaagtcatcatttggatccggagaccgaaattgttcaaatggataccggatgcgacctcgaaaaccccaggaaacctgttttcatgtcttttgaaaacaaaaaaaaaattttcaaaaacggagggcaccagttttattaaattttccagtcaatgatggtgtcatcccgaacgtgccgccagtgggtgccgaggacctcgctgcgcctttgccgggtataaaaaagtttttttggttcaatttcatttccaaagtttttttattttatcctctcgttcactctctctctctccttcactctcattttttttgttttgatactctcttcctccctttcctccccccccccccgcacgcatcgattcccccaaggaattttttttcaaatttacaaacacatttataagaaaaaatttttgatacgaaaattccaagaaaaaaatttcgataattttttcatttttttaatttgaaaaatctttaaaaaatttttattagaattttattatcaattgggacgacagggagggcgaaacgcagtgcaccccattttcctccgtcctgttcaccccaaccgtttctctttctttagagtgcagctggaccgggacctaaacacggacaactgagtaccgagctcccggttttgaaaattttgaccgggaccggggaattcacagccggctttcccagccaaaaagccccgggttttcaagccgaaaagtccaggttccgctgcgctctactttcattttctctctctctctccttcgccatcttctctcttttttctcctctatttctccctgtcctttcccccctgccgtttttctcgctctctccttcgctctctctcactctcctttactctctttccatcgctctctttctccttcgttctattctttctctattttattctctccctttcctttccccctacccatcgctaaaaatcttcgaaactttttttttacaagtaatttttttatgaaaattttctcaaaattttatgaccaattacaaaaaatctaaaataataaacttattctttacgcctaggacgctttgctgttttggggcgattaattcgccaatgtgacgactacattaactatcttcgcgtgctcgccaacttgatggacgaattgcgctgggagggagcaaattcggtgccgggcgcgtccgatgttctgctcatcccgctgaattgcgtgacgatgatccgaatgtgcctcattgttttccgtgcaacgcttagtttggtgatggagccggtgacatttgcgatgctctctttcacctctgtatatgtgtcttattcgtgttttggcatgtgtcaccagatcactatttatttctttatcgtatttttttgtatttcattcttccatctcatgccattgtactatcacttttttggctaatttgtaatgtttgtttgtttttgtgctaggtcaaacctaaattatcaatggagcgaaataaaaaaaagtatcaatggtaataatatttaaattattaatatttaaatataattattattttaattttatttacatattgagctggagacacttggagctatcagattaaatcatttatttcattgaaatcaataggggatggaaattttattatgaaaaatcgcaaaacatatacataaatatgtaaaaaaaagcccatatattaaaaaaatgtacaaaactcctcatctatgaacagaataagtaaataaaatttctttatattttttggtgaaaaaattcttgaaaaaagttatgaagcaaaaaatgccgtaaaactttctaaatcggtttttaagggtcagagtgtttttcgcattgacctttttaattctccgccatttcaacaaattgtatcggggatttcgttgccgattcccgatttttctcacccgggatcgggacgaacaaaaaaaaataaagaaaaatttgttttaagttttttaaagtaaatattaaattctggtcagaaatagctgattta

SEQ ID NO: 1928 - DNA, 1562 bp, Heterodera glycines
tttttacgtattgtttttagacgtaataataataaggctgttatacccgggtataacgaacttcttcaactctttaaacaagaatcccttttaaaacgcagaacaaaaatcgatttaaaacttttccatgatataattttgggaaagatccatattcagcataatgattctttttcaaaaatatattcatgactgaaaaacgattatattataaaaaccgcttattgttcaaccaatgttcggtttcattcgttttttattcgtacctctcgcctctataggagtttgcctaaagaggcgaggttacttaattctactgagtttgctaaacttcttgacacctatgatattgatgttttacttttgaaaccgccccatctcattcagtgaccaattttattttatttattttgttttaatgtcggtgtcacgcttttgcgtataaattgaattgaattgaattgaacgggcgggggaaggtggccgccggaaaattttctatatttcgttctgatttgttaacagattttctcccaaaaaattttaagaaacaggtgggggtaaggcgtgccggaaaaaaactttgtgcttttaatgcgattcggttacagattttgtccaaaaaattgtttaaattttgccaaaaatcttatttcttgataaaatagtgacattatgccataaatttcataaattttgagtttatttaagaaatcaacaaattttggtcgcccccccaaaaatcagaacatttctgacaaatcacagatgagaaccctgatttaaacacaatacagctatttaatattaaataataattttttccaattaatttttttcgttttatttgaaattcaaaaatgcaaatccaagctgatcgcgctcattggatgtgcttctattttgcattaattgcttatttcgaattattttaaatagttctgctctaattgatgtaaccgccaaatgaggaatgaattaataggctataaaattatttttttacgaatccttgctaattaatgtcattacgtgccaccattatttacctatcttttggcactttgctccattttgaatttcttcacaaagctggccatttctgtttgtttacactgcatttttgacagaattacatttcgtttagcagtgaaaagcgcttttattccacggtttgcaattggtaacaacacaaaataatgttttagattatcaaatttcgcggcaatttctccgacgtgattttcaacggctttgatcggctgattagaataatttctgagaaatattagaagattaaaatctgattttattttgggtttttctatagtaaaagcaatatccgattttctttaactacacaacattaattttcatagatttggtttaggattttgtattacattttatcatattataaatttgtatgatggctagataatcgctggctgtataatcgatattcaaattcagggcccttctcatcaccgaataatatggcttttcttcattttaatgacaattgttatttatttgtttgtttgtttttataagtttgtcat

SEQ ID NO: 1929 - DNA, 8090 bp, Heterodera glycines
  misc_feature (7872)..(7872): n is a, c, g, or t
  misc_feature (7892)..(7892): n is a, c, g, or t
  misc_feature (7917)..(7917): n is a, c, g, or t
  misc_feature (7972)..(7972): n is a, c, g, or t
  misc_feature (7982)..(7982): n is a, c, g, or t
  misc_feature (8006)..(8006): n is a, c, g, or t
  misc_feature (8035)..(8035): n is a, c, g, or t
  misc_feature (8059)..(8059): n is a, c, g, or t
  misc_feature (8070)..(8070): n is a, c, g, or t
ttaacctagtagcggtcagtcattaagcgctcaaattatcacaagcgtgcgctcaaatggcccctgcgggcgctcatgtggtacgcgcgagtgctcaaatgacccggcgtcgcttccctcccgacagctgacgccctttcccttctccattaggctttggttttgcgaattatttatttttatttttaatttaatttattttttattaattaataaaaacccttcaataggtttaggttcacccccgcacccatctaataggctttggttcactcccacacccattcaataggttttggttaaccaataggctttggtttggaacggtggttttccaagggccaaaaagggggtagtaactactaattttattgtctttttcaactgcataaaataaagaattttttcttaaaatcaatttttttaccatcactattttgtttaaattctaaatttataatattcattaaattaaattaatttttatattatagaaaaatgtttattcgaaatatgatttttattgaccatctaatgtcgagattattaaaaattattacaatagatggaaattttacaagttaccgaggtggttgatagtttaactatatatatataggttaatgtattttgataataaattaattagtgtataaaagtgttgtaatgtattcattaaatatctgtatgtctaattattgcaagttttttgtgtaatgttaattaagaaacaataatcactaaatgtaggaaaatgacaattctttgaccaatatgtttttacagaggaattttatgacgagggttagaaatcttattaattaattatgacaaattacaaagaatgttttgtagtgatgtatgatatgggggttaattgttgtgacaatttatgaaccaattatttttgattgaagtgttttatatagggatttttttatagtatgtgtgatgtttttaaaacttatgtgattaattatttcaaattaccgagaatgacttgtaatatttttattagttgtaaaagaattctaattaataatgagtcgtaaattattttgtataatatagctaaaaatcaattaatcatttcaaaggcggaacaatgtttggtgagatggttttacaattatttagtatggataagtattatgataaattactaagattttttggtagtgtatgtatgatatctgtattaattgtaattataaccaattattctttaatttttacaaactgaatatttctagggcaaagaagggttatgatgaaacttaaattatgtgtcacatttttgttgtaattcaatgaaacagaatacttgaagctgagacaaaggaaatgatgaacactaaatgagtatgataattgttgacagattaacttagttatggtattgatggctaggaaatatggcaattaattctaaaatatctgaaaaagaatgcaacttttcgggtagcgataaaccttttttaagtaagtaactaattattacagccacaaggattttagaaatgtataaaaacaaggaaaataataaaaggtgaattttcggtagccaatactcggctctccggtagtcagtacctaattaagctcggccctccggtcaccaatacctcataaggttcggctctccggtagccaatacctaattaaacttggcccgccagtaaccaatacctcgtaaggctctgacaccgaacactgaaaacttcattcttttgactatgaatttttatttttatgcaaattgttatcctcgtggtctaaaatttatatgagaataaaatatacctttcctattgatttggcaaaacgcataggatggaaaagggagtgggtaaactgagtttgcgatggtaaagagcaataatgaccgaatatgtgttggagcaagggcagagctgaggaaaccaaataagtgaaggagaggggggtgaggtcacggcgtcatcttatcctgtaaatcgatttctctaaaatgaacaaatggaaagaggctaacgtcaactgcttgcttaacaaaatccaatatttaagatatttttggtattgggttaagtttatttgaatattttccttttctccgtaatgtattttctctactcttatatctgcttactttcactgttatttcagacctacatattgtctaaataatcgtttccgttagctatttttcaatatcttttcttccaacactatgttttattctcgaaccgttatcttccaagtgttcgtattcttgttctttatcaaactattctcttccctatacattacctaatgtttgcttactaactcacattaaattctcactatttaatattgactctcttcaaccacatttctgagttctctatctctatctcttacacccattattaattgtccttgattctatggtgcactacaatattcttatatgatttcttcatttattcctattacaagacctgcttcacgcatacaattagcccttatctaccctttctcgtcacatacagtcagtcagctgtttgtcaaacctactttctattctcggttcaatcttagattcaaaattgtctatttctcttgtttcctttgaatattacttattcaatggaattgtaaatgttccttattataattagaattattttacgttgaattaggcaaggagcattgtttgtgtttatgattaaaattaacgagttttatataagttaataaatattatgcagaactttcaaacacacttatcctcaccctcgaaaaaacatacaatacacacacataagcacacgcatagacacgcacacacgcgcacatgcttacatacgcataaacacgcactgcatacatacgcatacacacacacacacacacacacacgcacacttacacatatacacatgcacacacaccccatgtgtgtaatttttacacatttttgagtaattccttcatttaatcattatttttcttaatttttgttaaattgtatcttctattccttaataatttacaaattgtgtcttctttctcttaattctgcatatttctacctaaaaatgacgttcccaaatgcttaataatttacaaattgtaacttccattgcttaattctgcatgcatgttcactccttaattatgcacttttctacctaaaaacgacatgctcgtgcattttttaaaattgtatcttctattccttactttttatcaaattttaccatcgatccgcttaataatatattttctttaatttagcaaatactatcttcgttagcttaattatgcattttctacgtaaaatcacattcccaaatgataaattattttcatattgtatcttccaatcattaattattcatgtattttattaaaacgtgaataaaatgacaaaattacacaatttgaggtataaaatagagaaataaaaggggtacatgtatgtgtacgtgtgtatggggtatatgtttatgcgtgtggaagagagatacaataaatggtgaacaaaatacaaaagggtacatatgtgtatgtgtgagagagatacaatgattggtgaagaaggtattacaatgtgtgctgacaaaatagttacaatgaatggtgaaaagacattataatgggtgagcaattacaaagtgtgtccaaaattgagaacattataatcggctcctacaatacccttcccaatataaggctgataacatttttgcatagagcttgatattacagatccaccatcacgaatattgggtctaataaagtttgggtatattacattaattggttcaatctctcctgtttgagcataacgtttgacttgctgtttttatatctaaagccttggttgttgatcacatcataattgagtgtcaatccacggagtttaagcacgtattccatttccgcatcatgtagaacatttatacgtcttaaagccaacgcatactattttgcaccagcagtgcagaattcttcgatttccatcaattaactgcttatagtgtcgatcttattcagctaaaaagcatcgcgtagatgtgagaaaacaagactatccgtgtcggtggagagtacttaacgccccggctatatcatcatttctgaatagttttattacccactttttttattttcgtaggtaatcaaaacatgatacacctttcaatcctcgatggccattacgtctattgaacgattatcccaaatattctccaaaatcgagtacatcattattgaagtaaagtctgttaaaggctgtaatttcgtaaagaaatatgtcgcacaaattgttcaagcatagtttaacaatcctactcttcttggttcacagctatctttgttgggttaagatctctaatttctctttgcactctcttacaaattcagcttccttctcaccatttccttttatgtcagtatcaattggtaaatgggtaaccttcttcaaccgtagtaacattaatttcgattgaaatgcagattgctcagccatctcattgtttgtgtttgcatatgtatttacgtctatcctgcctttttgattgtttttggtgcacttcataaataaagagaatcagagcctaccattcactttgacgggcaaaacagaatatctaattttctaaaggaatcacccaaactttgagtattgtcaaggggtagtgtttatcttccgggtatttaactcgacttattcattcagcacatgtacattggtttaccaatcgagtagtgtgtagtaaaattaacgaaggggtagagagaaatgaagtcacatagaaatttttcattccgtcttcaaatccgctcatttatttgttgctcattaacattttcgcgatctcgcagcctaatacacttacaactggatggacaacttgacttcgtataaattcataacgttttacattcctctcccgcactttatcagttatttttttcaattagacattaatatacatcttctaggtagcgctaattgcaggtatgctaaacatatccgcttacttctattgcagttctctctgtttccaactattcatccacagaataatgatcaatttgccaagtgttcagttgaaaagttattgatctagaaatatcgcaaacaggccttatactagtcatacattcctttagtacatcaatgggtactaaaagacgctgccttccttaataatgccttagttcctttgagacatcaaataattccctcctaaacgataccagcgctgtcattaaaattttcaatgtcattacattttttctcattaatcgcctctgtaaatacaaattttccagttgagaagatagttgtggtagaatttgtacctagacccttcattatatttgaaagatttatgtggttgtttttagtggatggggatattaaataaattgaggagaaaagttttactatttattgtcagtaacaccataaattgaatttaattttaggtataatttacttaattttaatcaatactattgtatttattatttttattatattttaatacaactttaatttaattttttaatttagttttatttatttttatttttatttaacatttattttcttttaattttaatcttatttttatttttattttactttttatttgaattaatttgaattttattttactttatttattattcagttaatttaaaggagttgttcataacctctatccaataaaggctatttcgccgatcagcacggcataaaaggtactttaaccgtgcaccgtttagcattgtatgatatcctcactattttcaatatttttacttgttttaattgtttatttctttgaaatttctattaatattttacttttgtagtgtttaatgcaatcaaagaacattttaacttgaaatttttaacaaaatgaacttaataaaatattagtagttaattattgtaaaatataatttattaataaataagtttaattcatttattaaaatctaaaaataatgataagaatatatgtatacttcatattatatatcattttattaattaatttttcaatataaaatttctttcttccatcattataatgtttttgcttagcaataagtaaaaaattccatatatgcacgctacccctctccgcctcccatctgatatgaaattcttaacgcttttttcttaattattattatttttttcatttatttccttatttttaactatcatcaccattattattattttactaaatttattttaatatttattttttctacaactcttcatctcttcattaggcttgggttatgatgacacaagtaccatttgccacccctccagtcgccacatgtcaccacacccctcaaataagttttgggttatacgaccaccatttggcaggttgccaactaaattgttcatgctatgccacactacactaaaatgagtcgccgtatgaccaacattttatgccatccacggtcagtcattagcgcttaaatgaccaccagtgggcgctcagatagcccatgcgggcgcttaggtgacacgtgcgagcgctcagatggcctggcatcccttccctccccaaaggccacgacagctgatgtccgtccctccaatacgatttgactttaataattatttaattaattaattttatattttttcatttatttttaaatttttatctattattttaattttattttaatttatttaatttacctaattttaatttattttattttatttttaatttaatttgaatttatttaatttaattttaattaatttattattattattatttatatttttgtgtggtattagagagagcaagagaaaagagagagagtgagagagaagagagaatgagagagagagagagagaaagaaaaaagagagagagtgagagagagagagagataagagagagaaagaaaaaagagagagagtgagagagagataagagagagtgagagagagagaaaagaaagaaagagagtgagagagagaaagaaaagagagagagagaaagagagagagataagagagagtgagagagaaagaaaagaaagaaagagagtgagagagagaaaaaaaagagagagagagaaagaaaagagagagagaaaagagagatataagagagagaaagaaaaaagaaagagagtgagagagagagagtgagataagagagaatgagagagagagagaaagaaaagagagagagagagaaaagagagatataagagagagaaagaaaaaagagagagagtgagagagagagataagagagagagtgagagagagaaagaaaagagagagagagagaaaagagagatataagagagagaaagaaaaaagagagagagtgagagagagagataagagagagagtgagagagagaaagaaaagaaagatagtgagagagagaatgaatcttagcttttttattcaattattttttaaattataaaaatttttttttaatttatttatttaatttatttataatttattatttaatttatttttaatttaatttattttttattaatcaataaaaaccttcaataggtttaggttcactcccgcacccatccaataggtttaggtttaaatcaataggttttagttttgggattgtttatttatttttatttttattatttatttatttttaatttaatttaattatttaaatttattattaatcaataaaaacccttcaatatttttacattcactcccacacccatccaataccctttaatttaaaccaatatactttaatttctaaccataattttccaacaactaaaatcacccttactaactacttataatcactttaaaatctccctcttcaaantaaataaaatctcaattcanttttcatacaaacctttttcatacnaccacaactttttacatataacttttttcttttccaaccaaatccaacattcttnttttcattcnatatccctatatatcctctattancctccaaaatttctaaaaatttcattaantttcaaaaaacttatttccataanaattcaaaaanccaaattttccaactttttt

SEQ ID NO: 1930 - DNA, 6191 bp, Heterodera glycines
  misc_feature (31)..(31): n is a, c, g, or t
  misc_feature (33)..(33): n is a, c, g, or t
  misc_feature (4493)..(4493): n is a, c, g, or t
acacctcccacccacgcctcccccctccccncnttccccttccatgggggctattgttttgaaatagatgtgattttgctctttttaagctccaaaactgactccattttcgcaatgtgttgcgcctccttcgccgttctgaaccttcgcaccgctttgacctcttcaatttcctgaaaaacaaaatttttcagcgttttcctcgcattttttggacatttgagacaaaaataaaaatttgtttaaaatggcaataactttatagaatcaatgaatttgttactttttgttaattccccaggttaacaaaggcaccgccacctcaacggttggccacagtttgctaatgtccacccctccgcgcagtccgtagcggccaaaccgttcgcccatcgcccacttttcgcgctcaaattcgtactccaacggtggcattccgccctcggcaattatgcggtgccgtgggctcaaagtgcaaaaggaagtggtggccaatcggcgaaactgacggggacagaaatatctgagcagagacggctccattctctgcaaaaaacaaacaatgatcatggcaaaaagaaaaaaacacttaaaacagaaaacataagaaatgggagaaaaaaaacaacaaatgaatagaatgggggcggcaagaaagggaaagtggagaacggcacagaacacggacgaacccaacaaaacaaaattcaaaagtttatttggcgaatcgtaacgcaacataacaaaattgccaattacgaattagatgtctgacttccagggattccttttttatgtaagaaaaatcgcgaaatatgtaaataaaatatgtataaaaaatgttaaaatatgtgtgaaatatgtacaaaaactcccaaatatgtacgaaaatatgtaaataaatttttttttaacggttactttttttggaaaaattcttcgtaaagggtgaaataggcataaaatgcaataaaaatgacccaaataggcctagaatcacattttagtactttaaaaattaatttttggtatctgtttttgaaaaaattgattttttagaggtatatttctcaaaaaaaatctaaatttctataaattctcaaaatatgaaaaaatgtacgaaaaattgctaaattttggattttttggggcatttaataaaaatttccttaaaaaatcttcaaaaattgcaaaatatgtacgaaaaaatggcgaaaagtccaaaatatgtataaaaatatgtacatatgtaatatgtagaaaaatcccaaaatatgtaaataaaagtcccgatttttgttcgcaaacacaaaaaagaaagtgtttttcctactaattaggctatggagaatccaggaaaaatatgtatttacataaaaaaggaatccctgctgacttcaatgaaaagcagaatcacgaatatcgcgattgtcagcggaatagttatagttccaattgatttaagacaattttgtcgaaaaaaagaatgtaaacgatttaattgtataattcgttcagcaaataaaagcatatgttttaacattttaacagtgatttttcgttgttccgttttctgtgttaattaatggcggagggcgacaaagcactaaaatttgttatttgtgagaaaacggcataaaatgcccttcccacccaatgtcatcgtcgtaagcacggaagacgagaacattgcgtccgctttgtcgcccctgctgcccattctcgccaagtgcttccctttcccattcggtccattgccgtgcatttctcccaatcgctgccctttccataagccaccaatcgtgcctaatgttacgcagtgccaactgctcacgggtcagcccattctccaactcaaacggcacaacgcgacaataccaccgggcgacaaggataaagccgaccgaagtggtggcattcagaaatgccttaaacggaaaagtgccaatatataagaccataaaactggcacatttctgacagttttaagtgcctccatcgaaaatgcccttcccaacgcgcatctgagcactttcgggtgaccatcggcttgcgctgtgtgcagccatttgcacaccgcttgtccatcggttgccccggggcgatcgtcgggcggaaattgggggaaaaggccataacaaatggaaatcaatcggagattggcacagtcgcgcagaatggagggcgaaagacgcgagcgcaaatagcccaaattgttgttgactttgaagcgcatttcgacgatggccgcggcattcaaaaggggccaaatcgaagaggcaaaagcgtcgcagctgcggccctcaaccgaggaaaagctcagttccaaagtgacgccgccatttgtgtggaaaaggcgccgaatgcgacggagaaaggcaatgacagtgccgtcgatgtaactgaaaagcgatgccaaaaaatatggcaatttgaatcaacggtagcggagagacccgaggccaatgcgtccgaatccgaccacgccgttcggcagcggcacttgcggaattggcagcagtcgtttcactgctgccgttcgaccttcgccgcccttttggttgtgaattgcggcgccgtttttcccccggcaaatccccaaatttccaattggccattttctgcttcggaaatgcgtgtccgcaagcacatcgaagcggtcagagaccaacgccaatgccaagccgactttggcaggtgccaacaggcggcaacagtccaacaaaatatcgtcgcaaatgcaactggaaaaccatgtgaattaccaattggcattgattgggtgtttattaaaagggctcacatttgcttaaaaatgcgtcgcggatggtccaccattccaatcaacttattatgtataatcaattagaaaataaaatgacaaaaactgtaattgaatatttgaagcattaaaaatgcggagaatcaaaaacagaagggggaaaagggcgaagaaatgattcatttattcatcatttttaagcgccaacgcaaatacacaaaataaaattctaacaataagcaaaaactgtttcaaatgcatattattattattattattacaccgacaaatgacaaaaggggcgaagagaaaagtgaacgaacgatcactgggaaaagcgaaaacaaaaataaacagaaaagggaaagaattgagatatgactttgttgaggaggggaaaatgaatgaacaaatgcattgctaccctgggtaattagtcattaattaggtaattaataattattcattgcgttgaaaatacaacaatcattttgcacccatttcgttgtgcctaatcaatgtccgtccacccttttcagtcgtccatgctgtctctgcggaccttaaattgcatttatggcattcaatggacaattaattaataattaattaggtacatgggtttttaaacaattaagacatttgaatttttaagtgagtctttttcgtcttaacctaccacggggacggggaagccgtgcttcatgtcgtgcgatggccaatcgtaggtttcgttgatcagttcgccatattcaaccgaataaatttgtgagcggatgaacatttccttgtccgtcggctccgggtacagcttggccgtgccgtcctgcataaatttaaattgtcctgttcccatatgaatgccataaagacggaaatgtaagtgtacccgctcccaatcgttaggccaacccggcataaattaaatgtgttaacccaaaatataattcgaaacgggcctggggccaaacaatgtgccaaattttatgtttttccacttttctttataaatctcgtggcatccctctccactgttattggtggacagtttgctaatgtcgtggctgcaaattaatgaatgtctcacccggtaacactcttccgcaactctcatggcgattctgatggaaatctcccgaatttctttgagccggggaaacacgcgaccatcggccaaactcttttcggtcaccgactcggcgaccatctgaaagtaagaatttttgggttttgggtacaatttttgaaaaatttccaaaaaacgccttcgactttctttacaaacagaaaaccgaatatattttcttgaataaaatgttcacccgtgcagccataaggaacagtttgttgtcaatggtggacactttgaacagaatgacgccgagggcaatgccggggaaaatgtacgcgttgttgccctggcccggtttgtacactttgccacccaattcgacatttttgaacggactgccggaggcgaacagcgcggtgcccttcacacaaaagagttaaatatatgttaaattgcattgcattgacacggtttttcaaatttgtttccgaacactttgacagacctccccctgggctagagaaattgccaaattcaaattgtaaaaaaatgtgccaccgacattggtcactcggtaggcgtcctccgccgtgcattccgcctttgctggtcgggttggacaacgcgaaaatgatcggntcgtgcgttgtgctcggccattgtgcgaatgacgtcgtcggtgaatgcgccacggaccgtcgaagcgcggatgagcgcgccgggccgaaccgacagaacgacctcaagcagagactgcgagtcgggcaaattcttggcgaacggcaaatgcctgtggggtgaaatgaaaagtgacggctcgcaaatacaacaaaatcggagggatgtgaaaggaaatggggacatcccatccaattatagttcgacatttgaaaaaaacatggaattggattccttttcggagttcgaaattcggacccgaacctggatttcttgtacaaaaatccaggcccaggaaaaacccatcgagttccctctgccaatgaattgaccttggctcaatgtttttgcgctgtgtggtgatcagtccgtcgatgtccatcatgtaaatttggccacacgcctcctcaaaggacagtccctcactttgcatctggcgaacgcacatttccgccacgcccaacgcggcctaaacagaagggcaaaattttattttttatatttcgattcgaatgggggacaacaactggacagcccggaccagctttttgagtacaactccttttttaagttgtccgaatttgtccggtggcgcttttttccctttgcggcgatttaaaaaaacgcactccgccggcaccgaagaaaacgtatttggtgtcgcgcattctcagcttggtcactcgtgtgcacgcgagcagtccggcgacgaccactgaggcggtgccttggatgtcgtcgttgaacctcaaaacgggggaacatcaaaaggagggggaggggggggggataattaaaaaaacaaattttaagaattttcatttttccagcggtataaaagggatttttagctataattttgagacttccagtactagcttaaaataacagataatgtgccgatcgttttttcaattgtaaaatgccatttgtccccaaaatgccgcacatgcaatattcgtcttggtatcgctcgagcaatcggtaggcgtttttattgccaaaatcctcgaattggaccagcacattctgtccgtatctgaaaaatgaatcaacggggaaaagacatatggaaaagttttttatgagtgtttcaagaaaaaataagttccattaaaaaatattttctatgtatattcttgcgaattggtaggcctaggaacgaaaatgtttaatgttagaaaaattcaagaaattgtttttttgtaaaatttcactttattttttttttaattcggagggggggggaaagcattgcaccccttcttaaacagacggactttttcctgcacgcattcatgaaattgtcgatcagttggtcgtactcctcgccacggacacggttcctccgcaacccaatgtaaaacgggctgaaaatgtgcaaaaaatatatttcaattgtaaaaactttgaaaatacatgttcactcgtaaccctgaaaattaaatgttcttcgaaaatttactcgttgagcaacgattggttgtccgtgccaacgtcgatttgcacgggcaaacaccagctgggctgaatgccggccaacgccacgtacagcgccattttgcccacggggatgccaatgccgtaacagcccaagtcgcccaggccgaggacgcgctcaccgtccgtcacgacaatcgcctttagaggggggggggg

SEQ ID NO: 1931 - DNA, 1227 bp, Heterodera glycines
atagtagcaagggttatgaaagctcgttttaaaatgccaaatgcgcactttgggtttctgtagatgagcccatacttttgacatgcgagcccaaccgtcggagtgtaactgaaaatgacaggcaattttattaaattgggagtaaattccacccgaactctcacacaattggcatcagttccttgaggttttcgcacagcacgcggtaaaagagcttctcatttcgatcctgcaatatttgggaatcatttaatcaatttttttaaaatttgattgacttttattccgtctcccttttctgttgtacacaattattccgtagaaaattctcaaacatttccaagacgacaccaattgatattaacaaattctaaggcattactaaaatttgaaaaatcctaaaagacgatgcaaccctaaagtttttttgtctccccgccaaaaaactactatgtttttagcccccccccccccctctgaccacctgcagtccgtccagctgaatgtagcgggccaagtcgtccggctgtttgcgcagtttggtgatcactcggtactcctgctgctcgctggtcataaaggcgggcggcaaaaggccgtggacacccaaatattggcgttcgtacaaagtgaatgccattccctggaaatcacaacttcaaaaaatgtttgtttctgaagggatttcgacattttcccggttccgtgactcttgggggattaatgccaccaaaaagtcttcaaatggaattgctccacaattttagcggttcacacaaataaacggcgttttgttgccctttaaatcgtcgggcaaaagaacggagaaagtgtctgttttgcgcttttttcctgcccccttcccacacactttgttcagccccgggtttttgagcaggtcgacgccccggacgctgggcgtcaagcgctccggacgatacaatttgtagagacgcagctgctccgggtctaaaccaagcattattatgtcattttataatattattgcaccactcaaaatatcacaaataaaatatcggatcaccattcaaatcccattctttgtgctggctcgccgataaagaaaaagctctacagtaaaagcggacatttgaaaatttaaaaaaaagtgccagcaccttgatgaattaccaagggaaataggacgaactgcaattcgatacattacgaggaaacagactaaaaaatctgaaaaagttaatcttt

SEQ ID NO: 1932 - DNA, 958 bp, Heterodera glycines
ttaataaaaacgaaaaattggcaaaagaaaatatttaatttttaaaaatgacaattttcttttatttggcataggtaattccaatctttaagaatgttatttatattttttatttttgttatcgagaaaatattcaaaaaattgttttatttgtgtcagccctcccataatacatggaaaaaaattcatgtgcaattttggactcctaatgatttgatcgtttgattgctagcgtgcatcgatcattttcttctcgcgttgatctattaaagatttcatcagctttttgtggctattgtgtaagcaacggtggttcagtggtagaatgctcgcctgccacgcgggcggcccgggttcgattcccggccgttgcaatttctttttgctttcattttacaattttttgttgtctaattacccccccccccccttcttttctatgcaataatctcaaaaattctttttttttgagcttctttgggttgggtttttaagaggcaattaattcaatgagaatttttctagcaccaatccctaaaaagttacagacccggtactgaaattgccaaatacctttgggactggaccgtcctataaagaaaacgattcttctcggtctgtaaatgatgaattcgagagaatttttgtgtaaaaagtttacaaaagctattggttctcaaaaacgtttaacacttttttaaaccggttcagtcagaagaaaaattggaaaaaacccgccaaaaaaaaaatttaatttaaaatataatttttttgcattatgtagtttataattttaaaaaatttatttattttctgtgttttttgttgttcaattttcgtttcgcttgccaatgaaagggcaaaggcgcggcagcggaggaactgagccgagtgagggcggaagcatcgacaaaaatgggacggcgacggcgccgttttgtcctaacgcgcaatttgt

SEQ ID NO: 1933 - DNA, 3788 bp, Heterodera glycines
  misc_feature (3433)..(3433): n is a, c, g, or t
  misc_feature (3437)..(3437): n is a, c, g, or t
  misc_feature (3441)..(3441): n is a, c, g, or t
  misc_feature (3443)..(3444): n is a, c, g, or t
  misc_feature (3465)..(3465): n is a, c, g, or t
  misc_feature (3484)..(3484): n is a, c, g, or t
  misc_feature (3500)..(3500): n is a, c, g, or t
  misc_feature (3506)..(3507): n is a, c, g, or t
  misc_feature (3510)..(3510): n is a, c, g, or t
  misc_feature (3516)..(3518): n is a, c, g, or t
  misc_feature (3525)..(3525): n is a, c, g, or t
  misc_feature (3527)..(3527): n is a, c, g, or t
  misc_feature (3529)..(3530): n is a, c, g, or t
  misc_feature (3536)..(3536): n is a, c, g, or t
  misc_feature (3539)..(3539): n is a, c, g, or t
  misc_feature (3547)..(3547): n is a, c, g, or t
  misc_feature (3554)..(3554): n is a, c, g, or t
  misc_feature (3557)..(3557): n is a, c, g, or t
  misc_feature (3560)..(3560): n is a, c, g, or t
  misc_feature (3580)..(3580): n is a, c, g, or t
  misc_feature (3583)..(3583): n is a, c, g, or t
  misc_feature (3591)..(3591): n is a, c, g, or t
  misc_feature (3597)..(3598): n is a, c, g, or t
  misc_feature (3602)..(3602): n is a, c, g, or t
  misc_feature (3605)..(3605): n is a, c, g, or t
  misc_feature (3611)..(3612): n is a, c, g, or t
  misc_feature (3616)..(3616): n is a, c, g, or t
  misc_feature (3625)..(3627): n is a, c, g, or t
  misc_feature (3632)..(3632): n is a, c, g, or t
  misc_feature (3650)..(3650): n is a, c, g, or t
  misc_feature (3664)..(3665): n is a, c, g, or t
  misc_feature (3668)..(3668): n is a, c, g, or t
  misc_feature (3730)..(3730): n is a, c, g, or t
  misc_feature (3736)..(3736): n is a, c, g, or t
  misc_feature (3763)..(3763): n is a, c, g, or t
  misc_feature (3779)..(3779): n is a, c, g, or t
ttacaattcgacgatttctgaaccaaaaattaaatggaaaatttcgtggcctccaaatttatgtccgcaaaaaaaaataagaatttgaaaaagtgctcataatcgccaagtcttgctctgtgatctttttttaaactttgccaaagtggaaataaaaaactattttcttctgattcccattttccacagattgtaatgcgtgcattgggcttagaaccgcgtcaggtggggaaacaaacaaagattttgccaattttcatttccttttaaattaaaaattttattttggctcagtttcaggccgaagttgacgaagtgacgcgaaaactgttgcaaaatgcgacggaacgacaggcgaacccaggcaaattttagaaattagccaatttccattcggtgatttgtgagaattaggcaaatttcgcgccacaaaatgcgatctgtttagattcgttcacggcttcggaattggccgatcttttggccgatcggctgaaggacagcgcggcggacggaggcgacagcgaattgcgcagtgtttttcgactgttcgacaccgacgcaaaagtaatttcagtgccgcttcgaatcactgaatttctctccatttattcccgggttttgctctttagggtttcatttcggtcgccgatttgcggcgggtggccgaagaattgggcgaacgtatcagtgaggaggagctgaaggtagaaaggacggggaacggacgcattttcgggaagggaccgccggagccgatttctaaacaccggaggcactttgggaatgggtaaccaatggcatttgaaaaaacggggataaaaaaaattatgtccccaaattactcatttcgttttgccaggaaatggtctccgtcgctgcgtcctcttcctcccccgttgggtccgaccgcgtctcagagaccgaattccgggccattatgaagaaaatatcgctttactaacggtggccacgggcggacgaacgaaagaattctcatcccttcccgatgatctctttttgcattattgtccccaatttttgacactttcctatatgaattaagaaagatacgaattttatggcccacacaaaattcgggcggtgcgccatggctgttcgggattacccttaaatccgacccgtactttgtgtgcgccttttaaaataaacccattcattgggagtgggatggagcagaggtcacactgtcttcattaccattttgcactataggcacaacaaaagaaacaaaaaacaaagaaatgagatggcctttatcacaatggctgggatttcgtcctctcgttgatcccttttttgttatttgcttatccttccatgtgctccttcgcgtcttgccaattaagtggcctcgagtcgggcgtaggcaccaaattgaccttttagggaaaggcattagggtaaacgcataaaaaggatatggacaaaagccgaaaagcgggccagtgttaattagtcatccaaatactaattgtaaaacctaaatttttggcctagcttatgtacgagttgccaggctatggattttcttgtccccattatttctggttacggttaattcttacgtagggagccacaaattttgtctgaactcgataaaatttttttttaataagaaaattcaaaaacattgttactaatataaaatttttcaaaaaatcattgaaaactttttaatgcaacccgacaaggcattcattccaccgtcccccattctcacctcgtatttgactgtgtttttgacgggcacaagtcgtaccgacacaatgctcatcatgcgcaccgtttgccgctgttcctcctcgctgctgctcacccacgtgggcacgtccaactgcgcgtccggcgcaattacggcgccctcctggtcgccaatctctgctggaagttcgtccacctgtgacatggcgagggagaaggagtgtaatgtgcgaaaatgcccttttaccgggaaaacgccctcaaaaaaacccgggaaatttcacgaattagaaatcgtcgtaataatcgaacctccattcggtcgtcctcctcctcttcttcttcgtcgttgtccgcttggtcctcgttcccattttccattgcttctgttgcgtctccgcctttgtttttgccactgtccgtctccgtcccgtcgttgtcattcgccagcagcagcaccaaagtgagcggtccttcactgtccaacttgccgtagtaagtgcgcaccaccgccttttgccgctttaagaaaagaaaacacggtcggatgaattgtccatcttggcaagggcaagccggggcgactgattgagagcgggctttataaccccattttcaaaaaaccgaaattttaacggaaaaagagggttaccaccaacattttatgggaattatccgagtttgtacaccaaatggtccggaggaaagatgtgtaagcaagcaccttcaaataaacgcgtttgatgattgcgtatttgagcaacagcacatcaaagcagccgtcataaatgcccatcacaatgccaagcgcttcgaaatggccctcggagccctgaaaatgccacacttttggcattaaatctatttccattccgtttttcttcacgcacccgcacaatggcgccgaagaaaatttcgccgctcaattcgctgcacactttggcgcccgttttggtgctgttggcacggcccgcgattttgtccacttgttccgtggaatagtcgggcgacgcggcgtagccgaggcaggcggccaacaatcggtggacgaccacgtcggggtaacgacgaatgggcgacgtgaaatgtgtgtaactgaacagagaaatggtggcatttttgaagaggtattggcacaaaaacaaaattttaagggggaggggggtaaacccatcaatggctatgtcttcgggtttgtccgtaagaaacccaattttccatgttaaactaccgaacttacaaatcgacgctgagtgcgtagtgccgaaactcgcgctccgactccaccagaccggtgcaaaagtactgggccaagtgcatgcacttcatcagcatttggttcagcgccggaatcacgccgtacctgtgacagaaagcaggtataaaactaatgaattgggtgcatatttggtaattttctcgccctgtccttgaaaaagtgcactcccaagattcatcagtctcccatttactccatgcccggatcttataatttattcacctgtactcctcccggtgctcgtacactttcaacgagtcggccaacgttttggagctaattgaattgattttgatgccgaggagggcgcatttgtccaccttaattgaacgaatattggcaaatgttctccgactttttgtaggtttcctctaccaaattcttcatttccctcttcttcggcggaggatgccgacgcagcagtgccgntttnttgntnncggcgtgtttttttcgtgccncgcgcgttttggcgctgtnttggccttttgcgttnttcttnncgnggggtnnngcctttntntnncgctcngcnccgtgtcntcttccnccngcnagttggcccctttgcgctgntcnctgtgtgntgccgnntggnttnttgggnnttgnggttgtcgnnnctgtntgttggtgttccctcttngccttttgtgtttnnttntgtgccttcttcgtcccgtcgtgtgccgcgcggttgccccttgccggtgctcgtcttctccncgtctnggcgctgtttgggcggttcccgcttcngtgctcctttgcctcncctgttttt

SEQ ID NO: 1934 - DNA, 1769 bp, Heterodera glycines
  misc_feature (858)..(858): n is a, c, g, or t
  misc_feature (1763)..(1763): n is a, c, g, or t
tgacagaaagcaggtataaaactcatgaattgggtgatatttggtaattttctcgcccagttccttgaaaagtgcactcccaagattcatcagtctcccatttactccatgcccgaatcttataatttattcacctgtactcctcccggtgctcgtacactttcaacgagtcggccaacgttttggagctaattgaattgattttgatgccgaggagggcgcatttgtccaccttaattgaacgaatattggcaaatgttctccgactttttgtaggtttcctctaccaaattcttcatttccctcttcttcggcggaggatgccgacgcagcagtgccgatttattgaaaaaggcgtgtattttacgtgccacgcacatattggcactgaaatggcatttagcgaaattcaaaaagaggggaaaagcatttataaaacgcacagcaacatgaactcttccaccagaaagttggcacctttgcgctgaaaaatgagtaatgaagaatggattattgggaattgagattgtcgaaaatgaatattggtgttccctcaaagcaatttgagttaaaaaatgtgccaacttcgtccagtcgaatgccgcgcggttgccaaatgccggtgctcgacttctccacgtcaaagcgcagtttgggcaattccaacttcagtgctcctttgccaaacctattttttgtaaaaatggaataaattttgcaaaaaatgcaattaaatggatttgaaagagccaaaaattattattttttgtacataagccacatttagcaataagtaattggcttaagcctaccgttttgtcttcaatttgcgcgcaattaagtccaaattgcgcaccnccctgtttgatgtcacgaattttgcggtcacaatgaatgggcggcatttcggcgatggcgaattgtttcttcggattgtcgatgatgtcctggggaaaattatttcattgtaagtggaatggaatcaaacatttagacagacgggaagaggcaactttttggtttttgaaatcgcccttccctcaaaagcaaaacagagggtcgagactctcggggttgtccccaccgccccccttctttttgtaccgacttgggcatgttcgtaggccaatttggcacacgaacggatgacggaacggcaaaattcggtctccaaaatgttggcatcgttgtccatgtgccacacgacggaaaaggtcagccgatcaacgccagggttcagcgagcagagttcttcacaaagaattcggggcaacatcggaatcacctttaatagggaggaggagggaaattgaaggaaaacacggcaaagttatcccaaaaccagaaattgccgagaacgagaaatggcttttcgatcatttctaccaaaaataagaattccctcattttcaaaaattccccctcccctctggcccatcatttatttgtccttccatttcaaaattgactcgctccaggaacagtctcaggtaggattaacgggggttggggaagagtgacgaggaaaaagttgttttttttcgcaatttttcgggagtttttgtccttttcaaataaatttcatcccccttgggggtgtgaccgtctccaaacttccgcccccctttgcccacctgatgcaccaaatacacactggtgccccgcttgcacgcccaatcgtccagttcggtgcccttttgcagaaagtaggacacgtccgcgatgtagagagccacttcccaacattcggtgccgtcctcccngggtga

SEQ ID NO: 1935 - DNA, 8471 bp, Heterodera glycines
ctacgaggcattgctgataccgattagaatcatggaaatgggcctgatattgaaccccttttagtattgggacgaattactccccccccccctcattttcgctaaaagttaaaaaaaaaaattttttttgtagagtgttattattagtcaaggggtcggttgcttcatctccttgtcctttgtttcttcgtagttgtgtcataattggtgaaacgaaggtgaaggcatgattttctaagaaaattggaaattttcaaaacaaaaaaatttttcatggcattgtttaacaacgaaaacctcttcgtccttggtttgtgaaatatttttttccacatcgttcagttgtctgtcatgttgaacagtgcgcacaagttggagctggaggcgctctgtgccatttcggccaattatttgagcaccgtttatctggacaacaaattaatgccgctgaatgtcgccgtcgcttacccacacaactgtcaattcaacaacaacggtgatcaacaacagcaacagaaccatcaaaaagacttctcagaagacagcgattggagtgataataacggtgatcaacaacagcaacagaaccatcaaaaagacttctcagaagacagcgattggagtgataataacgacgacgaagacgatgattttggaagtgattggtcgtgattgtctattttcttttattattcctgtgattttttaattggtaaatttatataaattatgctttctttattttatttttttcatccgtcccattcatggcacatttctccacaacaattattgctttttcaattattttttgctttttatgtaaaattttgccatttattttattgtactcttctttttttgtgtgctattgatttcaaatgtcacgtgtgtttgccacacaaagtcgctttctgcggcacattttgccggatggacaacaacaacagcaggaagatggtgatgatgatgttggctgccagcggatagaggaaggaatgtgcggcaccggtgggactccgctggcgaacatcgaccagcaacagccttttgcctggcgcaaaattggtacgctgtccaaaaaactggcagtggataagttccgctaattggggcctatttcagttccaaaaatgctatttttttcataatgacccatttaataaatttgaatgcattttcggcttttttatagtttaaacgacaccacaatttaatacttcgcaacttttttatagaatcacccaaatcaatcatttctgatctccattttcagtagttcggagtaatccgttgagcggtggcgactgttcgtccggttcggccagcattgacatgggcaacacccgggtgatgtgcacagtgtacgtaattgtcactaattatcaaaaaaaaacttggaaaatttactttttattgcacggatcggtgggggagaaaaatgcgattggcctagcataaaccagctccacttttgcaggaatgggccgcgtgaactgcagcaacagtcggtgtccagctcggcggacgcggccgcctccatggaggagggtgtgctgtgcgtcacactgcgcggctgtgacattgacgcatcgctgcgctacagtgtcgagcgcgcactgcaggcggcggtctgtctgcgcaaattggcacgggtcagtggcccggcatcaaattttgtgacaaaattcatcaattttttgggtgaatttttatagaaattgtccccctataatttagaccgaaactgcgattgagctgaatgtgctgtcggatgatggcggcgcatttgccgcctgtttggtcgccgccggtgtcgcaattgcgtcggctaacattgaaatgtaataattcccaatacttcttcgacatttacgaatccggaatagttccccctccccctcgaccatcctattcagaaaaccatttgttttatgtgccaggatggaattcaaacgcccaaaaatttttctggattttctgaaatccgatgctccaaatttttaagtttcaccggaattacgaccctaaaaatgttggaaaatctatttcatctctgataaggatagcaaaatccacaaatcttgggacactatcaagttgaatatgtttattaatcaaatctttttaaaggctcgacgttctgttggcttgtaatgtgttgctgattccgtccaattcgttgacggcaccgcttcgaattgtgttcgacccggacaaggccacaattgctgcacacgttggcaaagcatccgccctaacaatgggcgtcataccaaccattggccaggcaaataattcaatttttggcatttttaaaaattgtttttgtacgaaatatcgattaaaatcatttgcgggcacgcgggtttgaaccaccactgtttgtggtgtagtggtctatactctgggttcctcgttgtgccagcgtgggttcgagttcgcgtgtctgccaatgatttattttttgctcgtctaatggatccaaataccggattcctaattagacaaaattaatgcgaatttgtgattgatatgttaatcccatctaaaaaaaatttctgttttaatccaaaaaagaataccccccaaagaaaaggaatatgaattttatcgtctacattcgattacagccatcccagccattttataaatataaatttcgtccttttccacaggtggtctgtgccgaactgagtggcgacgcgtgtccgttgcccgcccatcagttgcgcggtgcgctttccgacgtgtacgagcactgtttgacactgtacggcacagtgcgagcggcactgttaaaaagcgtcaccgagggggcactttgacgggcaaaataaaaatcactttgttgttgttttttgtttttgtatattttttcttttattatctgttatttttgacatggaattccgacaaaactcattgacggatctcgtcgaataaaaataaaatgttggcgattggcacagccaccaaataaattttgtgtggcatttgtcgttgaacattcaattaattacctaattatttatttattttgttgtgtccattacatttctgtttgttatttgtttgtatattatacattgaaattgcgatggacactttgtttgacgtgcgaaacaacttttatttgggcgctttccaacaatgcatcaacgaagcacaggtttttgttttataatggggggaaaaggccgatttatagggaccgaaaaacgaaaaaatggtgttggaatgtgcaaaaaattggtcacaaaaatgtgttccttgtgacccatgttttaaattcagtaattcatatggtaaagtgcaatatcctgtcccgccctcttttttcactcaaatttgatgaaaatcattcattttaaactcatttttggttgcatggtttacatttttttacaaaagtatgattttacacttcagaaggtcaaatgcaagtcggaagaggagaaggagctcaaggacgcgttcatgtaccgcgcttacattggcctgaacaaatgttccgtgccgttgggcgaaattgacgccaccgatggcaatgggtcggccgcccttatggcaatccgacggttcgccacgtttatgagcggtgcgccggagaagaggtcgtttagggaattaagtggggttttccaattgtttagtaaggggtccgtcccctgttttttttttttttggatttccgtttcaattgtggcattttaatttaggtcagagattgttgaccaggtggccaaagaatttgaaacgaaaaagtacgctgacaacgaaatttgcctgctgatcagcacactcattttcatgcacggagaagtacggttttcaaaaaatagggttccgactttcgactcgtttgcgccatatttctgtcgatttctttacgttttatctaacaagcagcaccaatttttgaaaaatcaattctcgactcgaaagtctcgaacctaattgcactctcgagcagtactcaatagacacaaaagcaaaggtaaaattgtcaattccgtcacagaaaattgaggaggcattgcgcgtgctgaaccgcacggcgtccgattcgttggagtgcgccgcgttgcgcgtccaatgtttgctgaagctgaacaggggcgacctggcggccaaggaggtgaagcgaatgcaggagatggacgaggatgccaccatcacgcagttggctcaggcgtggctgaacatggccatggcgagtgaccaccggggaaagggcggggcaaaaatggatcactttttttgtaaattaagtgatcgaagtggtaggatttaatggggttaggtggtccggtatcattgtaaataccataattcggtatgaaatgtgtactaccgagaaaaggaaatttcaacaacaaaaaaaaaatggaaaaattttctaacgcttttacagggtcgtgacaagctgaaggacgccttctacatttaccaggaaatgttggacaaatacggggccaccccactgctgctcacttcgcaggccgcctgtctgatcatgcaacaaaaatatgaggaggcggagaaattgctcttggtactacaaaaaaaaaaacactgaattttaactcaaacttgtcgagaaatttcgcaaatttttacataagcccacaaaattagcaattttaaatttgttctaggaaattttctaattaatagacaattgaaatttttacaacacgacagagtgcccaggagcgtgacccgaacaacgctgatgtgcttgtcggtctgtttgtggttgcacaatttcttggcaaaccgatggaggtgagttgaacccaccttccaggaagggattgatcagaaaaaccaaaggactaatttaataaaggggtcaggcggaagttggtggatgggagagcaagcagttcaagcatttaatcaatatttcaataagcgatcgttttttttttgaaaaaaaccatttttataattttttgacacctcgtccgtcgtcaaggtgtccaaccggtacatgaaccagctgaagcaggaccatcccgcacatgcgtggaccaaagaaatgttggcaaaggagacggagttcgaccgtttggccgtcgcgtgaaacatcgccatgggataattggaggatttttatatatccgtcaaaatggtagtataattgttatttttcgctgcggaaattacactttttttgccttccttcgaattaagcaattccccctaattaaccgttaattactactaatcgatggttttgtagagttcgggacattgacaaacggcaattgctgtcccatcattcatttactaattgtgatcggttttaacaaaattttttgaagataatttaatccatctgttttatacataattctgacacatacacaatttgttatttgcgtctcttctgtgtgcagttaatgaacgaaaaaaaggaataaaaaatataaagaaatttttgtttttaaataagcaataatttgtgtgtacaagtagtggaaacaaaccgaagtttaaagtcaatgattttgcgacagaacagataaaatatatcggacattcatttgcgacgcatttaatgaatgaacacggattagttaagaagatagaataatacaataggattttaatgtgtttgtattggtcataattatctactgatcgcgatcattaaatgaaatgatcagatcatttatgaaattgcacttaaagcggattacaaacacattaaattcagcaggaggaggagacaataaatatgtgtgtgatggtatttctttatgaaaatatatagcccgtgttatgtgtatgttggtcgtctccaaataataatgctcacggtttttttttttgatgagtgatggatgatgtcacaaacaaaacggacgaggaagaggaggggaaggagtgggagcagttcaacgaaccgctcggccaagtcaaatagaatagttttttgatgggccgatcattaaacacgcgctaattgatgtccaacggtgccggcatcgggttgggcaccaacgaggtgaagaaggactgcacaaccgtgaagaacacgttccatgcgctgggctggtgcggaacactggcgctggcggtcgatgttgtgtcctccgcttcagtcgccgccggtggtccgtccgcttccgtgttgttgtcatttggccgttgattttgttgcggaagcgcatgctgtggtggcaacacattggcaatggcaccattttcgtgtgccgcagcggcgttgtcccgctgctgctgttggttccgccgacggtggacaaaccaaaagaacgccacaacagcgaggacgaggaagaaactgcaaaatttttggaatgaaattatgggagtgagtgagaagaagagggggttaactgtgatgaaagagtcttaggcatgtgccatgaacaaataatgttggctttccaatacggcacataattttgagtattttacgaccggcttgggttcagttaagactagacatgtgtgacgaagcaaaacttgggaacatttcgctagccccccccccccgtttcttccgtatttataagaaattaaaagaaaaatttgtccaagaaatcgttgaaaatttttttcgttggccgtttgaaaatcgggctaaacgttttcccccaccctactatcaagttggtaccaccaaagcactactgtattgcatagcaaacactcaccgttccagtgacgcgtacacgtacaggaccatggccaacagtgcgaagcgcaccgacttgtacacaatgtccaacaaatccgcaccggcacctgccgcggccgccgcttcgccaacaccgccgccgcccaccattcgttgctgctgctgttgttgctgcaccatggccggtgcttcgtcagcgcgttgttgctgttgctgatgttggtgttgctggtgcggtacagccatcatcatcatgttgttgtggttttgttgggcctgaccaaaatgcggtggtggtggaaccattggcgtggcaaacagttgctggtggtggtggtgctgcacggttggtggcatttgtccgccaaaaaatgcgtaggcctaaaaagaggaatgcaaaagctcattgaaatgttgctaaataggaaagtttaaaagggtttgacattttgaaaaaggcctgaagctggacaaaaatccatgcatcaggaaaaaccaaggttacgatcagaaaagggaggggtggggggattgtcgcccaggccaaacctgttgctgctgttgtgccatatgtgcagcagaagtatagggctgctgttggtagaactgtgccgccgccatttggttcatgctaaagaacgaatattatttttgtttcgtaatggccaaatcgccaccaaacaaaaaaaattttttttttttttttttgcaaaatttaccccctgcaaactcactaattctgataggcgctcatccatgcctcgtaactttgctgctgtggcgggtggaaagtggcaaaatattgctgctgcaaaggcacattcgacgacgaattcggttgaccaccaccactaaaaagacggggagagtgaaaaagaagccaaattatgtaagtaaaagccctaagttttttgaaaaaattccatacttcaacagggacttgtggtgcttttttgtggattttccagaaaaatttcactcaattttttagtgaagagtgtcttggagggggtaacaaaaaaaaatattttttttttgatttttgtaggtgggttggttctgctcacccatggagttgaaattcaggcattttgggaccacagggttaagtttcaccagaaattttttttccatgtcttaaattccgcacttgttggtgccacggtggcgaagcccttcactggtcgcggcatttgcggttggggcgcccgcattgttttcccgtgacggggttgtgttggtcccagcggttgttgacgaactctttgcaccaatgcaaaccatgtggatcacctaatttgaggggatggattaggataattagctaattaatactactaaaattgctaatttaggtaattagcactagtaaaaatgctagtttttgcgtttagaatttcatttttgaacagttttgtattcgagatggaccatcaaaaattcacaccaccccatttttttttttgccttggactgaatgaatgacgtgtcatttacaataatttcgtgatttcgttccaataaataatcagttaaaaattaaccggattaatcagtccctttgataacagtatgtacatttgttgtgttttttttgagtagaactagacattttgaaaaaaagcctgacaatgaacctggcttcaatgttggacctggatttcctggataaaaatccaggcttgtcatggcctggaccttgatttttttttttgaatttgtttaaaaagcaattaacaaatatttgataaagtcaacgaattgcttaggaacatcaaaaaatgtcggtactttt

SEQ ID NO: 1936 - DNA, 4905 bp, Heterodera glycines
  misc_feature (22)..(22): n is a, c, g, or t
  misc_feature (164)..(164): n is a, c, g, or t
aaatgtttttattaatttcctntaaattggaataaattattggtcacatgaaataacaaactatataaaatactatccaagaaatgctggacaaaaatgcaggtccaagaagaattttaggttgccgaaacaatcagataggaaaatcataaaaaaacaatttntaataataaaaagattgacaacacacaatgtgagctaacaataagtttttttgagcggcgaacggccttgaacatgacaaattgactaccatttatttctaactcaataaattaaaagtgtttgttgcacaattctcccccacgtgccgtcccattaaattgttgcgaaaccccaaaaaaagaggagggacactccaaccccgcccaatttggcacggtttgccatgccaaactaactaattttggcagattttcaaatttctcccctccccagaccttccaaaccaatgatgattaatgcgtcacctgtttctccgcaacttcgttgcgcacaattccgtcccggcgttgggccaacacttcgcgcaccttttgctcattgtccaaacaacggcccgcgtaaatcaaacgttggcgcgacgggtcgggctttgtgacgcattcctcggccaaatgagttttcagttggagcacactgaaattggtgtgatcaattagcatcaataattttggcacagtgttttatcttccggggcatttcccaaagactttttttggtcacagattttcatttttttttgtctgtttttaaaagttctgaacagtgaaaaacaggtttattcatgatgaacaaagttgaaaatcctaattttgtggggaaaaaaactcaaaaatttggacatgaatttacttccaatcagccggacattcaagagtgtggtcgggaaatgattgcatggcgcaacgaatggtcaattgaaaagttgcggcggtgccatcaattgtcgacattattttgctcggatagtattaatactgtgtctttatctcttaagattggattaatgaaatccgttaagtcattgaaatgaatgcatttactaaaactgacaaaatttgtcagaaataccatcacaaatgtcgtatatttcttaaaatagagccctcgggggctttatttttcaatccttcaaaaaatggagggggggggggctttattgcaggggagagaggctctaatttagggggggggcagtattttaattttattttaggactcgttaatcgcaaactcacaaattttgctgcactccttttatactattattacacttttcctgtacaaaacggtggatcattttgggtgtattaaagtattaattgcccggggtgttgatcagttttttgatcatttttaaacacaaatgaatgggggcggggggcagggaaatgcgacactttttggtcagcggtcggtttaataaaaactgacactgacagtaatcagtggctgacagtttgacagtccgtcagcctcccctctcttctttccttccttccgccacggttggtcggttctcctccctatttttgtaccctgtattttgggacggaaaaaacaaacaaaaaaaaatttctccacccctctcctaaagtattgatgaccttgaacagcaaagaatgcggacggacggaaaggtgggggggggggagccatgacatgaacaacaaaagattgattgaatggacagcttgaacaggtggttgctctggttggctgactgactggctgttgttgaacagaaccagccccgttttcaatgaccgggaaacacacaaaaacaaataaatacataaattaatttccgtctttaattttatgtatatgttttttattcgatgggtagcgatgaaatggatgaaaacgggagggagagacgaccatttgacgaaatagtgcaacgtatgcacacgaatagaaagaaaccaccacaaaatgggaggagggaggggaatgaatgaaaattatgtgtatgtgtagagctgacgtgttggaagaataagcattaagtgaagggaagggagggaaaattggtggaaggaatgaaaacagtgggaaaagcaatcgcagaaactcacaatcaaatcatttatttgtcagcagccgaaggaggagggtaatccaacgctgacgtggcgctgattgtgcctctattagtatttctttgctggtgctgtgattgattatcccagggcaaattgatttcagataatattgtcgtcatgtcatgtcatgcacacaaaattgaaaatttgtaaccctaagctatgagtcatcgcaaaaaaatttttttgggctttttttgattttccgtgtaagtgtaacaaatgttaaataaacgacgactactaatttggaaatgattatgattacgttgcattaggcaattaaagagttttagcaattgaaaatgcaggattaactaattgtttgttggatgaatttttcattatgtaattaaattttggtgtcaaacattttttgagttttcggtttacaaatttcacaaaatctcatttgtttcagtgtttcaaagtggtgacagatttaaaaattctggatgaagatgcaaccgaactaagattaggatatatatacatacagaattaaatctatttgcttaaattttaatcaaaattctggatcagaaatcctagtaaatccgttccatcttttctctgtctgtgatatctttagtttcaactttcaacccaaataaaacatatttattcttttgatttcatatgcattttaatcaaaatcgcatttctattctattccattgcaggaattaaaacactacttcattttgttttaaaaatctgtcaattttctccaaaaaatgggcgattttggcgagtggtatcgttccattccgttaatcaccagatattggttcaccggatcaacagtgatcccattgttgggccgactgggcattttccagtgagtttttgttttcgttttattacttttaatttgcatttttcttttcagtccgtatttgatgttgctcagttgggagctgttcttctacaaattgcaggtgattgtcaaaatttgataaaatcatttggcgatgggtcaggcaaggggtcggacagattgaaaaatgagtcccattttgcgattgaattttataaatatttttcattcaaatgcctctataatctggccatccattcagaaggagtttttcactttttcattaaaaacttatggccatcgaggggggggggggcataattttctttaaatatccccggaaaatgggatttttccaggaattccggtcccgttcatttcaaattctgattttgtgattttgaaaaaatcgtgtccatggctgctttagcaagacaaaaatcccatttacttttcccagtctggtcccctcccattgcctaaaaaatggacaaattccctggtccgattctcgcttttcccagttttgactcctgtttttaaaactcaaaatccaaagattgttttacatttgccccctgccaatctctccccatcttttcagttatggcgtcctctcagcgcactgttctactacccggtcaccccacagacgggcttccactggatgttgatgtgttatttcctgtacaattactctaaagatttggagaccagtcaatttgatggacggccagccgactttttgtttatgctgattttcaattggatttgttgcacggtttgtgaaacaatttttgtgtaaagcagagcacccgccaatttgggtgtctaaaaatgacaatttagaaaccggaattaccggaaattcgttagcctttacaaaaaaccatgacatattttttgggtttttttggtacactaaattacgatattttttcaaaatacggcgtttcaattccgtccatccgtttcaattggccttttttcaacctaaaaacaaatttttttttttttttgcgtcgaatcaaaattgattttaaagaggcattttataaatgtagtcatctttcacagattgtgtgtttcgttgccgaaatttacttcttgctcgaaccgatggtgctcagtgttctgtacgtgtggtgtcagttcaacaaggaccggactgttcagttttggttcggcatgcagttcaaggtttgcacagtggacggtccaaagtttttttggccatttaagagtggattttgatgtcatgaaattgtgccggttcatgagtcaatttaagactttgccgaatttgtttcatgagtcgaaattgatcggaatagatgccgaattcgttcgacgacctcaaaactcctccccatccccgagtttcacgacttaaaattaccgtagaattttttaagctgaaatttctccaaaaatggcaaaagcaaacaaaaaaatctaaacgattgatacttgtaacccgtaccataatcaatcaaaacccatttaggccatctatttgccatggattctggtcgcgttcagcatggtgttgcgtggtggcggaatcaacgaattggttggcattcttgtcggccacacctactacttcctggcattccaatacgcacttgactatggtggctcggtgctgttgcggacaccgcaattcttgtaatatttttacatcaattttttttattacgaaaaacgaaatttcagagggggtgacaaaactcggaaataccaaatttttgtaccagtccattttttggggttttttttctttcattttcgaaaaattagttttgcgagctgttcacacatggtttcgcccccatccccccgaataactaaaaaaaattttgaaatttatctaccgggttttttaaacttttatgattaattgaaacattcgtcatacacactgtcttctatctgtcttacaattacccatttctccccaggtatgacctg

SEQ ID NO: 1937 - DNA, 9685 bp, Heterodera glycines
aataaaagaatacattttttattaataattatacacttttaatatttttatataaaagaaaaaaactcactctctcctcattgatcgaaatttcataataaaaaatgtcagacgaattaatgctcagctgcaaaatcggatgttcagcaaacacggaacaccagccttttgcgggaaaattttggagattcttgtgacaagcattggcatcccaataattttgtccgaaatttaaaatagccttaaaataaaatttttttaaataaaattgcttaaatacaaaaataaggaagatattaaaaaatatatattttggtaaatattgttcatatgtatagtcagagtcgaacacgaactataatatgctatgaaaagggctcaaaaatagcatttcacgttaattttcgatttggtgaagatttgaaattattttttgaaacataaaatttattcgtttttcctttttcccttatttagctttcttttcagcttccgtctttctccagttcagtgattttttccaaaatttttgaaaattgatccgcagcagctaaaaattaaatagtttgtaaattaaatgcaaatatttaaatatttaatttcccctcgccttttgactgttctttttgctgcttttccaattcgctgattttttccaagagtttcttctgatcattttctagttgtgagcgcttttcctcgtcagcttaaaatatatcaattaaaatcttaaaattttaacaaattttcatagcaaaaatcattaaaatgccaaaaaaaatttcttagtttttttcgagtttataaatatcattatgaatcttagcatataattggaaaaaaccctatttttttgcaaattttcatcttttagtcttaaatacccgggaaacgacaaaattttccgattattacagaaaaccaaattttaattgaagaagaaaaacataaaaatgataaaaacgagcaaattgatcgaaaacattagtgaataattaatccttccttcagagagtcgccaaatcgaatttgaaattgggcccaaaattcgcctcaattttgtcaccagaaaagagtaaagaaacgaatggataaaaagaaccatcagcaaaagatggagcaaccaaaaaatcagaggaatctgtgaaaaagttaagggatttttgattattttaaacataaaataaattagataaatagacaattaaccaaattgtaatttaaaaatcgtaaaattatattatttattatttgctaacccaaacgaagcccatttttggtgaaaatgatctgtcgagtggccgaattgacgccaattccaacggtatcgccaacaccgtaggaatattcggcatttgctccttttccttttccgttaatccataaaaagccataattgtcaaatgcataagtgcccttttcaagttgaattgattcatccaattttgtctgctgtttaacagcgaatccgaagatgacccaactgaataaagaaaaaaatatattaaaatatttcactttttatacaaaattcgcttacttcttttttttcataactgaaatttcgtagtaaaaaaagtcagacaaatgcttgttcagcaaaatcggacattttgcgaagacggaaataccaaaagtatttcccttatgctggacaatgagacttttgtcaccactgatttggatgtccttgtgacaagcgaaggcatcccaacaattttcttggaattttaaaaacacctgaaagtaaataattctatatttttataatattatataataatttattaaataaattaaaaattatttttcccgtaaatattttattttacttttctcttccattcattcattcacctttttctttgtctgcttctccatttcactgattctttccaaaatgttcttcttatcattttccatctttgaaaattgctccgaagttcctaaaattaattttcaaaaattaaaaatgttataatttatttaaatgaaattcttaattcatataagaaacttattcaaaaaaaaaagaatttttaataagtgataatttattcttcgctaaaattccctcgcctttgtccgtgttttcgttctgtttttccatttcaccaattttttccaaaatctttgacaattgccccgcagtagcttaaaaatcggattaatttttaaatttaaaatggaaacatttaattcgattaaatattttttcattttaatttctcctcgccttttgtctgctgttgttgctgcttctccaattcactgattttttccaaaattttcttctgatcattttgcgattgtaagaatgcttaaaatagaaaacaattaattatttatttatttaaatgaaaataaaataaatttaataattattcctatggttttggcattttttcgcagaatcggtcgagttttaagatttttctgattgtattaattctgctgccagtcaaaatgttctcaataattaaaggattcgaaaaatgtccaattgcgcagttaccaaagaaaagcccaaaaatttcattttcgttaaattggcctcgccttttgtctgctgttgttgctgcttctccaattcaccaattctctccaaaattgctttcaaatgatctcccgaaactgaaatttgaagcaattttcaattaattttttaaaattgttgtcaagttataaaaggttatagcttttaaagttgtcaaattattttatggttatttcttttttatggtttctaccaattctggattcttgaatcgggttcgaatttgggataaataattcggaaaatttgtaaaatggtggtaatttaaaatgtttattattattgtattttaattatgcattttaagaaattttttacgttgaagaggagaaaattcgtcggccgatgaagaagtcgtgaatgatgacattttaattttaaaatctaaatttaaacatttttataattcttttcgtaaaaaatgatcctgttaaaaatatatttttctttatttattttcatttaccataccgtttttctgttcaattttgaccactttttccttcaatgccttctgttcgcctaccaattcctggtgcattaacttttgttcaagtgccttctaaaaataattataaaattttggcatttataatttactcaaatttttatgcaaactcacattttccagttccaatttggccattttcaattccgtttccaatttggcaaacttttcatgaaattcctgaatttaaattaacaaaatcgcttttgtctcacattaattcaatttttctgcaattctttcttctgttagcttttcttccgcccaccttaagctgttgttgttgatcagtgatcgtttcactgtttccatcaaataattgtccatcattttccaaactaattgcatcgccattcacttctaaaatttaaataaattaaatctttaattttaaaataatttaattaattcatattcaaaatttaaatttttctcccatttcctttacccctgttttctgctggtgtaaaatcatctccacaatttattgaattggtcgaaattgacatttttgagttttggtactctaaaaaaagatttaaatttaagttttcattaataaaaatgttactattgaataaatgaaaaagaaaaaagacaaataaaaataaatgaccattacctattccttcgttttgtttcatgtcagtccattttttcaaaatttcggtattgatttctcaatgctaaaaatatgcatgggagggaagagaaaaataaaaatgaaatagaattggttagacatattttggtcagtaagacaaaggaaataaaagaggaagaagagagaaagagaaggaggacagaaaaaacaatatgacagagagagaaataaagagaagagggagaaaagggtaacataatagaggaagagaaaaaaaggtaagtcgccgcctgagcaggcggaagccgaaatcctgggaccgtccctggatcccaccctcaccattcccctcggctccaacattaattttctaacaaaagagaggcctcaagtgtccatggagtttgggtagatttgttgtaattggtttccgatttgtcttcatttgtgagccttccctcttcataataactttgatccaaagacaggataggtttgatccactgacttgtccaatggatgtatttttattttattttttgtccttttgaaattagtcatttgaattgttaaataaaattgcacaaattatttgacctttaatattgtatcttcgtaaacctatttctcgaatttatacacaaattaattttctgcaaggcgtttgcctgcatttttcttggccaaataagtgaatttttaaaatcaaaatacagtattgacctaaagcaaatgcttttgccgagttacggttcggcattttatacaccgtttcaaaaaacgagacatttgtgtcaataaatagaactgaaaatttaatggattcttgttaaatcgaaaaaaaaaatatattatatacaaaaatcgtcattaattatatcctagctaatttgggccgatttttggcattatcctcttattcaaaaaaaaactaagagaaaatgtgcaaatttcggattcttaaatccctgacaaaatgtctaacattattgatttattgggcatttaatcccgctctatttaaagtataatcaaaattatattaaattaatccgatgattagacatttacaaggctttaattccaattgcaaattgattggtcaccaaatttgatcaccttttcatctgttctcactttgttgctccgcatttgatcatcgccgatccccaccattaaaattgctgatcacaatgtgtccaaattgaggcatttttcgtcccatccgtgcggcaccgaattgttgcatgccattggcagtcccatcatttaccggcaacacaggtggtcaaaaagctggtacaaataccggaaacaaaggaccgaaatgcaacctgaaaattttggggaaaatttttattaacattttaaaaagggcttttaaaagttttttcaaaaaataaagcggttttttaaaattcaataaatatgtatttttatttgtgttttcttttaatgtgcgaaatttttatatttaaattattaatttttgttttaaaaaatagagtgagtcttaattttaacttttttgatttatgaattttcaaaaaaaaaatttcggaaatttaattttttgcataatttagaaatgctcaacttaacttggcaaaaacacttttcttctttgggcatataacgctcaaaaattcgatttggctacctgagaaaaaatttggaattttaaattaaattcaattaatttattatttttcaccgatcattttgacacatttgaaaaagcgcacaaagcgaaggttgccatccggacaattaaaatttattaaattatattttaattaaaaattaccattttcgcacgtgcttaaatttaaacaaatttggcatcctttgatggcatttcccccctttttactgtacattaattaccccattaagtgtgccgttggccaccatttgagccaatcgttggtaagcaatgaattcgttcagtgccgttttgatgcacatcagttcagccactttcatcgtttgtccaacattaccttagatttttatttttttattatttaattgtgctcattaaaattatttttcaaaaaaatttattttcgacgactattgaaataataaattttcattttttatttattattagcaaaaagttatgaaaaaatttgggtttttctgaacatttttgataataaatctacaaaaaataaggtacattaatgttgtcaaatattttattatctttttttatggtcgtgtaaactgtgcaatagagccaaatttcccgaggcccgagactaataccgcaaaaagccaagaccttttttcgagtattgattgactcgagaccacgactctcgatcagcataactgattatcctgtctggaacctcaacttgatgatttttaattaaattaatttaaccggcgactctcttttagaaaatatgttatacaaaaaattgccaagcaatcttatcaaatttatttgtattttttgcatttgttcagttgaatctgtgcctactccgctcaggtgattttaccaaaattaaattcaaaaatctgttgaaaatctttgaaagattttcaaaaacatccttttgcttctccttcccttctctcagagcttcctcagtcggttcgtgctcgttggtggtcagtcatttgctatttaaattttcaaaaatccattaaaaaaattcccaaaatttaggcacgtattggcgctctgttcgctcctatggtaagttcaggtaaatttgtgatcaaacctttgatcgcacttcatcaaccattgaacgcgtcgcgtcgttagggttcactaaggctttctccccctccatgaaattttttaaattttttccaaaacatttttcatgttttcaacaatttccaacgagtttcggttagcttacctatcccaactgagtcccgatttatctagctaattaacatctcccaactgaataataatttgaaattaaatttttactttgttttttattgaataaactccaaaagttaaagctaaattaaatcaatgaaaattttcaaaacaaattttcttcaattatttcaaacaattaatcattttggactaaatgatcgaatattattagaaattcaggtttgcttttcacataactttttttcggcgcgctttttccaaaaaactttttgggaagaaaagggtccggcggtgccgataggcgccgccgggggggggggaattttgaaattttgagtgcaatttgttaacagattttcaacaaaaaaggctggtttttgggattaataggttcaacaatttgtacggattttcatttaaaaaatgataaaatatgtaaataaatcttattttctcgataggaaacccctgattatacaaaaagaaaattcaaaatatttaaatttctctagaggaactgaaccatgggaaagaagtagagaataaagacgaaaagcctgctacttttaaacaatatattaatttttattttttattttttcctttaactccaattttcatcactattttttcactcagacccccattcttaccagttcttgaattttttgttttaatcatatatatttaattatcatttacgtttcaattttgattatttttgtcattttcgtttttaattgattttcacgtttacttttgttataaaccccttaataaaagacaaaatcaatgaataggaatgaatttagagtgatcaaattaaataaatgtaatttttccaaattttttgtcttccgttttattgtgaattgcacgtggggaggggaggaattgggggagttaaaaaaggtcttatgtaaagaaaatcttaaaataaattattaaagggctgactgagtaccgtcaataaactgaaaggttcttgttcatttttccaaccgattgtagcccaaaattttaatattacaaaaattccgagtttttctcaaattcattggacatttatacaacgactcacaaattatatgtacaatcagagatatttggaacatattacagacaaatcggatcaaatgggaatgatgagcataataaatacaatacaattagtgatcaattaatgtcttccgaagaaatccatccgccgcttttggccattgattcgctctctctgtgctgtcacatctgctgttgatcgttttgctgtctgaaaatggaaaaaacaattattattgatcaaaaacaatcaaatttttctttacccatcggtgccctccgccgcgtcccgcccattgtccgtcgcggttgcacgaaaaatgtccaccatttcggcatttccgctctcttccgcgaaatcctgtgcccgtttgcctgaaatgggcgaataaaacgctcgctagcacaacaatttggccacttccgctgctgctcaccttcaatgttccgttggttaatgtccgcgccgatggccaccaaatgccgtgccatttcaatcttcccaaacttcactgcccacatcaaagcattgtgtccgtccacgtcaacacgttgaaggtcggcgccatgttcgacgaggaaattcactgaaaattagggagattacatttttggcactttgccacaattctctcccaccgatggccaaatgtcctttactggcagcgcaaatcactggagtgtatcgctcttggatggtttgttggttgacatctgcggcccactcctccaccagcagacggcacacctccaaactgccgcccatggcagcgctcttaagtgcgaaatggaatcctgaaattaggacaacatttgtggcatggtatttttgggtactgtaacagtaatcccccaccttcgaaatctatttgctcgacatttgcaccatgtgacagcaacaagcgcacaatgtccacctgaattcaaatggaaatgttggaaaacatttcgccaatggaaatttttccctacatttcccgtgtaacacgcgtacatcagtgctgttgccccatcaccattctgcagattgatgttggcaccattctcgacaagaaatgtgactgtgggggaaaaaatgacgggaaaaattacgcattttttcaaattttcgtctctctaccaatttccgtttgcgatcttttgcaagcgtgcatcagcggcgttgtggcaaagtccgtgcccaagtcaatgttggcaccacgcgcgaccagcacacggcacagcggcaaattggcatggcggacagcaaggaaaagaggcgtcatatctgcacaaatggggaaacaccattattttcagagcaagcaaaaatataattattttccggtatccgtttcgaccaattccgagccgaatccagggacccgaattagatgcatggtaacaacgatttcatcatcaacaccacccactcactcgtgtttatgttgttcacttggtcagccactggctcatccggatcggcgcccttctccaactgaaaatgccatacaaaattagtgccgacggataaaattgttcattcactaccaagagatcaacaatttggatgtgttggcgtaagaaggcagtccaaagagctgatcgtgatcgggtgttgtcgcgctccactggatcaaccgtccaccgcagcaaaatgttcagctcgtcggcgtccagcgaatcgatcagcacacgcaattgttggatgttgccatcgttgatcaggtcgaagaagcggagagtgagcgtctcaaagttgtccacaacagcagcagcagcgggatgttcagtatctgccttaattgtgggggaaatcagttattgaaaaagaattctgagttgaacccgtgcaacacatttttcagggaggggcgggtgggttcattatcacggatcagtgaccccaaaaatcccggtggaaagatgatttttaaaaactaaaaactcgaaaatatgaaggggaattgcacttgttgttcgtgttgcaatcacaaccaaaacataaatgttaaaaaggtttcatggaaacaaaaaactttaccatgcgaatcagagcagtgaacagtgacgacgaatatgcaatggcaattataa

SEQ ID NO: 1938 - DNA, 1751 bp, Heterodera glycines
  misc_feature (928)..(928): n is a, c, g, or t
  misc_feature (935)..(935): n is a, c, g, or t
caagccaaatggtagacaaaatgactcgaaacgccaaaatagggtagtgatttcggcatataaaagcacgcgacattaacattttccgccatttcatcgcgtcttcgtcttccattttcactattatcgccatcgcacattcgtcgtctccgttcaaccgcgctgattcgcacgggcaatatttttcacgtaaatccttttaacatctttgttttatttgtgattgcaacgccatgcttttaagttcaattccccccccccccccccctcccattttagagtttttttaagaagtccatcattccaccgggttttcaaagtcactttttactatttttcaggaagcacaccccctgaaaaatattttgcacaaattctgcatcagatttttccttttttcaaaaactgattttttccccacaattaaggcagatgctgaacctcccgctgctgctgatgctccggctgatgctgttgtggacaactttgagacgcgcactctccgcttcttcgacctgatcaacgatggcaacatccaacaattgcgtgtgctgatcgattcgctggacgccgacgagctgaacactttgctgcggtggacggttgatccagtggagcgcgtcacccgaacaggatcagctctttggtgtgccttctttcgacgacacttcgaaattgttgctctcttggtagtgactgatcattttttctggtttaaatcactaattttgtatggcattttcagttggagaagggtgcagatccgaatgagccgatcattttcgaaacgcacgatcacagaacgagtgagtgttgttgatgaatgttttaccatggattttcgagtgtcactgtgttaacaaatccggcaccatttcgaccaatttcgaattctttttctcgaaaaatgaaatttggatattttggncgaattnttatccaggattcggaattggtcgaaatacggattccggcgatccctatgaacttttaagcgtcccattgaattttcacgcgtcccatgaacttcatcaattaggaattttctttttttagaattaaccaacttttttatctttggtttccatccgaatagcccatgcttgacatagcgtgtccagacatttgcgcctatgtccaaaatcggattcaaactttaattttttttgattctgtttcacgcatcccacgtccattgtacttttctaattgaaagaaagaaaagaaaatattcccaacattaaaaaaatccatgggacgcgtaaaagtcaatgggacgcgtattctgcactagaaccgaaaattgaatgacaaaaaaatctaccccctccccctaattttcagtgaatttcctcatcgaacatggagccgaccttcaacgtgttgacgtggacggacacaatgctttgatgtgggcagtgaagaatgggaagattgaaatggcacggcatttggtggccatcggcgcggacattaaccaacggaacatggaaggtgagcagcagcggaagtggccaaattgttgtgctagcgagcgttttattcgcccatttcaggcaaacgggcacaggattttgcggaagagagcggaaatgccgaaatggtggacatttttcgtgcaaccgcgacggacaatgggcgacacgcggcggagggcaccgatgggtaaagaaaaatttgattgtttttgatcaataataattgtttttccattttcagacagcaaaacgatcaagagcagatgtgacagc

SEQ ID NO: 1939 - DNA, 1778 bp, Heterodera glycines
ccatccgtccctggctgatattttcgaattcattactttcgttaaaatgttcgatacaataccaaacaagtttccataaaaaaatattataaaaattatagcaaaactaaatttatttttattagaatatctttttggtgcttgtacaatagaaattatatcaacaaaacaattctgacaaatacagtaacagctgtaaaaccaaatttaattttttattttaatttttttcctttttattccataattggagataatcagggacaaaaaaccgaaacatcttcgtaatttaattatgtatgtgtacaaattataatataaaattaaaaataacaatattagcatctcttccgatatagaattgtgggccattcaatgaattattgcttccccaaagaatttactaaaaatattatgacgttttcaaaattggaccacatattttttgttttttttaatttaaaatgaaaaaatatacgaaacttttttcgattttcaattgagcttcacaatgcttttaagtcccaccgtgaggctggactttttcaaaattacttttttacaaaattaattttttaacctattttgacgcaaaatcttttacaaattgcacttaaatcttcaaaatttttctctactgcgtctatccgcactttcggtcacgccaaatctttttaatatgcttttaaattgcttataaaattattgaatttttaaaataaaaatttgaaaattctttaaaaaaaattttgcgagtgcagcagcggcagatgccgatggtccacttcgtttggtactcagtggcggaaatgacagattaattttgttttgttcaaaaaaggtgctcaattgtctgcgctcatatgctcgtctaactgacgagaatgcgaaccgtatcgcctcctgtaaagtaaagaaaattctaactttttttttctaaaaatgttcttaaactgcagcttcccactcccgggtgctacacaaaattttggccgggacaaacaacgctgaatctttttgaaaaaaaatcaaaaaatttttcatgaaaatcttaaaaaatttttcgcgagttttagaataaaatttactaatgcatcataaaatttcaaaaaaagcccggtaccgattttttaacggtatgcagtgaaaaagagcaaaaaaaaaattcaaaatattcgtaaaaacattttttactattttaaaaagaagccgaaaatttggtcacctttagaataaaaccgtaaattttcagcatcttttatttgtaattaaaaaagaaaattttttcaaaacaaaaattttttcaaaataaaaaattttttttcaaggggtgcctaaagaataggcaacaataaacaattttttggcttggaatttttttcaaattataaatttggaatttaccttcaatacggggtcgacatttccatatatgagcaggggatgcattctttggctgaccactgcttcaacacggattctgattattttgccttgaaaatggaaaaaaaagaaatgaaaaacactttttttcggtcgacactgtaaattttgtccgggacgtaacgcgtacaaaaacaaaaattttttgtaccgtgactgatcgtacccctcccccttccccatctcctcccaacacagcccaccgatttgtttttcaaaaaaaacgaggagggagcaaacggcactttgttcgttttgccccccccccgccccccccccccgcccaaacgaaatttattttccttttccctgagcatgtaattttcatttattta

SEQ ID NO: 1940 - DNA, 3292 bp, Heterodera glycines
  misc_feature (7)..(7): n is a, c, g, or t
  misc_feature (27)..(27): n is a, c, g, or t
ggcttcnggataaatcaaaaaaatttntctgaactaaatatttgagacgcaactggccccttaagtactaagacgcaactggcccccagacgcaactggcccccagacgcaactggccagaggcaactggccagacgcaactggccagaggcaactggccagaggcaactggccagaggcaactggccagacgcaaccggccagaggcaactggccagaggcaactggccagacgcaaccggccagacgcaactggccagaggcaactggccagaggcaactggccagaggcaactggccagaggcaactggccagacgcaaccggccagacgcaactggccagaggcaactggcccgttccgtcattcgaaagctcttaatgaggagaagatttttctaagaaaatgctaaacaatttgatgagttagaaaaaagatgttggcgttcaacaaaaaaactttcttataatttttgtattagactatatacaaaaatagattcattatagaaagatgcaaaatttttctctatcgatatgcaaaattaaagaaaatctgtacgggaaaaaaaaagtttcccgtgagaagcaaattcaatttttctctttataatagagatacagaaatagtacgcaaaaatgagaaatttgtttctggtaaatattgatcataggccccaaactcaaaaatgcttaaaaacggtcagaatcgatgtaaaaaggttcgaaatgggttggaaaaatagaattaggggcgcgcttgccctcacaaaggagaggtacccaagtgaccatgggacttccgaatgaaactttcagggtaggtagattaccccccccctttgtattataaatttttttttttttttgctaaatgaagcttctggccgagatatgaagcttttcctttttgccttttcaatatcattttcaaagaatgtaaagccgatctgagcgtcggtggcctggtggttgtgccttccatacttttttcttcttctaaagttcaattccccaaccctgtaaataattattttgtttttttttcatatccaaattagtttttaagctttttaatattaataaatttgaacataatattttttcatttttattcgacattaattttggcacatgtgataattttggtagaaatgagtgaagcaaaggaatttgtcacaccatgcacatctaatcattataaattccgaacaaaaagtgatttgacagtgttcaggaaaagcaaaaaacgatggctattgttaatccttgtcaacaatcaattcgttgatcagatcaaatggcacaacggaatcagcagacaactgaaaacaaatgacaatgaaattgacgggggaagaagcatttgcaaaagcctgaaatttgataaaattgattaaagaaatacgaactgaaagcaccgctttgaacggttcaatattcgacggcaaaatcccatcattcaagtgcaatgaacagttgaacatctttggcaaattgttttgaagcggagtgaaaagccattttgccaatgcttgtccatccgacgccgcgcactgtcatcgcatggaaattaggcgaacaaaccgtcataattgacattgataacgcaaagcgatggacagtcgtcgagaattgacggaacgaattgtcgcaaaaggcaaaaaattctggcagacagatccatgccataaatatttttcttgagcattgcccaaatgttgcacagaataaactccaaaatgcggtcactgaacgtattgatggaaaaaattaattggacatttggtgaaaagctggccaaaacggttgagaaaagcgatgacattttggtcgatgaaactcactcaaatggaaatgtgttgaaaattttatgtttagcctagggttgcgaccccgaccccgccccgaccccgacttttttggccattttccggggataaccccgacaccgacgctcccaaccgcgacaacgccaacccttaaccccgactcggggtcgggttaaatatagacccctaagaatggaatgctttcgtgagagaaaagacaaaaaacatacaaatttgaattatttaaccattttgccaaatttttattaaataaagtaatttgttttttcattcttatgtagtagtggtgtttggttactttctatgggttttttgaggcgtagattccgaatataatatttattttgttctaattcaatccgaaacatgaattcaatagatctggaaaatttaatgaaaaatcttatacaaaaacatagataacggaattctgattccgtcggcgccgaaaatttttggttgatttcttgaaattaaccgtacggaaaaaagcctttgctttttggtttctttttcgttaaaaaagcaatgggttttaagtgtaccatggtttttccatgttttgctcttatttcggaatgtttgacattttttataaagcgaatgcttgaaacactgaaatttaaaaaaaaatggttttcgaggttccagaacagagaatccgattacaaacctatccatttccactggatttcttgttcgttcattttaataaatttcttttatttatttagaagaaataaattttgctaaaaatgatggtcgctgaggtgaacggaatcggagttggccaattctcaaaaaaaggtacgttttacaaaaaaataaataaatgaaaattacatgctcagggaaaaggaaaataaatttcgtttgggcgggggggggggcggggggggaggggaaatcaacccagcgccgtttggaccctcctccatctatatgaatgcaaatccatgacgctggttaggaactatatggaaaaccacgaaagataagttaattatctaaattttttactgataagcttattataattaaaatttccctttgaaagttgcaaagaaatattgtagcacttattgcggcacttcattttttgactcatgctttatagcaccagtaatacgggtttgcaactttaaaaaaggtataaaacaatgtacatttattataaatttttaaatgatagagtcgatgattgctgttattaccatgatttatgctatataaacaaatctactacacgctacgattgcgaccacaagcttttgcaaatgtttgtatgagagtgctgaatgttcattaacaaaagtctgtatttattagtattttaaataatttattttttataatttgttatgcttgtcagttcatgatcttgctgaacatttctaagaataggaatatctctcaaagaaatactggtatatatatatt

SEQ ID NO: 1941 - DNA, 3235 bp, Heterodera glycines
  misc_feature (163)..(163): n is a, c, g, or t
aaggcaaaataatcagaatccgtgtgaaagcagtggtcagccaaagaatgcatcccctggtcatatatgaaatgtcgaccccgtattgaggtaaattcaatttataatttgaaaaaaattccaatacaaaaaattgtttattgttgcctattctttaggcacnccttgaaaaaaattttttattttgaaaaaatttttgttttgaaaaaaattttttcttttttaattacaaataaaagatgctgaaaatttacggttttattctaaaggtgaccaaatttttggcttctttttaaaatagtaaagaatgtttttacgagtattttgaatttttttttttgctctttttcactgcataccgttaaaaaatcggtaccgggctttttttgaaattttatgatgcattagtaaattttattctaaaactcgcgaaaaattttttaagattttcatgaaaaattttttgattttttttcaaaaagattcggcgttgtttgtcccggccaaaattttgtgtagcacccgggagtgggaagctgcagtttaagaacatttttagaaaaaaaaagttagaattttctttactttacaggaggcgatacggttcgcattctcgtcagttagacgagcatatgagcgcagacaattgagcaccttttttgaacaaaacaaaattaatctgtcatttccgccactgagtaccaaacgaagtggaccatcggcatctgccgctgctgcactcgcaattctctcattggcgacgggaagaccagtgcaggcgggcgtttgtgtcactggaaaagtgacaacgattggccacatcagcaaaatcagccaaatgaaagaaaagacgatcgcagctgcagaggcaaatatggtcaaaatggcatttccaagggccaacctaagcgagttcaagaaagtgccttatcgaacccgaaagaatttaaggagaaaaactttgaataaggtggatgatttattttctctttattgatttaattttttttattgtttttccatttaatattttgatttgttatcacttttaccatttatgaaaatttacctttttgaaaaaattgcaaataattaattagggagtcaatgatcggatcaaaatttttaaggtttatgggtttgggccagtagggctgtaatggcggatgacataaagtcggaattcggctccaacaaagtccaacacttttgctgtttaagcactccgagaaaccataggggtaaaggacccttagggttggcaaaaaaaaaattttttttttgggaggtttttggggttattaatataattctgatatcagatttagcaaatctcttcagcaaaatcgaacagaatgtcaaaaatttaagttttccgggttttgatttttgttcaaaatggaattaggctttctaaataggattaaatagatgttatatctgtgattaacgccctagaaaaccccaacgacgttttcacgacgtgccaaagtcccgaaaaaatggccaagttgcgagtgtcaatgagatttggaaaattttttaaattatgattctccggaccgccacacattttcattacttcagaaagtgccgacaaataaaatgacatcagcgcaaatataagtttgagggcaaatcacgtcaaatcatgctcaaagcgtccatggtaatttaaaattgagaaaaataagacgaggaaattggggattggttttttgtatcaaataaaatgttttttgattttttaatgtgccaatgtgcacaaaatgtaaataggaagtaattaagatgcacgccgtcactttggaacagacaaaagcaagtttttacaattcaaaaggtttttacataaccttaatttaaggtgattaggacgtcaatttaagaaacaataatttttctgtatctttattttgtcaaaacattaaattgcgtatgaaatgcgctagtgcttattttgcattttaacggcctattaagcgcttaaattgccaattgctttaatcaaatgattaatttcttaagcattacctaatttacattttttgttttgatgaataggtaattcataacaaaacatgtttaaaagcaaattttttcaaaaaggtaaattttcataaatggtaaaagtgataacaaatcaaaatattaaatggaaaaacaataaaaaaattaaatcaataaagagaaaataattcatccaccttattcaaagtttttctccttaaattctttcgggttcgataaggcactttcttgaactcgcttaggttggcccttggaaatgccattttgaccatatttgcctctgcagctgcgatcgtcttttctttcatttggccgattttgctgatgtggcccatcgttgtcacttttccagtgacacaaacgcccgcctgcactggtcttcccgtcgccaatgagagaattgcgagtgcagcagcggcagatgccgatggtccacttcgtttggtactcagtggcggaaatgacagattaattttgttttgttcaaaaaaggtgctcaattgtctgcgctcatatgctcgtctaactgacgagaatgcgaaccgtatcgcctcctgtaaagtaaagaaaattctaactttttttttctaaaaatgttcttaaactgcagcttcccactcccgggtgctacacaaaattttggccgggacaaacaacgccgaatctttttgaaaaaaaatcaaaaaatttttcatgaaaattttaaaaaatttttcgcgagttttagaataaaatttactaatgcatcataaaatttcaaaaaaagcccggtaccgattttttaacggtatgcagtgaaaaagagcaaaaaaaaaaattcaaaatattcgtaaaaacattttttactattttaaaaagaagccgaaaatttggtcacctttagaataaaaccgtaaattttcagcatcttttatttgtaattaaaaaagaaaattttttcaaaacaaaaattttttcaaaataaaaaattttttttcaaggggtgcctaaagaataggcaacaataaacaattttttggcttggaatttttttccaattataaatttggaatttaccttcaatacggggtcgacatttccatatatgagcaggggatgcattctttggctgaccactgcttcaacacgggatctgattatttttgcttgaaaatggaaaaaaaagaaatgaaaaacactttttttcgggcgaaactgtaaattt

SEQ ID NO: 1942 - DNA, 1534 bp, Heterodera glycines
aaataaccacaataccgtcgcgtggggctttgaaacagtggtggaggcacagatgagcaccaaagcgaggctggcgaagaaaaagaaacgcatttttggataagctgagaatttcgtttcgaagctggcgcctgagaaattttatgaaaaaacatatttcagggcggttaaatctcaacttgtagcttttgtccttattttttttaaaagtataaaaaaatttttatgacttactgacaaaaaataatagtcaccatgaatttcacgggttttttgcgtcactgtcattcagtcacagcgaattctattgaattggttgactgaatgttttcgcttgtaagtactagggctgggaaatttaggaacgaaaaatcgcgaaataggtatttaaaaaggtacaaaaaagctcaaaataggtattaaataggtacaaaaatcccgaaataggtagaaaaataggtaaataaaatttttattaacgattttttagtggaaaaaagcaaacaaagggggaaaattttggttctatttctttgtaaacgaataattaaaatatttttaatatgttcttagaaaataatgacattttaaattaaaaattttgttaataaaaataaataaataaatttttgggggaagaatttttgggaaaattttccaattcttaggggtgtattttttgattttattgcatttttgttaaagaattttctgaaaatccttaaataggtataatgggtagaaaaactccaaaatagcaaagttatacattataaaagtcatcgtagacaccccaaaccaagtggaaaatgcttattttgtgcttagcaaaattggcccgatataatgagcagaaatgagtccatttcatcacatatgtcggttttttcaacttttatatatacgcaattacaccataaagaaatgtataacaaattttaaatttaattgtttgaaatgtgaaatttgctgattcattttgcttattaattttattcaaaacccatttattaaaccaataacacaaaataattttaaatttttatgctccttccaattctcttcacccttccatttattcttcctgctcctcgccttgggtaatgtttgtcatgttaaaggaaggcagggaaatggcgtcggggattggcacggaaatgttaagccatttcacagcagcaccattttcatcgttcttggcaattaaattgaattattttagcacataaattctgaacccaaagttttataaacaaaaaaatgccaaccttggccttagggcaaatgttgatgcacacaacgacaaagcacacttgatagcaacctttttcattggtcttgacagatgggcaggcttaaaaaatatgaatgttttacatttaaatgccttttatcggaaataaccacaataccgtcgcgtggggcttagaaacagtggtggaggcacagatgagcaccaaagcgaggctggcgaagaaaaaagaacgcattttgggagtttcaacgcttaaaaatttgaaaatttgaatgcttt

SEQ ID NO: 1943 - DNA, 1032 bp, Heterodera glycines
tttgaaaattggatgccttttagagttttctatgattaaattgaaaaaaataaaaaatgtaaattctttccgagatttcaatgctaaaaattgaaaaagttgaaaatttgaagtttcattgcttaaaatttgaaaattttaatgtttttagagttttcaatgaataaactgaaaaatttgaaaattttagtgtttttagagttttcaatgattaaaattgaaaaaaatttgaaaatttgaagtttcaatgcttaaaatttgaaaattggatgccttttagagtttttcaatgataaaacttaaaaaatttgaaaattttaatgcttttggctgttttatttttcatttttatagtttcacatttgcttccaaatacattctttgaatataaattcggcatttgttttttggcaaaaatcatttgaaaaatgtcagaaattaattgcgttgaaatattgggaaaataatgaaatattattctcagcaagtcgtaaaagaaagcggggtgaattaatttttatttttaatattgaatctgggacaaaaagacagaaaaatgtgaaaaaataatttttcaaataatttttatttttataaattttaatttaatttaattggtcaaattcaaaattaaaactcctgattttaaatagttttaataacactgattctctcgacagtttatttctattaaaatttcgctaattgaatttctttatttaaagaattctattttcaatttgttttcaattgttttgcctcacatcttttttctgcttacaaattagtccaagttggcatttaaaatggatgggttttctgcttattatctcacaatcagaccaattttgctcaattgaagtgatgcattgagaataaaaggtaagacttgggttcaaggggtaaaccaaaaacacttttaatggttcttaaatagagtataattaatggaaataatcatttttggcgtaaaaccgacgatttcttggcgaaatgcaattttttaatctaaaatttttttgatttatttta

SEQ ID NO: 1944 - DNA, 3130 bp, Heterodera glycines
  misc_feature (3061)..(3061): n is a, c, g, or t
  misc_feature (3107)..(3107): n is a, c, g, or t
tttcgccatcaaattcttttcctttattcgtccaatttggctgagaatctcgaaaaaactgatcaatcgaatccctattcaaaaaccattctcccaacaaaattcgtctttttcaaaaatttcaaactagtcctttccctcaaaacacgcggcggaaagtcccagtggtgatgcgacatttgcagcgctggcatttgcggcgccgacacttgcggcgcccagtcaaaatgagatttacggcgccgactggcactcctataattaatgctcaaaaattaaatctcgaacaccttttgttttccttatgtccaaacgaaattcttttcaaaggtaataacgaacgactgaatggaattcttagaaacttttgaattttgctgagttcataaatttttaaggctgggcagcgacgggatattgtaaggaaaagttagatggatgttaaagcaagtaaagcggtggtttttacgaggcggatttgcctcaaaacgcattggccgagttgccaaaggactgaatttccacccctggcttaacatttagcctatttgttcattaaatggaggaatgcataagataaaataaaactttttggccctgaatcattaattctgcgccgcaaatgtcattttgacttgaagcagcaaatgtcagtgccgcaaaatgtaagcgccgcaaatgtcggctaatcatcccagtcgctcgcaaatgcatttttggggttttctcatttttatgaattttagatttttgaataaagcaaaggccaaaataaaaaataaattaattgtaaatagtttcagtgttttattatttcaattttttctcacccttggccaaatttgcgtgggcacagttgactctgcttgctgctgctgctacttagcaacttgtttttcaaaaatgttgctcaaaacccatctaaaaattaccaatcaacaattattcgaactaattaattttcattctttttgcaaaaattcaaaaaattaaatttatttgaaattttcatagaattacgtattaaaataattttcttctgtctgggggtcgaactaagtcgaaacttttatatatggtgataataatccatatataaatttgctttgagcaaaatggtgaccaataatttaacaaaaagttaatttcatctttgttttttgcttcacattctgtgagttctatgcacttgcattttctgctgctttgatcaccttaatattaaaaaatcatatgaaactaagtttgttaatttatgaaatcaaacatttggtacaaaatttttaatattaatacgaatacctcttctgcaatgctggtagcttgttttttgttatttccatttttgccaagaaaagttcgtcgttcatgccaatttccagtttcacaacatgaatggccactaaacccggtttgcttgatcgtatacaacgttgttttgttggaatcaatacttaaaataagggggagatttttatgcaaattttgttattttttcatgtacaaactttgaaaaatttattaaatattttttaatagtctgcaaaaatgcaattaaagaaaaacaacaaaataattctaaatccaaaaatttccgttttttataaacttggattaaattaaataatatttaaataaaacttgcataatttttgaggatcaattcacatttgtatctggacaaaccagcagacaaaattcatacaaaacattcatttgccgatcagtggtttttttgacgagattgtccattttaattgcaaaattcatcaagggtttcaattaaaaccttgttgcattcattaaaggccttaattcgtttataaatattaaagggagctcgaaaaattatttattacctgagcatgaatggttttcagatcactcgaaaaactgctatcatgtttttttaaagcttgaagctcaaacattttgttgcaatcatttcgcaacttgttggcaccgtttttcacggtatcagcaaaaaatctggcctcttgtaaggtttctggttctagttcttgctggaaattaaaacactttaatttttcccaatatttatttattattgtttttgaaaatggaaatcgcatatcatatttcttaatagtcctttatataagtctgataaagtaccttttaatgatgggttgaataagccccaagggcccaatttaataaacagagtaaagtataaaaaaaacatcaaataacaaaaaatagtaaaggcaaaaatgaatttagctaaatccgctttcaatttattttaatgaacattactgaccgttataagagttaaagcatgttcatctacaccaatcattgtaaaatattctacttttgaaatgaacgggacaagggcggactttcataatcttctatttaatttgggattcattagtaaatagcatgtattttaattccatattaataaaatatagaaattttaactttaggcaattttatggatcagttttcacatataacattaaggctttatttttaaaaaaaaaattatattaaatgttaaaattttgctgatttttttgctttccttttcgaatcactttacagcgtaattaaaagaacttttttgcgagtcaggactcaatttttttaaattaatgaaggctggacatcaccaggaaaattgtttaggttttaaattatattaaatatgaagcaggagtcgggaaaggtcagtaatttgaggcggtgacctgttgataggcgacgtgacgcacagcaatttactgaagagataagtgtgatggcctttctcggaaactcggctgtgaacactcaaattgataaaagggcaaaagtgaaattttatagcttaaagtggggtgggattgaggggcatgcattaataaaaaaatacatttgaaaatgtggcaagaggaaccaccagcaatcggaatatcacaatgttgttcgaattattgagagagggtggggagatgggcgtgagataatcggctgtcgagaccagggctaggcatatgtgtttttaattacgcaaatttatccctttattactgtgatttttcaattactngaatcagtaatttttaaaaacaaaaataataaagtcagtttattangctttatacgtattttttttgct

SEQ ID NO: 1945 - DNA, 1124 bp, Heterodera glycines
cgtacagaggctgcaaaggcgagcagaagacttccttgcttttatatttccgcacggtttcttagaaaagagccagaattagcataaaattaacgacacataaagtgttggccccagtgccgtacagaggctgcaaaggcgagcagaagacttccttgcttttatatttccgcacgggttcttagaaaagagccagaattagcataaaattaacgacacataaagtgttggccccagtgccgtacagaggctgcaaaggcgagcagaagacttccttgcttttatatttccgcacgggttcttagaaaagagccagaattagcataaaattaacgacacataaagtgttggccccagtgccgtacagaggctgcaaaggcgagcagaagacttccttgcttttatatttccgcacgggttcttagaaaagagccagaattagcataaaattaacgacacataaagtgttggccccagtgccgtacagaggctgcaaaggcgagcataatacttccttgcttttatatttccgcacgggttcttagaaaagagccagaattagcataaaattaacgacacataaagggttggccccagtgccgtacagaggcttcaaaggcgagcagaagacttccttgcttttatatttccgcacgggttcttagaaaagagccagaattagcataaaattaacgacacataaagtgttggccccagtgccgtacagaggctgcaaaggcgagcataatacttccttgcttttatatttccgcacgggttcttagaaaagagccagaattagcataaaattaacgacacataaagtgttggccccagtgccgtacagaggctgcaaaggcgagcagaagacttccttgcacgtatatttccgcacgggttcttagaaaagagccagaattagcataaaattagcgacacataaagtgttggccccagtgccgtacagaggctgcaaaggcgagcataatacttccttgcttttatatttccgcacgggttcttagaaaagagccagaattagcataaaattaacgacacataaagtgttggccccagtgccgtacagaggctgcaaaggcgagcataatacttccttgctttta

SEQ ID NO: 1946 - DNA, 1119 bp, Heterodera glycines
agaaaagagccagaattagcataaaattaacgacacataaagtgttggccccagtgccgtacagaggctgcaaaggcgagcagaagacttccttgcttttatatttccgcacgggttcttagaaaagagccagaattagcataaaattaacgacacataaagtgttggccccagtgccgtacagaggctgcaaaggcgagcagaagacttccttgcttttatatttccgcacgggttcttagaaaagagccagaattagcataaaattaacgacacataaagtgttggccccagtgccgtacagaggctgcaaaggcgagcagaagacttccttgcttttatatttccgcacgggttcttagaaaagagccagaattagcataaaattaacgacacataaagtgttggccccagtgccgtacagaggctgcaaaggcgagcagaagacttccttgcttttatatttccgcacgggttcttagaaaagagccagaattagcataaaattaacgacacataaagtgttggccccagtgccgtacagaggctgcaaaggcgagcagaagacttccttgcttttatatttccgcacgggttcttagaaaagagccagaattagcataaaattaacgacacataaagtgttggccccagtgccgtacagaggctgcaaaggcgagcagaagacttccttgcttttatatttccgcacgggttcttagaaaagagccagaattagcataaaattaacgacacataaagtgttggccccagtgccgtacagaggctgcaaaggcgagcagaagacttccttgcttttatatttccgcacgggttcttagaaaagagccagaattagcataaaattaacgacacataaagtgttggccccagtgccgtacagaggctgcaaaggcgagcagaagacttccttgcttttatatttccgcacgggttcttagaaaagagccagaattagcataaaattaacgacacataaagtgttggccccagtgccgtacagaggctgcaaaggcgagcagaagacttccttgcttttatatttccgcacgggttcttagaaagagccagaattagcataaaattaacgacacataa

SEQ ID NO: 1947 - DNA, 990 bp, Heterodera glycines
  misc_feature (49)..(49): n is a, c, g, or t
aaaagagccagaattagcataaaattaacgacacataaagtgttggccncagtgcggtacagaggctgcaaaggcgagcagaagacttcctgcactgtatatttccgcacgggttcttagaaaagagccagaattagcataaaatgaacgacacataaagtgttggccccagtgccgtacagaggctgcaaaggtgagcagaagacttccttgcacgtatatttccgcacgggttcttagaaaagagccagaattagcataaaattaacgacacataaagtgttggccccagtgccgtacagaggctgcaaaggcgagcagaagacttccttgcttttatatttccgcacgggttcttagaaaagagccagaattagcataaaattaacgacacataaagtgttggccccagtgccgtacagaggctgcaaaggcgagcataagacttccttgcttttatatttccgcacgggttcttagaaaagagccagaattagcataaaattaacgacacataaagtgttggccccagtgccgtacagaggctgcaaaggcgtgcagaagacttccttgcttttatatttccgcacgggttcttagaaaagagccagaattagcataaaattaacgacacataaagtgttggccccagtgccgtacagaggctgcaaaggcgagcataatacttccttgcttttatatttccgcacgagttcttagaaaagagccagaattagcataaaattaacgacacataaagtgttggccccagtgccgtacagaggctgcaaaggcgagcagaagacttccttgcttgtatatttccgcacgggttcttagaaaagagccagaattagcataaaattaacgacacataaagtgttggccccagtgccgtacagaggctgcaaaggcgagcagaagacttccttgcttttatatttccgcacggttcttagaaaagagccagaattagcataaaattaacga

SEQ ID NO: 1948 - DNA, 1496 bp, Heterodera glycines
ggatttttatgttttaacatattttttttgcggcttagttatggcgagagaagcccaaaaatagcattttctccgaacaatttttgatttagagcgagttataaaaacacatattttggcgttttggcacataaaaacatatggcacatatttcggggttttggcacatattttgcacatattttggcatttttgagaaaaatcgtaaaaaaaatacaagaaaatctgaaaatgcaccctaaaaattgactactttacgtttcttaagcatttagaaaatttctttatatatttaaatgcctaaagcagccaaatcaaacgctgtgttaaatcgtcactggatttcaaagttcccggaaggaacttattcaactgatggaaaaattaatccgggactttacaatttttggtttttagcacatattttgggctttttagcacatattttattacatatttcaggatttttagcacataaaaatcccagccctactgatatctcaatattttaattataaaatgctgatgtttatttaaaaaattcataaataacaaaaatcacgagtccataaatgtattgcattgagtacggcgagttgggcggttctcccccgccccgcacaaaatttagaaaaccccagccaattgcaaagtgcacattacgcttttattgtcctaataacctatttatgtacaagacacaattaaataatccattttggtccgatcacaattggagattagtgccgatcacttagccactgttgctttgttcaccatcaggtatgagcacaacgtgtccatcgttgtacgcgccctcaaacacggcgtttcccgaatgatacaattccgtgcgaaagttgagcagacagacggggcaaaacaggcgatatttgagccaacggtggaggcagacgtagtggaacacgtggtcacagatggtgcgcacctgacggacttgggtcattttcttcaagcagatcagacaaatggggcgcctgttggcagcttgcacctgaaaaggggagaaatgaaatttctgccttcgctctgtctggaaaagtgccaaaaagtgaaacgaaaaaacaattgagggacgcctagcacagctgcagaataaaaacccacgtttgcagcagtccctgcggcctcctttcttttgttgcccgtgtgatgtcttgccctggcactgcgtgctttgaatgggtctcttccactacccctgggtctggcgccattatgaactgaaaagtttaaggggatttaacttttattaaagaaatgaatgcaattaagtgcttgctctactgagtctatacgtccagacagcaaacaatttttatttttgcatccaaaaaataacgaaaaaagccatttgctgcaattattagaaccaccttttttggcagcattttcagtttaaggctttaagttgtctcaaagagaacgcattaaacaaacatttgagcgtaatatgaaaaaaagcatgcaaaaac

SEQ ID NO: 1949 - DNA, 3272 bp, Heterodera glycines
acgaatgtttgggttgccaaaagttgttgaggtgttcgttaaggagaataatatataatgaatggcgtgcacacagggaaaagtcgggaaagagagttgcttaaataggcaaatgaatgaaagaggagggaaaagaaggaatgacttttatagtacgatgcagcggggaaggggaaaaaattacaattgcccaaatgccaaatgttttttctctctttataaggggtgcttttctcatcggactgattattttttctttgaattaacaatctttgcattactaaattgcttcatttgtctcttcgttgctcaatcctctgtgttccaaaattccattttgtttttcatttttgaccagcatattgtttgattgttacggattaaccgaaatcgcgtttttttcttaaccaattaaacctaagacctaacccaagttccgaaaaaacccccaaaaattgcaatgtttcttattttgaaatttataattcatttcattatatattgtttttatatttttttcctttttttagatcagaactatttgcgtttatcatcatcatcccttcattgtgcaacaacaacaacacttcaaaagcgacctcatcgccgtttctcatcgttcgtccgtccttcacatcaattcgctcgccgttcgcaatgacacgtcgacgcatcaaacaggtggcgaaatgacaactctctgatcagccaatgcttaaaacgttttgatcaacttgcaggaactggcggagctggagcaggaaccgatcacgggttgcaccgcgacaccgatggatgacggcaaagacttgtaccattggagggcctccatcaaaggaccgcccgagtcgccgtacgaaggaggcacctttcatttggacatcgttttgcgccgcgactacccatgcactccgccaattgtcaaattcgtcacagacatttaccatccgaacgttggagaaaggggcgacatttgtttggacattctgaagcagatgtgggctccggcgttgaccatttcgaaaggtgaaagagtggacaaaacgccgacaaaatatcgacaaaacaaaacaaccgccataaccagactttttggaaaagtgtcgatattttgtcgtgtgaaatgggatttttcaaattcggtagtgccgttttaatctttacccccccccccccccatttcagtgctgctctccatctcttcgcttctctgtgacccgaatccggactgtgcgctgcggcaggacattgcgactatgtaccgcgacaaccgagaggagtacaaccgaaatgcccgtgaatggacgaggaagtacgcgatgacatgacacgacaaacgaccgatggatgggagaggatgcagaagacaaccgccgaagaggaaggaggaggaggacacattcagcttaccctattcccattcactattatcaatgtgttgtatctctgtgttatcatttcaaacgatttgtgattaattgttgcgcctaatgtgtgtaaataaatgtgagaatccaaaaagttgttttgactttattaaaattgcattaaaaaatcaatttttgaaggcctttcccagctccgaaaacccccgggttaatccttttataacagaattggtgaattgttaacagtcgctcttccttaagctaatgaagcggcaaagagtgccaatggatcattaaaaaaataattatttaaaattaaaatggagcggaaattcaaaatttaaatcataaaaatgacgggccaggtcgttttcgcgccgggtcgttttcgcgccagcctagtttttgaactataagttttttcattggcaaccaaatccaacttttttggcatcattcaatagccctaagtatcctctattagcctacaaaatttcaaaaaatttcgttaattttcaacaaacttatgaccaaaagtacattagaaaccgggtttttcagcttttttggccataactttttgaaccttaacgaaattttgcaggctaatagagcatgtgaagggctttcgaatgatatcaagaaaattagatttggttgacaatggaaaaagttatagttcaaaaactaggctggcgcgaaaacgaccggcgcgaaagcgaccccgacccggatgacgacaattgaaaaagagaaaaaaattgagggaaaaaatgtatttgtgattttaagaaaatgcttttaaacaaataaatttcttctgttctgtcattttgtctttattagtcatttaaattaaaatgcagctgtttttaatgtttttttattctttcatctttcatgtctaattaattcatttttacggcaattgaatcattggctttttcgctgtccaactgcttctgctggtcctcaatctgttgctggatgcatcgaagggcgatactgtgccgttccgatgttttctgcacaaactcaaatgtgcccgtcagcacatcagtcagtgacggcatgccgaagtccgccgatggcattttcgaacgcatcgaacgctttgtcaatgcgggagtcggtcggcagaatggtgtcgcgcaccattcgagtccatcgttcttctccgcttcggccaaacgcatgatggcatcatcaagaccaatgcggtcgccaatcgtttgggacgacgtgccgttgttgttgtcaagcggtgccgctggcagcatgatcacgcttggtgatcgccgccgctgctcatcctcacggcgccttgggctgctcagtggcacaactcatgtgcttcttgcatctgttttggctcgtttggcaattgctggaccatgaccatcatcagcagggtggttaccgtgtgccgcagcttctgctgttcttcgtgttccggcacgggtgttggccctgttactgttggtcgcggtccgatccgccagcctgccggcgcgggccatggtgttggggcagcgatgcgggttggcacaactgcgcgacgacggagcagcacgaggtcggcggtggactggactggtcgccatcgttcgacgagcggcactgctggtgctgctgctgctaacacgtcgtcttcgagccgacattcggttggagcgagcagagtgtgccattgtggaaatttaataaaaatggaattgtttaatggcgttttggagagactgttcatttgtcagcagcggtttatatagcattgttgcttctgtttggatcagcagtaggccaacgaacaatcaaaaatgtgttgttgataatatgctaactcgtcatgccgaacgggggagggagggcatgacaatggattag

SEQ ID NO: 1950 - DNA, 1812 bp, Heterodera glycines
  misc_feature (13)..(13): n is a, c, g, or t
ataagtccgattntgttcgcaaacacaaaaaagaaagtgtttttcctactaattagagcatgaaagccaggaaaaaaatgtatttacataaaattggcagccctactcatatttttatttttcagctgacaaatttttataagtttagcatcattcgaaagctctctacatgttttgaagctgtttgtaaaatatttctaagcgattcttataaaaaagttgcaagatgaaaaagtccgaatttttcgcatatttttatccccgatttacgaatcctcgtttccagagatcccgttttagtcatccccgctctccgtttcagagatccccggtttatacgttcctaaatcaaaggctttcaaataattgcttgttgttttaaactagggttgcacccccgaccccgccccgaccccgaaccccgacatttttggccatttttcggggttaaccccgacccgaaccccgacgcttccaaccccgacaaccccgaaccccgacccttaaccccgactcggggtcggggttaaatatacacccctaagaatggcatttttgtgagagaaagtcaagaaaatttaaacaagttttgaatttttgaaccattttgccaaatttttattaaataaagaaaatttgctttcaattatgacatgtattgtggtgtattggttagtgcatcacactgacattactgtctttcataagttcgataaccattgacgttctcatttttaatttatttttttgtgattaatactagagttcgggtacggaccggatccgtatacggatttttacggatccgtagtccgcattttttgggccgatacggatttttacggactacggattttccggatttttagtccgtaatccgtatgggtgcctagtccgtactcttggtccttatccgtattttctcaaaataccgatctctaattaatacattttttaaacaaaattatcaataaaaatagaccattcttggcataattgttaacagattaaacccaaattttcaaaaaatttttactttcgttgaaatttaaaattcaattttcatgactaaataaatcatgaaaacaatatatttcaaaatattgacaaaatatcgaaacaattaaatttcaaaattcgcttggccgagtccaaaaattcgtaaatcttattaaaaaaattggctcaaaatcgaaaatattcagcactttttgggcaaaatctgttaacagacccatgcaaattttcaaaaattttcccggcggcgcctatcggcaccgccggacccctttctcctgaaaagtctttagaaaaagcgcgccgagaaaaaaagatggtttgaaaaagaaaaaagtaatcagaaatttttgatcattttttgaataagattcacttttttcaaattgccggatccgaaaccggtttccggattgggaaaaatttaaattttcacatgttaatatttgtaaaaaccggcaaaatttcatttattaatatagaaattcgatgcaccagaaatgtcgccgccaaaaagacataatgttgccgacaaaataaaaaattttaaaattttcaagatattaaagcatacaaaaatatttatgataaaaaaaaaataaatataaacaaataaaactttattatggaaattataaaaaattttgactatatggcataaggtaaaaatttaaaaaccccgaaccccgaccccgaacgattttgttaaccccgaccccgaccccgaacttgctgaccccgacaaccccgaaccccgacttttctaaccccgacgttcgggggtgcaaccctagt

SEQ ID NO: 1951 - DNA, 5227 bp, Heterodera glycines
ctttagcctcttcttgaccagcacaaagctcgcctcgctgcacccatcggccgatgtccgacaatgaaatggcgccatttggattagagatcggaccggtcggttttttttcggttttttcggtatttttcggaaaccgaccgaccgaaaattttttgagtttttcggtttcggtttttttcggtttttataccgaaaccgaccgaccgaaataatcaaaaaaccgaccgacttttttcaaaaaccgaaaaaaaaccgaatcaaattggagcgatataacctgttaataataataaatttattgctttttttgtgctctttttcattttgaagaattttttgtaaaatattttctgctattttgagaaaaattattaacaaaaatgcaataaaaactaaaaatacacccctgagaaatggaaaattttatcaaaaattcatattcaaaatttatttatttatttacttgactacatttttgatttttaaaatatttatctcatttccatttttagtgtcccaatcgcagcagaaaagttgctgatcacttaatacgaatgattagacaaattatttgctgaaaaaagcagcaaaaatattttaaaattaaaatttttaaacaatttttaatgccttttataaaatcagagaaaacttaaacatttcaaatcaatttcaaattaacttcaccgggggctctgtttcttcaactctcctcgatggatttatttggaagcaacagtttgttcccgcccccgccgaaattaaaaaaaaacaatttttttttatttctagaaaaatttttaaaaagctttcatcgattttttagaaagcttatgattattttttaaattttcccagaaaatctttttattttatttttcttgaaattttctttgaataaaaattttataaatttttttgaaggaatttctaaaaagtccgttttaccgggcggcccggtagtgacaccattcaattggaagaagggaaaagtgtgctaattaccgcaaagaatgaacgaaaaattttgtaaaatacacccccataattcaggatttatccgaaagaatttttttgcggcaaccaatctctgaagagttaccgacccgggactgaaatggccatatgcctttgggactgaaccgtccaattactgaaaacgcatgaattgcgacaaaatagataccaatcgactcctctcggcatgtaacccacgaatctgaaagaattttttgacaaaaattaaattgaaaaaagttgtgggacctcaaaatcgttaaaactatttttaaaccagtagtcagtgaatttagcttattgcgctaaaacgtgctgagtcgaagcacgaaaaagtgcaaagtgaacaaattaaagcaaaataattattaataaattaaaagcaaaataattattttaaataataataataatctacttaattaatgcgtttattttataatatttttaaatctcaataaaactaacatttatagttttctcattttttattaaaaacaaaaaatcagagacttttagagggatggggtcatttcagtacagaaaattatattaataaataaatttaattattttaaatgtatttttaaatattttccatattggttcgaggcaataaaatccatcaatatattttttgcccattaagtggattgcacttttatttttattcacaattgtatctttatataagcttttttgccatgccagccgaccactttttaacgagacgtaggaaaagccgacgaaaggaaagcaaatgctaattacagaaatttatctcgatcttaattttttcttctctcactgattttttgtttttaataaaaaatttttgaaaaatggaggccaaaatggcaaaaaaaaattaattttttggcgaaaaacggcgaaaaattttgtaaaatacaccccataattcaggatttcaaaaaaccaaaaatacacccctaaaaatcgacttaaaaaagaaaaatacacacctaaaaatcgaattttagacttcagcccccccccccaaagccaagggtctggctacgcccttggacgacggtaaggaattaattattaatataaaaaaattacaattttggtctccaaatggcattgctttcttatcgttttgatgttttggtggacaaatattttggtggaaaaagcgaattgacaatttggaatgcgatgacaattttcgactgcattggatctctggaagtatatgtacggattgatggcaaatttgtgcattttccgttgccgggccgtcccctgcccaataaaattcgttttcgttcccttcactttgggtaatttgaaagtttgtatatattagcattttcatatttcttcaggtacattgaccattccgtgatcacttttttccgttccaacaaacaaatttttgacagaattggcatcgaattggaattgtttattaattttattaaaaatgtccagccaatttgggatgtttttgtgtgtgaaatttggccaatttttgcaacaaacattcgccatttgcgccttggccgtagttataatttggacaatttgcgtcgccgcacttcgccgacaatcttcactgatcttgatcaattgaatccaatcgattccgttgatctgttacccgatgtgttcgctgatgatgggccaaatgcaactgctggccaagcgttggccaaatggttgcacactccaagcactgatggtcagtcgaagcgcttgttatgccgtaattattcattaaatttcgaatggctcaacaatttcatagaggtgatccgccatattttcgttaatttgtttttctcaattttgttcagacatttctccgtgccaccacttctgtcagttacaaaattcgaaatgatatgtcttcgtcaacaaggccaattgagccatttgaattggtgaacgaacggaccaaagagaagttgacactgacgaacgatggatttggttggctgttgaaacggtgcccaattattgtggagatggcggcgcagaaatatgaaatttttggctattggaaccgagtcatcttccgtctgtgaaaattacattgggtgagcagaaggatgcttttgtatagagcacggacagggggacagtatcccctgtacagtactttcccagaatcttggtcctcttgtacgttttggaaacgacaaggaatccagttaaaacaggacttcagtccttgtcttgtccctcctgtcctgctggtccatcggaaaccatggtcttggttccagttttttccaaaattctccaggctctatttttacaaaaagattgttcatccaattcaaattgtgcttaatttaggcctttgtctccgccaacagaccaaagcgacgaaaaagtgttctcttttcccgggcccagtgatcagcggaagaagaagtgatcatttgacaaatgaccgatcatttttgcgttatgatttggaatttggataaatattgtttatctgacgtctcaaaatttcataactaattcttaccccaattcaaataaatacacccagtatcaccgacaatttttacgatgaattggcaaataaaaactaaatgacttggcctgctgataatgaaggtcgcttgaaatttttatggctaataattttatcaaataaatttcaaaaaattcacaaattctcaaaaaagaatttatatttttttcagaaatgttttgaaagagttcgaaaagtctcaattccgaatatggcacatcatcttcggcttgcaattccaattaacattggcaagtgccgccatttaattgagcctttccttccgccaaaatgtgaagaagcgcgagtgctcttcattttagtgatgccgaggaataagacaaaagaaaatcataatttgaaaaatttacgtacgccaaaagtcactttttacatttttgttttgttttgctgcgtgtactgctccaaaatcagcaaaaattcaaagtcgggaaatgttcatcgccattaactgctgctgctcattctccattattattctctgctcctcaacgatgttttttgccgttggccaaccgaacactttggaggcaccgctgctgctgctgttgcagctgaacgtgttgccgaggacggaaatgccaacagcgacggcactttgcctggcccaatgacttagactttttgcaaaaatgggcacttcgcgaaacgtgcaaatttaaccgaaagagaccgggcctcatcagtacggtgtctctttgggttaaataatttaaattaattattatgtgtgtttcggccctaaaccgtatacacacaaagccacagcaatcaagcaaagcaaataaattttattaagcaaaataaatatttatattggtttattttattttatttttaactaattattttgaatatcattattcaattttataatttgttagtagtatttttaaatttattttgagcttgcaaggctccaacatttgcattatctgtgtaaaatcagttacacatgtacaagtctaaacgttttccattggctaaacaatatagcaagataaggggaaggttttcttcgtctttgtggatttctctctgcttttgtacttgtcgcgaaatgacatagcaccccgaaaatgggggactgtgaaatttggcatttttattaaattttttaaaaatggggcatcaaaaaatgtccctcttctcctctcagttatgccgaggggcactgtgccagctccgttctcagctggcccagcttggttatctgatcgatttgacaaccgaagaaatttattttttggctggagatgcagccaccgttgggccctcatcgactggtgccggtacaacactttaatcccgacatatgccgtgccaagtgcacaaaagcgtgtttttggcactatcacaaccactgacgctgaagttgcagcaatggcggcacaacaacaaaaaggcgaaaaacctccagcggcacgttgcgcattgtgccggttcctgctatacaaccagaaaaacaacagctcgttgctgctgatcaataaggccgccgtgccattggcgcaatgctccgaccactggtcaaattggtatgaaattggctgtggttggataataaatgtccaaatggatttgaatgattcccatacaaaaaatggtgcttggtcattcattccataaaatgcgcctttttctataaaagttttggtaatagtgtacttt

SEQ ID NO: 1952 - DNA, 1062 bp, Heterodera glycines
  misc_feature (684)..(684): n is a, c, g, or t
  misc_feature (694)..(694): n is a, c, g, or t
  misc_feature (790)..(790): n is a, c, g, or t
  misc_feature (872)..(872): n is a, c, g, or t
atcatcactcaatgctgcggcggtggacagaaggtagcgatgcttctgtcgtgactgattttttaaaataatttccctttttcattttcagaacacggaagagccgcaaatgccggcgggaccggaaggggcggaggccagcgccaaaccgacaggacagagcgcagcacctggtggaacttcagcagctggtggaacttccgcggtgggacagcagccagccgacgcctccaagaaatcattggctccagcggggaccgcatcggccggtgagaggagagggacgggcgggcggggaagcgtttttggttcactctaatactttcattcccatttttagcagttccttcgacgtacgcggcgcccggcacggggacgactttgagcaccgcatcgcagaagtcagcagcgcctgctggaggagcctcggcactgagcaccgcgtcgcagaagtcagccgctggaggagccatgtcgcagaagtcagcagcgcctgctggaggagcctcggcactgagcaccgcgtcgcagaagtcagccgccggtggttccgtgtcgcgggtgtcggcggctggcggagccgcgtcgcggggggcctggtcgtcctccggcctgcgcgggtcctgggtgctctgcccgccgcttctgtgctgttcttcgtctgtgttcggcgttgcttttggntgctcccgtnttgttcccccctttgtgcctcgtgtgctctcttgtctgtgctcgcttgtcgttgtcccgccgttgtgtgctcgttctttgggtctctgtctgtctnttgtgtgtgtgtctgcttggctttccgccgggtctcgctccgcgtgttctttctcgtctcctttttctgctttcggtttttntgctcggttccgccgcccggtctggctgtttttgttttggtggtttcgtcttttgctgtgttgttttcgcgccgtgcttgctcgtttgtcttccgccgtttgtttgtgcgccttggggtttctgccttcgttctttgtggtctggtttggttgtcggcttttccgcttcgttcttgcggctttttggttt

SEQ ID NO: 1953 - DNA, 1748 bp, Heterodera glycines
atttatactctatcccagaaaaatggctatctcttttttggagaaattttatgcctcacaaaagcgcttgcgtatgagacggagggcggtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaagtttatactctatcccagaaaaatggctatctctttttttgagaaattttatacctcacaaaagcgcttgcgtatgagtcggagggctgtgcacaatcgccattttatttcacagaggatttttatatttagaggttatcccagaaaaatggctatctctttttttgataagttttatacacatccaaatcattgaggtccatagacagagatcagaaatgattataaatgatctcatagagttcccccatatgtgcctaatgtgctctattgtctgtgatcacttgtcattgtaaaaccgttgtgtgatcattatttgggtatatgtatatatattgtatgtatgtataattggctaatcaccggatatcgataacacgtgataattcaagtatacattttcaaaattcaaattttatgctcagttcaaaagcacgaactggctatttttattttggaaaaaacgtattttgctgtggtattttcaagccgtaattgatcgtttgtcttcaaaaatttgattatgagcctaggggtaaatgaattcgttatttgtggtctgatttaattgtcagattttcagcttaaatattgaggctttttaatttctatttgcaataaaccaatttggatgagacgcgtaaaacatttttcagacgccaaaatgtcatggtacgcgtaaaaccgagaacaccacgtagagaagtttaaaaaaaaaatcaaatttgatgaaaaatgatagaaaaatcggtacttgtgggttaggtagcgtccagattttcaaaaaattttttttgaaataaacttgctttaggggttttcagggtcggagaaaccgattccggtatctattttcgcccaattcgaactccgaacccggattcgaacaaaaaagtcaaaatccatttttcaaaaaaattcacattttagagacaaaattgagtcatggcctttttttggttatacgagtcgtcgtcgtgccattttttggttatatgagccgtcgtcgtggcattttttggttatacgagccgtcgtcgtggcattttttggttatatgagccgtcgtcgtgccattttttggttatatgagccgtcgtcgtggcattttttggttatacgagtcgtcgtcgtgccattttttggttatatgagccgtcgtcgtggcattttttggttatacgagccgtcgtcgtgccattttttggttatacgagtcgtcgtcgtgccattttttggttatatgagccgtcgtcgtggcattttttggttatacgagtcgtcgtcgtgccattttttggttatatgagccgtcgtcgtggcattttttggttatacgagccgtcgtcgtggcattttttggttatacgagtcgtcgtcgtgccattttttggttatatgagccgtcgtcgtggcattttttggttatacgagtcgtcgtcgtgccattttttggttatacgagtcgtcgtcgtagcattttttggttatgcga

SEQ ID NO: 1954 - DNA, 6031 bp, Heterodera glycines
ttaagtaatgcttggcaattcgttgtatttttgttcctttgagttttgcaatggtcggatttgggttcgggattaaagtagcacgatgtttagattcgtgatcactgatcaagcgaacccgaaaacctataaaaattggttttaaaaatttttatataaaaaattttttgggccgtaaactgcataagtagcaagaaaaatatatgtaagaaaagaggcaaaacgttcaaataattttgtggagttttaggccaaatttgaaattttattaggattttgtgataatcctgcagaatttcggtcccgacgaaaaataaagtaaaaaactaatatgtacccaaatgttgtaatttaccctaataaagacaaattaaaaattaatttttcgggaccgcaattctgcaggattaccggattttgattgcggcggtacggtaggcacctaatttgtaagggaaagaaaacacaaatttgacatttttattaatattttgccgaaaaatcgaattcttaccagtatattttactcccgcatatggtgagaaaattgtaggaagcgggatcgggaatccgaaattttcccagagtgggatcaccaatcccgtaaaattcccgagggagttccgatccttccggtctgaaaattttcaacaaaaaattgttcaaaagcaattaaattttaattcttcatattattcgataaccccttcatgtttcctattaatatcctgaaaaattcattaagatttaacaagttatggccaaaaatatacaaggaaccaggttttcaagcatttttggccataacttttttgaaactgcgaaattttttgtaagttttcaagctagtagagatttctaagagctactgaaacacattctgattctctttaaaggatagcgaatgaaaaacaaaaatttgattggaactttatgattgaagcaggggcaatttttaggtttttgtccgtgataaaaaataatcttaatcccccctaaacataatccatgcattatcacgcgtagtcctttttaatgaccaagttatttgttaattcttatcaaaagcaagacttatttgtcccctgtaatactcttaaaaatacaaaaaatttcgctgtttcaaaaaaagttttggccaaaaatatttgaaaacctggttcattgtgtatttttggccatatttgttcaaccttaacgaagttttttgaaattgtacatacaggctaatagagaactcttaagactatcgaatgatatcaaaaagaattaaatttaattgcattgaacaaaattatgggtaattttgtgtcgaaattttatttgatagtttttaattttataacaacatagcacctgggaaagtaaatttttttcttcataaaaattgtaatcccgaatcccaacccgacaattttctcgaccagcggcaacactgattgcttcaaccgaatatgtcgtcggcatccgtctttttcttgaataaaatttttgaaaaatatttattaaattgattaaataaaaaatatatagcttaaatttgtttttatttgaattaagccaatcaatatgtcaagcacagttttggtcgttaaaaaaagaaaaatagcaataacattaaagttatatcgcttaaaaatttcaaaaagtttaaaaaaagtatttttataacggaacctttaagtaaatccaagttttaaatggattttgcaatttaattttttcataaaatctttaagtaggcactatttaggttttttaaaatttcataaaaataacctgcgcaataaattagaataacatacaataacaaatctaatccccattacgtcaagggaagaaatattggcatttattacgtaaattagacgtcaaattatgcatatgttaacaaaatattaaaatatttacgtaaatattatttggacgtcattttctgaaaaaatcatataaatatattttaacaaaaataagaaattaaatatcatttaaattcattcgattacgatgttttactcaattgctattccattaattcaaataatttttgtaaatttatgctttggcaacgacgaaagcccaaatgatggccaaaaaactcaaataaatttattaaaagaagctggaaaaaagccgggaaatgagttgaatttgaatgaagaaggcaattcaaatggcaatcaatcagctgataatgaagaaaatgaattgatggtattaagcagacaaattcaaaacaaagtaaaagtttaaattggcaaaattattattattaaaatttttaactaactttagggcaaagaaaaggaaaaagattcacttgaaaaggagagtcatttaataacaaaaacgaaagagcaacaaaatatatttggtaaaatcattttaaataaaaaattttgaccaaaagcgatgctattatgctggccgcaaaaaatgtttaaatattcgttattttctaacaaatttttgtccaaaaataaaaaatattcgaggaatttagtatatttaaaaaaagagtatttttacgaataaattggcgccgctgaaaatttccaaaaaatataacaaattaaaaagaaaaaacccaatttttctctcatgcaaaatttaaaattgctaaccattgaactataaggaaaattatgatgaaacttaaacatttgaaatctctaagacttaaagattttgatttaaacactttattacagcttttagaaataattttcactcttgaactctgtttaatgacaattttcttttgcttttctttttcaaattaattttagaattgccaacggaactgaacgaatttgaacaagatttattaccattaccatgggcattcgacaacgatttgttgcttttaagtgaacaaatccaaaaacaaagtgaaatgctgcaattagcgaaaagtaatgaaaaagtacaaaaaacaccggcggtggaaaagcgacaggaaaatgggaaagcaaaggcggcatgggtggattacggtaggataatacaacaataaacggctttacaggttttagtacagtataccataagccttgtcggtttttgtcagattaagtcaaataatttacaaatgacaaccaaaaaataagtgaaggattgatgaattttttaaaattatcatctgatagagtcaatttctgctgcactattttacgtttttaaatgaattgcctcattaagaaacggttgcccaaaagcgatcacgcctttcccttgctcaaacttctggcacttctaagcccaattggccgaataaaattgcttcattggtagatatttttttggaaaaaagtaacaaacgatggcaaagcgtgaattgcaagtgtttaaaatgttatacgaagaatgcaatgcaaaacaaaaattgctgatccaaatgagcggatttggagtgggaaaaacactttttacttttttaaaatcaaaaaagcgaaaaattaaagtgactgtgactgcaatgggactgtaaaatgtaaataatgaaatgcaatgtgtaaaattttgcatgaatgaatggtatgtgtggaaaatagggagagatgacgacgacaaaagataaaacatcgatttcattggatgcgttgtaatttatttaatgcttttttaatgtgcatttttaagagaatgcgacgtattcattcatattcacatgaaaatcggggaattcgtggcaatgaaaagagagagaaagagagccacggtcttagctcctttatttaagttttcaccagtttcaaagtgtaattttaggctttgaatttaggcattaaataggcacaaaaataggcaaaaaaaattttaggtagcaaaatactagagaccggattttccaaaagtgccggaccggaccggtctgatattttcagaagcaaccgatttccgggcccggcctctcaaaaaccggtcaaaccggaaaaccggattttcaaattgccgggcccggaaccggtttggtaaaaatttaaattttcacatgtatttcacccaaaattgaccataaatcgtgccagatgtaaaatttcggatctatttcacttcaggcgtcaataaatgacctcttcaataataaaatttcaaaaaaataaaaaaattttaaagaattttttgaaaaattttttggtaaagtgcattagtacaggaaaacctagtaagtaattctccataaaaagaaaaaaatttctttcttagatatttgtggaaaattttttaagattttgaaatttctgtttggaaataaaaaaaatttgcgattttgagcaaatttttaaagaaaattaaggatttttagggtccggcggtgccgataggcgccgccgagaaattttttgaaaatttcgatgcaatttattaacagaaattgtataaaaatgaagaatttttggctatatcataaaccggtaaaaaccggtccaaaatgccggtttccggaccggtttggcattttcaaaatgaccggtttccgggcccggcctctcaaaaaccggtcaaaccggatttttccaaaaaacgccggaccggtttgccgggcccggtaaaaaccggtaccgggcccggtccggtccgctctctacaaaatacataaaaacttaatttaaacatttaattttgcttatatttcaattattttaaagttttttcgaataaggacaatttttaaaccaaaaaattttaacaaaaatgaataaaattttggggatcaatttctgtgaaaaatttttcaattcttaggagtgtattttttgatcgaatcttaggggtgtatttttcatttttattgcatttttcttaaggatttttccgaaaattcagaaaaaggcgcaaaaaaggcgaaataggcataaaaataggcattaagcacaaaaagtccaaaattggcaaagttagatgttttttcaaaaattaatttttagaaatttacacttgaattatcacgtttatcgatatccggtgattagccaattatacatacatacaatatatatatatacatatacacaaataatgatcacacaacggttttacaatgacaagtgatcacagacaatagagcacattaggcacatatgggggaacaatatgggatcatttaaaatcatttctgatcactgtcgatgaacatcattgaagcgggttgtagagcatcttgttcttgtgctgtccggtggttgttcaggccttctgcgacgcggctcctccagctgccgacttctgcgatgcagtgcccagtgccgacgctcctccaaccggtgccgacttcagggtggttcctccggcggccgacttctgcgatgcggtgcccagtgccgatgttcctccagctggtgccgctgcggtcttctgcgatgcggtgcccagtgccgatgttcctccagccggtgctgctgccgacttctgcgatgcggtgcccagtgccgatgttcctccagccggtgccgctgcggtcttctgcgatgcggtgcccagtgccgatgttcctccagccggtgccgtcttctgcgatgcggtgcccagtgtcgatgttcctccagccggtgccgtcttctgcgatgcggtgcccagtgtcgatgttcctccagccggtgtctgcgatgcggtgcccagtgtcgatgttcctccagccggtgccgtcttctgcgatgcggtgcccagtgtcgatgttcctccagccggtgccgtcttctgcgatgcggtgcacaaagtcgtccccgtgccgggcgccgcgtacgtcgaaggaactgctaaaaatgggaatgaaagtattagagtgaaccaaaaacgcttccccgcccgcccgtccctctcctctcaccggccgatgcggtccccgctggagccaatgatttcttggaggcgtcggctggctgctgtcccaccgcggaagttccaccagctgctgaagttccaccaggtgctgcgctctgtcctgtcggtttggcgctggcctccgccccttccggtcccgccggcatttgcggctcttccgtgttctgaaaatgaaaaagggaaatta

SEQ ID NO: 1955 - DNA, 978 bp, Heterodera glycines
ttttacagacattcctccaagttgtgctgatcagcttcttcaacggaatggctgctggcatttacatttacatgcagtcagtgccgctgacccacaaaatgtccagcccacgaaatgtccaagtctcgaataaaaatcctaaattactcattttgtttttataaattttgaaaaattttggacatttcgtgggtttttactcttttggacatttcgtggcttggacactttgtgggggtgccgtcagtgcgtatcagcgatgcactcactgatcatcgccggcacatacgcatggcgttggcacatggtactcaaatgggcgttttatattaaaaattatacacataaaatatgcatataaattctcgaaatatgctgaaatatgatccacatggaaaaacgttatagaagtttcaaaatatgtttttcttacctgtttgaccattttcgatgagccgatcgagataaaatttattgagcatttctaaaaatatgcagacccagaaagtcggaaagcaaaatgtaagctagaaaaattttgacattttttcccgaaaacgagtgtttaaaatagggacattttttcggaagcctagaaatccctaaatacactgaaaatgtgaaaattttcgaaaaatttaaggattggaaattttttaaatttatacattgaataaagttaaaaaaattagataaattatttatttatttatttaaaattccgccgctgatttatttggcactgaacaaaaccattcgtacagactttgtgcgctatgccaaaattattgtttacaacaaatgtacacatcgttctcatcaacagcaagcgcaaacactcaacataatgccaatgacggcattgcgcggggtccaattgagaggacggaacaatgccaactttgtcggcacaaatgccaatttcagcacccgcggaaatagcaacagaacacgaccaatatcatatgcattttaatg

SEQ ID NO: 1956 - DNA, 2335 bp, Heterodera glycines
acattttgatcgactgcataaattttttttttaatatttacttatcaattcggtaattatgcagtaagaaaataagtcttggattttcgtaatatatgttgggttgaaattttttgtgggttttttagtctgtttaataatcagggctgcaaaaaatatgcaaatgcatatttttttcctagcttctccatgctctaaattagagtgcagcgggaccgggacctgaacacggacaactgagtaccaaggtcccggttttgaccagtttgaccgggaccggaaaattcccggcttttttcccggttttcccagccaaaagtcccggttttcaaccaaaaaagttttttgcatattttgccacttttcgtgaaactcgccttcgttgagagttaaataattgttatgttgaaatatttttttattaattaaaatttcatttacataaaaatggtaaagaaaatatgaaaaatattctatcccagtaatttggctaatttctaacaaaattcatatagtcttaaaaattttccgcttgcggcgccaatcgacaccaccggacctctcccctcgcacattcactaagttttttggaaatgtgccgcaaaaaatgttaaatctgatttagtgatcccgaatgaactgaaatttatcaaaaatataataatagaatgaatacatttttgatcgaataaaatgtaaaaatatttgaagcaattttgcaaaatgttcttatttttgaccctaaaatcttattttttggcctttattcttattttgaaaattttgaaatagatttggtcatttttagacaatatctatgcaattataccaaaaaagaattgaatcgaggcgatatatcgaataaaggaatgtggagccaaacacatcattcaaaaaaaaaattttgtgccacccccgcccacggggtccgaaccctagtaataatcatttaaatgaataattatcatgcaattaatgttttaattgtctgtgtggggctcaaaccaaggcaacaattaaagaaatatttaattattatttcttctcgaaaaaatgttcctattctccaaattttcaaaaaatattttctctcaaccccatcccccattcaccagtgcttgaaaatttcgtatttcgtgccaaaatacgaaaacgaaacggcacaaaaacacgaaaagatcaacattcctgatgtatagtagtgaagcgttgatgagtgttaatttcaaatatgacccaaaatgacaattttccctgagaaggggggcaaattggtgacctcggcattggcatcactgtccgcgaatgtcagttattaaaacaatctttgggaaatgagtaccataaatctcctcccccctttcaaagtccatctgttcattttcctctaactaacaaatgagtcaattattctcaactccaactcctcctcctgccttcatcaaagcaattcaatcttctctatttggaaacatctgaaagacaaaaatttttaaaacccggggttcactaaactgcatgggcccacctcgtttgggcgctcatgtttgggcgatcacatttgggccatcacgtttgggcgccagcgtgtttttccattataactttgttatttgtcaaacaaatccaacattgttggtatcattcaaaagtttaatgtgtttagaagctttttataagctattgtaataaaattttttccaggcttgaaaatctttttattttttgtatggataacagagcatgttaagagctttcgaatgataccaagattgttggatttggatgccaaagaacaaagctatagtggaaaaacatgctggcgtccaaacgagcgcgcccaaacgcatgggtcgcaaactggataaatgctaattttgccttggattatattttcattttttaatctaatataatattcttaaatgaaataaaaaatagtctaaattgaaaacaaactttagtaaatttcctgcgtttgttgcttaaccttttggcttttatgaaatacatgaaaacaaagaaacgggattccgttaaagaattgacgggatcaggaaaaatgcgggaatcccgtccccagtttaggtatggacgagggtaggtcgggaccgggaccaaatcacggacaacgctggagcgcgcacagaaaaaaaccgcggccgtgcattcaaattgccgcggccgcggaccgcgcaaaaaaaaaaaaccgcggccgcgcaccgcgcattcaaattgccgcggccgcggaccgcgcaaaaaaaaaaccgcggccgcgcaccgtgcattcaaattgccgcggccgcggaccgcgcaaaaaaaaaaccgcggccgc

SEQ ID NO: 1957 - DNA, 2321 bp, Heterodera glycines
tttccaggaatttcatagataaagtgaataaacaagaaaaattcattcataagaattgtctcaaaattttcaaatatgcccctatagtaatgtaaaaataagtttattgtaaaaatcgtttccaaaatatatttttgtatatattttctgggcaaattgcaattgtgcgggtgaaattgggaatattgtgcatattgactatggaatattcaatttaagcccaaatagtttcgcatattaggtaaattgaaatgttttggccataacttttgtaaacctttacgacattaatagatattttgcagtttaatagagaacacttagggctttagaatgatcccaacaatgctagatttgggtgacaaagaaaaaagttatagtccaaaaactgggctggcgccgaaacgagggtgctcctaaaaagagggctcttttgtaaaaattttcttttttttggtctaatatcacataataatgaatagccgggggttttccaggtcactgatcacgaatatggcacccaaaaaatgatcattttgttcagattctaacaaaagcaaattttcaaaaattcgactttttgttcgaagttggtttctcggaaggcccaaataattgtcatattcgtgaccaacgacctcgaaaacccccagatacttggttcaggactttttaaaccgaaaagaaaaatttgaaaaaaatttagggcaaaaaaaagtgaaaaaattttcaaaagagccctcttttaagtagcgcccttttctccttttcaagaatgggcacacaattaggtatgcattaatactgtgtgttcagaaatgacatttttttaggcgccttggcatttgatggcccagtcaaagacattcatgcaaatgtggcacgtaatttttaattgacgaaatctggcaatatttgattattatccctttgttttttggctataacttttttatttgccaaccaatttcaacattgttggtatcattcgatagccctaaatgtcctctattagcctgcaaatttttgaaaatttctttatgctttaaaaaagttatggccagaaaatttcaaaaaacatggttttcttaacatttttggtcataactttttttttaaacaaaacgaaatgtttagcaattttgcaggctaatagaagacatttagggctatcgagtgataccaaaaatgttttgatttggttggcaaagaaaaaggttatacccaaaaaacatgtgttcagactaaaacgaccccaaccgaattttgcatggtcgtcgagtctatgatcattttcaggcggctttatttgatggaatgggcccaattaaaaaaacaatataaaagttaatgaccaattcgtatttcaatttagggaaagtctcggcatggaagaaaaaacggaagagaattttgcggacttcgtttttccgctcaatgacatcaccagcgactgttttcaacagattcttgcttggatgcgcgaacatcacagtccgttggcacttacaattaaacataataattaccagaatcgttttaccccctctaaaattgataaattcataatcctttaatttcccaacgggtaaataaacagtcgagcacactattccacctccataggataagtaaatattagtgaatgttagtgtttttacggatgcaaaaaatttcgctgcccaaatttcgccgaagaaattttttaaaaaattttcaagaaaaaaatattaaaattttttatatgaaaattccaaggggaaaatgtttgtaaattttttttttatcgacttttggaaaaattttcgaaacaatttactaatcaccatatatttcatggaaaatcgctgaaaaatttttttttttttaattttgtctctgcgaaatttcggctgctaaattatgtcccgtctcctgtttgtacatcgtcgggggccaactgagtttctgaaattttggtgacacaaaaattcggctccttttcagaccttgccgagccaattgtcaaggaggacccggtgacgcaggaagtgagtgctcttcaaagcaaactgtgaaaagaggccactttaagcgcatttggttcaaattcaccgattgggaacgccaattcttcgacgttgactttgaaagggtcaaggaatactttttggcctccaactttttggacattcgttcattgtacctctactgtaagtaaaaaaaaaattttttttttccatataaaaaaggaaccattttacggttggggtcgaatgagcgccagcccgatatttttgaacataactcttttcatagttccccgaaaatgagactctaga

SEQ ID NO: 1958 - DNA, 2803 bp, Heterodera glycines
tttttcgtgcgaaatttaaattcctttatttttagcgccgggggctccagccagtcgtaatttttcaattggatgaaaaagggatcagaaaaaaaatcattttgacggcttggattttcttaacgactttgcattgttttcttttgtttctcctttttatttgcttcttaatttaacaaaataaaagttcaaatgcctttggaaatttttgttggactctgacgggcgcttcggctaattaattatactgcaaaattttgtgtttaataaataaaagggaataataatttacttttaaattaattgttaatgcatcatccatttttaatcttattttgcttaaaaaaatacatagaataatttgcacacagtccgggttcgaacctgacccatcccccctcagaaagatgcctcagaatccccatttacgaatggattttgaggccttaatgaatgcatataagctatataccaaaaagttacagggcctccaaaatcgaaaatttggctgtgttttcacatgaagttggtggctcagttggttaaattcctaatttttggggtccgggttcgaatccaacgtaaaaataaataaatgtaattaaatttttaacaaattaaagattttaaaaatacatttttaaatagggttgcaaccccgaccccgaaccccgacatttttggccattttcggggaaaaccccgaccccgaaccccgacgcttcataccccgacaaccccgaaccccgatcggggtcggggttaaatatacacccctaagaatggcattttcgtgggagaaaatgcaaaaaagttagacgaaatttgaatttttttaaccatttgccaaatttttattaaataaagaagatttgctcaatttggaggtgctgtaacatttcgacagtggctgatttcgacagtgacagatttcgacagtgactgatttcgacagtgacagatttcgacagtggatttcgacaatggctgatttcgacagtgacagatttcgacagtggatttcgacaatggctgatttcgacagtgacagatttcgacagagaattaaattattattttattattattatgtattcacatgaaccatccggaatccacggtttgcccgaagcaaactgcctcagggtcaaactgacccaaaaagtcatttttatttaaaaaatcactatgcttaatgaaaattgatatatgtgtgtagtaaaaataacgcatctttctcttattttcaatgtggtaaaattcagtggtactttggccgttggatagtgataaggccggtcgttcagtttatctcgggtggtcaattttcttgggaggtcattttgataagagaatttggagaggaattgttttggcattcccgaatgctgatggtcattctcgagttgtaattgctggtgttcatcatttgctgtttttccctctattccttttccaaattcattggctcatggctcttctccgattcgcagaaactaaaacaaatcgcgggaaaattcttctatctcgtggtggatatgagtacacttttgaggttaaaaagctaatttaatttggtgaaaatgttaaacggcaagttctaaaggcggtttcaaaaactgaagacggaatggagtattggcgttgccctaaccgtccaccttattgcccagggcgtgcttgtgtacaatgccgcagggaagtcgatgacgatgggtcgcaatataaaattggacgaattaccgggcagcataatcatccacccgttttgggtggtcatatggtagaaatttaaaatgtaaagtgcgttaagtagctaattaggtgagagaagcatctgaacgtctccgacaagaggcgaaaagcgaatttccgacaacaagccgtaacatcatcagagaagttcggtcgaaccttagtgatgaggttcgggcaatcagtgcaccatctgcagccgacatgaggcgaacatataattatcagaaacggaagcatcaggaagaggcaaaatgataatttaaaaaataaattaaaacaaaataatatttaaaaataattggttaggtcggcgatgttggattggatgtctacccgcatcgcaaatcacatcataccggacagattgcgtgatcgtacaatttatgatcaaacagttaatggggaaaaatgatcattttttgttctcgttttgacctcgatcttttggcgaattatcactttgttatctaattttgtcgtattctcgaaaccatcaatttgacgtcttcaaatgttccaaatggcaaagttaactaaaccagatacaataatattcgaatgcacaattaaaataaaaattcaaatttaatttcattagtacagtaaacagtaaattttaaaaaataacatttccttttttatgtgaataataataaaataataatttaattctctgtcgaaatctgtcactgtcgaaatcagccactgtcgggaatgtcggaaaactgtaaaataaatgaaaatatttcactgtcgaaatcagtcactgtcgaaatcagccattgtcgaaatccactgtcgaaatcggtcactgtcgaaatcagccactgtcgaaatgttacagtaccgactggatgtagtccacttggccgagtggactacatcccagtcacaacaaaaaggaacttcaagttttatggctccagtcacaaggaatgaatgatgtgccttcaggattggttacctccgtcgggctcgacttttcagtgcaatgaatggtgcacctacttcctccctcttaacggccccccttgatgaatgatga

SEQ ID NO: 1959 - DNA, 2060 bp, Heterodera glycines
ctgtcgaaatcagccattgtcgaaatccactgtcgaaatcggtcactgtcgaaatcagccattgtcgaaatccactgtcgaaatcggtcactgtcgaaatcagccactgtcgaaatccactgtcgaaatcggtcactgtcgaaatcagccactgtcgaaatttcctggcacgtactaaactgacccggtccgagaaaatgcatagtcataatcacttaaatgaataatttatctttgttattaattaatgttttaatggttacctatcatttcgtcactgatccgtcacgttcatttcgtcactgagatataattttaaaaaatattggctaatttcaataaaattatcttattaaagtattacctaattggtttaaatttctcaaaaattatttctgggtaggagtaggagtaccaccggtggtagcccctttttcgaaaagatttttagattttaaaaaggcgaaaaatgaatttataagggttttgaggtcgcagatcacgaatttgagtgttatcctttcgatgtggattttctgctgctgctttctgtataaattccagcaaaaatgtgacgcaaattattgtcttgatcaacatagagggaattgcgctacgactttccctctaatgctattttctgacgcattttcataatcagcaacgaatgttactgtaatgactgatcgaaaatagctgtgggagctcaaagtgctgtgggagcaaaaagcaaccggggccaaaatgaaggaaagatggccccataacaacagtcatccctccagtgttggatgtggtctagtggctaagacaacggatccacgtaaggggccacgagcggcggttcaaatccggccttacaccccaatttttcgcctaaataatagttaccatcgctgaaaactttaagcattccttttaacaaatttattgatgaatgcatgatccctggttttttgtcggagttgaatcgaattggtcattttatgaaaataaaacggaaactcaagtccacaatttgcgagaaagcctatggaagtatataaaaataaataaaacaaagaattttcaataattaactaatatttttaaaaattatttctcagtgacgaaatgatcggccaccgttttaattgggatttaaaaatttataaatttgataccacaaatggttgaaatagcgaagacgaattcggacaatattacaattttagcactgtccggcacagaattagggtcaggtgactaaaaataaaacattttaccggaaaatggattgttctgttttaaactcaatttaatttaaaaattacagcgaaaatgaaaaactaaattatataaaatttcaataattttttatgcatatttagctaaatacaacatcaaaataaatttaggcttcaatgcctttgttcatttatgtgtcagttttatttctgatagcacttcaaaggcaatgccagtcaatggcactggatcaatcattacaatgtttgtgccctctgcattgaacccaattttctcaatttgcatgataaaaagctatcgaagtgcttttgcaaaggaagcgctgaaaattggtaaatttcaggaaatatcgtatttccttcattataagcctcctctcgattagaagccaccctcccctcgaatataagcaccttcttgagggaggttgaacaataaaagccccggggcttataattgaggaaatacggtattattcattaaaaactattgtaaagatttaaaattaaattgaaaatggtttttagacttaggcaatttttagattttttcagaaattattcgctaaagcgtacacacgggcaattagtttctataatttaatattataattttgctaatagttaatgtcctctttttattaagcaaaacgttttcaaaaatttgattattcggcaacaaaatgtgcaaccgatggctgagaattgtgcaaccgttccttctaaaactaataaaatttacagttataatttgaaaaccaacgcttaggtcaacagatatattcagcaggaaagcaattaattttaaaaaca

SEQ ID NO: 1960 - DNA, 1219 bp, Heterodera glycines
ataaatcaaaaacagtcgcatttttttgaattcccgcatttatcatcattatcgatatgcttaacaaatgaaaaaataataatgttcactcactgttgttcatggacaatatatagttgaaggcttagacaaatactcatttaatacttggcttaatgtttcatttttctgcagtattctcaatgcctttgttccttttttctacatatatatgcatgaattttaaaagagtcacagattgtagtaaacagtttgaatatctgctcattaaagggaaaattacacaatcaaatataatattctgaaatttcaatttatgctctattttcttactctttttctacaatccttatcgaatttttctcggcaactcaaatcaagtagtctttcttttttataaaaaacagaattttgcattaacaatttaccaaaaataaattaaacccgaaaagtttggcttacagttttaacttgcacgcgctataaagacggtttattttaagcttcccatcaaaaaaggatcagatttaaaagagtttataaaaatggcctataaaattaaaaaattttggtttttcgctaaattttactaataaatactatggtcattcacgccctttttccagtattataaatcaaaaacagtcgcatttttttgaattcccgcatttatcatcattatcgatatgcttaacaaatgaaaaaataataatgttcactcactgttgttcatggacaatatatagttgaaggcttagacaaatacccatttaatacttggcttaatttttcagtaattctcgtgaagggcctaatttttctgcagtattctcaatgcctttgttccttttttctacatatatatgcatgaattttaaaagagtcacagattgtagtaaacagtttgaatatctgctcattaaagggaaaattttttgggaatgggatgaggtatgggtgcattatttttatttaaatttgttggttgattttccgaaaagcccccaaacctcaaaacattgcaataggaagtcagttttttgactgatgaacgttggtgatcagagaaatggttggcggaaacagcgcgttggattttcttttgatgtcgtcccgcagagtcaagcgatcgttgtaaatgatccagtcctgtccggtttgtgctcgtttggctgtgcattctttttgcatctcacaccgggctgacaattgttcaggc

SEQ ID NO: 1961 - DNA, 6105 bp, Heterodera glycines
  misc_feature (2409)..(2409): n is a, c, g, or t
aaaaaggcgagaataaaatattacatagaggtaccatgactaatttttacaagtttttaaagactattttatgcgcattagaattatatagagaaatataaaagctttatttacccaatactgacttaataagcaagaacaaaatattgtaaagaggtaccatgaaaaatctatacgaatttttgtagaccgcttttatgcgctttagaattatatagagaatcggaacgcgaaattaaaacggatgatgagaagccggaatatgaaaatgaaacaacaaatgatgaagagtcggaatatgaaactgaatagatgatttgaatgtataatctgatgagaatggttaggcaatgataccagcaaaaaagataaccgtagcagattgttaaaaatgattgttgaataatttttttattatattcaggatttctatatgttcttattgctaagaaatgttctgatttggaggtggtgccttattttcatcagaaagagggaaattcatgaaaaattttgctaatttctaacaaaatttcctccataaaattgttaaaatcgataatgggagactaaaaataaaatattatctatatttttgatagaataaattgtaaaaataactgatttgaaataaagaatatattaactttttcaacaattattttctttcgctctctaaaaagtaaaaaatgtcattttctgttggaaaaattagggttgcacccccgaccccgccccgaccccgaaccccgacatttttggccatttttcggggttaaccccgacccgaaccccgacgcttccaaccccgacaaccccgaaccccgacccttaaccccgactcggggtcggggttaaatatacacccctaagaatggcatttttgtgagagaaagtcaagaaaatttaaacaagttttgaatttttgaaccattttgccaaatttttattaaataaagaaaatttgcttttaattatgacatgtattgtggtgtattggttagtgcatcacactgacattactgtctttcataagttcgataaccattgacgttctcatttttaatttatttttttgtgattaatactagagttcgggtacggaccggatccgtatacggatttttacggatccgtagtccgtattttttgggccgatacggatttttacggattttccggatttttagtccgtaatccgtatgggtgtctagtccgtactcttggtccttatccgtattttctcaaaataccgatctctaattaatacattttttaaacaaaattatcaataaataaaaatagaccattcttggcataattgttaacagattaaacccaaattttcaaaaaatttttatttcgttgaaatttaaaattcaattttcatgactaaataaatcatgaaaacaatatatttcaaaatattgacaaaatatcgaaacaattaaatttcaaaattcgcttggccgagtccaaaaattcgtaaatcttattaaaaaaattggctcaaaatcgaaaatattcagcactttttgggcaaaatctgttaacagacccatgcaaattttcaaaaattttcccggcggcgcctatcggcaccgccggacccctttctcctgaaaagtctagaaaaagcgcgccgagaaaaaaagatggattgaaaaagaaaaaagtaatcagaaatttttgatcattttttgaataagattcacttttttcaaattgccggatccgaaaccggtttccggattgggaaaaattaaaattttcacatgttaatatttgtaaaaaccggcaaaatttcatttattaatatagaaattcgatgcaccagaaatgtcgccgccaaaaagacataatgttgccgacaaaataaaaaattttaaaattttcaagatattaaagcatacaaaaatatttatgataaaaaataaataaataaatataaacaaataaaactttattatggaaattataaaaaattttgactatatggcataaggtaaaaatttaaaaaccccgaaccccgaccccgaacgattttgttaaccccgaccccgaacttgctgaccccgacaaccccgaaccccgacttttctaaccccgacgttcgggggtgcaaccctaaattatttacaagtaaaaacttaaaatactatgtttagctacaaatacgaatggaacaacgcaatcaggaaataaagacaaagagaaacaagcaaaagctggaacatgaaggtgcactttatgttcttcaccaaatcagtgacgatggacttcggaagtattggcgctgcgagtttttcggacctaacaacaaatgcaaaggtgtatgcaaaaataaaatatagattattttttaaattcagggcgaattcacactgacattaatggtaatgtcctcanaataattggaagccacacatgcgacatgagtgccgcacaagtggagtgtcagcgacgcgtgaccccagctcaagcggcgtgcagttgagacgtgcgaagcgccggcaacaatccgtgcgcaagtattgcagaacacagcaacccccgtgttggccgcttttcctaccaaagctgcgacaaaaaagcagggacggtcccaggatttggcttgggggggcacctccccccgggcgacgacctttttttttttttgcttttcacccccgttttttatgtggcgcggtttttccaaaaaaaaattttgggggaagggggtccggcggtgccgataggcgccgccgggaaaatttttgcggttttaaatgcggtttgttaacagattttgtccaaaaaatgaccaaattttgtgattttgagccatttttagcagattttcagtaaaaatttgtggattttttgtaaaatttagcgacatttcattaagacatacaacaacaatgccgtgtttgctgaaaagagcaaaatgatcacctctatggcttttcttcctgtccaccatctccgtgctggcctcaatgttttgcagacacaactccctcaacaacttattggcgtcttcgattggtgttttttggaatgttaaatcaatttttttttatcttaaaggttcatggacaattacaccggaaggccgtggttcaatggtggtttgacagtgccacggttcgcaaaatatcgtgccgccgatgcgagaattcttcgactcttgcagagctacaatgccatcaacaataaccaggctcaccaaaatgatcacaattaccatgcccttatcaatgttaacccctataacatcatcaatttctccttggtatttctcggaattatgagatgcgcccgtaatattttcaatgttttgttatttttttgttgttaacacattgacaaatctgttatggtgttaattttaaagaatttttgagaaacaaatcagaattggatcaatgtaggacaaaaacagcttgccagactagaacgaccctctgactaaaccggccagactaaatcgaccctctgactaaaccggccagactaaatcgaccctctgactaaaccggccatactaaactgacccccaccgcaattccggcactttttcggcttgaaaaagggcaagcgcgcctctaattctatttttccaacccattttgaacggggggcggaagtttgggcaccgggaagtttgggcaccagaaatttgggcaccgggaagtttgggcactaaatttaggatttaaaaaataaaattatttttaattgtctataaattgcaaccatctaatttaaaagcatagtaaatttaatcaagttacgaatagaaagtttttttaacgaatattcactcgattaagcatgcttattttgctaaactgattaccattcattctataaaatgccttacatatatatgtattatttgtatcattacaaggctcagtatgttcaagatttaaaatttataaatttaaatagtattagacgggtctcttgtcatttcgggcccaactaagacggtattcagggtctaagtccataaccagtacatgtttaattctacgtttaaacaaccgtaagaattgactaaataataagaatgccaggtttccatataaaaactttttaattttcaagaacatagaaatttttgagcacaagggttgttaaatttactaaactttaatgatttatataacattttatatatttatattgttttatttttttgaaaggtgctgtaacatttcgacagtggctgatttcgacagtgaccgatttcgacagtgaactattttcatttattttactgttttccgacatttccgacagtggctgattacgacagtgaccgatttcgacaatgaacaaaattttaactttgccaattctaacatttgaaaacttcaaattgatatcgaaaataacgacaaaattgtgtaaaacgacaatgctaaaatcctataaatgtttaaaagtgcagatgataagcgcaagcgcgaagaaattggatcggatcacgattgaaaaaatcctgcacaagtgcttccaagttttggtcttgacgaatgtatttggcctttctcgtttcatgaggccctttaatgccgtcagccggtgcaagcatcgacttcccaacggcactgtacacaagcacgccctgggcaataaggtggacggtttgggcaacgccaatactccattccgtcttcagttttcgaaacagccttagaatttttcgtttaacattttcacgaaattaaattagccttttaacctcgaaagtgtagtcatatccgctacgagatagaagaattttcccacgatttgttttggtctctgcgaatcggagtagagccattggtcaatgaattcggaaaaaaacgaatagagggaacagcaaatgatgaacaccagcaatgacaagtcgagaatgaccatcagcattcgggaacaccaaaacaattcctctcaaaattctcttatcaaattgacctccaagaaaattgacctcccaatataaagtgaacgaccggcccttccactatcaacggcctacggccaaagtacagtacaactgagttttacctcattgaaaataaaagaaaaatgctttattttactacatcatatataaatttcacccattaaatagtgacttttttaaataaaaatgactaatacacaaatataattttgttcattgtcgaaatcggtcactgtcgtaatcagccactgtcggaaatgtcggaaaacagtaaaataaatgaaaatagttcactgtcgaaatcggtcactgtcgaaatcagccactgtcgaaatccactgtcgaaatcggtcactgtcgaaatcagccactgtcgaaatttcctggcaccaattttaatgtgatagaaagacaggagaattgtgtgaccattagccaacggacaacagattaattatatagtcaacaaagagatcgatccataaattccactctgtcagctgttgctcatcgcttttctttaagttcttccaaactgctccaaatcattgtgagtgggcccagtttgagcttcaggtcggttttcaactgctcaaactgaaggcgaagcaatgaagcgccgttcacctcctcttcaacaaaacggtggccgtaagtgtctgatccggtgacaaaattgacccagctggacacttcttccacctgaggaagaaataaaaatgtaaaaataggagagcagtacaaaacattgacaacaaaaaatagaaaatatttaagggaaaattaaaaaattttcaccacctttcgcaatccaaaaatttaacactattaagaaaattcatttttcaaaatgtttttctgaaaattgagtacaaaagttttcaaaaaagtttccttttttgtgattttttgtggcaattgtttggggagcatagcaaaaaagtgtctagcaaaatatttaaaaattacggtccaagtgtgaactcctcgcgccttcagcgcatcaattacagccgcccccctccttaagatagtaataaactacaattagaagaaaaaaaatttagaaaaattttcagcaatttttttttggcattctatgataaattacttaattttttgaaattaaaaaaaatttctagcggcgtgatttc

SEQ ID NO: 1962 - DNA, 888 bp, Heterodera glycines
tcagggacacccgacacaattccaatctttcatctccacgtacagcatatagcatcagaattccaagatccgcttttgaatttttcacttttcttgtcgccctgtttttggcttaatagtttataacagtatttactttttgtaaatataaaggaaacatactagtaagacaaatttcgtcaactcgtcgccccatttgctttgatattttgttaaaaaaatactcgggcgtatagtccttcgcggcaatattaaattcgtaattgtccaacacgaagttcaaggtgaaaaagttttgcaaaagctcctcataatggtttgaagctgaaaattaagtctttttcttaattgtctgaaggctttgatgcgattgagaacccaaatgaggatgaaatacttactcatctcagatctttgcaataccgacttatgcgcaatgattttgaaaattgggatgatccagagaacgaatagttagttttatattcgctcccgttggcccttgggaaaggcattttcttctttttataatggaaaggcattttctttttataatgatataaaataaaatttccatttatttttccgggctggacagactcatccaattggcatttgaaaaatggtgccgaattgcaacattaataaattgattaaatgaattaagaattggcattaaatataaaatgcaatttcaaaattaaggcatgcaaaagtgaatcgcactgtttacctcggcacttttgtgcttgtttcgctgtttttcggcactttgatgagcctcaaatacgcccaaattgccttttgccaccccaaatggccccagacaggcacaattagcgacattttcctgttcgagtttaagcccatcttcttctctttcatgct

SEQ ID NO: 1963 - DNA, 1639 bp, Heterodera glycines
gcaaaatcagcgtgcttgtctttccccgaaaggggttggtaaaccggtgaaaatttgccgtgattgggatcggacattgcaattattgtccgtgaacgaggaattccttgtaggggcgacccaccccctttatcaacaaacttcctaccccctccctcagaccgaggcaatttttaaaaaatcagataaatgagagctgtactttcatacgcagaccacccgaattggacggggaggcagacaattgcggaacagcaacaacgttagtgacattgttgacttgcgcggtgggcaaggacagctgctgctcgcaattcacacaaaggagacgcgcacatgacagacaaaaacgcgtaaatttctcgtgtttgatacagatttccacacgcgaactttcagtggattgacccgaaattgaagacatttcaaccttaaaacggataattgttaaacattgagtgagtgagcaacagaaacaatcaattaattggtggtagtagaggtcggtggacaagagagtaaatgatcgattatgtacaggatttgccaaggaactgagtcatacacatgtattatgtatgaaaaatacagcacagcccggagtgatttatttccttatcagtttttacttttgacataatacaattattttttaggtaagacttccgtttaaggggtaaatgaaaaacacgtttaatggttctaaaatggcacataattaatagatatcatcatttttttgctataaaacttggtatttcatgctgaaaacaatttttttgaaaaaagtaaaatttggcaattaattttaacttttttcattataagacattggatcataggtagaccaaagtttaataatattacgctacaaaaccgccgcacactcgactacggcggccagtaggtggggcgagacggagggcggaggaaaaagtctaagcaaatgaatatttttgagccagttataatttgcaaaaaaatgcttgaattcttttctgtcactttttgtccgaaaaaactgtacatgtcatgaccagcttgaagccattcattaagatcttttgcctacacattttgatttgctccccaacagatgcgcgggttgcccaaaaaattcataattaataatctaacttttaaaaagaaacatattgcaatgccccacaacactccgagcgttaaagccggtggcatttcccaagattgccacgcgctgctttcccctatttaacactaatgatgggcccgtacttggctgcaatttgggcatcggatttcgtcgggctccaaattgtccagcagcaggcattgttcaggcacacactcttcgcacacatagtgcagacagtccaacaggcgactgggctgaacaaaaaagggggagggagggtgaaagcagcgatgccattttgaccaagaaaccgggcatatttgccaaattttgaggtgtccgcgcccggtttttttattttgaagcagcagttgccatcgttttattttttaatccaaatttatcttatttctttaaaaattccatttaatccgcgcaattactttcttcctagccaaatttctgaaaataagtgaaaattggcgtaatatgctaatttttacgttttcattttactggctaaaa

SEQ ID NO: 1964 - DNA, 599 bp, Heterodera glycines
agcgttgttgtggtcggatagaagaaaaagttagatgtgaaaagatgataattcggcatccaaaagtgtcggtcatttgcaaaaattttccggtggtattcatttcaaacccctcttctcttttcattttcctctcagttttgtagctattccatttttttgtgaattatttcggcgtaaaattacaaatgcgtctggcattgtccgtcattgtttcgactcttcttctggtggctctgaattggccctctgctttggcttccgcagaaattggtcagcgaatgaattgcgatcggtggggcggggagagaaagagagagagagagaaagagatgaaagagagtgagggcgagaggggagtgcgcaattgaggcaaaaatgggtggaaatggcataaggcagagcgagagaaaaaaaaaaggacaaattggcgaacaaatgcgaacaaaagaaatagaaataaaataataaaaaaacgaataattggttagatgattatggctttatttggaaaagcgaaaagggatttatttattttaatttttgaatttttgagtaaaatggttaaataaaagataacataattaattttttttttt

SEQ ID NO: 1965 - DNA, 7408 bp, Heterodera glycines
tgcatagcaaacagttttttctcctgattacttaataatttagctcaaacatcgctttttatctcttcaaattatttttattataaaaggtcaaagggaatatttaaagaatcattcacatgtaacttttgttctcataataaattaaaaaaacagagattttttggcattcttgatcacatttcatcgtctttggtttatggaataggctgcatcaatcaaccattataatttaaaaaaaattaaaaatatgtatccctatataagtatataaataaaagacacgtgcagcatttaatttagcgatggcaaactatacaactttttcttttttcgatgtcctctttctcggttgagtggatggccaacacaaggtaatctaagttgagctattcacagaatgaatgatcgtacggtccaggggaattgagggtggcagaaaggggaggggcagttggtcaattgaggggacaaaaagtgatgagaggggctgacaccaaggaagggggaggaactccaagcccaatccaaaggggaaccccggtcaatgaccatcttttcatcacattccccaccgacgacattgccgcgccctcgcggcaaaaataacaaagcgatgtggaaaaggggaaaaagcagagagaaggaagaaaaatgacgttaaagagagagagagaaaatggagaaaatgaaatgattttgagacaaagagatgcagccccctgccccaaccgacgaccgatcgctccagcgttgttgtggtcgggtagcagaaaaagttagatgtgaaaagatgataattcggcatccaaaagtgtcggtcatttgcaaaaatttttccggtggtattcatctcaattccctcttctcttttgggtttcctctcagttttgtagctatttcatttttagtgaattatttcggtgtaaaaattacaaatgcgtctggcattgtccgtcattgtttcgactcttcttctggtggctctgaattggccctctgctttggcttccgcagaaattggtcagcgaatgaattgcgatcggtggggcggggagagaaagagagagagagagaaagagatgaaagagagtgagggcgagaggggagtgcgcaattgaggcaaaaatgggtggaaaaggcataaggcagagcgagaaaaaggacaaattggcgaacaaatgcgaacaatagaaaaataaaataataaaaaaacaaataattgtttagatgattatggctttatttggaaaagcgaaaagggatttatttatttttttgaatttttgagtaaaatgtttaaataaaagataaaataaataattttttttttttttttttttgattaaaatgtaatggattaaaaggttaattgattttaatttaaattttttttttttttttaatccctttccgattttccattttctttctgctgtttttccttgtcgccactttgcccattgtttccatcgctttcttcttcctcctttttcttgaaagcggcgatcagttcgttcagcttcgtcttcatcagcagcatttgttccaccacgtctcctgtgcagctgggccatgcggtcgtcgtctgcgttccgacggtgctgcttcgtgctcggattgggctgatgtttcgaagcggactgacgaagcgcggtctttttttgaagcggctccaactggcatttggtgtgggtcctctgcggataccttcgggtgggatcccgggatttcggatgacgtcactctcagctgggcccaacgcattctgcacgaacttttcgaccaatttcggtctttctctacccttcggtcttctttccccgccaattagctctttccattcctcttctctttcctctctctttcttattcgcatttcgtcttcctttgaacggttctgcaacgctttggccatgtcccattccccttccttttcctctcgcgggtcttctatgtagccgaccactttccctggcacatattcttcttccattgtgtccaaaatcaatttttttgagtcctgccctatcagcggccctttcaaagctactttctcattctttctttttgcttcttcttctgcttctctcacgattttccgaatttcttctcttccttcatccattgccttatcttccgctttttttgctgcctcgctactgtctttcttggctttttcctctttctctttctccgtaatcttccttcttattactcctctggcaattctctcccctactttctttctttcctcttttttcttagctatctcactgcttttcctcaatatattttgcaccttcttttccgcttcttcccaatccaactcatcctcacaaagactaatctcggatggagccctcagattgtttttggccttcgcttccacctctttttgcactttctcttcgctctctcgtttcgctctttcctccgcttctcttttggctctttcttccgcctctctctgcgctctcgcttctgcctcttttttggctttttcttccgcctctctctgcgtttttgcttccgcctctctacgggctttcgcttccatctctcgcttggctctcgcttctgccgctttttttgctttttcttccgcttctctctgcgcttttgcttctgcctcttttttggctttttcttccacctctctctgcgctctcgcttctgcctctttttttgctctcttttccgcctctttcttagctttagccgccttccgagcatcacttgccttttcggcctccaaaagcaggagtttttgcttaagctcctgaatctccttctcacgatccgtttccttgttctgtggccaggccggacgttgttttttcagttgagttcccgcctcagttgccgtttctttgtctgattcgtccgacgaaattgacaccaaaatcgggggtggagttggtgacgattggtcgcgagactggcgcactttttcgggaataaaagcttcgtgccgcgatatttggtgtgaaagtaaatatttttgctgtaaaatggcggtaattttgtccaaattatatgttgtataaggaaatgaacggtcgaaatttgaaaataggtgcggattatgcgaacatgggtgaaaattattagtagaaaatatttcttcctcattttttgtaaatttttcattttcatttaacttgagacagtttatttgggcattttccaaatcaaaatcccaagagtcccgatgagtgacttcaacaatcggcataatcatttcttcccaaatttgtcccctcttgccaatcgagttccaaaacattgccatatcattttcggccgtaattataccattttgcctcaaaagtcttttcatttcgctaccgatgtacggtcgatccgccccttcctctacaaaaatttgtaactcttcttcgaatagccatgccgtgatgtaaggcttttgtcctcccgaatatatttcccaatgggcttggacacggtttcttgggattattgagggctcataattttcggagaagttaatataagccaatattgtgtttccgtcgatttgaatttccattagaaataatggatcttccaaagcatcatttgtggactcttcgtcggtgtctgatgttctcaaaaaggctatagttgttttttcgtcttcattttcgtcatctgattcctccagatttgggtcgcccaacgctctcgtttttatttcatcgccaggttcatttctctcttctacctcacgctggaaatatggcttgcatctgtccatatgagcctcaaattctgtgccgtcgggatttaacttcttcagcaacaaatttggcttctcaattccaatcacgcgatacggcccttcgtagttcgcttccagcttatgttttttgtcgacttttcgcaacaaaactagcattccttctgtccacggtatttcattaatgcgtttttgctgctttttcatttggaccgcacattttttcaacttctcattaactttttgtcggatttccgtcattcgcactgtcaaatcgcttataaaaatggccatgtcagagaaatttctgtcatccgcttttggcgagagattcaaatgttgtgctcagaaattgagtcccacaatcagtgacgactatttttggtaaaccgaataagcacaagaatttgtcgacaaatacagctgtgacggtggttgctgattgttcccgcaatggaatggccatcatatatttagaaaaggagtcgacaatcattagaatgtactggaatcctccttttgccgtttttaatggacccattaaatccaaatgtaatctctcgcagggccgtgatgcgggttcgattggacaaattggttctgcgctcatttgaattccaataatttttctccgttggcaggcatcacatgttttaacaaagcgctggacatctccgtccagtccttcccaaaataagcttctccttatcttctctctcgtccgtttctctcccaaatgagcgccttggaatgggtcagaatggtattcgcccatgattttcgaccgtagacttttcggcacacatattttccattcgcctttgtccataatacatagcaattcctcaaaaagtttccatctcttcttttcattttcgtttgactcttccccgtctacggttgttttcaatctgatcattattttttgtatttcggcatctctcttctgagcctcgaccatctcactttgtgatgtcttcgcttcgacattcagccaatttatttggggttcagcactctcttccaaataccgagacaaatggtcacaaaattgatttctctttccaggcctatgaattatgtcaacgtcgaatgccataatggctaattggtagcgactcaatcttccctctaagtcttttcgccggaatagagatgttaacgccgagttatctgtgataacagtcgattttccggccccttccaagtatgggcgaaaatttttaagagaggcacaaatggccaacgcctcaagttcaacgacggaatatcttttttcatgtttggtgagaactctgctgaaatagctgattgggtgcacttctccgtcacggttttcctgaagaaggcagcctgcgatggcctttgtactggcatctgtctcaacaacgaacggctttccgaatttcggtggagccaacactggtgccgtcattaatcgctgtttaagttcctccagagcattttcatggatttgaccccattccgttgtattttcatttttcgtcagttcgtaaatcggttgtagaatttcggcgaagccaaaaataaatttccggaaatacgacagcattccgatcagtgaccgcagttcggtgatatttgccggtttctttagtcgttggattggttccaaatctttcgggtcaattcgaactcccttctccgaaatcaaatgtcccaaataacgaatttcaccaagcgcaaagcggcacttctccggtttcaaacggaagcccacctctgccattgtctttagaaaaatgtcaatgtccctcaagtgttcatcctcagtcattgatccaacaatacagtcgtccaagtagacaagaaaagtggccgagcacatttggcggacttcctccattgctctttgaaaagttgttggtgctcccgctaggccaaatggacagcgtagccactcaaacagccccatgtgacagataaaggcactcctttcctcatgtcctttagccaattttatgtggaagaatccactggagcagtcagcaaccgaaaaatacttctttcccgtcacttcgtcaagaatcgattggattctcggcaaataatatgttgatcgctttgtcaattgatttaattttcgataatcgacacaaaagcggtaggacccgtccggttttcgtacaagcacaataggagaagcccaagcggaggaagaggggcggattacattctgtcgcagtaattcttttacttgcctctttatttctggttggagtgccacgggataacgatacggcctttgttgacatggtctggctccctcagtcagatcaattcgatgaattgtcttccccttaaagagaccgacttcgcccggcttcacaaatgcattttcgtttgtttcgatgatttgcctcaattttatcattcctcccggactcaaaattgattccttcagcgagattctttccaaaattggcttggtggcctcgccattttttgggaacgccagagtttcatctgtccaatcggcttccggtggtatttgatcactttctgctttgaatttatgccattcctcgtcgttcatcagcatgttttcttcggtttctgtacactttcgcaacgaattaatatgcgtgtcagctgaaagcggttcaagtacagccaagcgggatcccccgtgcacttttatgtcacaatttccaaagtttaacaagcggagtggtacgattcgagtcgccccggggctcgttagacacttccccacacgcattggaaaatagtcgtgttctctctcagcggtgatgaatgtgtcttctggactcaaatttctgtttatccgtccccacacaaaggaatccgagagcggtggaagagtgtgtgtttgcaaaagtcgtacttcgatcggtcggcactcaatattaacggctccaaccatgggcaattggacgtgccccactcggacaattccctgtttgaagttgagaccaatttcctcttcccctccttgctcgctgataaagtccataaaatcagtcccaataatggcggcacatggacagcctccgtcctcgcttataagaattgggaattttccctcaaattctccgaatttcacgttcgtcagagcagatccaataaaatttatagacgttgaattggcagcacgagcttgtgggaagtctcctcgaagtatgctcagcccgtatttcttggcagttgagagctcaatgtacgtgacatctgctccggtgtcgaacaatgcttttatgtccttcccgtttattaggacattcacgtagcatctcttctttcggcgttgataatgatgaatttgacaaattttcggcaaataattcaaaatgtaggcagtctgttcgagcgctggctcctccggcggcgcggaaggtttcgaaaagggctggagttccacctccataacgaccgggtgtcgaacacgttcgacgacatttcttccggatgtgaaacaatccattaacatttgggtcagggtgccaatcatgtggagcggaatcgtcagaatagtgccgtaaattttaatttttccgaagataaaacatgagccgacggcaattaagacgattaaaatagaaaacccaatccatttgacgtattttattatgccaattcgaggagatcaatcccatgtcttccctttctcaattgtttcttctg

SEQ ID NO: 1966 - DNA, 1751 bp, Heterodera glycines
tggtggtcggaatcgctgtgatcggaattttggttgtcgtggccggaatggtggtggtcggaatcgccgtggttggaattttggctgtcctgaccggaattgtggtggtcggaaacgccgtggtcggaattttggttgtcgtgaccggaattgtggtggtcggaatcgctgtgatcggaattttggttgtcgtgaccggaattgtggtggtcggaatcgctgtgatcggaattttggttgtcgtggccggaattgtggtggtcggaatcgccgtggtcggaattttggttgttgtgaccggaattgtggtggtcggaatcgccgtggtcggaattttggttgttgtgaccggaattgtggtggtcgaaatcgccgtggtcggaattttggttgttgtgaccggaattgtggtggtcggaattgccatagtcgagacggaactgttggatgggagtccatcattttgatttcttcttatgtttggtgtcctctttatttgctgagtggaaaaccaagccaagcgaaacaaagttgaacaattaacagaatgaatgaacgaacgggccaggggaattgagggtggcagaaaggggaggggcagttggtcaattgaggggacaaaaagtgatgagaggggctgacaccaaggaagggggaggaactccaagcccaagccaaaggggaaccccggtcaatgaccatcttttcatcacaacctcaattagctattatcaaactaatgaaatatataatttttgagggatccactggtgctatgacgttagtcaaaaaccatcaactgaaaatttggtttgatataactttgcccaaaatgaatgaactcattaattcttgatatccttcgatagctctaagtgttttctattatcctgcaaaaatttgaaaaaatttcgataaatttcaagatgactaaaaatgttcaaaaaaactttgttttttgagtttctcaggtcattatttatttgaaaattaatgatttttttttgtaatttttcaggataatagaaacacttaggactatcgaaagatatcaagattttaaaatttggtatattttatgcgaagttatgaaaaatttttatgtcaaaaattttgcattttggtctttattttatagtcattttcttcgagaacatttctgactctgggcaattaccttaaaggcacaattagctattataaaaataataaataaaattttttgtgggatccactgcaagagtatctatcatccatagcttaattgggtggatcctgcaaaggtattcggctgctacaggttcatgacctgccggatgtgtaaccttttacgattcctttttcaaaaattgatattaaatctgggtgttaacttgtcaggagtaaaatgttttacagggtgcagtgtcgttatttgaaaactatcataatgtgcgttctttaaaaaactatcaaaataaacaattatgtgtataactttgctctaaagcaactaaatttttatttcttgctatcacttggtagctagccttaaatgttctctattagcctgcaaaagaaatctaaaattttggttgactttgagccaaattataaaataatttttcatcaaaaatttttatattggtgattttttaaataaaggcccgccctttatgatgttttttttgtagaaaaacaggcaaaagaaacaaatgaagaaagcaataataaaaactgaaaaggtccaaataaatttatttctgcttaaa

SEQ ID NO: 1967 - DNA, 8642 bp, Heterodera glycines
gttgtgcgcagcgacaacgcggagattcgcccgggcagatcatcatatccttcagctccacgtacaggacttcgctcctaaattgaaaaaatgtttttatctaggatttcggattgctccattcgcttaccagttgattgtccctgcttccgtcctcggataacatgtggagtacagttccagtccggcgatcaaatcaagcgttccttcgacgaacaccggcaaatcgggatgatcgtcgttgaaaatgtgtacacaaccaagaacacaaagaggattcgggtaatattcacccggggcgctcaaaatctcttctttaaaatgtgtatacaattgttcaacgctgccaagtccaaaggattcttgaaaatgctttatcgctctttgcatgaaatagttagcagcagcaaatacgcaatataattatttttggctgtcataaaatgacagtaaatttatgcaagtgtggtatggaaaattcaaaaaaaaagtgagcatttaaatagtggcacatgatcttagctggtgggcggtccttggtgctatagtggttggattgtatacagcagacgcgtcataggctccgcccccattgttgttgttttgcaacgaaagtgaatggaaaagatcgtattcatttagttccatcgcgtcatgcccatttcgtgcggctccaccacctcccaatcggcggaactggcggaagaaacaaatggcaatcaatatgacgacaacatcaaagaggtaagtcaaggcgagcaagaggcgttcaattccattggacgagaccgctggtacaacaatagctgatctgctatttctacgatcgccgtcttcaccccgcttttcggcgcctgcttcaaataagaggaagttgaagcgaatgtcgcttgagttggtcagaaactggagctgtgacgaaggatcgttgaaatagtgtccaatgcggaacttgtacacctgccttcgccaaatcaggtacacatggtcagctgcaatgaaataatccgttttttgttccggcaaaaagccaacaaaattgcttctcagaacatgtgccgtcctgttcagtgcattgtcagtgttattcagagtccaccatcgctccaaatcgccaatgagcaattcgttgattcggcgttcgctattgtccacaatgtacaatcgggcggcgatatgatcatacaaaatgcgaccatgtgcactcaattgccctgctattttttgctggtgtccacgaagaacggtcacctcacccacggcattttgaaggttgaaaattacaaaactatggccgccatgcccaaaacatgcccatggtaaggcggttgacggtatctcaattgttgtccgtcccaggctcattaaattatccacatctgtcagggcaatgttccacgtatccgggttggtgtacagccgattgatgttcctttccaactcaacatggcatgctgtgtcccggttatagccgaaccaatgttgcgccggtgaagtcttggaaattgtgcgaaatgaacggtcaaaaaagtttggtgggtcaacactcagctcaacattaatccattcgccagcagatagacggagaacatggaaaaaaattacgatgaaggcgatcagcaagaaataaaagaacaacatccttctgttctcgcaatgaaagaaaaaatgtggcgccctccccacttttagtcggccttttatacatggcgcgccagtgtacgtacataccatttgaccaaccagtccgccatcccacgcgttttgcgcagcgtttcaattacatcgcaaaacggggtgccagaacatcggctggccaagaaatagacacaaaagtggccacaggcatcagatgaggggaactgaatttgatgcgtgttgacctgcacatgttgaaaatggttgagataggcggataaatcgggatttggtgccgcacctaggctgtcaaagtattcaattcgcttcgcacatggcacatagcacgctatccaatgttctccgcgtgttccctccctgtctgtgttgactaccatgcagtgggggtagcgacgtaatcgtttctgtctctcaagaacaaacggtattttgttggatggataaactccaatgaacttcccgcttgtaacgcgcattcttcttagtagcacttctatttgtgccgaattcatatctatctcttttttttctcccactgtttaaacacttccgtccgtactcagcactcggtcagcgttgatggaaaggacagaatcgaactcaccaaggatcaacatttcgtaaccgtcctcttttataggcttttcaaattggaccttaagcgtacacgtgccctgacggatcaactcaaacccgggcgtatcgtctagcgtggaggtcatcgggattacgaagaaggcccatccgctgaggaagcgttgcatcccaatggacactgtttttgtgtctgagtcatccagaccaagaccggcgtacatgtcgacaaaagcacgaacaaaacgttgctgtgcaccatcaaacgacaacaggtatggagtgctgggaaaagattgtccgtttgcctccgcacttatcgctcgaacatttgcatgttcaaatttgaagggtgacaaccgtcgattgccagaataagcgtctgtagagacaaagcagcaaatcagacgacggggcaaggttgaagtgaacacgttgtgagccaactcagtcctgcctttgcccaggaaaatggagcgcaactcaattttacgcagcgggtatttggccgaggttgactccaactgacgactgattgccaggttaaggctaggtgtaacatccaccgtgcgaacatacagacgcagatcgtgcacgcgaatacggtattctttgctgttttcctgcaatgttccgtccgctttcttcccggggggcgtaagcagaaggaaagaatcgctgttacgatgaatagtgaatatcacgtcttggttgttcagcatcaatgcactctgatgtgcaagatcaaagttcagcctcaccatcgtttcgcattgctttccgttagagaatcgcgctgcacgggcgatgaagccctcattggtggcactatcttggccatcatcctcatctgtgtaatagcacgccgactcatggaaagatttgcgaatttcatgggagtggcccagttccttcattatgtagtcacgataatgatagtaaatggagctgtcgaacacttctatacccgaaatgttgattttcagtgagcggacaaaactgctgccaaagttttgaattacacccactcgcttatcctccggctcagcatcgctggtcggaacccattcacctgcggcatttttgcgctcaatagagctgagcaaatacatgtatgttttgctcaagtcgcagtactgactgtccgagaacaaacgaaacagatatgggccggtctggttaagtgccgacaatggcaacaattcgcggacgtttgtcctatttatcgccacattcgttggtggaagagaaaacagtgaaaggctaccctcaaggccttcaacactgtctttgtcaattttcttgattacgctcattattgttagttttatgccactgaatttattaagtgaacgtcaagtagacagaacatccatttacgtgcctatttatagattttcatgtgtgtgtccattgacaggcgcgctaccgtgtaatttaaggcgcaaatgtgagttggtctattgcctgtctcttgttgcctctcaacgaatgcattggcaatggcaccttcacttttttcaccggtctcttcctcttccttgtgggggctcccttcccacattgcttcaatttttcagccaggttttccataccatgttttgcgtgtgcctgaatggattccttgagggcctttccctgcgaaagatcctccataatccggcttccggcagtcaccccttcgcgtgacaccgccttcagcatattggaagcgaccggcatcaggaagcgggcaacatttctcaatagaccagcaccacgctgatgccgtgtaccaacaaaatattgcatttctccccctcccacttgttctaaagcaagaagaggtccccaattaatgctatccgggttaaatgtgacgtgagtcattttgttgctgatattttttaaaataatttccgtctaaaatgcagagtgacaatgcaggttccccaattaaatttgacgtatcgtccaaatgcgttctgaatttctatgcgaatttcggaaatgcgtttgttttgaagtgaatgaaatatttcattggtatatataacctcaggcacgtccgtccctcccccactgacaggtgcggccgaaacattgacaactctaagcagaggagccattcggtcacctatgatacactcctcaataagctttggagcataaacatacaattgtttaacaccaccagacagatctggcatatagcgtgcctgttccccatgaaacagacgagtgttgtcaaagcctagcacatatgcaagatgcttacttacatccacatgcagaacgcccgcaccggttatcagaacgaaccgttgtgcaagatcgttgaacacaaactcggcagcggttgactctttttgctgcttggcgacaagtttttcaaagcttacctcttcctccctggaaaacttcatatgttccaacatcaactttaaaatttctcctcgcgtttttgcagaggatttatgcaaaggttcattttgtgtttttttaatcagttccttcaacgcttcacctcttcgcagtgttgaagaaagataggctgatttctgtagatggtgataattttgctgtgcatccgcagtgtcagttttttcttctaatatgtttttcaacagctccatcagtacctgtccacgggtttgttcagcatcagcaaattggtggtggatgacatcgcccatttgctgttggttagtcggcaccgttgatcgcaacagtttccacagcatttctccatgcttcggcgctcgcccatcatcatcattatcttggggtgggtccccccattcttttttctgctcctcgctctgtttaagtcgggcaattagcgtttgaccatgcgcgattttctcatcagtaccgctaccatcatcttgttttgcattggcagaatttgacttatcgtcaactaggtgcttctgctcttgcgatattttttcttttaacgtctcaccacgtgtttttgttgctgttgggattgtttgctgaccgacagctgctttatcatcatcgtccgtgcgcttttgttgatccaatattttctcacgtactgcctccccatgcgttgtggtagctgcttgtggaccggcatctgctgtatcatcgttgtccgtgtgtttttgttgatccaatattttctcacgtactgcctccccatgcgttgtggtagctgcttgcggaccggcatctgctgtatcatcgttgtccgtgtgtttttgctgctccagtattttctcttttaatacctccccatgtattgttgtggtagctgtttgtggaccgacatctgctttatcatcgttgtccgtgtgtttttgctgctccagtattttctcttttaatacctccccatgtgttgttgtggtagctgtttgtggaccgacatctgctttatcacctacttcaccatccgttctggcagagatgcctgtacgtttttttaacgcctcccttccgatcaatgccgacgcagtcggtgcagtaattgtatttgctgctgctgcaacaaactgttgttgctcatcacgcttttttgcctcaaattccagcgcagcgaatctctttcgtctgtactcaatcatctgttttgctcgctctatttgcttttcgaaagaggcattatcctttaaccctactgcctttgcttgcagttcttctatcttctgaaaatgttctgtaagacccctataattgttgtgaataatttgccaataatttttgggatgtttttgaaaaaattcctcaacaaatgcactattctgctggtggctgagctcctcatattccgacaaagatttttggtggtcacgctgaagcgcagcattttcaaagatggtcaaattgtgctgcatgtgttttatttttgtgcgtattttgccaacctcggtgttaagctgacgaattttatttatatctttttcaccaatgtacttgctcatcacctcttgcagccccgagagatgttgtgtgaatataagtcttgactcgttcaattttttgttataatcttcgggatgatgttggaaaaaatcgctaatctttctttgctcattctccggactttcctgatcacgacgttcagcagcgcgttccaactcttccagctcttcctttttcctctgcatacgaatccgtttgagtggaagctcgctttgtatcagttttttcctctccacatccgtagtgtctgccgaaagttcactctcctcctgttttacctccttttcgaactgctcttgtttggtgcgtaattcgccaatcttttcccaataatccactggattttcatgaaaaaataggtctgtgacctgccgtttcgtccggctagctccatcatggccagaagaaaattgctgctgctgatacacctcacgtatgaggctgttcagggtgagccgcaaatgttctacactcgaaaattgcatgcttggaacctttagttctatatgtaaaaattttttgtcgtctaggaatctatagttcgggttaacaagtttaatgctaatgatatcatcctcatcaattccgactgatggaaatgaataagggtagattatagatgctagagcgacggtccaatttgagtccaactccaacgtgtgtggaagccgaaccgtaaaatttgatgccgtattcgttgagcctggtgtgttggacggaagtacaatgtaaaattcgtccatttttgtatcaattaatttcggacaatgtcctcgtctcgaatccaacgattgtgtttgtcagagtagccaatccacctcacaaagtgttctttgacgccttttctgcgccgggtcttcagcacttcagctctatgcgctgtttctgcaacggtttttaccagctcttgctcgtaaaaaatccctttaatgtcttccccgtcttgatcacggatcctgtaggaaggtggatcggtcggattcactttagaaatccgaaacagttcgtccgtaaaattcgaaaataacctttcgaaaaatcacccttttctttgcttattcgcactatgtctcccaccttaaattttggcgttttgggactcgactcgccttgcttatatagccgattccgtagagcagaggcatttttaaagttaacgtccgttggccttagtccggttgttcggttcgcggagctgttcaggttacgcacaatgctgtccagcacatcaacccaccgctttgtgttcttttcgctaaatacttgtaaagtcgctcctttagcgtacggtttgctttccacaactccagcatgcaaatgtgggctgtacatcacgtgcttgatgatctccttttgtttccagtagtccatcattttctttgcctgaaactcaagcccagcgtcgctgtacagcttattgggcagcacacctgctttattgcaaatcttctcaaatgccgcaatcatgtgctcactttttttggactctacctctgcagtgaaaatcttccgacttagcacatctatgcactctaggatgtagcgaaatccatcattatactccttcagcgcgtccatgatgcacaaatcgcattgccagtccgtgtgtagtccgctaggcacagtttttagtctgcggaagcggtttttgcgcggcttaaacaacgtgtaggtgcgctgtttatgcaaaaaatggtcaacatcacgaagagtaatgctcggatttcgcttccttcaatactttttgaatacctgcgtaacttgccggcgacccaagatcgtaatacacttgttccagtaatttttgtactacagctttgcccatagaagcggtttaaagaatttacgcttcgtgttatttggttgctctattcggctgagtcctaccgtttttatagcgtttgctttaacaagaacgaatttttttgcgcttgctccgcttactaccaccctctccccgttgggaatggaaaaatttcatcatttccgggtcgctgccaattttttgaacaaaaaatcgatgacctttcggcacatctgctctctgtcctgtcaggtacattaaagaatcaatgtagttggacctaatcaccggctttttgaagttagttaaaatttcaccggacgatttatctactccgtacttttcggggtttcgttcaatcatttcctgtagcttatcgtaatgctctgggcctgttttaagttcaagaaacttttgttgtctctttttgcttagccgcaaatctgtctcaggcgcagacgtatccgtttcttcaccaaagctggcaccattgtgagtttggattctggaagcctgaaccgattttcgtctgatcttcttattaattttttggccatcctttccgttcacttcttcaatccggttgagtgttggtttttgtatgcccatatacggggcaaatgttttttggtgctatgcctgtagcgttttc

SEQ ID NO: 1968 - DNA, 4221 bp, Heterodera glycines
aattttctggtcgcgatcacagtgacctattattctcaacgcaggtaaaatatgattcgttctttctgcagttaaatcttttaaatttaaagaaaaatgtatgagtacgatcattatctttttgttgatttattttcactcaaatgaaattattttatttttaaggtttctaaatatttttttatttgattaatacaagatttgcatcttctttccatatatatttaaatcaacggtaaaccaattcatttaaaaataaaataatttttaattcacaaaattaaaattcattgttcattgaaaaatggtgcaaattagtttaattagctttatttttttttcatcatttgcatatttttaaactaagtttgcaattaaaagcaggttttattgtagagcataaaaggtaaatcgcccggtgggactcgaacccgcgaccccagcaatccgtgccatactctaacaaattagcttcgggcactacttttggaggttctctcatgtcctttgtcccactttctcccatactccgttccttttggcatcacattatagctaaattgacgatgtaaatatattattttcaaaaaaaaccctaaatatttgccaaaaatcctaaaaagtccaaactatttgccagaaattaaaaaaaatcttaaaaatacgtgattttctcaaaagatctcgttcgttatccaattcgttaaaacagttcaaaaaaaaattttgtatgataccagtaagaaagtttttaattttcaattgaatttatctgtttgtggtaacttgcgacacaattattttttacaatcatttttcattattatattaatttgcagaatcaatattgtaaattatttgtttgcttcatgttggtggtacaatctttattctttcttggaagaaattgtatttcttttaactcgtttttgtctttaattagtctgtttaccatgcttggagttggatcgcacgatgaaaacttttagtttaagttttgaattatggtaaatttggttaatttggcttcaaataaagccacaagttaagaaataaattttattgattttattttgttatttatatcaaatttattttggtaaaattatgttgcttcgaagaaattttttcctccgtatttcttgcacactaggaattgtatcttgttctttattcagaattatttaaatatttgtatttatttgctaaataaaaatgtaaatttttgtgattatattattagaatagattagtaaaattttaattttctggtcatgatcatatatgtatttatttgttaaatcaaaatctaaatttgtgtgattagtttattagattagattcgtgctgagtcgatccacaaaaaaactcagtgtgggcgatccacaaaaaactctgtgtgggcgatccacaaaaaatctgtgtgggcgatccacaaaaaactcagtgtgggcgatccacaaaaaatctcagtgtgggcaatccacaaaaaatctcagtgtgggcgatccacaaaaaatctcagtgtgggcaatccacaaaaaatctcagtgtgggcgatccacaaaaaatctcagtgtgggcgatccacaaaaaatctcagtgaataataataattttgtattatattatgcgcttcacaaaattcatgtgtcaaatcaataacactcaatattaaataattttcgctgcctgtaactgcaaaattaatatacatatgaattttatttaaaaaatatatatttataatattattctaaactagaaaaatgaataaaatttttattttatttttttcttatctctatttgagtattcggtcaaggaatgttctttttttgtaaacggaaaaccgatcgaattctgatcatttttaattaattatacgcaaatagtaaaacaacaccgtgcaggcaaatgctctgtatgcttggatttttggttatgcgttcaatttgctcaaaaagaaactcatttgtaaaattttcgagcgaaattgagagaagctgatcgtggacggtcacttggacctggaaaaacacttttaccagcttgctttctaaaaaaaacatagaaaagttaaaattgatgaccaacgatcattgtttgcgtgtgcagtattgcttccaataacatatcctgcaaccacgctgccgatgattattggtgtcaacacggcagtcactgccccaattatgagcccaacactgatcaggtctcgttcatttcgagatttggcattttcagtaatgttttcagcagaatttggtgtgcaaatcaagaaaattagaagaataatttttattggaagcatttcaagccattccattttattttattcttttttcaattttagtatgaaatttcatgccattccttttgtttacccttttttttgcattttttgccataaatgacaaaagatatttatgcaaaaaattagaacaaaaatgacaaatttttatttgttctttttaaatttatcttgaaatataatggtataaatttaattataattaattcagtgacacgttctatataattaaaattaattatttaattattcactgagattttttgtggatcgcccacactgagattttttgtggatcgcccacactgagattttttgtggatcgcccacactgagattttttgtggatcgcccacactgagtttttttgtggatcgcccacactgagtttttttgtggatcgacctagcaccgattagatttactcgcgtttaggctctcagatgcaagaaaggcagaaacaatggagcgttaaacattttaccctgcctgtgctagcttgttccattctttataaaatgataataaattctttcatttaataatgcccaaagcttactctggtgaaacggtaaaccaagcaccgcgtcatttgaaaatctttaaaaaagaaattatgtttatatttttacaagaaatataaaattaataataatatttggtaattaataaattttattttattttaaatatggttccttattttccataaaagattattaaggtatagctttttctgattttaataatgtttagaggcaatacgagttattctttgtattcaatattaaaattatttatatatttctaacaattgagaatataatttcattttttattccttgataaaaagatgaacattttttaaaattttatatgcgttcctttcattagacaatttaagcatttcgtaattatttgcattttaattttaaataattataacaagcgctattataatcacatattttttaaattagtatttaatatttttatttgatttttttaccgaaaattcacgcaacatttctcgaaatgattatatatatatatatatatttttatttacatattatgttagtaaattgaaaagaatagttggttacattttaaattttgttcacaatttctctattgggaatctcattcgaatttttgtatgcttatacattaatttttttaaagattttagatcatcaaagaaataattgcgtaatcccaccttttcgtttaacgaatattgtatagaaaatgtattcttagtttacatagaataaaaatgcttttttagcttattctattcgatttcctttagaaattattgttataaaagaaataatacatttggtggtgttcttcgggggtcatgtcttttttctgataaattgttttgtaaattgaaaactttcagctaaataagttccaacagggaactttgaaatcctcccatgacattaattaagaattcgatttgtttgtttgctttcaacagttgaaataaatttaagaaatacgcaaaaaattgcttttttaggaatgtatttttcaaattttctcaaaaatgccaaaatatgtgcaaagtgtgtgcaaaccccaaaatatgcccatatgtttttatgtgccaaaatgccaaaatatatgtatgttcttatgtttttacaagttgctctaaatcaaaaattgttcgtagaaaatgcctatttttgtagaccaacttgtttatttattttaaatatagtaaggttttataatccatgtaaaaaagtaagaatattttgctcatcttgatatgttttgtttgaaaatatgaaatctttttattaaatttgtgacttagtcttgtcaaatatattttggcaaatttttaggttcttagtttcgcataaatttttctctattcatttccc

SEQ ID NO: 1969 - DNA, 2158 bp, Heterodera glycines
tgttaaggatttttgaaagtatttatgatgataattcttgctagtttttaccttcttaaatctttttaatttttttgcgaaatgttcgcttataatttcgttttattgcttttttaaattttgaacataataatgaaaataataagtatttaggtactaattctaatgtcatgtttaattacttcgaattattttaatgtatttttatttaaatttaaaattaagcatttttctttgtttcagataacaataaaatgatttaaaataaaataacatgatatttatttcattattataatatttgtctttaatataattgtttttttaaaatttatcaaatcatatttaaaatgcgttttttgtgttatttgtagtaattttctattaccttgatctccagtgaaaaaattgcatttattatatatattcattactttttgtgaaattaaattattccatttatttttatttttaagttatatttaatcaaattctattaaatgtttatttgtattttatggggtttcttattttattttatgaattattaatttggattgcatttattcaattaaattaaaatgctttattccttctttcttaataatgagattttttaatatcttttcatgcatctctttttttatttgttaaaactatatttttattttttataattataatttatattttcaattgtttgttgtattattgtttatgttttatttttttaataattcaatgaggatacttaatatcagtatctggtattttattatctacataaaatttctttctttgttttctcttttttcaataagctggctccattagtattccgataaaattattttgtcagtactcttctataaatataattattcaaatttaaacgaatattatctcaatagaattattaagcttatccggctcgaacttttattagaaaatatattatttttttaattttaatgaaatacatgtattattaggaattcttttatatttttcggtgctaattcgtttcagaaaatccgccaacatgggagtttataaaattcaacattttagcgaatttttcgacagaacagaaccgagcatggcataactttgcttaaaggcaatcaaatcttggtactatttgatagcccagctttttctctaatatatcgcaaaattttaaaaaaattatcaaatttaacataagttgtgccagaaacattacttgtcttcatacaactttttctaaagttgaccaaattttttacctttccaggctaattgagaaaaatatgggctaccaaatggtgccaagaatgtaaaatttgattgcccttaagcaaagttaggctcaagtacagtttatgcgtccaatggactttcaacatgtgggatgccacggcttaatcattgacaaaatgggatatgtaagatcgaaaccttggcatttttgcggatgttctaacagatatgaaaaggaaaacattttacgtgaatataactagtaattctgagaaaatattcataattttgggaaattctagcaaatctttgtgtcatattgtcaatgtgatacaattcgaagtattgattggacacataaaaatttgattggacgcataaactgtacttgagcccaaagttatgccatgtttggtcgaaaatcactaaaaattgcgcattttatggaacgacccagcacagtatgttcctatcccattgtgagtgtcaattgcattatggatcgaaatgaaattttaattagtaaattctttaattagatttttcatattttccacatttatttgggttgtgtgtagttaaaagattaattacatttttagataatcattaattaaaaaaaatattatttcgtcggaaaacatctttgtatcttaattatttaatttaattaataaattcatttttttaattttgaaatgaaattttaattagtaaattctttaattagatttttcatattttccacatttatttgggttgtgtgtagttaaaagattaattacatttttagataatcattaattaaaaaaaatattatttcgtcggaaaacatctttgtatcttaattatttaatttaattaataaattcatttttttaattttcaaattagattatctatcgatttctttgtt

SEQ ID NO: 1970 - DNA, 2637 bp, Heterodera glycines
  misc_feature (2560)..(2560): n is a, c, g, or t
  misc_feature (2618)..(2618): n is a, c, g, or t
tctctctctctcgttctccctctccctctttctctcttctctgtctcttcgctctatcacccgtcgctctatcacccgtcgctctctctctctcttcactctgttctccttttcttccttttctctatttctctgtttctttctctctctctcccttcactctctctactctctttcccatcctctcacctctctctctctcttcgctctttctctctttctcacttttttctcttctctctctttctctctttttctctctctgatatctttctctctcccaccctctctgctctctctcatctcttacctctctctctttctctctctctgctctctctctcccagcctctcacctctctctctctatcttttgcactttctctctcactgctttctcccttctctgttttttctctcttctctctctctttcgctctccctcttttctctttcccatcctctctgttctctctctatcatctatcaattttcccccctctttttctatcgttaccatttctcacttctcgattgggtgctatgtcgttatataaaaaccttcaaaaagggcattatataaaaaaccctcaaatggtatttttgtgtttttattgatttttccttgtgttttgggcgttatataaaaaaccgtcaaaaagggcgttatataaaaaaccctcaaatcaatcaaattgtaagacatttcatcaaaattgggcgttatataaaaaaccctcaaaaagggcgttatataaaaaaccatcaaatcttattgttaccgtattaatttagaaaaaacaatcgtgtcaataaaattaaaaaaaacaatcgtgccaataaaataaaacctatataaaataataaagcattttttaaaaagaaacctttttattgaaaattcacacatagaaatactttctgtatacacactaacaattttataaattatttattattatcaataacaattattatttttttttaattttttaaattctattttattcaaccaattttcatatacaaatattatttaacctattttcaatgaaatttttatttaaatttattcgcctttctcaagggctaacgagaaaaaatagcaatcaacaagcattcagtgaaacaggcaattccatttttgacagataaaataaaaatatttcaatttgtcccgatcgagtgtggcgtctttttgttccttttaaatctgaaaggaaggctgatttatgtggttttttatcagttctttcataccaaaaaaacaaatctcatccaaatttggcatggaccacatttcaccaatttttcgaaacaaaaattcattgttaaagttttccaaatcaattgaaatttcgcggtcgccaaacgaaaatttgatggggaaaaaagtttgaggtactccttatctgaacaaattttttgattttttaaattattaattaatattttaattatcattttatttattatttttaaatttaaatttatattcatacattcacgaccacttccatcttttaaagtataaccaaatacaatgccggttgcaaccgaaccaagtattattggagttagaacaattgccgaaataattgcaatagccgcaagagtccccagttatctttctttgcgacgaattggttttgaaattgtcaaattttgtgacaaaatcaaaaatgcaaaaaaaaaaatttttaatttagccattttataaaaatataatttttaagaaaaattaacccttttataattgtcaagccaatgcacaatcacatgaaagcacaaaattagaaaaattgatcactttatcgccaaaacccattaagaacaatttaaagaattcacattatcaaagaaaccttaaaaaattttgctgcagcaaattttgcaaaatttgatcagtttatcagcgaaacccattaaacgaacaatttaaagagaaagcatttgatcaataattttttggaaaatttgctcaatttttaattaatttcttgaggattgattatagcttcaaaatgcccatgacaatcataataaacaaaaatagaatttatatcactttttaaagaaattgataactaaaatttaagaaaaatgaaataaaattcgaaagaaatatttaccgaattatttgaatctggagaataaacagcccatgtatactttatattactttgggatgtttgaatattcggactacacactataacattgagctgaaaaagctttgctgcagctaaaaagtcaatatttgatgcccatttaaacatttctgttgcatctattgctggcattttatggtttctaatatactcttcgagttggttaatttccggatgaaataatttttgctgtataatttgacatttaatacaagaaatataaaatttgttattgtaaattaaagtgacaccaaattttctccaattgtcttcctgttcttttcctattagaaacaatttttcttgatcgttttttgttatacattgtcttgcgatgtattttgtttcatctgctttcgtagaatattttccaacgcttgttttgattntagaaagatatctttccagtgtagatttacttaggttttgagatgattcattattaanttttttgaagtaagtcatt

SEQ ID NO: 1971 - DNA, 2526 bp, Heterodera glycines
  misc_feature (9)..(11): n is a, c, g, or t
cagcaaacnnncgcaaaaccttttcagtttatcagcgaaaaccattaaacgaacaatttaaagagaaagcatttaatcaataattttttggaaaatttgctcaatttttaattatatttaaatttgccatattaacttttaaatgtgttaataatgctttggtataatggaataaacagccataaattaggttgttgtcaaaaacagtcttcaaaacatttatttgagcgccttcataatcaacatgtattctttttatatttttattaaaattggaccattaacgtttaatttctcgccatacgattgaatatgaatttatatttctaataaaaatacaatttaaaaaaaaattagaattaccttctctccattaacgcaaaaactaacgggacccactctccgtcaccttcaggtgcagattcttgagtgtactatataacaaaggaaaagtgaaaaagtttaaaaattttattttaaataaatataaaatctaataccaatccgtgcacaatatataattgcataaaaggttttggtgctacttcaaaagtcccgtctagtgcgataattggacatttttgcatagcttggcttgcagtttttgttgcaaaaatgattataccatcttctctatttcggtatataacccagctataaaatcaaataatttcaaaattttattccgagaattttaagcagaacttacttatcttgacttgaaagttctttatttaatgccagctttatagaaccaaaacgtgttattaataaagattctggcaaattatatgagtcagttgaaattccgtgtgcttgctgtctacgtctattatatgaacgtctgacggaattataagttgggtaatgaaatgataatgattgttctgataatgtttcggtatctgttgctacatcaaaagactcagctttttgaaacccctagttaaataaaattacaagttaaaatatattttaatttatttcacgccataaacttttaatgttagcagtgcaatttattattttatttcgttgttgtctgtctatctgttctgcgctaaatttttcaattttttctcccaagcagtcgtgatgatgtattgttggacgtgaagaaattatctcggtattttcattaattatttaatacaagaaatataaaatttgttattgtaaattaatgtgacaccaaattttctccaattgtcttcctgttcttttcctattagaaagaatttttcttgatcgttttttgttgtacattgtcttgcgatgtattttgttccaacgcttgttttgattttagaaagatatctttccagtgtagatttgcttaggttttgagatgattcattattaattttttgaagtaattcatttattgttcggatttctcttttttcatatttatttaaaagatttttaattatattgtcattgataaaagagtcaaaggaagaagcacggcttccaccagtaatgtaatcgtaaatccgatttttaaaaagaaatatgaataaaataaataatatacaatatacggcttttgatggtccatgcatttccattaatatgaataataaaaaatataaatctatcgaatattttttttgatgacgtaacatttacataaatccaataattgattacatttaatgtcaatattgtataaaaaatatttatttaaaatgatttattattttatataggttttattttattggcacgattgtttttttaattttattggcacgattgttttttctaaattaatacggtaacaataagatttgatggttttttatataacgcccattttgagggttttttatataacgcccaattttgatgaaatgtcttacaatttgattgatttgagggttttttatataacgccctttttgacggttttttatataacgcccaaaacacaaggaaaaatcaataaaaacacaaaaaaaaaccatttgagggttttttatataacgccctttttgagggtttttatataacgactcagcaccatcaaaacttggaaccctgtcataagtttttcctaatgatagaattcttgaattacagattgaaattacaatgtgaaacgtaaaaattgatcaatcgtatttaacgaggttagacaggcactttttatgcagttttgttgaaaggctgcactggtcgaacatttgtctggatcggcttcccgtcctccccttcaattgtccgtaacaattggatctgttgattaaagcaataaattaatgctaagaaatttatctttccatttaaatggcaccagttcggcattgttgaatctcggcacttcgtacactgaccaaatcaccgcttcgtggcagccccccgtggtcagagagccgttgtagcggaaaaaagtgttcataacggtgggcaaaagatcattgggcatccaattgtcaatttgaacggtggcatcttttattttttgagatttaaatttaatatttaaatttttgactctgtgaattatttaaaatgaaattt

SEQ ID NO: 1972 - DNA, 667 bp, Heterodera glycines
cattgattaaattttgaatctgcccattctctcaaattacttgtgtcgtttgccggcattggcactgtcattcgatctaaaaataaagatcttctggtaaagctttcttcgaccatttcgctctggcatatgtgcagcgattagagcgaaaatagcaatgcgaatgtattcaaccattttattttattggaaaacaaatggtttattattattatttattaattatggcatcaacattttcttaattaaaataaatcttgtcttatatttaaatgaacgttgagttcaatattttttaaaaatttagtgtgcttttgcgttgtttgactcacgtgtgtatattatataattttcaattttcaattatttgatgataattagtggcattattatttccctaaattaaaataaatctttgtattataattaaattaaaattgagttgaatattttttaaatatttagtgtacttttgcgagttttgacaaacggatttcattatttaataagattaataagtttaagttcaattaattgttttaatattagttttaattgtctttgttcttgctatattctagtattttattcaattttttattttaatgattcatttaaagaaatttatgactaataaattatttgttttctaaatgtatcttttaat

SEQ ID NO: 1973 - DNA, 1429 bp, Heterodera glycines
  misc_feature (1399)..(1399): n is a, c, g, or t
tttgctctcttttaaatgtattctggcttttttcttttatctttccttctctcttctcttcctctctgtctccctcacctttctttctgaatcttcgttctatcccctctctcgcttcctttttcatctctctctatagtttctctcttctctaacatctaattcccaaccactcctatacacccatcacacacacaaaaacgcacgcattcaatcatgcgtgaaaaccgcacgcgttacccactctacccctcccatacgcgccgacagagaaacatacactgcactttcttctctacccagcctttctctattagtccccaattacatttttcaattttatgtttctttttctctatgaaaacaaaacaccactttaggcgcaaattcaaaagggcaaaagtgggcggagcttcgcctcacttaatatataagtaagggatttctatactctcgctttcggccgcaaatgcgctggtaagagacatatatgataaacctacctgacatcatcgattctgaatcggccgttaaattgcgtttctttctgtgtttatatattattattaaaaatttggcagcacttttttcagattttattctatcttgggcatgatgtgctaaatattaaataaaaaatatcttgtttagagcgaaaatggcgatgcgaattgtattcgacaattttatttcattggaaaataagttttcaattatttgatgataattagtgacatcattatttccctaaattaaaataatataattaaaataaaattgagttgaatatatttttttaatatttagtgtacttttgcgagctttgtttgactcacggatttcattatgtaataagattaataagttcaggttcaattaattgttttaatattagttttaattgtctttgttcttgctatattctagtattttattcaattttttatttaaatgattcatttaaagaaatttatgactaataaattatttgttttctaaatgtatcttttaatcaatgaattcatttttttaaattttcaaattcgattatatatctctatatttgttataacatttggattttagtatttaaatattctcatgggcaacatttttcacctcgtttttgctcctccatgtaatccaactgggaaaatttgaaactataaataaaactattcattcgagtatatttactgtttttacatctaataaattttacatatacttttagctaattaatatatttattttatgattagttgattcatttttattaaaagcaataattttataatataaatttcaaaataatatttatttctataacaaaaaaaaacaagcatatattattttttaatattcttttgttatgtatattaatagctatttgtttctnttattaaaattatgattttctattttaatt

SEQ ID NO: 1974 - DNA, 9998 bp, Heterodera glycines
gatgagtttgcatcgtgtgttatttaccacgagccagtgcccgtgtgcaaaaacgataaaattgaattgaaggagccctttcctcccttcaatgatggccatccccatcgatggtttgtgtagtaaaaaagttttataaaattaaaacacatcaaaaaacaatttattctaaataggtgtttttagcttcttttcgatggtcggcatgctctacacctttttgttctattttggaatgtaaggcgttgaaagtgatggagcacgcgtaacacgacctgacactgtcgcatggcaactttggcttgaaaaagagaagaataataaatatttaaaatgattttcatttaatttttgttcatcggtttattttgaaatttgtcatcctcaacccaattacacgttgagaccacgaaaatataccccctaatcggcaccgcatcgaaaatttcaaattttcgccgatttttcatattctttaaaaaggcatattttttcagaacgtttcctattttatggtaaatggatgtgccgaaagaaatacgtgttcatcaaggttggagaaactaagcaaaaagaatgatgagtttgcatcgtgtgttatttaccacgagccagtgcccgtgtgcaaaaacgataaaattgaattgaaggagccatcctccctccaataatgcccgcgcccaccgaaggtttgtgcagcaaaaatttttttataaaaataaaacttaattttataaaatttcgttgcaattaatagtggcatttaggcttgtacctattttttcggatactacttgatgagagaaatacgaaaaacatatattcaccgaacaatttttattttctcagcaactttttagcccctataaaacttaaaagcaggggttagcagttagcacctattggcattttcgaattagcacctattttgggcgttttccaaaaattttatagcaacaatgcaataaaaacgaaaaacgcacccctaagaattggtctcaaaaattttgaaaaatatacccctaaaaattcataaaaatttatttcaacaggatattattgaaaaaacacagttttcgcacaattctttttttggcaacatatccaagcagggaaaagtgtcaaacattggccctgcactctgatcaggcacaagggtggaagagaatttcatatgatttgattttttccaaaatatccaattttggaattaaatgagatggcataggggacggttcagcaaatgcttagtcaaaaatttaaagtcttcgtgtttttatgcttctcgacgaaacccttgatccaattgatctgcagaagtgaatgatttgctgagcagttatggattctaattgaattttggaattatttacattcaacttggattgtgttatgcatttttgtgacggcattttgcatagaaagtgaaagcccatttcgaggccagccccagcattttgccaaatgccaaacgctttaactccttcgccaatatttctgtgtttttctcttcgatattccattttttacagtttttaattgtgtaaaatcatttattttaaacctcatttttggactattcgaatttgatttagtctaggcttaacaaatgcgaggaatgagtcgatggaaagggacccatcgacaaaatacaaagaacagcacaatctccgtgttttatccaactttatattaatataatgtttaacttccctcaacagaatggcacattcgccatgtcttttcccattgtggcacaataacttccgtaacagaaatgaatggcggcgtttgcatttggtcaatgatagaacgaattatgactaaagaagaattacgcaggcgcttgttggtggtcagcattgaacgcagccaaccgaaggtttgcgaaacgcaattagataaaatgatggacgaccgaattttggagtaaacggtcaaacatttgtacagcaaaggagaccacatgacactttcttatcaaacttgatgaataatgggataggaaatttttctcaaaatttggtccacgtaccgcgcacttcaacccgaacccgaaatgctgaatttcaacagcaaataggaccattcccgtttgttgttgaccacaacaacagagcaccagccccacctttaaacatacggcaacaaattttccaccccgtaccactgatgcacaccgcattaaccaagtgtcggttaacgcgcaacgcaacattgactttcagtatttaccaaataatggcgttaatgcaccgacaaacttacaatgtcatggcgacattcagtacgccgctgttaaccctgtcactgcgccatcaaacgcgcaaaaatttttagctcaaaaccaacaaaaattcactcgccaggctttccaaatgccagaaatgaatcaagagcctagacatttccctacctacctatacccaccagggctggccgtgattgaatttccaatcacggatatccgtgagccgtgatcacggggcttccaaaaaaatccgtgacccgtgaaccgtgatcacggcaccccaaaaaccccgtgatttccgtgatccgtgattataaaaattcttgaaaattattatttttttaatttattagcaaaaacgaaaatttattcgcttgaaaatcctgtcaatatcaaattatgatggaggaacagaagttttgcgagattttcgggtgccaaactttttcggagatcattagagataaggcccgcggtcgagaaaagtcgttcactttctgaactcgtagcgggtggagaaagaaatttgggcacaattcttccgatcatcggccatttttgtgaattgatttcccagtaagcataaggatcggattttgccttaattttcgcatctctccaatattcgttcacttcaacttcagccttttgttttatttctaacgctgatgggctgggtgatggtgcctgtgaaatgaacaataatgcgattgtttaaaaagaaagctttactgtattaattaattggtcgaattcagcatctttttcaaattgagaaaaaatgtcggttgaacttgacccgcttgcattattttcaactaacaaatcatcggtatactaaaaattaaaatataaactcaaaataaaatatttcattacgtaattttcattgtgaaaactctcgatttcactgattagccaatttttgtagccatctacgcgattgcaatccaaataaacagccttaaaccgtggatcaagaagggtcgaaatcaccaaatatttttggttctcgaattggtttagtctcttttcaatggccgatgcaattgtatttttgatatttgaaaatcgattatccccctctttacgtaatgcaaacgtaatagcctaaatgctatttagattaagatatattgttaaataattaactttaaagagtggaatgataatggaacttgaagcgtttcggttctgtaaaagcagagtcgcttcgtaaatcggagcgagtacattcttaacagaagataaaagtgtccaatcgtcggcatttaattttggcagttccgcgtgttcaattgccaacaaattcacagccgaacgattaatcaaaaaacgttctaacattttgtaagaactgttccaacgaaccttcaaatgattttttgtaattaattttaaaaaataatataattacctctgtgttttttagcaaaaccgtttgtagtatttcttcattggattggaattcagctaatttttctgtcaaaactcttgactttcgtacttttcgaacaaattttttgacattttcaataagttccttcaatctttcttcttcatcaatttttttaagtccttccttaatacacttaaaaaagaaattgaaattttttaaattttaattaccaattgaagtacatgggcagcgcaatcgattgattcaaatcccaaatcttttgaaactcttttcattgtattttcagtgtcgcgtgttattgctgagattttgtcctccgaaattttaaattcgttcaagctttcacgaataaaagcagaaattgcatctgctgtatgtcgcccttaattttgtgccggtttgctgaccgccaactatttgggcaatcagcacataccgaagtggatgagcacggaatatcacaagaacaaacagatgtaatcaatggaactaataatgctgatcacagctgataaaattcggatagagccaaaagtggagtccctttttttgctgttcgctataggaaaattttaaaaagtgccaaagatagatgcccccggaaatattaatgttttggagcaaaaataaattaatcattgataatgtaaataaagatgacattttaggcataaaaaatgcaaaaaaggcacctaaaaaggcaaaaaaaaaaagtcacaaaacattaaataggcacaaaaatctttgaattgacataaaaagcaaaatttttatgaaaactttttggttgcaaaaacacacataaacttaatttagttataattgtaaataaagtatttaatatttagaagattttttttaataaggacaatttttaaaaatttttggtcaaaccaaaaaaaacattttgggatgaatttttgagaaaatttctcaatcaataaaaccaaactaaaatcacgttttacaagccgaacacaaatcttaggaatttacctaaaatgtcatccctaaaaattgtaaataatacctatgcattgtttaattatgatttattagtatttttaaccgcttttctgatcgttattttttgccccttaaaagtgtgccgttaatttatgattatgtattgcacttaggcttgtccctgggaagcaggatggtgagtttttggcatttgccaaaataatttaaatcaaaaaatttatgataaaagttgtgggaattttgtcataatactcgtaaaaatttagtaatcttataaatattttattttttatttttttaaaactaaattctaatgagcataatgttcctcatgcatttaaggctgtttctagtccaagaaaaaaataagcaagtattaaaagccatacttatgaccaatgtgtcaaatgtactcaattttgtctcaagatatatttttttcttattttaaattttctcatttttatgtgtcctcaatagtgcttcacctttcccaccacccagcagcagattaaattatgtgcatatatttatttccctcaatttcttcgtcaatttcatccatttgttgaccatctatgacgaagaagaagccaacaattgaataatattatatatttttttctacagcccatttatggagaaggacacacaaattggataataaaatcaaaaacaaacgttgagcacaaatctttgaaaaattttgcagaatttttttttagtttttttttaaattattcgctattaaatgttaattggcatatgactctgtcgtccaatacattatcaaattggctctgctgaatgattaattgctttaatacccgcttatttatgaatgttttctatgagagcagctctaatcgctctgttcggggcactgccgccgaagtttgaatgaaatgacataatgccaatcgatttctgttccatttcatgttccttccctcgcccataaatatgctctctttccccttaagattgtcttcccttctttcattttgcatttatatatttgttccccaaattgttgtgactttattttccttctccaataaattataaatatttaattggacttcaacaaaacccctcggaccgaacacgctctaaccgattgggctgtaaaatatgtacatttaaaattatttcttgtgaagagcattaattaatttatattttttaatgatttttcgcagattcttgtcttttgaaaaccgttttttattactgtttcaccgccttagaaatttccacgataattaaaatggcactctgattttgagcaaactaatttcttactttttctccacaattttacaaatttttctgtaattacctagacgtagccggacatttttagcaaatttttgtatgaacagttattaaaattaaaagtgaatttaaaaaaacaaaaattttaccccgatttagccattttagagatcttcctacatatcaccttgaataattgtaaagtagtatgagcaactaatatgattaccacattttactcaattcgatctccttttttcattcgtttcccacttatcgtccctttcattatctaattaattaaatatgcaatttacggaagcattctaaaaattggtattgttttttttggtctcttcaaaaaacacaacaatggaacaaccagcgggaaatgaaagcaaagtgccgcgtaagtgaatgtgaaaaattgaaaatttggcaatttcagggtcctttaaataacagtcagctatatcgattaagaaaaggccaaaagcttaaccaaaattccaacaaataaaaaatatggacaaagatttgggtttcatatgaaaaaccgataaattttatatttaaatttgtataaatgctcggtcaaaccaaaatgtgccacccacggcgttaattggttattagcgcactaattacacctggtatttccagcccatgaaattcgtggtattgcgccggtcggagtgctgctcaacgcatttgagctgaatttgagtgcggtgccagacaaagtgttccggcacgagcttcgcttcgtagccgagtacccaaatacgaaatggggtcaagcggacattcaggaattgacccgtgagcttcgcaatgagtgagtcactcattagcggagtgccaatctcaaacagcaaaaatttgcttaggctgatttttatggcgattttaaaattcgatttaaattcataatacctaataaaaaataaataaaatttcggctctttttttgggggggggagagcgtgcaaaatccggtgattcaattcatcaatcgcatttttaagcggtggtcagcgtgtgccgttggacaagcaaacgctgcaagccgaggcgcagcagttgttcccgctggcactcgccttcgccgcatccaatgagcaaattgagaaaattgagccgaccaaccgtggcagtcagcatatttataattaattaacgcatcattagcttttttgtttctaagctcttgttttttcttgtcctgaattttctgagaatttcatgaaaaaatatctgaaaaagatattttcttttttaaaaataaatttagaaaattgaatatatattttttgccaattgtcatttaagtacgcttactgtctatgtcattgtggcaaccaaattaaaattatttaagtaatgcattaattcaatatttatgaatcccctaaattcccttcagttttggacttttctttggctgcccgtggccaaccgttgccgtgccgttacacattcccatgtcaatttccaaaattctgggctgtcgtcatcgtccaatgcgctgtttcaaaggaccagtgcaggtgcgcctacgattgttttgaatatgggtcaacgattactgtatttgttagaaggaagagatactgtaattgaaaatctccggtacttagttcccgctcaaattttaatccaaaacccgtgacccgcgtcataaacaaattttgaagttttacgggctatagagaaaaccttaattatttattaaaaaaactctcaattggcggtttttataaaacgaccaggcaccaactgtatcctcgaatcccatttttacaactacagtatcactctttgggtagctaacaaaacgtcctttctcacatataaattcggtattttacatattctctaattggatgtgcaattttgaaaaaatttggccaaatcttaaaaaagtaaatgatcaaaaaataggttttacttttctttataatattttttcaaacctttttcatttttaaaaccgattaaattttcatatatttctattttaaattttgttaaatcttcttataatcatcttattgttttttttttcataaataaatttttaaaaatattaaataatttttaaaaatgctattgaattgtgccaaaatataaaatttttgttcattaagcaaaatttaaaatttattattctattactgaccagggttgttccgggttacccgaaacccgatacccgaaacccggcctttttctcgacccgaaacccgacccgatgattttgggtcgggtttcgggtcgaaataagcactggtaagaaaggggtctgggtgaaaattaggtggataaggaaattgagaatttttgttgaaacgattgtgttcaatggaattgaagaaaggagctcaaaaaacgcatttccgaataaaaatttttcgattctgatgtcattatcggtcactagaaatcgggccagggtcgttttggcgcccacgttttggcgccgacgatttggcgcccacgttttggcgcccacgttttggcgccagggtcgttttggcgcccacgttttggcgcgaagccaaaaattaaaaaaggtaaaaatttgatcaaaaattttacaaaaaaaagtgaaaaacttttaccttccaatgggtttttcaaattttcaaaaaattcacaaccccctagaattttttttcaaacttcccgattttgactgtgttttatgggtgtagattagagatcaacatgtacctggatccagccctgtatttttcctggatccaggtacaggcacaggccatttttcggcaacctggatttttcctgtacatttattttcctgtacttatgcacagaaaaaataggtacaggccattttttgaaacaggtacaactacggttttttcaaaatgttgatctctagtgtagatcaacattaaggagtgatatgatcaacttgctgtgaacattttgttggtcaacatgaaaaattgacttagcaagaattttttcaaatttttctcttcgctatgcttcaaaaaatgtcaaaacattttgaatatttttaaacttaaattttttcggttgaaatttcaaaagagttagtgatacatattttcatttattcaaacatagaaaaaatttaaaaacctgaccctggcgccaaaacgtcggcgccaaaacgaccccgactcgtttctgggtttctctctgctcacgaaatgataaccatttaaatcaattgcaaagaaaaaatcgaaagttaaaaattttcgaatttcgcatttttcttctaaataggcttaaatacacggaaacaaattgaaagccatcacacctgcactatgggtacgccccactgtgcagagaaaagcctagtactatctcgtcgtttctctttctttgtattttctctcactttggcgtactatctcttcattttaacaatgtaaaaaacaacttttacttttctccgtctaactttttttctatacgttaaacctacaccaaaatttgcatatcgatagagaaaaaaattctgcattattctatgctcaattattattgtctgtgctcaaactcaaaagttaagaagttcctaataaaaagtatttcttttcctctccttttggcgtactattttcatgtctctaacacattaaaaatcatgaaattcgcaaattctaataattttggttataagggtacaaaatcactttgaacatttagaatcaatagaaaaaagaataaatttagcattttggttagaaagagctggctaggacttgagttataacatgataaaagtttgaaattccgacaacttttttctgagatgacaaattacttaacattcgcttagaaaaagattctccttttcaaaaactttttttttgataccaaatttgttcagtttagttgggaatgaaacgagttatggcagatcaaaataaaaaatacaaaaagggcattttccagtgtcaattttgaaatagcgcgcaaaaatttacgccaaatgcgctatttggcgttatgagcaattttgtctgacactggcgcgtacccatagtgcacctg

SEQ ID NO: 1975 - DNA, 4134 bp, Heterodera glycines
attattataatgtatatcctaaattttcccattttttattacaaaataaaattatttaaaaattcattgagcaacatttaatgtgtgtgctctcttttctgtgcaatgtgtacaataatttttgtacagtcaatcccattttcccatcgacccttagccgcggcatttatggtcggcattggcatattaatctttgttgattcaaatggggttgggggcaaattccgatgcaaattccgtccgtcgtctttgttcgtcgggtgccgtaccatgccgtcgtggtgaccttgctgctccccatgtgggtaattaagtgccattatgatgtgccccgtccaacccattcattatccctaattagttgtataattaggccccgccctctctcatttacatttcgtttatcattcgctcttatagttggaacacaatgaatatcttcattcctctgaatcatcctcgaaaatgataaaatttgtaaaagttgtttcaaatctcgcgcgggactttgatgagggaagggatcccagtgcgaaaaagcctatagcaatcccgcgcgggctcccacaaacattaaatgcgggattaatcccgtggctccactcctagaaggcacagattcacaaacgcggcacggactccaaaaacctgctaaatgccggattttccatgtgtaaacggcaacacgcgtagacccgtgtggccgaaaataggtgaaatgtaggagtgaatcagaatttcttaaaaattattatgaaataattaaaatgtgaacaaatatacaataacccagtacagtacatacatatgtttatttttttacggattttgttaaattttataaaattttagtaaataatttttgaacttttcaaaaatttaattgacaaattcaaatcgatgtgtccattgaatatgtattagtgaaattattcgaaatttgttaattttttatataattacaattaggtaaattttcttaatttatttgattacttaaaatgtctgaccatcccaacgatgcgcagcgacacttaagaaaaatgtgtgttttttacacctttttgtgtacaaaataaattaatttttattgaaaattattgataaatatgtaaaaaaaattttagaaaatttaaaaataaaataaaaaaatttatttaaaaaagaaaatgattaatttggcagtggaagaaacttgctaattatgattatttgattattggcattggtaaattttaaatcacatagaaatgaatttagacattttttcaaaaatagaattgagaatttctggccatatttatagcaatttcatgctactttggtggaaaatttttggttaattttaaaatttcggcaaaaatattttaaaattcgtgtttggttgggtctttgggggtacttaccagtgatggcattccgaggtccgaaaaattttcggaaatcggaattccgggggcaaaaaagaaacgagctaattaattgattattgatataaatgaagttgtttaattttcatgaagtaacaagcaaactttaatgttgacattttttatccaaaattgagtttcatgcttagatttaaaaatattttttttagtttttagccaaattaaacacagtggtggcgccaggggggggggcggcattgcgaatttctggtattttaagcgttttcgtgtatggaggggtcttgggatggagggtacggtacatgcccctctccaccttctttagaccgtccccgggtcggacccccctaaaaacacggaatgccggattttccatgcaaatttgcgtttttgtttatttttctttatttctaaacagttctctatgcgacgacgtcctgttcgacaccttcaaatgcatgtacatcgacgaactcggcttctgcatggcgttggtctgcgaccggttcgacgtgttggtggacattcatctgagccgacgcaaatggatgcttaacacattcacaatctgcgggggcccaccaccatcggtggcggggggaggcgaagcggaaggagaagaaggtgagcagcagaagtgccatgccatgcccagggggccgttacgcaataccccctccggctggctacatacaatccgacaaaaattagtttttaaatgcaaaatttctcggtctctagtcgtaggaccaagaaagcccatttcagacatttatgacaggagtctcgcgggcaatccgtaaatggacattgtatttgtggcgaaggagacaatccgtcatagaaagacaattagtctaagatggacaaagccaatccattaatgaaagacaaataaaattttctgacggattgtctccatttctaaatgattgtccactgaccgattgtccggatataggacaatggataaaaatttgaaaaattacataaataaaattgaataattttaacaaatttgatccgtcttttaattttcacaaatttattaattcatttcgacaacgaatacccaatttgaacttgttgaaggctacttgcttaaagaagcaagcgtgccatgccacatcacaattaaataagtctaaagtcaatttataatcgtagcgcggtttctgatcacttcccatgcttggtaatttgggcacttttattgcttcatcattaagaaattgtgcagctggttgaatcattcagcaagtcaaattagatattcgttgtcaaaatgaaaaaataaatttgtaaagaataaattaaaattattcaagtgatttttttttgaataatgatttttcatttaaaaatttcgtactttcgtaagtaatctcatatttttaggatgttcgtgtgtccgtgtctcataattattttttgtttcattatttcgtatttttattgttattttttaattacgcaatatccctggctacataaaaaccaacaaaaaaaaaaaaaaattcctatgaaacaggcggtggtgccatggtggcacaaattgtcgtctacaaatggcgcactgtttggcgccaaatgccggcggcaactttggtggatggaggagaacaacgacaacttcaacaagttagcaagagaacggaccgaacactgcctattccgcaggggccgctgcccgaccaagtggtcggctttaagggcatttgcattcagtgagtgtgcatggcgccggcatgccatcatgtcgactggccctttgtactcgggccggggccagcctttggcattttgaccgggcatgcttaacggcacacacacaaaaaagaagccgttttccggcaattattaaactagaaaccaaataccaatgagcattttcgtgccaaattagcaaattttttatggctctaattagtagggcgtgtaattaaaagtagagttgagcgggaccgggaattttgggcaaaaccgggaccgggacttgccgggacctgagaagccgggacctcgatttttttcgggaccgggaaccgggaccaatcgggactttttaaaaattcaaaaaaattcaaaaaatttttaaaattcaaattttaattcatttcaattgaaaataatacaaaaataaatttttattttgttttttatttataaaatccaaattaaaagctaaataaattaataaaaactttcaaatcaaattttcagtcttattttgtactgattttcttaaaaaaatgataaaaatgtgtcaattaaacaaaactatgaggaattatattttgtcgataagaaacccatgagtagacaataagcaaattcaaaatattttaatttctgtagagggattgaaccaggggaaagaagaagggaaagtcaagggactagcactaggccatttgcaaatttaatttttttttcctttcactctaatttttatcactaatttttcactcagacccccattcttaccagtgcttgtttttcccggttcccggtcccgctcaactctaattttgacaaatgaatgacttaaaaaacttcttatttttcttagaaagaccaaaaatcgtaaaatttaacaaacttttacaattaaattagttaaatttttgaatttttaataatcctttgcattcaaaactataatttttaattcatcaggaattttcataatgcaaatgtttcagacgcagcgaaaaataaa

SEQ ID NO: 1976 - DNA, 841 bp, Heterodera glycines
  misc_feature (717)..(717): n is a, c, g, or t
aagcattaattaagttagcgtaaaattgtatccatcctttacaaaatgtacgcataagaattggtattcattggatgggatttgttttgtcgaaatttaattcccgccattgtttaaattgtgatcatttgaattttaattaccaatgtcaatgtaaacacacttttgcttaattaaattattgactcacaataaatacaaatctttcgcaaatcaacaagttacagtcttatcaaattcccttttgccttaacgatctcggaatgtccttttcccttttctcgataggcaattaattaattaattcattcattgaccattctcacccatttgcttgaccaccatctccgatttgtcattaagccctttctatcggtcccccaattaaaagcttaaacaaaccactgatgttttgtgcttctttcccaatggacgctaattggcttcactcagtgaactatttcgcctttcttacaccaccctgctgcgtgtgaattcgaccaatcaatatttattgttttcatgccgaaataatgatgaccttttttggtactatcaagacagctcagcaaaacacacaaatgttgttttgagcttgtgacgtgttatagcttttgaacaattttcattcattactcacgaaagtcatccgattttagaattttcaggagagccttccaacccctccggacaaagaatccctctttttgtttttanagacataatcccatttaaggtatagcatcaaaattccaaaatttttcagttgactccctattgttacctttcatcatcattagggcatagaataatatgcatttgcatatttttttcctggact

SEQ ID NO: 1977 - DNA, 3987 bp, Heterodera glycines
  misc_feature (11)..(11): n is a, c, g, or t
taaaattgttnttctttcttgaccaaattttggtttttgaaatatatttatttatagaaaaatgtattcaaaaatttcgaatatatttaattattttcaactgtaatcaatgaaaaagaaattatttccatataaaagcaatttgaaaaattatacccctaaatttggaatttttcatgcttattttcgcacttatttcgcgatattttcgtacttatttaaggccttattttggactttttcgcgcttaaaaatcctcactctaccaatcaatgaacattttccatttcttaggccatacatttttaaaattaaataaagatatgtatgtatcaacgatttttgacttattgtaacgtatataatttgttttgacgggctcctacagtataatattaccgtatttttccgattaatagaccgttcgattataagaccccttttgcgaggggctgaacaatagaagagaccccggtccgataatcgaaaaaatacggtacgacaaattgaaggttaagatctattcggctttacgaaacttttattaaaaatgtttaggagcaatattctttatttgctcagctttatccgattgttgtgtacaccaaatgtaagattgttcacctgcttagtgaatgtatgttctattccagtcgttgctatacgccttcccccccccccttttttataaattgaaacaatcttattaatagggaatagaattatatgcacatgcatatttttttcctggactgtgggaggcctgaaacgcatgaaaaacatgtttctagcttggtttgacgcttctaggccgtacttccatatgcatatttgtgcatatttcgcgatttatgtgcatattttggcatttcatgcatattttacgtgcatatttgggcattttttcaaaatacctctattagaacggccctatcaggtaaattggcctttttgacccctatagaccgaaaaaatttacgaaaaagtcattttttagcaaaattttgtcgaaaatattgctaaattaaaatttcttaaaaattgatcgttttatgtccaaaataagcaaaaaagctaaattttgcttttcaggttgatttttctaaattttaagctgtattgggtttttttcttctaaaatgatttttagtaccatattttatccatttttgtaagtcttactttgcgtttagcgaataaagaaattttgagaaattacaacatcaatttggaaaattttatgtgcatattttcactttttatgtgcatattttgccattttcggtgcatattttgcgattttatatgcatataattctatgcctgccctaatcatcattaatcaaagatgtctgtctctctcttctctctcttgattggaaacggcaacactaaaatgccttcctactcctttttttcatattgattcgaatggcacttttggttcttattttttcaccttctcttcttccccttcttcatcattcttttctgggtcagccaaagctccattaattaatttgtaaaatgcattcgatgtgattttcgttttctattcataaatttctaatgtttttattacttatttctctgaaaaatgcttttttaaaacataaaacccgggtaattcaaattaaaattcaacataattccgtttcaaattaatcggccccaatttgtttaattggttttcgttttggccattcattcttttacatacagtagtagtatcttttctcactctctctctctgtcactccatttttatttttaattttttaaatttaaataaatattagcggtcattgtgcctcacgacattcaaatcgttcaaaatgttcacaattgtacaacgtcacagcaagtatattttttgcagtttcaagaccgataataaaattaattttaaaaattggtcggtgtcacttagagagacaaagaaaaaatatttttttggatatttttgtgtttatttcttcttcttaatcaaaaaagagcatgctctcgactagaatcgggtgttgatctaatatattcacaggatgccaaatccgttgctgttgctgatcatcgttgtccaactgtttcaagcaattcatgcacaaccagcccgactccgtgtgccaagtgccgatttcttcggcggcattggccaccgcctttcaggcgatgagaacgttgcgatggtgttcatgctgttgatgatcaccattttggcaacgaatacggccattctgatcatgcaaattgtcatgttttggacagttatctcacggccaagggcagcagcaggtgaacagcagacggagaagaaaaagacggacaactacaagaaaatgatgagcaacaccaatggaaaaggtgagagaattggttaaaaggataaactaatgagatagagtgggaacgagagagaatgagcgcgagagagagataaaaagcgagagaaagcgagagagagctaaagagagagggagaaaatgccaatggagggctaaaataggagagaaagatttacagcctttatttatccctcttaaattaaaaattttataattattttgttgaaaaatgtttttcattactccctttccttttaaaacagtccatttggtgtcatcgcctcgtaattcggccgaattgctattgtttgaccgcaaagggaatgccgtcgtctgaacgctgtgcctttcggcaatttgctagaaaattgcaaaaaaaataataattcatttttttgttttcctaaatttccccattttacagtaacctcacccgtttttttgtactgctattatcagtaatttcattaattgacaagaaaaataaaagaatgaccatttgttaaaatataaatcaaaatttatttggtcaaactgttgtggtcgcagagaagcacaaaaagaaaaaataatttgttaggtttttcgtcattaagctaaaactgatgttagacggtcagctgtattagtaacactttttactcgtgaagactgaaatttaaaaaactcaatttctggaaattgagaatattaaagaaatttcaaaaattgtattacttagccattttcattagcttaaattaaggattagagaaatgtttccctcaatttgggaaaataatatgcatgtttttacgcttccatgtgacatattttgcaatttgggataccacaaatggattaatttggtcgtgacatgtccattcgagtgttaacgcctgagaaggcgaagaacagaagtggaaaactattgcattgattctgatcactcattttagcatcagagctgggccaatccatctttgatttttttgccgatcagtagggtgctatcatgttactcaaaaaccatcaaaattggcgttagtcaaaaaaccatcaaaagaaaacattttttccgggccaggacgctttcgtaccggagaccttttcgtaccaccgttttcgtaccggggacgtttgcaaaaaaaaattgcattcaaataatttttttaatctttaagtaattacttttaatgttttgagaatttatgcttttattaactacaaaatgaaccagtagcaagtaattaaaacaaaacgaaataatgataaattggtgcatgatggtgcactctactctatgtgttccacaaattcagtaaagatggacttaacaatattgtccctcaaaatgatcataattatgccaatgccaatgtcagtcccgaaaaccttaacaattttcttcgtgtgtatttcccgaaactatgagatgcgaccttattgtcccggattttgttatttttgttaaagttatgaattttctacaaaattttatgaatgggaaacaaaaaatgataaattttggttctattagttcttaagtttttctaatcgaatctgacgcttgtacaagaactcgtacgaaaatgtccccggtacgaaaattgcggtacgaaaacggcggtacgaaaacggcggtacgaaaacgaccctgaccgca

SEQ ID NO: 1978 - DNA, 2967 bp, Heterodera glycines
  misc_feature (1459)..(1459): n is a, c, g, or t
  misc_feature (1504)..(1504): n is a, c, g, or t
  misc_feature (1512)..(1513): n is a, c, g, or t
attaatccatacgatgccaaactcattcatttcaatttccgaatattacttaattatgctttagtttaactttaaatatcttctgccaaaagcacaactcataacaattgttcattttatagatgtatttaaatcgatgcattttaaaaatcattcaccaagaaaaatataaataaaaaaattaaaattatttcacattttccggttttcgttgtgcttgaataaaaaaaccgagtgaggctaatacattaaaaaagagaaggtatttagggataattcgataattagtacagcactcgagagtctcggattcgaaccaacaaatggcacataaatgaaataatagagataattgcaatttagtataagtaggtatatgaatagaaaaaattatatgtgactaagtaaaatcagattttcggcgctatttaaagagtaaacttttgaaatttttttcacttttttttggtcaatttttttgtttatttttaatgcagaatttgcttttttaccagatggtacgcatttcacgctatttaataattgattacgacaaaaaaaaagagaaaaaacagtttaaaaattagtttaggaggccagacgttttgcacagctgtgaaagtcgaaaaaagaaaacgttgtacaaattgataaagaaatggattcgtccaggctcagtgatcatcagcgatgaatggccggcgtacctgaaactggctctgcacttgccacaacagtacgaacacgtgctcatcagacacaaaaaatcgactggtggtggcttctaaaaaattgtcatgctcccggacggcaatgaatttaacgtcaacactaataaatgtgaaggactctgggctcaattgaaacaaaagacgaaaagaattcatggaaccagtacaaatctaacgaattcatacatgtgtgaataaatttttcgaattaatgctagggcaaaaggaaaaactattattaatgctttctgtgatcttcttagccataattatacttttattcgccataattgttctgttaatatttaatattcattattatgtgtaaaaaattaaaaaaaaattcaaccaaaaaaaagtgcaaaaaaatttcaaaaaggactgcttttaaactagcgccgtgttttctattatccttcaaaatttcaaaaagtttagttaagtttacagaaagttatgactagggctgccaattttatgtaaatacatatttttttcctggcttctccttgctctaaatagcaggaaaacactttcttttttgtgtttgcgaacaaaaaccgggacttttatttacatattttacatatttcggggtttttatacatatttacatatttcggcatatttgacatattttggatttttttcatatatattttcatttttttacatattttgagtattttttacggaaatttttggaaatcctcaaaaaaaatccgaantttcggcaaatatttttgtacatattttcattttttttacatatntgaaattnnataagaaaaaaataagttgaaaaatgttgcctaaaatacccaaaaaaagtaatttttatgtcattttgtggctgtttcatattttacggggatttttttcccaaaaaataccattaaaaaaattttatttacatatttggggttttttgtacatatttggaccacttttagtacatatttttggcagccctagttatgaccaaaaaatgttaaagaaaacttgcttttttgagtttctcaggtcataaatttttgaaacttaatgattttttgaaattttgcaggataatagaaaacccttagggctatcgaaaaataacaagattttaaaattcggtttaaaagtaaaatagacaagaaaccaacaaaaaaaaaattagtaaaaattttcaaaatttttgatgatcctactagctcagtgaaacacaaaattgagcaaactttatagtataaatttgcagaagtaatttttaaatatatgatttttaattttttaagaatttttaaaaaacaaggtcacatgctagggtaaccttaccagttaagctgagggtggtcaacccttacctcgatcttttggtacgggcccagggtgctaagtcgttataaaaaaaccagcaaaaagggcgttataaaaaaccatcaaatgaaaattttcaacaaaaaactgccaataactttttgtcaatgtcaaccaaattaaacattcttggtatcatacgatagccctaagattcctctattagcacacctaagattcaaaaaatatggccaagtttcaaaattttacgtatttaaattctcaagtcatataaatatattatttcaattgtgatccatctgcctgcaatcattgatctcagatggaattcattttttgacaaatatattgtcaaattattctgtatgcttatagtcacattaaaaatattttattattatttgtttttaaaaaactttattttattttttatcttttctttagaattagttaaaataatgataataccttttgctttgttttaactgctaatgattattaaattaattaattgtttatcagcagcacgggttcgtgttttggctttcttcaacttctgctgctgctgatcgatcggcggctgcagttaatccgctttgtcgttgccgtacaaaggcacaccattattattctttatttagtaaaccttgtattgcctcataaaataattggtcaactataaatatttaaatttaggcctttaaatttcgttaatttaaaataattacataattttactacatatatatatattgtgtcaatagtgtttaatccattatctaattcaaataacatattatgactaaaaaattctgcagccatgagctcgataaaagaattctccttctatcgtagactaactcacttaatccaagacctatttatttgtatttttataataaaatatttatac

SEQ ID NO: 1979 - DNA, 5421 bp, Heterodera glycines
ttgagtaagcttttgcctgtatttgaagctgatcaaaaggatgccaatgttcatgaaaatggcggggacggcgttcgaattgactaacttaattgatcaattaaacaaacttcatctgataataggaataattttcattgagtccttcaatttgttgggcattcatttgcgattttttgggaattaagaaagcaataaaaaatgttaaaataaattttctgttgcaccaaataattcctttcatcagcttaaatggaatttaaaataaatacaattagtattaatgagataagcacattaaagtactattcatcagatgttttattctttcaaattactttttgtatccgtttacgctcgctggttttaaaagtcaatggcaatttaataggctattaaatttaatggatgggttttttgtccttttggtttatttaattatttccacagcataaaattttgaatgaattatgaaatgaatgtgtaatgaattgcaaaaattgaaaatgttttataattatttttaaaaaattaaatgatcaaataactttccagatagaaattaaagaaacttaatttaattgatttaatttgacttttaaaaatcacgtggaaaggaaaaagaatgtagtggcatttgaagtttaaatctttaattattttcaaaagtaatttttaaatacatttttcaactaattttccaatttggcgatttatttttgaataaaaaaatgacaattcggatggactagcgtaactaacaataagccgggcagagaatgaaataattctgcataaattcaattcaattcatttttcatatgcactttatgattttcctgctggccaatttctttttcaatttctttcattgcgtcaacgattgtttttgccacattcttttggcgaaatgccgcacttatggctttgaatttggtcaaattgaaatgcgccgcggccgaatcattgctaattgtttttaaaattcatttttattttcaatttttgtcactttttcccctgctgccgtcccaatgcctctgataatgcgttgatcagatcattttgcactgtttgctggtcattttccctgtcaactgccagcccaatgtgccgaaatgccatcaattccgcgttgtaatattggtccccgatgaacggcacacaaatgattggcactccgtggaaaacgctctccaaaagactgttcatcccgcaatgggacacaaatgcctttgttttgggatgggctgaactttgattggtgtttgcctttgtgccgatcactcattttgggtgttaaaaagcggagttttggtcttttttttttactggtcccggcttctgttcttgcccattttaattcgcttatataattgaatctactttcgtcctattttgacaactcataaattgtgggccgattgatcggcagagtttgctgatcaatcatttgttggccattgaaaagtgagtgagtgcccttccttttcgtcgcctacccaacagctccttttggttgatccaactctgcgtgatcacattgtcccatttgaattgtaattggccttcgattccctgggtcaacttccaaatgaacaaaatgtttgggaatttgtccattgtgccagccaatgctttgacgaattgcgcatcgccgggcccagtaaaagcatcgtttgtgccaaaactgaccagaacaacgccctcttttgtgcccaaacttcgactgatcagtgaatttgtctgtcggattaagttttgaattagaatttgtcgccaaaagcgacacaaatttctttgaaatttcatttatttttgatccttttcatcgatcaattttcccattcgctcgctcctcttttttatgactcatctctttttctctcttcatttttattatgagtcatcatttttgagggaatttttccctttgcttgtgcacatttttcacgtgcctggccccgcccccattgatttgtgagggtataaaagcccggcccattctccattttcttcactgatcaatttttgattaagtcagccggacagttttctgtccaaacaatttgcattaaattgtaattgtgtaaattgaataaagattaagaaaagagtcttaatcttttccctgtctgtaaaagggacatcaggagccctttaatacagaccattaagccattgacccccttgggtcagaaaaggcttaccaaaggaaaggagaagaatttctccttccaaatgtccttccccctttaatttgtccctttggactctgtgagtttctgtcttttggacagaaattcgctttgcttaaaagactcccccccttctgccgggaagtgcaaatttttgtggccttttgcccacagaatttcatctcactgctgaatgaaagaagccgacagaaggcggttaaaagtcataagcaaatgtttcgaagccaaaaattagtctcgagacggaaagtaatgaaaaattgaaaaattattgagtcaagaacaaatgagtttgaccaataagcaaggaactcgtgacttttaatcatcatcttttttatttatatatattttttaaattttacattttccattgctttttcgtcaatttccgacggacggttaaaatttaagccgccaataaatttgacgcgcttatcgctcttcaaaattttggactgggcaaaatcgatttcgggcagcgaattgatgaaaaaaaagcggctcttggcgaacagtgcgtcccaacccgggaaattcaaatggaatttttcctccgccattttttggtaatcagtgtccttaatttaattatatttattataaatatttaaattattattatttccaccatatttatgtgttctttgattttggccaatgtttgctccacgcaattcttccaaacttcgtctcttctccacttcaattcctcgtccatttgttcttttgtgcgcatatttagcagtttcatacgctccccaccatttcgaaaaaaattcattgtagaaattccgataaattctgaaaattttcaaaagtaagacgaaaaatgaaaagacccgttaaaatttctgttttttttttgctcagaagcaacaaaaaacggacaaaattaaaataattttaatttcttttggcacatattaaaaaaaagtcatgagtcataaatttaggcgctagctaataataaatattttttaattttatccaaaaacaatgtgcgaagagtttttggtttgcataatttttgtgattttcacgtggttttcgtggcccctgatcacgaactctctctctctaactatttctcttctccccccccccccttctctcactcttttctctctctctatttcgctctctctctctctctctttccctctatctactctctctctttcgctctctccctctctctttttaattcatttaagctttttggcactttttacccgtcggcattccctccgaatggttcattttgctcaaatggcccatcaaatacagctgaaacggagacatcggctgactttgggtagagattgtgaccgcaatttgcagaaagtggaaaagtgccaacgaatactccgtgaaacagaatgcctctgccattcccacgtcgaatttctcggcacgtaattcgtccatcagttcaaagtcatcggcaatttctaattagggagttaaaaaaagtatatttgaattatttttgtcacaataaaattattgataggaaaagcaccaaaaagccccatggattgaacgggcgtaagaaaggcggctaacactttccatgctttgtttatctaaactttcccgccaggaaagagaaaatttttagatagttttttctaatttttaaaaaaaagttgagaagctactgctcatttaaatccttagagcgctgtcttttttttgcattaatttaccatggtaaattctgtcattcattttgcttaagtctccctccatgataaactcgtgcaacggtttcgtctttttctgcacaaaataccgcacattcagttggacttcatcatttttgttggttaatttataagttgcatctgttattgggaccaacatatgctaaaagtgcgttttaattttatttattcgtaaaatttggaaattttggcgaaattaaccataaaatgtaaattaaaaccctaattaattacaatttggtggccttcttctgccaaatatttggccaagtttaaaccgaatccaaaatgacttcgaaggaacatgtaatttggttggacgactaatattttcaaagtgtttgccatttccgcaacaaatgaactcattagtaaaaaggttatcgtaattaaagcagccatttggattaattattttctgatgtgccaaagaaatatcgaaatagaaaacaaataaatcaagccatttaaatattaaaaatcattcgtaatttaaatttaattttagccaacaatttccgaatatttgccaattttatgaaaaccaaatccgcctcatttccactttaatgttccacaattttcctttcctttccatcatttgccacacttttgcttcacttacaacaaattccccccccccggaaaaataaaaagaaatttgtattggattcaaatttaaaaaattatcatttaatggaataaaaatatttttaaatttgggatttttttaataatttgatttttggacaaatttttttttactttttcgaaaaagtcattttagaggtgtattctgctgaaaaattttctttcgttcgtagatttttttcgttttcaaattggtttaatatgaaattttctcaaatatgtattcaaaaaatattgaaaaaacataaaaacatccactttatcaccgaaattcgagacccaccaacttaggttaggcctaggcttaggcctaagctttcggctaggcctatgcttgctttgaaacatttttaaaatttatattattgttatttcgcaataggtacataatatcctaaatttctttataatattaataaagcattggattaatattaataaaatgtaattttgcaagacgtattattaagcttatttgcgtcataattggctttcataaacagaaatattaaaatttttgtcattctaagggaaagcaaaatatattgccataattttattgggaagggaatgccaaaaatttagagtttcattttagtcaaggttttagatagcagaaagaaacataaaattttatttatatttaaaagttaattatatgtttgaattttgtaatattttggctttttatgactattcacattggttttacaatgttcattttaatataatattttcaaataaaaatttaattttagagaatgaatgtcattatgctatatttatgtctatttgtggcattcccatttacttttggcatg

SEQ ID NO: 1980 - DNA, 3587 bp, Heterodera glycines
  misc_feature (12)..(12): n is a, c, g, or t
  misc_feature (28)..(28): n is a, c, g, or t
  misc_feature (45)..(46): n is a, c, g, or t
  misc_feature (53)..(53): n is a, c, g, or t
  misc_feature (83)..(83): n is a, c, g, or t
  misc_feature (134)..(134): n is a, c, g, or t
gatcagaaaaangaaggataaaatgggnaaaatgctaagatgtgnnatgaatntaggaatgggttgtattatgataaattgtntattcaacagactttatttattctttgttttcagtttttcttttttttgtntaaacaaaattttgggcatatttaaacggactttaatttgttgtacttagaaagagaatagcttactattttgagcttgtctgctgatgggtttaatttattgagctttgaatatatcaaaatattcgccattactgccaacgaatggattatgaaaaaaacgaaaaaatgtcattatctttttttcgaccggttatttgtaagcatgacattgaattaatcgtccagagaaggattttccaaatcctttggcattattttgctgaaattataaaaatttgccgcgtccaaccccaaaataaaattgaaatattatttattttatgtatttttgaataaaaaaatatcaaaattaagctgaatttcatattattggataattcattattagggactccatttttaggcaaatgcctaaaatttctgcgcatttaatacgcatagataagcacaaaaaacgcattttccgcttggtttgaggtgtctacgatgactcttataatgcctatttttgcctatttcggggtttttgtgcctaatgtgcgtattttagggtttttgaaaaaatccttaacaaaaatgcaataaaaacgaaaaacacacccctaagaaatgaaccgaaaaaattttttcagaaaatacactcctaagaattgaaaatttctcaaaaattgatcgacaaaaatttaatatttttttcttaataaaaatttttgtttaaattttgttcttttcgaaaaaaactttaaaatatttaataatttcatttacaaattaaaatttttatctgttttgctacctaaaaagcgttaataaaaaatttatttgcctatttttgcctatttgaggatttttgtgcctatttagtgcctatttctcgattttttgtgcctaaaaatggagtccctattcattagtgttcacctgcatttgtccagcaatgttcgtcgtttgtcctcctttttggcacatgcttcgggacaattccgtgccatccaatgcaggttccgttggcattcgctgatcgttgcgttagtgcccaacaaatgctcgggaaaggaggcccatcgtttgcactgcaagagcagatcctttggtactaatttaaaaaatcttgttagttttatattacctattatttgttttgtttacctgtcgatcgtttcgggtcggcgaaggaatggcacccgtcgaaacggcacgtgccggcgcaccacacattcataaattgtggtgccgttttgcacgtttggttggcgccggcccaatacgcgcaacactcgtggttgtcgtagcagacgcgttctgttggaaacccgagctaagaagcaatttaaaagttaattttaacagtgagaaagaacgatagagcgcggattagcataaatttccattttttcatattaatggtgctttatgaaattcttattgactgaattttctgaaatctcaattcatattttgatattttcctattttattcttttcccatttttatccgtattttaatccgtgttttggtttttccatataacccgagcatgctcaatactttgaattatattaaataataaataacatttataaataaataagcttattgggtgctcaccaattcagaggaaatgtgtgcagtagttggaactatctaaaagtgagaatgcatttcattggcaatgagaaatttggatggcactaagaaagccgaaggcaattccgaattcgattctgaataaaacccaaaaataagggaacactctgatggcctcgaatttatcattcggaaaaaaacaaaaaggcggaaaaaagaaatattccatttttgaaaattcattaaaagacttaaaagctcacgcactcccaattttaaagaatctgacaatataaccccaaaaagaaacaataatagtttttaccactttagtggaccgctgacaaatgccatcgacgcaggccgagccgtagcacgattcctcacctgaagttttctcacatttttggtcattaatagaaaaaaacttcaagtttctttgcaaaaaatgtcaaccactcttttcaaattctctttttttattaaattaatccattgaaaatgggctaccgtttccgctaaatttggaacaatttccaccgagctttatcttggaataacagttgggactttttccattggttgtgtcgcagaaaagatacctttattaatggttggaaaattgaaaaaaatataaaaaataatttttttttcaatattttattgagtaaattacggtgatccacagccaccagtggaactgcaagttggcctcattttgtagttatacaaatacgaagtgtaggcattgctcagtccaactgaaaattaatttatttaaatttaaaaataataaaattgtaaaatcataaaaaagagagaaccgcgattttgaagcggagggtcaatgaatgggaccattggagtatcgagaaagaaactcacgccagcagaacacttaaaaagcattaccacacaaattttcaaatttactaaaatggaaaaattgtatcatttttatttttttaatttggaataaaaatgatggccattgttatttaattgctaaacaccgctttaatttgatggtggggcgggaaaacagtttcacgctcagaaaaactgtgctgtgtgcgcaaacgccactgctcccaaatctgtaaaaattaaataaatcggaaacaattaatttaaaataaaattgttttttgttttcatttatgattatgtaaaataataaaaaaccaacgtaatcaataaaagtgtggtgcaaaaagaaaattggatcatagggagcagtgccgacatgttcctaatgggaaaacttatcaaattcaatccaatcagcagacggtctttcatttaaacgatataaatgccaatcccattggaagtagtttcgatgattaaataaaaaatgccaatccgatcgttctctctctctctctcccctctctaaatctctctctctctctaaatctctctctctctctaaatctctctctctctctcccctctctctctctctcaaatctctatctctctctaaatctctctctctctctaaatctccctctctctctaaatctctctctctctctcccctctctctctctctcaaatctctatctctctctaaatctctctctctctctctctaaatctcactctctctaaatctctttctctctctaaatctctctctctctctcccctctctctctctctctctctctctctcaaatctctatctctctctaaatctctctctctctctaaatctctctctctctctctaaatctctctctctctctctaaatctcactctctctaaatctctctctctctaaatctctctctctctctcccctctctctctctctcaaatctctatctctctcaaaatctctctctctctctc

SEQ ID NO: 1981 - DNA, 8259 bp, Heterodera glycines
  misc_feature (1208)..(1208): n is a, c, g, or t
  misc_feature (1224)..(1224): n is a, c, g, or t
  misc_feature (1228)..(1228): n is a, c, g, or t
  misc_feature (1230)..(1230): n is a, c, g, or t
  misc_feature (1236)..(1236): n is a, c, g, or t
  misc_feature (1239)..(1239): n is a, c, g, or t
  misc_feature (1243)..(1243): n is a, c, g, or t
  misc_feature (1262)..(1262): n is a, c, g, or t
  misc_feature (1266)..(1266): n is a, c, g, or t
  misc_feature (1296)..(1296): n is a, c, g, or t
  misc_feature (1309)..(1309): n is a, c, g, or t
  misc_feature (1315)..(1315): n is a, c, g, or t
  misc_feature (1317)..(1317): n is a, c, g, or t
  misc_feature (1333)..(1333): n is a, c, g, or t
  misc_feature (1340)..(1340): n is a, c, g, or t
  misc_feature (1349)..(1349): n is a, c, g, or t
  misc_feature (1351)..(1351): n is a, c, g, or t
  misc_feature (1357)..(1357): n is a, c, g, or t
  misc_feature (1371)..(1371): n is a, c, g, or t
  misc_feature (1375)..(1375): n is a, c, g, or t
  misc_feature (1384)..(1384): n is a, c, g, or t
  misc_feature (1392)..(1392): n is a, c, g, or t
  misc_feature (1411)..(1411): n is a, c, g, or t
aaaagaaacatcaattaaagtaaaatgggtcatttgccgaattgcccacttttcccaatgcttggaactgccgtaataatccacgcatttatcaacaatcactttaattgtagagataatgaccagcactttgaaaactaaatactttccgctcatattgtacctgaaaatgcgataaatatcgacattttttctgtgccaaaatttgaccgctgtaaaattaccaaattggaaatgaaacggccattaatcgttccactccgatgcacaattgcaatattatggccatcacacaagctgagcggctgatgaattgtatccaaaagcatgtcccgagagttataaaatttatgccaaaaatgaaaatgacaattttgacacaaaatccgatgtggagaaaaatggcaaagaaagcgtacaaagcgatcagaatattgcattgggagtgaatcgatctgtcaaataaaaattagttattatacatgaaatacaggggaggggggttgcaggaagagaaaagagtgaaatttctgaaaaatttgactaatttattaataaaattcattgaaaacgctttaaaaaatttttcccggcggtgccgccgcaaaaagcgggtgaaaactaaaaataagcggccgcaaattggctcaaaattgcaaaaatagtcttttttgtgaaattccgttaacaaattgaaatttaattgccaaaattttccccggcggcgcctatcggcgtttaaaaaatgatttttttgaaaactaataaaaaatataattataatcgtcgaaaaattctgcaaatatctaaagaagatttttaaaaataataatatttgaaacctttataaaaaacgtactttgatttgacggtcacgtagacaagtgacgcatttagcgcaattccgaaaaagcaaatcagcgtaattatcccactaattgcaacttcgaccgacacaaaaccagcctcatcctttgaataaatgaatagtgaatgaaaagattataattttggcacagcttttattattattgttacctgttgatcagttacatttgatgacataaataattattaatttaatccctcaaaaaataagtgattcattaaaaataatgttactggttgtataaatgtgagaaaaaaaattcgaaacttttcctcataatttttcaatggcatttcattataggaaggatttatttctntgatatatgtgaaaanggangnattagnttnattnataaatttttattgaattntagntttttattaattaggtaattaaaatggttnattaggaaagatntggtgnanattttaatttgttttnaaaaggnattaaaagngnagtaangttaaaaaagtaanatanagaataaanaaatattnaaaatttgtgttatagagnaaaatgagaaaaataaaaatatttatagatataataaagtcataaattttttctgttttattttatttaattttttttttttgatattgtaataaattagcgccatgaacagtcggttctgtacttgggttaaagcgcttcgcgcttttggagcttcgctacctagatccattaggtcgaattgtctaaaatttaaaatgtaatacagacccatcacggcatcagacgggcgcttcgcgccccgtttcttaaatttttcataaaattttaaaagcctttggcaaaaattttaatttattttttttaattaaaaatcgttaaaaatatatatgaaatatacccaatttaaacacattataatttggtaaggtgtcagttgtagaggctaaccaacagttgccagtggagaacactcactggatgcatggtgccaaattattatatttattttgcaaaaaatctttaattttagggaccattttgcataccaaaaaatgtttagtttttttattgtcaaattactgtttttcctctcaacttttccttccttccaattcccaaaaaaataattttttcttggtcctaccccattcttacgagtgcttaaaaatctcgtttctcgtgataagtatttttatttaattttttctattttatcaaaacttagcatatattcattaaattaagttaaaaattcgaatttcattcaagtttcccagctaaatgctttatttaccttaatttccttttttatctttgataaatttgatgaaattacattgatttattgggaagtaattaattgggtgaaagcaaaatattaaaaaatagccaaaaaacttatgcgacttttaactggcctttctagcaccgcgcgccataagtgtttaaatttaattcacattgagaaaaaagataaaaccaaaaatgacgaagccgaatgcggatcttcttgggagcaaaaatatttaaaaaacataaaaaacttttacctccacttccatcatttacaaatcgtcttaataagtatgaaagttgctctatgaaagggatttacatttggatactggataccgcatcgataacagaatgaatctgatttttttttcgacacggtagcgattgctcccgatcatccctaatgcaattgtttttctttcagttgcattcgaaattgaattttattattacggtaaaaatttaatttaatttaactgctattagttcagcccagcaaaagttgttatttatttaaaagtaaatcaaaccaaaaatcaaatgggtaatttctgaaaaataaattaaattaatcattgattacaccctaaagaacgagttttttaagaaaataaaagaaaatgataaaatttcaatattatatggtcttacaattagctaattgctaactgtggctctcttttcggtttttgatttgttgtgattagagaccggaaatttcaaatttgcggatcccgctgcgggattggaactcaaaattcaattacttttatggctttttggaatatatatatttttacattttattttggtcatttgcatattataccatgatgcaaaaaagaattcattttaaatgacctatttaccaaactcacgcttaattaattagtaaaaggaaaaacatttaccgtaatggacagccaaaccaccgtaaatgcctaactattgcatctcacgtaaatgtctacgtaaacagtcgcacatatgccctccacaatcagcacatggccaacaatgttgatgaatgcaggatagaaattgtcggaatgagtgtgccaagttccaaaatgccatggcataagcaacgaaaatgaaagtgccgctgatttcggtgccgtttgaagatgtttcaaccattttcatgaaaattttgtttaaaggaaaattcaaacactaacaaaagctaaatataaaataaaataaaattattgccattcggacgaatatttggttgcaaactgtcaattaagctaattttgttagctttttcgtcgcaaacgcaaataaaattataattaaatttttgttatctcattaataaatgtcagatttaatagatgagcacagaatgagaattgttaaaatcaaatgatttgtggtacttaaattatttatgtcattttaaaatgatatttgaaattagaccatgttttaaaaaatcggtgcaacaatttttttttattataatttttttagaagtttaaaatacttttaaagtaattttttgctcttaatttaataataagaattttatttaaagccaaactgtcaattatactaattttatttcttgtttattcataaacaataaaaaagtcatcagaagggcgagaaccacttactctgacgactgttcagataatgtgtcgtagagtaagtgataaaataaagttgatcacaggaattaaaaaagacaaatatgtgaaaataaattgaggtcaaagtcaaatgaggtcgaaataccaaatcacttagaaatttgttacattctagctttcccggtcttacatattaccctagtgaactttaagttttattttaaattgatttaaagaatttgttttgattagttctttatcgagttgattccacttaccctcccagcaaagggaatgaattttttgcccagtttgtattttgtgttaaatctataaaaggggatgttaaagcgtgctgatggattaaaaatagaaaatagtttcagatctgttcggccataaacaattttatgcgccataaacagattaaacagctttcgcctattctcaagtgttggcagttgcaggtattctaatcgattttggtatggaattggcggaaggctgcagtgatcagcaatttgaaaactttctcccctattttgggattttttgcccctacaaagcctcggcttaattatgagattaaatcgtagtggcctttatcacttaacacacatattcattcaattgcattttccaattatagaggattcgtatgattgcgtccattgtttatcataattggttgaagctgcaagttctgtacaggtgtcacgtggttataatttggccaaagcacggattggtatgcttgtcggtacacagaactgtaggcaattaaattagctaatttatttgccaaactaaaatttaaataaatttttaaatacaatttggacctggtaatgaaaagaaccggcgcactgctgcaatggcctaacacaaaaaaggcataagcaacgggacgagcaatgtgcgaaagagtaaatgcactcaaattgaaccacccaaagacaaattggaagcaaaaacttgtcttaaaaacaatgaaataattaaaaatattataatcaggtaacggatttatatgtgctgaaaaactccaaaatatgtgctaaaaagccccaaaaaggccaaaatatgtgctaaaaattgaataaaaaaatgctcaaaaataagtgatttctcagataagtctcaatttttttattatttcgctagcataaatgcaaacaaaatcatttcaatgcttttggtgaaaacttcttttcgctttctaagattgacttattttcccagattttcgagaaaattcaaattttgccataaaagtgaaaaaaaatcgccaaaatatatgataaaaactatcaaaaacccaaaattgtttttatgagcaaaaagcccaaaatatgtttagctaacttgattgctatgaaaacaggtaaaaatgctatttttgagcttttcatgcgatgacatatgcgcaaaaaatatgtaaaaacatataaatccgttccctgcttataatattgaggaaattcaaataaacaaactccgatatgaaagatgagattgatggacataattaaactgactgaacgaagcaaccgtttgctttgtacgtccgttaaagctaaatgtcaatttggtaaatgaatttgtcataattattctgggactttttatatattaataatgcagaggtttttgagaaattccattaaaaatttatataaaattttagatttttttgtatttttgggtaagattttgccaaagaatcaacaaaaatcattttttgttaaaatttctaaacggtaattttccaagcggctttattttttgtgcctatgaattaatatgatcattcactgacactgattccaccaactgatcagccaaagcattgcgtagcacaaaacttcagcaacctcaataatcagtatgttataaactgtgtaaccaatgatttcggattgatttgccgggtcggaaagttcgcatctgactaatctgtgaaaaaagaaacatcaattaaagtaaaatgggtcatttgccgaattgcccaacttttcccaatgcttggaactgccgtaataatccacgcatttatcaacaatcactttggtcaaacagatagtgatcagcactttgaaaactaaatactttccgctcatattgtacctgaaaatgcgataaatatcgacattttttctgtgccaaaatttgaccgctgtaaaattaccaaattggaaatgaaacggccattaatcgttccactccgatgcacaattgcaatattatggccatcacacaagctgatcgactgatgaattgtatccaaaagcatgtcccgagagttataaaatttatgccaaaaatcaaaatgacaattttgacacaaaatccgatgtggagaaaaatggcaaaaaaagcgtacaaagcgatcagaatattgcattgggagtgaatcgatctgccaaataaaaaatattatcatttggaacgaagcgatctgccaaataaaaaatattatatgtatttaaatttaagaaactgaaaatttggcattattccacggaaaatgtccacacccgtggaagttttacccaaagatgagatgcaataatcagaatttttctcgaatcactactaaatatttggtaggaaatgccaatatgattgctaattaatgttttctagaaaataatatgatcattttacgaaaaaggcgcacttagatttgacggtgatgtaaacaagtgacgtatttagcgcaattccaaaaaagcaaaccaccgtaatgatcccactaattgcaatttcgatgaacacaaaaccagcctcatcctttgactaaacaaacaatgaatgattgatttcaaaaagcttatattaattttggcacctctttaattattattattattttatattaattttggcacctcattaattattattattattttacctgttgatcagttacatttgatgacataattattattcaaattggaaaatttaaacacgaaagaaatgtaaagaaatataaactgaatgaaattattgccagtcgggcgcattctttttctgaaagaaaaagagaagtaatttgataattataaatttgatttaaagtcaaactgtcaattaagctccaacctgccaattaagctaattttatttttccttcacaaatgaatgaaaataaaaatatttgtatttatttcccaactaaaataatttaataaactcaaacttaataaaataaataaagtagttaattgattatgggcaaaattaaattatttatattattcaaattattattgtgaagttaaaatgaattaaattttttggtgccacaaatgacgaaaatctatatttgtttttattgaatacatttttgggaagcattttttattactttgtttctaaggtaaattattaatttcttaaaattggtgctccaattttttttgcaatttcttttagaagctatcaatgcattaggctaaacaaattagagaaaaagtttagttaataaaaaaaataaatttaaatgtaaaattcattaagtaaatttaagcataatttgaagccaaatttgggtatttctgagaaatttccaaaaatacccatataacaaaagttgcatacattaggatttaaaatttttgaaaatctttcaaaaaatttcttttttctcgaccaaaatttttaaattcgaaacaattttaaattgaattcaaattaacaaggattgttctgcacaaaatatgacaatcaaataaagagaaaattatagaacagcattttttctgctaaatcaaattgaagaatcatcagatggaacttttaggcccattaggccacgctggccgacactttcgccggccaaaaaagtggctttgatcagcgcttggcgaagcccatcgccggcattcaaaaaatgtacagtgccggcaacaaaacaatcgccggccgccaatgtgtccaccacacggccattggacggaaaatgggctgacaattcgatgacagtgccatcattctcagtgcatgggaatggcacggaagtgccaattttggcggcaactccctgaaaccaaacccggaatattattttctgccgaaatggctggcattttccaattttttgaggcctagaccttaattttaaggtctatgagaattttttcgttcgttgtaccttcccgtcttttggccattttttgcgaacattaattatttctcgcttggaatggcgtgtatttaaactcctaggattttcttaattcttttttaaatttccaccttctcaccccaagggcaaattacggcggaatggtgggcgccatatttttcttggaacattgtcacacattcatgcattgttgtccaagcttaaaaaattgagaattttgagaatttagggagtgaatcgatctgtcaaataaaaattagttattatacatgaaatacaggggaggggggttgcaggaagcagaaaagagtgaaatttctgaaaaatttgactaatttattaataaaattcattga

SEQ ID NO: 1982 - DNA, 2972 bp, Heterodera glycines
cccgagggggggggggggggggaggaccagactgacggtacaaaaacgaggaagaaacaaaaatatatatttggtgtgctgctaattatgagcgaaaattacggaacatggaaaagtggcttcatctccgctcccccgccccctccaaaaaatgaaatgccatttttggtaactactgacccccctcccctggcaaccctttcctcctgtttttgttggcacgaattgggtcgccggcgaaaggtgccaatgctttgctgctggactgattggagtttttggcacaaaatttgcatcccacgacccccactttttcatcaattccgtcgaacacccccaccccccggggaacggaccccgttatgcatttcattcattttcgactaaatccctaaagcccttgccgaggagggagtggacccattcgccgcgcttttttatcgcatctggcacaatatattaatatgctaataaatgaaatgaggaactccaacaccatttctatttaaggcatcatcaaatctccccagatccattctttgagcagcgagttaatcgttcattttggcacactttgcgtcgttgtcggcacaccaaaataattcaacttcaagaaaaatttattgatcggcacatcaccaaccaccaccaccaccaccaccaccaccactaccaccattagccatatcgctcgcgcacatctattaactaatgagttcaacaaaaacattggcaaaacaaatgccattagctgctgctgcttctgctgcacggggaggaggaaaagcggctttatgtggtgccaaacaggacgaaaattgtcgtttccggaatagcggtggtgccagcattgacagccgccgcctccgcttagctgggggcctgaaagcttttggcttcattggctgtgcgacgacgacgacgacggcattggcatttactgaaacagtggaggatgaggcggatgagggggaagaggaaaagacgattcatcgccaaagaagctgcataacagattcaacaacaagacaaaaaatagcagcaacggcacaactgctggccgatcaccacggggatgaagttgcttcatcttcggcaccactattttcctcttccggttcggcatcattatcctccaccgctgcttcgttattttgcccctcttcatccggcgggtacaacatttttagagttggctccccggcttcgtcttcggcttcatcttttttggcacatcccgtgccgttgtcgtgcttctccgcctgtttttctcccgtgcttcctgctactaatactgctgctgctgctgtttctgtcccatctcacttcagtttcacgcttctcttccttttattgtgcacatctcagttgttcatctgcaggtatttcttgggaaagttgtgtgccaaaatcctttgccggatatacttttaaccgtgattaaaatgcgactaaaaagcatgccgctagaaaaggttccgactgaatttcaggattccaatttttgaaaaacccaggtctagtctaagcccaaacctaataatggcgaaattctgtagttccatgatcccacaacctactccgatcagtgctttactttgatcagagtctcatccaactgattaatttgtgatgcctctgttgaccattctcgactcggtgctttatcaggatttccgataatgatttgcccatttgtccccctcgatctgagggtttccgaccaaaatgcctatctccacactccccccccccacccaaacagtgctgtccctgctcggcatggttcatcctcgtccgatcagtcgtcctcgctgatcaccactgatcaagcgtttacgatgcgcgaagaatgttaccatcgctacgcaaactctgatcaccattcgtcgttgctgcattggctgcaccggaagaatgcttcacactattcaccaatttcaccatcctaccagcaagcattgcttaagctgagggtgagtcatctctttttttttgtttttggcatttttgtgccataatttcaggcccaggaattggcccacggcctccaagtgacttccggtgcgtccagttgcaactcgcgcaaaatgaaggtaaacagtgggaggggcactttttgttattgtagttaccatgacatggcacggtattaccggtgaaatttttggcgctttgttttgtgtcaaaatattacgcatttgggtactgtattttttaccataaaacgattataagggacaaatcgtcattaaaagttgaccactgcactttatcgaaatggccgtagatttatacggtatttataccaaattaagtggcaattactccatgaaaatttttttctttccataaatccgttttttgttttgttgcaaatttaccttttgtacggaatacggtattatttggcaaaatactatttttgtagtcaatcaaaaataaacattcaattttaaagaatgtgcacattggcactcaaaaataattcataaaacgtttttacggatcagaaaacatctaccgtaatccaaattttttggagataaagtcatcaatcactgacttacaccgcttaccgtaatccagatttttttgaaggtaagtgatcactcactgccttacacagtgctaatctctttcactgatcgcttgccgtaaccaaaattttcgggtcaatgcccacatttctgcaaacctgatcactgatcattgacacacagtaatacccacattccgtttttgaaggtgatcagtgccagcactccgctcagggaacgggcattgtgccaatttgagtacgtcctcaactacaagcccaatgtttgttgtgcagcgtgcatttttggcacataaatatcccatatgatccgttcagagaatcccgtccacattcaccgaagtcaaatgttcatgtccacggccctccattaggatggtgggcaaccgtatgttcgagtgcgagccgttac

SEQ ID NO: 1983 - DNA, 1582 bp, Heterodera glycines
  misc_feature (65)..(65): n is a, c, g, or t
tcgaaaacttcgcggtttttgggcttcgaacttccagcttttgcttcgggtaatttacccgaagnttcgagaaaaatacacctttaacaatcgagttttcaaagtgaaaaatacacccctaatgattagcttatagtgaatttaaatttaaatctcattacatgtttttctcttggatccgttcctgatttttgcgttagatcagttccctccaagtaattgtttttctttcaatttttcacaaattaagactttaaaaatatgatgtaagtgtagatttttatcatataagttgaaaattcgcaccttttcacccgtctggcgacgcctaccccgcccccaatttttcttaaaaaataggctcaaacatcgcaaaatttttacattttttgcttaaatttgttaacaagatacgctcaaatttcaaaatttttcccgacggcgcctaccggcgccgttggcccgttcccaaaaagttttttggaaaaagcgcgccgcaaaaaacgttttattgagttttttaaacttggaataaaatttacaaaatgctgattttttaccggccaaatgctgattttgaaaattttcagttggtagccctgatcaaaatcaaaaaaggaaaaatttattaggaaaaacattagttattagtttttttttaatttattgaaagctttaattaatttttagtgaatacgaaaattttttgaaaaaaaaagtttttgttaggataaaattattttttcaaaaacttcgagcttcgtgcttcgagcttcgaaaacttcgcggtttttgggcttcgaacttcgaacttcgtgcttcgaaaaaaattgggcttcgccttcggcttcggcttcgagtgctaagccgagcttcgcccagtccctgatcccgacacttaccgtaaccatttttatgcccaaacacataccgtaatcatttttgttggttgttcttgtcccagcccaaatacataccgttgttcttaccccagcccaacactttgcgtaattattcgtaggcccaaacatgtaccgtaccatttttattgtaccgtacgcccaaaactataaaaaacgatctgttcttgttatcagaaccctaaatgcatgtgtttttgttgtttaatttcggcagaatttgatcagaattgcaattgtagtggcctaggtagaatatagattgaagccaagtggagacaaattgtcgaaccgacaaaatgccaaaaaaaaatgaaaaatttaatttaaaaacagcgacttttcccacttccaatcagtgatcacattaaaaacaaatccttttggccatactgtgctgtgtaatgtccgaaaattcattgtgggtgcatgaaaatgtgttgatggcataaaatttttgttttgttttttttttgctaatttgctgtttgcccattccattggattaaaatttaaaaaaaaatacagaaaagtccgaagcccccaaaaatttcagattatcggattcatttctatcccatacagaatcgcaattcgggaaaggttgttgggtggcatccctggaaacagagaaaattttcaaaaattaatggtttcaattt

SEQ ID NO: 1984 - DNA, 2541 bp, Heterodera glycines
tatgtgtatactgtgatatttttatcaaatgctttaagtgcacatttttgccaaccgcgccacaaattttcttatgccatttatcgaaaacaaatagaaactagaaacatctggtgctgttttgacgcggttgttgatctttttggcacggcacaaatttggtcggacgaatggcactaatctctcccgcaaggcaaaaaaaaaatgcgtatgccaaaaaagggcggcgccttcaaagggcaaagagagagagagagcatagaaaatagatagagagagagcgagagaaagagaaagcgagagagggagagaaaagagagtaagagagagagagagagagaagagagaacattgagagagagagagagagcgagtgaggagaaagaaaagagtgagacagatttagatttaattggtttcaaatctatccaagaaatcatccgcggattatcggattatatacccaaacgcgtatttgacgggtattaagactcaaaaaagactatctcttttttgcggcttttatcaaaccgataattgcataccaacaattgccttctgttgtctggctcaataaagcattcatagggtttttgaaacgctaccaaaaaggttcttatccaaaaaatcgctatctctttttttttggaattttaccggacctcagagtgtggggaataggattttcatacctgatttgctgataaaaattccaaacgcgtatttgccgggtattaagcccgcaaatcccgcattatccaaaaaatgcgggattgcggactgggatcccgcaaaatcccgcgcgggatcccgtcccgcgccggtctctaattctatggtcatttttatggcattttatgcctttgtttcactttttacgaagaatttttatccaaaaaagtacaactgagtaccaaggttccggttttgaccggtactggtactagtaccggttttttaccggttttcccagccaaaaagtaccggtttttcaacccgaaaattaccggtaccggtttttttacaattaccggttaccgctcaaccctagtaaatggtattcaaaaaataataattttagaacaaaagatacaaataaaaaaaattataaatttattatttaaattataaaccgaaatttttatttttattttgtgcaaattttttcccccataaaaatttacccaatttttctgaggttgagcattttccattaatttattttattcatttttaaatgaaataaatgtgttgtatgtgtacatccaattagcagatgcatcagtgaataaatgtgctttttgttgctcgttaattttgatgatttccaaaaaatgggaagcgaaaatgccgttgccagcgactgtgccgagaaattttttttttttgaatttttaatttaattttatcggaaaaattggcatgaacggtggtgatatcattgtgccagggattgattttatttgttgtaaaatttatttttaaaaaattacactaaaaatgaggtctggaatttatttaggaaaacaaatttttaggtttttacctatttttcttttctaagcccactatggtctaaaatgcacgaaaagcatgtttttttgaggggttgttaagctacttttcgagtttttagaaccaattttctaggttttcaaaatttttgaaaaaacttattttcactcattctggcgttttgcccaaaatttgttaacaaaaatgctataaaaaggaaaaatacacccctaagaatctatctaaaatttttttttcaaaaatacaaccctaagaatcgacctgaaaattttcaaaaaatgcacccctaagaaattaaaaatttcttaaaaattcatttccaaaattttttatttattttatcaagaatttttgattttaaaaatatttatctcaatactggtttggcctaatttaaaataaattttgtcattttacactcctaattttgaaactttttggcacctattttcccatttttagcacctattttgggggttttttagaacctaaaacctaactattttagcagtttttagtaaaaattggagccctaatgataacaaatgattcacaaaaaaaaatttggcactagtgaaaaagtcaccacttttgaaaattttttcaaacttttttttcatgcaattttttttttgtttatttacacataatgatgttgtatattaagcattaccatcacaattatggtgaataaaaagtatattcacgattttttatctcaaaaaaattttgcaaaacaaaagggtccctccccccttttgtttttgataaaattaaaaatctgtcactttataactggcgccaaatttgcttaataggcccaaataattgtcatattcatgatcagcgacctctaagccccccggggtacttaatttcatgactttttaaacaaaaaaaaagggcgccggacttttcgacagcaaaggacatttgacagaaatattataaatttgaggaggggacttttcgacagaaaaagtaattaaattcagattagggggg

SEQ ID NO: 1985 - DNA, 1243 bp, Heterodera glycines
gcaaaaaaaaaaaagttgaaatatttccgtatttgttacggaatccataatttttgacaaaaacattttaaataaaatttggagtaaacacattttcagcccttttcaccttaactttttaaaccaaatgaaattttttaaatttcatcaccgcttaactgaaaccctgcagtatgtatcttcaaaaaacaaaaactatttttcctaaaaatattatataaaaaacaaattttggcacaaaattcggcggcatttgtcgagatcgggtttttctccatttttcaagcatttttatttccttatctttgtgttgattgtgcttcctgtcaacaaatccgttttagctttagcgggcgggggggggggggggtaaaaaattccaaaatttcgcattttcttctttctgtgtacgatgagtgaaaaaaaaaagtgagcgtaccaaaaaaggaaataacggcacggcaccaaattttcatgccattgttctcggatctcgctgaaaaaaagttattttacattagcaagcagagcagcaacaaaaatttttttgttgttggtgggtcattagccgctaatttgggtggcaaacgcaaagggccgatttatcacttccattcactcattggtcgcccattgttccgttctgccgcggcacagccaagcaacacaaacaaatttttttggcattcgcctttttggccaaatttttcaacatccacagggattcgaagcttgctcttggccagcaggcttgccatttttttcagggccaaattggcatggccccgagagtttgagaattaagactctcttgaaatacccaacttaaatttcttgaaattcgcaatacgtccgagtgttgagagaatacgagggtctagaaatgccagagaaatttcattggccgacattttaggacagatctattggcacgcagtggcatcttgccagattggcacttagtgccggcacactcggaaaccctctgaattgtgtgccctgtaacccatgagattgatcattcgaagcgaaatttgacactgtgcccttctaaattggccctgataccgccctgaaattggcaatttgatgcggaatcaacgcttggcttttggcccaacctgaattggcactgatctccataaattgttgcgaaattggcatcccaactccgatttcttccctgaggcgaggggacgtatgacaatttttttttgaggaaaggtggggggggggggggggg

SEQ ID NO: 1986 - DNA, 3477 bp, Heterodera glycines
  misc_feature (13)..(13): n is a, c, g, or t
gctccattgcccncattttgttgaaagaacaatcatttctcatccaaaaagatcgcgctcctcccactcccccgtttttttggcttttaaccaacggcgacggccatggcactctcaaaaagaaattgccaaaaaagcggccacggcactctcaaaagaaattgccaaaaatttaaattcctttttttaagaaatttcattttaaaatggcactccaaatttcaaacaccgtcttcatgctgattgtgttggccacttcgcttctgctgttgatgccgtccagcagcaatgccaaagtgatgccccaacttggtacggttgttttttggcgctcccaaattcaaaatgccagcaaatcaattttatttcaaaatgccaaaactatcccgttcaaaaatcgaggttttaatgccgtgagcaatcctatgacatcatcatatgtcctaataaaattttgccaaatcaaagaaatgccgccgtgccctattttcaaaatgcctaactttcccattcaaaaattgagaaatgccgtggataagccaatttccaaagtttcggtggcccatccgtcataataaatcttcctggaccactccattttcccactaatgactcccgcgagtgccataaaatcccattttttggggcaatttcaggcttcgcgaatgcagaacaactgatgaatgacaacagcagtccaatgggcgccggagttgagggtgaagtcatggacaaagtggaggcccgacttttgggtaaaacaatttaaaattggcattcattttggcaaattgttgcgtcacagagagtgccaaaatttaattgcaaaataatttgaaaaaatgccatttttgaaaatcatggaccaacatcattcattcatacaggtgcactggaacttcttcaaagctataaagaaggtgaggagaacaatgggatgactttatttaattggtgggatttcatattatgccacaggacaaaacgccaaaagaaaaaaaatgcaaattaattacgttaactgatcagtagggcttcgatttttaggtgctaaaaactgccaaaataagtaggttttaggttctaaaaaacccccaaaataggtgctaaaaatgggaaaataggtgccaaaaagttccgaatttaggggtgtaaaatcgaaaattttcatcaaaaagcaaaaatattttgccaagtcattaaggatatacataattttcaaaatcaaaaattatcgtcaagaaaataaaataaataaattttggagataaatttttgagaaatttttcatttcttaggggcgcatttttgaaaattttctggtcgattcttagggatgtattttttgaaaaaatttttgggtcggttcttaggggtgtatttttcttttttttgcatatttttaacaaattttgggcaaaacgccaaaataggtgaaaataagtttttttaaatttttttaggttttttaggtgctaaaaataaaaacctagaaaataggtgctaataactcgaaaagtagcttaacaacagcccaaaaaaacatgtttttcgtgcgtttcaggccacggggagctcaggaaaaaaatatgtaaaaacctaaaaatcgaagccctactgatcagtagggctggcaaaaataaatacaaaaagtggtaaaatatgtacataaatatgtaaaaaaaaaaaaaaaattttggtcatttttggaaaaaagttcttagtaaagggtgaaataggacctaaatagtcttagaatcacatttttgtatatttaaatattaatttttggtatctccttttttgaaaaaaaaacaatttttaggggtacatattcaaaaaaattttatttttttcacaagaaatttttataaattttaaaaatttctcaaaaaaatttagaaaaaaatgctaaaaagtccaaaatatgtaaaaaaaaaaagcccgaaatatgtaaaaatatgtaaataaaagtcccaacttttgttcacaaacacaaaaaagaaagtgtttttcctactatttagagcatggttggaaaatccaggaaaaaatatgtatttacataaaattgacattacaaaaaagcaaatttaaattccattaactgatcagctgatcattttgccataattaccgtatttgtttcttttctcttttttatgatactgtcctgtttccgttataacaaattagtgaaactaattaattatatgagctctaaatgtaattgactgaccataataccaaattcggccgtccctcattcattttgtaagtggacaatcaaccattggtttcggttttccttattggtaccccctcgaagacatctctcacccaaattttccaaaaaatttcgctaaatttttccaaaaatgccacaatattagcgcagttttttgtgaaaatctgataaagaattgagggaaaaccaacaaaaaaaaattcccggaaatccgaaattctcattttaaatccaaaatctttgtgtcagctttttaagaaatttttttttttggcaggctttcaaatatcataaatgaaactggtttttttcagtcccaattgtgcccaaattcacggaaaagcggaagaacaaattcgagttcatccgattcgggaagagaagacgatgatcaacaagagagagagagagtggaaggacagacagtcagacaaaaccatttgagtgatcagagagcggtgatcaatgatacatttttaacaaatacacgtacaattttggtaatattatcgctggcaatgggacattttttgcttttttgatgggcattgaataaagagaaacactgtgatcaaaaattgatgatgaatgtgtgaaaattcacaattctcggggtgtcaaaaatgtcttctgttaaccaccgagtctcggaaattctcagtctcgagtttcactaattggcggatctcagatatctgcaaaggataacaatttgaatatttaaaattagatctcgagctggattctaggccaggattttttctttgcttttttccaagaaatgcacaggtccaggtttttcaaaatgtcgagctctaattttaacagattgtgtgtcttattagtagggtcgcgacttttagtgacgaaaactctcgaaatagttaactaaaataatgagtaaaaatgccaaaatagtgacaaaatagtggcaaaaagtccgaaatagtgacataattttttgccaaaatatataccaaaaaaataatttttaaaattaaaattcttgccaaaaaaatgcatttttgagaaaatgttttcatttcttaggagtgtatagaaaaatttcgcgtcgatttttaggggtaaatttttcgtttttatcgcatttttattgagaaatttccaaaaaatgccgaaatagtgaaaaaatagtgacaaagcgccaaaatagtgatttctagtgacggataatgacggcagaagcgaaaatttttaatgcagaaaat

SEQ ID NO: 1987 - DNA, 1412 bp, Heterodera glycines
ggttaatgtttgtgaaaaatttgcactacatcttttctttttgacgcgaaaataataaaaattggcaaaacccctacaaattactgctttttcgcttcggtgctgaaatttaaaaaaaaaaaaactgtaaaaattttttggccagaaacccaatcaaacggtcttcagattcctccatcccctccgaaattttttgtttttggctacgggtctgaatgaggcacaattcaattcaattcaattcgagagcatttccaatccgtccgtccgtccggtgtccgtttgattattcattcatttttgcccttttctttttcctcctcctcattgttgtcgtcgtcgttgttgttctcctcttcctcatcctcttcttcttcctcttccacttcttccgtctctgctgctgctgctgttgccgcacttttcttatgcattattgtcaactcatttttggacgcgttgaacccgttgcacttgtagcagaaaaaggacagacttttgaactcctccagcagtgccatgccgttgtgggtgtgacaatgggcacagatcagcgcgtaactgtacaagaaaacaatcaaatgggcaaaaaattgggttagaaattcacaaaaattcaaaaaataaaataaaattttttccccagcggcacacatcagcaccgatggaagaccacagaaatgtttctgataaatgttttgtcagggctatgaattctaatggggcaaaaaataaatgaataaaatgggagaagttcgtttcccccgtaccgttcttccgccctccctcgaatttttttttaatttaatattttttcggaaaaaatttcctttttttgttttgctataataaatcagtgaaaaaaaatgttaaaaaccgaccgactgttgatactttcacccatcaaaaagtccaaaacgcgatctgaaaaatgtatagaattaaataatgatgtaaaaaaaaacaaatttaaaatggcagtcccaaaaaagtgtcgccgaacggtgcaaattttttgaaaaaattcagcgaaaaatccgatagaaaaaaaatactcggcccaacggtcaacccaccgggagcaattcgtttcctacccccgcaagaaaattttgaaaaaattgctgcaaaattaaaaaaaaatttttttttttttgaaatttcttaagaaaaaacattctaatcaagggcgtacccagacccgtaagtaagtccatcggaaaaacctttgaattttgaccgatttaaacagattttccaaaaaattgaaattttggaaaattaaaaaaaaaactcgggggcggggagaggaaccatttttatgtttcatgattttttttttttttgttttttgcttacccactggcgtccgacaatgctcaatgaacggacgaattggcgtcctctgctgc

SEQ ID NO: 1988 - DNA, 1199 bp, Heterodera glycines
tatccatattttatgtgttatttggccatttttttcaacaaacctctattagaacggctcccttctgctaaattgacctttttgtccccttaaagacagaaaaattttcaaagaaaacttttttaggtaatttttgtggataattttgtttaaatttatcattctaaaatttgtttattttatgtcaaaataagcttaaaaaggaatttctatttatatataatttttcactaaaattaataaaataccgtttttagccatttgaagaattttaaatttattgaatttatagaaattttgagttaacccctcattctgataaaatttatgccaatattttctctagccattgttgtgatgttgtttctttattattattttttttaatttgtattttttaacttttaggcacttccgtttgtgttgatcgacaccgattgtgctctttctgggcttcgcttaaggaatgcgagacaaatgcagtttggatggtggttaactgtgctcggtcttgcaaaatgtgtaaaggtgaaaattaaaaataaattattattattattatttatttaaaattaaaattgcaggtaaagctgcggttcgggctgcgaatggtgaatttgaggaaacggattgtaagttttggttgcttaaataattaaaaatttaacatgattttaataaaaatccgaatcgctttgagaccatcgaattattttaatttaaaaaaaaatttttttttaattaaagcattaattttccaggcacatttgtctcaacgcatgaaggtaaatttaaaaaaaaacatttaaaaattaaaatataaaattctaataaaaaatatataattttaagacatttccattcgtcgaacgatttcaacaaccgatgttcgcatcagcaacggcgcgtttggttgtgtgccaacacagacggcgacaaactgcaagaaaaatttgtgctaccatttgaaattccgcagctttgacggtgatataaaaaataaataaatttcaatttttgtttttaataatgcctataggaacgtgcaacaatttggaaaagccgttgcgcggagctgcatttatgccattcgcaaggtccttttttgttgagaaatttggataaaaaaattttctttttaattttaattaattttacatttaagattaaaatcttctatttatgatgacaatcttgga

SEQ ID NO: 1989 - DNA, 1651 bp, Heterodera glycines
  misc_feature (30)..(30): n is a, c, g, or t
  misc_feature (42)..(42): n is a, c, g, or t
taaaatacattaattttttaaaaacgactnggatacgaattnaatagacttatttgaatgctttttttattagctacttgccaaaaagggggtcatttttatgaaacgacttagtaaatgatactaattttgaaaaatataaattgttaaattattacctaatttaaattgttatttttactcagatgctgagttcagcctcggaaattccggtgcgttggaatgcgttgttcatgcaatggggccaattcattgcgcatgacgtggccaagacgacaatgcttaacaaccaagtaaaaacatcattatcatttcaatattgactatttcagctcgagaattaacatcaaaattacatacaaaaataattttgaaccaaaaattattttaaaaagtttaaattcctataaaattacatatgtatgaaaaaaacccttttgtccaattaagatagaattttattgattttttaataaatatgttgttgttttttaagatttgcgccagttgtaagccggaaggtggtcaatgtttttcagtgatgttgagtcgaatggacccaacgtaacttttttttttagctaaattatttttttttaattatttaaaaaaaaattataaaattttgttaatttagttttggacgatttttgtgcttaccagtcgccagatcagcaccggtaggtttttttttgaatttgcattagcttttttatgcattttcttattcaaggtttgtggaacgggcagcgatcaaacgcgagaacagtacaatgagaacaccgcattcattgacggttcaatggtatagttttaaacaaatttaatttttatttatttgatttccaattaataaatcccaaaaatgatgaaaatttcaaacccattttatggcaaaattcggcggtgctgctgatttgtagagaataaatagaatatagaatattattttaataattttgtaaataattttaaacaaaaatttaattaaattttaaattatttccagatttacgggagcagcacgcgtgatcaattcctgttccgtcaaggaggcttcatgaagacgaacattctgcgcggtcgaattttcccgcccgttgacaacaatcaaaatttgattgcgggcgatgaccgagcaaacatttttgtcggcctcgccgcactgcacacactgtttgttcgagaacacaacaggtgaattgatgtgaaatcactgaccttggtagagttggacaaaatcattcaaagtttatagatttttgtaccatttgaattggtcactgattaaacagataagcgtttgttattaaacaccataaaattgtgtattcaattcggaatatcaaatcagaacgctgacccgtagcatgtgatccagggacggtcggtctattgacgaaccttttttgctagccaaccgacaaaactttttcccgcactatttattttttttccattttcccttaaaatttggagccaccgggtcttggagggtggtactaaaataaaaccgaaaattaaaaaaataataaattgattattaaaaaatttgaatgtagatgtgtggggggaagggtatcccgcatccatgagttctaaggagagaagagttctcgataggcattatgtgtaaagaaaatagaaaaat

SEQ ID NO: 1990 - DNA, 2953 bp, Heterodera glycines
  misc_feature (22)..(23): n is a, c, g, or t
  misc_feature (35)..(35): n is a, c, g, or t
cattaaaaaatcattttatttnntttaaggaatantctgccacagttgtgttgggcaaaaaattcaatgaactaattgggccatacagaggatacaacccaaaggttgacccttctgttttggtgagttattttttaaataaaattaaattttatgatatttttaaaatatcatttttgtagaatgaattcactggctgcgcattccgatttggacatggcatgatacaggtcagaaaatttttagtgagctgataaattattaagaaaagaaattcgtaaaatttgaactttaaatacaaaaatttatgaaaaacaattgttattgtttgtgcttaaagttacaataattaattaattgcaaatacaaaaattaatttaattaatttatgttaaggaattttatccattcttcaatgagaaatttcaacaaattggtatgtttattgtttatttgtatgtcgatcagaaaaaataaataaatataattaaggtggaatcccattcaacgatggaatgttcaggagtattcatataatcaacaacggcattgatccattgatcaggggtaaactgattagttggcgggcactgatcagctttagcacaatcaacattttgaaaattttaaggccttatgacactgccagcaaaaatgccgcaacgcttaacaattgcagtaacggagaaaatttttgggaattccgatcttgggtgagtttttttcatgttgcggcataaaattcaatttaaaaatttcggatttattttaacaattataataaatttatttattttttcatcaatctttgcttaagttcaatcaacattcaacgtggtcgtgaccatggcatccctggttacactgcttggcgcgaagtgtgcaatttgccgccagtgcgcgactttaacgacttgaacagcacaattacgaatccggttgtgcgcgaaaatttgcgtattctttacaaaagagttggtgcgtgagtgttattaacatttttagggggtgggggattttatgtattttataaatttttacctagagaacggtgtacaataccaccacaccctgcaatttataaatttgggaatctgaaaatcacaaaacaaaaaaaaattcaaaaaatttgttaggaaataaaaactttcgggcttgtccttatcttgaaccaaaatgttcaaaaccctataagctccttagctttgcacgaattaaattaaaaattaaatattaaaactaaattttttctctaattaactatctatccaaattaaacaattatttttaactattattaaaaaatctttaaagaactcattgacatgtatgttggaagcattttggaagaccccgttgaaggaggaatgattggtgagcaatttttaaagaatattttgctcagaatttccaaaatgatttaggtccaacgcttgcctgcattattggaaagcaattcagggcactcagagatggagatcggtaaaaatttcagcgttttccaacttcaaaaaacaaaataaaaaaatccagatttttctatgaaaaccgaaaagtgatgtccgaggagcacatacgacaaataaaacgtgcctcattagcacgaatgctgtgtgattctggggacggaatgaaattggtgcttagttttattcagttggaaatttcaattatttttaaagatttaaaatttaatttaattattattcaaaaattattattaaatttataggattgtttcgagacaaataacaaaaaaatactaatttaaaaaaccaattcttatttgatcattgcttttgaatttaaaaatgacaaatgatctacagtatgatcattattaagtattgaaactttaaaattcaaattttaggtgccaaagcacgcattcaatcaaatccaaggacagaatgagctgttcacatgtgaccaaatagactcaccaaattacttcaaatggaaagacacctcatttttctcataaatttcattttctaaaatatttaatttttttcatctacccaaaatattgctcaatatgattttgacgaatttgtctatttgaatattcctcaaccataccatatatattttttcctaataattacacatatatatatctctattaattgtaataaatatgttaacttcggcataaagatgtgtttgaattacggttttggatattttgtctggcatttaaattcttgctaaattggtttaaaaaaaaaattaaataatgattaaatttcacattttttcctttattgcgcagaggttcaaccaaccacgacacattcataatataaataacatgggcgaggggatggggtgatgttggccaaaaaggttgtgtgtgtgtttgtgtgtgatccgatcagtttggccagaggattgaaccatgttgctcagtcagcagggcaaaaggggggaattggccaagaaatcaaacaaacaaaacattgtcgccagaagagttagcttaaaacagatgcgaaaagctcattcttcctcttcctcctcttcaccgccctcatccccctcggcatcttcgtcatcatcatcgccttcttcatcatcatcgtcaccctctgcacctgttaaaaaatatattttaaatttaaaaaatttatttgaaaaagtagttgatcagttttatggtggcattaagttaatctaaacccagagaatatatgtttaagaattaagtttgccatttaaggaccatcagaatgcgcttggttacgtccttgaaagtcactcctttttgaattgtatttacttgaaattcagtacattataaaattttccatcatcgtaatatttgcgaattttaaagccatgagattgtcgtagtccaaggacatattttctcaaggacaacgcaattcaaaataataaaattcatccccccccccctctctctctctccctaccctcttcatcgtcttcc

SEQ ID NO: 1991 - DNA, 2098 bp, Heterodera glycines
gaccccctcatgtctctctgttccttcctctctcacgtgtgcccccccccccactattttgtccgtcttcgccttctctctgtgttatgctgctctctctctctcttttctttatgattgcccgtgccgttgttcgtctccatggattgtcgtgccccttttgtgcgtgttcgtccgtcgtcgtcgtcgtctctgccgtggtgtcccacaaatcgccgtcatatccttgggccaacgagtgaaaagtttacggagcaattaaccccaaagaagtgccataatcagtcgcttttccttccatttcattcatttatttttttgtaatcacaaaatttgcacacgaagagagagaaaataaacaaatgaaatattttggggagggaatgaaaatattcaaagcaaaagaaaaggatacaatttgaggatggattctgaatcctacgcaatttaagtgaggcgaatgcaaaatcattgtcagtccgtgccattccaaaacaaaagtcgcggagattcggtggaccaaatgctacgccctccgccggtcgttgcggtcacttgcgacgcgtcagcaatcgactgatcttcgcgcgtttgccgtttccttctcgcgcgattaaaattgcccgattgtttaccttaagaaaggggtgccgacaaatgaacataaggccatgagaatgactgactccaaaaagcatgtaactgggcgaccttcggacaattgtataagcggcatcgaagtcaatgtcctgaggggggggggggggaaagttggcatttgcttatttgttagggtaattagtaaaaagccatttcgaaaggccaattcccctttagcataacgcataaaacaaacagaacactcacaaatattcccaccatccatcgaccgccaaactgcttctccattatctgtaattgcatttaaacttctttaaatcacttagacattggaagagcaaagagtgagaagcatcataaacaaagaaaatattcaattcaattatgtttagaatctcaccaataattcaaatttatttcgtggattttttgagaaaaaaaatagagttgagtgggaccgggacctgaatacggaaaactgagtacaactgagtaccgaagtcccggttttaaccgggaccgggactagtcccggttttcccagcaaaaaattcccggtttttcaacccgaaaaggtcccggttaagcccaaaattcccggtcccgctcaactctatttaaaaatgaagagaagagaagagtgaggaacagaggaataattcttttaacaccattctctcatttctcaagagtggggcgagagaagcaaaaaagcgacgcagaaaaaaaacgttttaaggaagtaaaaaaaagagtgatataaaagttaaataataaaaaataataaaagtaacaaatttaaattgacaaatttctttgtgcttatccaaaaaattcaaaagcatgtaaatggaacaaaaaaaaatttttttttattattattatgaaaataaggaaaaattgttatgaaaaatgccaagttttcactgctgaaggcaaaacggtcggcagaaatgagaataacagcacacacacatacacacagcaaagaaggaacacccctcgctgagaatggcacacagcccacaaataaatggggagaaaaaaataatttttttttgagagagagaaatgagagattgccgcccccgccccctccgcccgcccctcgtcttcgacgtcgtagtcgtcgctgtcgctgctgtgtggtgtgagtgatgtgcggcggcggcggcgacgacgccgctcggtcggcaattcgccctgggcgaatggagcggagggcgggcgggggacggatggtactcaactggtgagagaatagatggatttttatgtggcaatatgagcgggcaaatagaagatgtaaagaggggactcatttttgttggcgtttaaatggacttatttggctgattaaaatggagatttttgtagggtacatggaatagagtagccaccaagggcgtcatttaatcaacactcaaaaaagggagtagcaatttgaatgatggatgtagaccagagaaactctaga

SEQ ID NO: 1992 - DNA, 2837 bp, Heterodera glycines
aagtcacgactttttgaaaaaactcctgaaaaattaggcgaaagttaaaaaatcacatttttaataatttatagaataacattttgatcgtatttttaggcacttaattttataaatagtatctaaaataggcataaaaaagagattcttccacaattaagaaaaaattcatccacattgcctttttatcgatcgaaattttatttcggaattttcttgtatttttcggcattttcttctctaaaattcaaattttgcctaaaaaagtcaaaaaaaaaatcatgaaaaaagtcgcaaaacgtcaaaaaaagccataaaaatccaaaaagtgtaaaaaaatcaaaaaagtcacaaaaatgcatgttagaagattcaaacagaatttagaacacactttttaagtcattttatgaaaccatttagagtcaacaaaaaaagccatttgacttaaattcccagtcctatttaacaccaaacataaattgcccacccatacggtttaacaaaattgtttcttaaacataattcatcgtttcaaatggttccaggcttttccccaaaaaagttgacaaatatgtgttaccgacgggcggaggatgtttaggactgggcaatcaaatggtaatttttgtgaacaagccgggatgggattaccgttcacaatatttcaaacaaaacaattagggaataaatgattttagggactggtccaaaagttttaaaattcaccccccaggggcaaggaaatttgagttttacgtgttttattaatttggtttttgtttttagttccgttttgccgcattgtacggaattggaaaaccttatggacggaagccgatttacaaggacagtcaaaaatgcaaaaagtcaagcgtaaatgcggtagaaaaaggcgagaagaaagagcatcttttcccgatctttgccagccaagaaaaatattttgtaattttaatttaattaataatttaatattatttcatttattttaattagttttataaattatacttaaaatttattcagaacccggaagaaaagaagaatgaaactgtttgtgtacagaatttattcattcgatgtttttcatatgtaaacccacaaaagtttgcctccttttttgattaatttcaattcattttgcttaagttttgctttttcgaggatcaagcagaaatatttggaattggatgtatttattaataaacaaaaaataaataaatttaaaatttaagggcgacggttgttttcaatcttataaattctttgaaagccgaagaatggaaatacgtcaaatatttcagtttgggcatcaactttgtttaaatgtgacggcattcaaaaatgaattatttgggtaagtatttgaaaaaataaataatattattattaatatacaatatatatacaaataaataattaaatttttttattaaaattaatatataataattgcaatcatttcagaaatgatcagtcacacaaattttgtgtgcacacccgcaggggagattttgttaaaagaggttgggactcgaagaaggaacctacggagaaaggaattgatttgggatttgaatatttaaaggcgactcataagttgtcgatacaagacactttgagatgaaagtatgaaaagttaaaatgggctaagtacgaaaagctgttcgaattgcctcattaagtctgtcggcaaattcacactctttcgtctgcttgtaaattgagaaagcttgtctcgctattgagcgcatattttggttttcttttttttttattcaaaaataaaaataaccaaaagaagggcaaagctgccgcttacatttgaggtggaaatacgagaggtcaaatgggtagaagtgaaagaagacaatttacatttggtaatgaaatgaggtcaatgggtagttgtgacatgattgttgaaattttaatttaagaagcggaagagtcagacctccagcaaagggaaattggtttttatagcaaattgagaaaaaatttttaggaaattgagtagagatattttttttttcgatttgttggaggtctgcagaactatttatcgaagcactggggaattgtttttgaaatgattccagttggaggagaaatttgtcaatatttgagagtggatttggattttcgttttgtgtgattgttttgtcaacctgcgatgattttgaagtgtcttcactggcctccttcggttctggtccattttctttggcaagagtcggaacatatagagaattgagattaattgctcaaacttgggtaattaaaccgttttcaatttcaaatttgggttttaattggtttaacggtagtttaattttgggtggttgattcaatgcttctaattccgctataaagtaatattttattttcttcgacttaatgaaaagcataatttcaggcttcacaattttgttcttcgaccagtgctgcaacatttgtttgtaccctcaacattacgcatttttggtggttttttttaccacccaaatttttcatttcatttttgccaaaaaattctttcgaattcgtatgcccaaaaatattaacaaatgcaataaaaaaaccgaaaaaacacccctaagaattgacccgaacattttaaaaatgcatcctagggaatgaaaaatatctcaaaaactcatccctagggctaatatttttagtttttttttttacttttttttcctgaactcctcgtggcctgaaacgcacgaaaaaatatttttttaggttattgttaagctagttttcgagttattagcaactattttctagttttttatttttagcacctaaaaaccttaaaaaattta

SEQ ID NO: 1993 - DNA, 3931 bp, Heterodera glycines
aaaaaggaaatagccatttttccaaatttttccaaacaaacgcgcagagaacaaaatccagaacaattagtatcggcgtaattatttgagaatgcggtggaaattcctattactgtggagcagaaaaagagatagccaattttccaaatttttcccaaacaaacgcgccgagaaacaaattccagaacaattagtatcgcgtaattattctgagaatgcggttggaattcctattactgttgagcagaaaaagagatatccaattttccaaatttttcccaaacaaacgcgccgagaaacaaattccagaacaattagtatcggcgtaattattctgagaacccagcccccccccctccccctctgaaaggaaaataaaattttaaaagaaacatagggacccattttttagaataaaaaacaattttctttttttttgtttttgaaataatcctaaaaataaaaatgctcttttgttagaaagtaccatttttatagcatctacaatgttggaaaattacacagtaaataatttctagggaccaaaaagcaaaaaattctcgaacctcccaacagttccgaattttttcaggttacgggcctgcttacaaagggaggtggccaagtgtccgtgggatttcgaaatgagattttttgggtagatagagcacccccgggttcataagaaaaatgtgcgtaaaattttaggcatttgcctaaaaaacaagtccctactgattaggaatttgatcaaaccaaaagatttgttttctctgaaatattccttgagttcttctagccataactgaaatgttgctgaattgtgacgccgtacgccgagacaaaaacaattaattgactataattaagccaaaaataaatgtccttggacttgatttctaaaattgataaatttgacacaaatcgattaagagtgaaaggaattgttcaaaagtcatttaacactccgccataaacgccggagagattcaagacagatattctcgaatagcattaataattggcataattttatttccattttatccggctaattgtaagcaaaatatttaaatctgtaatgatatttaaatatcagatttttacaactatccaaccaggaaactttaaatttcccaaaaattactatttacagggttttgtcggactaatcgtgcgcccatgaaaattttaaaacccaatcattaacagaactcggaaattcaaaattactgtttaattttgagttattaaattcataaatgtttttttctttttacgatttatttaattgtgtttttctttttgtttttgattagagcacgacgggaccgggactcccgcgggatttttacgagattcccggtcccgctttttttcggtgaacgggattttaacgggagcgggatttttacgggatcctgttcggactcccgtcccggaaatcgagtaaatacggtataggagcattaattctgccgtttgaatattgatgattttttttaatcacttcttgaaaacttgaaaaaaaaacatcggtcactagaaaataaattcgaaaattttgtccaggaaatccaggttttttcgtctttggtccggacctgaatttccttgacaaaaatccaggaaaatccgggtctaggaaaaatccaggttgccgaaaaatgacctggagctggatccaggaaaaatgcaagcttgaatccaggtcctggtcggccctaattttttaaatttatttctcaattattttgtgcttaaaagaaatatttatgactggccgaaaatgtgacggaattggcctttaaatggtaaggaaaaacagaatcagcagtacaaatttaatttctcaagggatatgcattttctgtgattgttcatgagtttttgtataattttagcctatttaaatcataaattaactttttttaaaacaaataaatatttattcggagtttcaaatccatttttgcaaaagcataaattttttcaaaaatattaaaacaataaaagcattttttgagaacactccgtttggatttaatcgcgagtcattgagccattgatcagttttatcggaatccattcaggcaaaaaatggtcacgtgtatgaaggcctaaaacagaattactcattattttaaaattcaacgaaattaaattaaaaaaactgacccggaagaaaatctgaattgtacaaaatggtagcatcgtcgggcatcaaataagcaatccaccaagcaaaagttgatgtctgtgccgacaaaaacaaagaatcgcatcccaacacggcaaaagccaaatcattagcccttggcattggtttcgacaaataaacattggcaaaaagcaaaaaaaaaaaaaaaaagaatttattttattaattatagtaataaaatatgttaatttatttgcctgccgattgaatgataaattcgccaaaaattgtttgtcttctccaagcaaaacaacagaaatggaaatgttgtcaaatttttcctaaatttttaattaaaaattaaaaaatgaccattcgccatatgaatcacctttaaatattcaaatccaaaatcaattcctttctccgtaggttccttcttcgagtcccaacctcttttaacaaaatctcccctgcggatatgcacacaaaatttgtgagactgatcatttctaaaagattggaattattatatattaattttaattaaaaaaatttatttgtatatatattgtatattaataataatattatttattttttcaaatacttacccaaataattcatttttgaatgccgtcacattcaaacaaagttgatgcccaaactgaaatatttgacgtatttccatccttcgactttcaaagaatttgtaagattggaaacaaccgtcgcccttaaattttaaatttatttattttttgtttattaataaatacatccaattccaaatatttctgcttgatcctcgaaaaagcaaaacttaagcaaaattaattgaaattaatcaaaaaagaaggcaaacttttgtgggtttacatatgaaaaacatcgaatgaataaattctgtacacaaacagtttcattcttcttttcttccgggttctgaataaattttaagtataatttataaaactaattaaaataaatgaaataatattaaattattaattaaattaaaattacaaaatatttttcttggctggcaaagatcgggaaaagctgctccttcttctcgcctttttctaccgcatttacgtgtgactttttgcatttgtcactgtccttgtaaatcggtttccgtccataaggttttccaattccgtacaatgcggcaaaacggaactaaaaacataagccaaatttaataaagcgcgttaaaatcgaatttccttgccccggggggggggggggggggtggattttaaattttttgaccagtccataaaatcatttaactctgattgtttttttaaaggttctgatcggtaatcccgacttgttcaccaaaattaccatttgattgcccagtcctgaacatcctccgcccgtcggtaacacatatttgtcaacttttttggggaaaagcctggaaccatttgaaacgatgaattatgtttaagaaacaaatttttgttataccggctagttttattttactctttttttctctgttccccctatggtctgaaacgcatgaaaaccatgttttttttggttgttgttaagcctagttttctagttattagagcctactttctagtttttttattttacaaaaatacaataaaaacgaaaaatgcacccctaagaatcgacctaaaatttttctcaaaaatacacccctaagaatcgaacaaaaaaaatttttcaaaaaatacacccctaataaacggacaaaaaatttttttcaaaaatcacctctaagaa

SEQ ID NO: 1994 - DNA, 3476 bp, Heterodera glycines
gggggcacacgacggtaccaactgggagacatacggtatgccaaaagttaccaaagaggagggcatacggtagaaagtgcttaccaaaaggtatcaaaggcgagaggcatacggtagaaagtgctgccaatgggacaattcggtcagaatggcaacagaaaagcattttcccattcgtttgctcagctgtcgaaggggtccaccgaattcaacgtgttcgggcagatgctcatcgtcagttctcctttcattgcttctcctctgttgcccaatttcggtcggtgtcccttttaagtcgtggaatgactcgcggttgggttgggacaccaaagaatggcatttggacgagttggagctgaaggacacgcagacgcaggaagtgtggacgcccagtttcacagatgagacgtaaattggcactttaagcatgcaaaaactgtgaatttgaaatcattttcagtaattgcggtgcgatggacggatgtttatccaaggtaaagcgaataaaagtgacaaacggaaaaggcgcgctccttttgaggtgggcgattttacgctgactccgtccggtcgcgtgacggcacggctcgtcttccgttatccgtccttttgccgaatcgattatcgcaggcatttcatataaaatacacctaattagattaatctcaggatttcttccattgcttaacccgctttttctttccccatttttgctctgttccgttctctttttcggcttttccttttcaccgctcctttttcttttctcagttaccccgaggagcgcaacgactgctgtttgtatatcagtgcagcggacattggcaggacggtgaagttcgtcgtgcagatggaccagcggagggcgcttctgtcctccaagtcggtgccggtcagccgagtggcgcagggactgtccgccattgtggtcacaaatatggagacctccgtttgggctgtgcaggtggccaatgccaatttggcaaagttggcgaattgcgcctccaaattcagcgccaatcgttggaaagcattcgcatcgaaggcaatcgcggcgaacatttgcagctttgcgtgcaggcaaagaaggaaatgagcactttgcgaattgcgctgcgtatccccgtcacaattgccactttgtgagtgaatggagtgttggcattggcaccgttttggcattggcaaattccaaatttgtcggacggatgccctcccctcctcccacttttgcttgtcagtttttccttgctgctgctttaggcttatgttggtctctccgctgttcggcgatttgcgtgcccaggccctggtcaaactgttgaccctcctcctgcagaccatctgctttttgttcctctgctcaatcgcacccgccaatggcttcggggggtcaaagcccaaactctgtgagtggggcccattcattggcacatttgccattcctacggtttgcccccccccccccccaatgttttaattttccgcaattgcccctccccctcagacaccttctatgagttcatgttctcgatgacttttctgagcattttgatcactaccttttgtctggcattgtgccgaatgaaacggacagtgccggcatcgcacggactttttttggcggcaaaagtaagcgaatttgggggggggggcaataaaagaggtggattattacttcagatgctcaaccatttcctttgctgtgttgagcccgacccatcaacaaattatcagcgtcaatttggcaagcgaatgtttttgaataattaaaatttaaaaatggagagacaattaggaaaagctgggacagggctaaaaagaaccaattcaatttgcctaaaaattcagacgatggcttcgattcggtcagcgcccgcggcggaattccgcaggcgccgaatagcggcccggcacttcaaaatgagtgagttaaacggacagaaaaaggcatgacgagacagcaacaaatccatactcccctccccctcttcccttcagttactccacagaatggcgccacatttacatcgcgggaaataaccttttctccgggatttgcttctctctgttttgtttcgtcacggttttcgaaattatgtgacccaataaggaacacgaaaaaggacaaatataatacaattattagaattttgttgtttatttaattcgttaaaaaaattaaaaacaaaaaatgcatcaaatcgattaaaaacctgcgttgccgagagaacgtgaaaattagggaacaattaaagttgaaaacaagaaaaaaagtttaaaagcaaagtttgataatgagagagagagtggtaaaaaaggcatatgaagttgaataaaactgagaaaattaacaacaaattaagattatggcgaatgtgaaatggaaagaaagataatcttattaaaataaaaaagtaattgtataaattagtgcgtgtcaatttcgctttgctttgcctttccctaggcgttcacgcgttggtcgcgcagttgcgtgtgcgcgtagcaaagtcgttcagagatggcctggtaatcgagctgaccgtcatcccttcgttcttggatggtctcgcgacttaaaggatccatcaaaaatggacacattaatgatcacagaagcacactcacttcactttgtaaatgtctcggccacgtttggcgtacatcagagcgatgtaaacctaaaaagttaaaagttttaccaaacaaaatgcattaaattcgtggaaaatgtactggagctggcaaagaagtgggcgtattgatgatcttgtgacaataggcaagcgaattgcacatctgaaaatggaaacaatgtgtaatttttaaattaaaatgcgttgaactccccccccccccggggattatttgcctgttgaatatggtccatgggcatatgcgactcgtcaatgagcacagaatagcgaggagttcgagtggttccctgtgataaatggccaatattttgaacgttaaactttctattgttagcacctgaacagccgcgtgcgtggccaaataaaattcgctgtgttccggatgagtcacctgcataaaacataaaacattgcgaagaaatgcctggtaaacgtacttgggtgtcaacaacggtgcccggtttaatgttccaattggggcctttcattcccggcaaatacactgcagctttggccgattcgggaatctaaaatagcagaaaggggattaaaatgaaacaaaataaaggaacggaatgtgtcccgtgtgtatttattcccctttccccggaacctcctcaaaaagacgaatgttgtgcgtcttctgcgacaccaacacagtcagtttgcagtcatgcgcaccgcacctgcaaaagggagagtaaagtgatgcgcacctttacaacaccaaaaccaagcaaaggaaggcgactgattgtgaatgactcactctttgagcgcgtggttgatcagtgggatttcgtactgcagtgacat

SEQ ID NO: 1995 - DNA, 1576 bp, Heterodera glycines
cggaagtgccgtttctgaacatgaccagccgcttcgtctcccttcgcggtgctcggcgtatcgtgtgatgcattgcgaatcgatggccgccaacgtggaaaacttttcgtccctgcggggctcgtcgaaaacgtagtcgccgacgaaatcgaaggggttctttttcatgttggccgcgtacttaaagcgaataccaatcatggagtagtctatgaagattgatcggttacaccacctctcccccccccccccccctcctttaatttcgaaactcactccaatcactgaagggtccctcggagtggcaccgcgtgccctttcgtaacttcccatggcgccggggtgcgacacgccaaggccaatgaacagagtgccctcctcaagcattcgttgcacactaaaagcatgcaatttattattaggaacgaaaattaattgattgttccatgcgacaaagcgtttcttactcagggtttgtgacacggacctaaagaacaaaatatcatggattccttcaatttcgtaaacccttaccgaataattaatgccgcccaatttttcattcgatttggccacaatattctcaaccgtttcgggttttcctctgcgcgaaatttcacaggcatttgaaagtttgaggtcctgtgtgacaatttcgtacttctgttcgcatgcttttatgacttctaaaagtggaattgcttttacaaaagtttaattttcaaaaagtttaccatggagagctttgaccgcgtcgctggtgatgaaaaagacgaagttgcaatggtaccgtttgcactccacgattgtgttttccacctttaaatattccgatcacaacgatgtgcccatttttggcacttacatcgcccggggtcgcgtcaatcatttgttggtcagcagggttagagatgatcatgccatgcttacggcacatttgcagataacacgcgacgaaattactttagaaaggggaaaatggtaaaaatgatggagaaaaaaggggatgattgatcggaatgggaagcgatcatcagcaatagtaatcagataacccctatttgtaagtgacaattctacttcaacaaaaggcactcactccatgtcggtagacgagaaattgtatttttcgtcacgcgaaccgccggaaatcaaataaatctggcaattgctccaattaaaaataaatttgtttgatttgtgacataccgcccacgttttcacttcggcgggcaacaagaagaaattgttcatgttccatttggcatcatcgcggtcggccctcacctccttgtctaaataaacgacgaggggcaacggcaaacgacgcgcgtcgacagtcagtggcttctcagttactggaggaaaagcattaattaatataagcaaaattgccgtaaaaaaaggtcacttgagatgcatgccgacttcaaatattcactcccatgcaaattcaacgcgtcgacgctgcacctaaaggaggacagaaattgtgcattttgttgggacaggggcgtatctagaaacatttttcgggggggggggggaagacccgacctgaagacctttttttttt

SEQ ID NO: 1996 - DNA, 1561 bp, Heterodera glycines
  misc_feature (1465)..(1465): n is a, c, g, or t
  misc_feature (1495)..(1495): n is a, c, g, or t
cccccccctggaatacgcccttgtgttgggacgacgctgacaaaaaccttgcgtgtacaagacttactcgatttggcgcttcaatcgttccggtggcactgcggaagcctaaaagggataaaggggttttgtttgttggaaaagccaaccgtcgctcggcactcactttgatcatatcggcgacttcgcgctgactgagctgattgagttgagctcgctgattgtcgcgaagacagcacagttccatcgggtaataattcgtctgtcctttttccaaagcggtggccaacggagcatttgggaatctatgaacgaaatgtttggggaagtgcatttaaaaagaattcttcatccaactgactcgagttcgtattcgtatttgcgcttgaaatattccgaaaccggcactttctctccctgcacgtcgattatgtgatttgatgcggttgccgtcgacactccgctgagtcggacatcgcgagtacggccctttgggtaattcacattgacatgcagtcctgaacaacatcacttgggtcattcattcatgggttcattcaactttcgaacaattcgttgcacctttgagttgggcgttcaaactgccaatcaaattgggcctgacttggccgtcccctttgatgttattggggccaacaattgaagaaactttatcaagcaaagtgccgtctatgttgtggaacggagtctaaacgaattcaaaaattataatgagtcttgaatcagaaattgggctgacttttttactctcgacaatcagtccgacttttttatttccgcgccctcgtggcccctgcaaatgaaaaggaatggtcactcaatttttggccataaattgcaccaacctccacgtagcgaatgcttttatgaattccaattgccaaatatttgttgtgctgactcaacacgggcccatcctccgccacaaagccgtgattggacgcgttgattaggtaagtgttacccccgccaatgatcacgtgctcctctctatgattacaattggaatttcaaatgggaaagaattggaaaaaagggattaataatacggcgtttggagagggtgctgagaagtggccaactccaaaaaggacgaaagactgtgctaaaagaagcaaaagtcttaaaggagaggcgagttctggtcactgacgtcctgctgggtcatgtcattggtcagtctcgacaggtcggccaattcgaccactttgttcacctttctgaccagcatctaaacaattgtaaggcaatgacaaaaaactttaaaaagtcaattccaaacaaacttttcaatttgtaagaaaatggggatgaactcaatgggtttcagcaagtggtggctatttgctgacctgcactttaaagaatttgttcagctgttcgacttcgctgcagtattggcggtcgaggacgaacacgcgttccttctcatgccccggcccanagtccaactcgcgtagcgtgtacaaactanattttattctttttgttttgccagaaaaaatgaaatgccaaaaaaccaaatgcactcacatgcact

SEQ ID NO: 1997 - DNA, 1154 bp, Heterodera glycines
atcgtaacggtacaccgtcctggaaaatgacttcgctataagagaatgtccaggaatgaaccgaactcactttggttccattttcacaccgtaaatgttggtcactattttgcatcgctggccctcgtgtccgggttcgaccagtgactccaagcgtgggtcgccaacttcaatctgtcagtgtttgcgtttctggtcagttttctgatttgccctcgtcccaactcaccccgaggtgctcaaattccttctttatgtcctccaacaattgagttttgcggcgcttttccactgccgatgaactcgttgtcggtgatctaatgtatatttttattcatttcgattttttctgtctaaccctccgcgcctcgaaccgccgcgacctccgcccctccgtcctccacgccctctgccacgtcctcgcccaccacctcctcttccaccaccacctcttccacggcttgtctgtactggcccgtctcctcgctgtccaagcggcatcatattagcaccagtcccagcactcattttttgttttcttaaatgcaaaaatggtagtttaaatacagtagcttattattttagaactgaatggtatttgcaagttcccttatcccactcccacacacagacaactttttacccgcttaataaatatggtttaaagaacacaatactttaagagatgaattgaataataactttaagagatgaaatgaataaagatgggtgggtggaaagggggagggaaggaaagggaagagaggaatgggtgggggttttttcctcttcccaggggaagtgagcgaaagaacgggctgttgggttgggctctacccgtttgcacattctttctctgtgtatgcaaatgttatttgatttttcttttttcttcgcgttcgatttttctttcattctttccttcaggcaaaaaaaggaatcgcttcatttttgctttttctttatatcccattgaatgaggcggtcagaggccaaaggccgcccatagacagaagactgactgtcagcaccataagccagaatgttatttcacagtggttatataaaataaaagataatgcttaagctcagatttaagtccaaagtttgtcggacattctaaaggaataatttgttttaaattaaattcctaa

SEQ ID NO: 1998 - DNA, 6258 bp, Heterodera glycines
  misc_feature (5868)..(5868): n is a, c, g, or t
ttaattttgttgcacaacaaattaatattacaataacatagaaatttttagtcgaactttaatacgtaaataaacaaacacccatcttgtctacattttagtcgaagtcacaaaaaactttatttttcaaaaaatcaaaaaaataatttttaagaaataacattaatcaatgaatctataaaaagaatcaataaaatcattagttaatcacatatatatttatctatctatcaagtaaacaagagagaaaaaattgaagaatttttatatagaaatattttaaatgcacataaatatttttgttccatttttatttctatttgttatttttaatggttgtcaggcaaaagaactgaaaatttgtgtcaaatatgagaaacgtggtgcgacttttggggatttgtaacttggggacccgacatttggggacccgacttttggggatcccgacatttggggacccgacttttggggatccgacacttagggatcccgacatttggggatcccgacatttggggacccgacttttggggatccgacatttggggatcccgacatttggggacccgacatttggggaccgaacgacatttgagcaaaagacacttaagaaaaccacggacatttggcaacccgacatttagggacccgacatttggggatttcaataaaacaaaaaaaaattaaaaaatttaattctaagccacaaaattagacaaaattacgtctgctttagccagagttaattccattgcaaaaaaaattaattaatattttaaaaattaactctgtttccggactcaccgcgaggaggcgcagaattttgagcccatactaaccacaacacaatagacaaaccacaatacattttttaactacagtagacctttttctaatttttatttaaagtgcctttcccaagggccaacgggatgtgaaaacagacttaatcaccatttgggtcgtcccaattctcaaaatcattgcgcataagtctgtattgcaacgatctgagatgagcaagaatctcatcttcgtttcagaatacaacatttcacgattttttgtggtttgaggacattggacgggcaatgagagtgcaatgaagaagtaaatagctcgcattgaaaaaatggaaattatcagaatgaatcgctccactctctttcgttcggcggcttctcaaaaacaattttcaattagctgacgcgacggctggcacaaataattcccttccccccccccgctctcgttcgttcgttcggcggcttctcaaaaacaattttcaattagctgacgcgacggctggcacaaataattcccttcccccccgctctcgttcgttcgttcggcggcttctcaaaaacaattttcaattagctgacgcgacggctggcacaaataattcccttcccccccccccccgctctcgttcgttcgttcggcggcttctcaaaaacaattttcaattagctgacgcgacggctggcacaattctcttctcccgtttttgtcatttctttacgaattatgaatatattttctagaaaatgaaaaaatttctttttttgacaattataattctgttgctatcaaatactcatagttcgaacaaacagagcatcggaaacaaagggcagtttcggctttagctcgtttgacagtggctttatcacgtataggcacctacattaaagcccacccgtacattaccgcctcgacaattttgatggaaatgggctcagtttccctcaacatttatttgctaatacaagaaataaaaggttaaaaatctttattttttgaaaagatataattattttagcttgcgaagagaaacagatcttaaaggactttttcccatttgtgctcactctgaattcttatgaattcagtgtgaatgttgatgactacaaccctggatatatttttggaaaaataaataccgaaatagggcgaccagtggaagagatttgttttgcaggtcagccacaaaaaattaattcgttaaaaaattcatttaaagcaccgaacaaagtcacccgaaagataagaaaccgaaaagatgacctcggcattttgttgttagacagcaaagtcggctggaactttttgaatgtccttgacggatttctgttcccgttggcccttgggaaaggcactttaaataaaaattggaaaaaggtctactgtagttaaaaaatgtattgtggtttgtctattgtgttgtggttagtatgggctcaaaattctgcgcctcctcgcggtgagtccggaaacagagttaattttttaaatattaattaattttgtggcttattgttagaattaaatttttaaatttttttttgttttattgaaatccccaaatgtcgggtccctaaatgtcgggttgccaaatgtccgtggttttcttaattgtcttttgctcaaatgtcgttcggtccccaaatgtcgggatccccaaatgtcggatccccaaaagtcgggtccccaaatgtcgggatccccaaatgtcgggtccccaaatgtcgggtccccaaaagtcgggtccccaaatgtcgggatccctaagtgtcggatccccaaaagtcgggtccccaagttgcaaatccccaaaagtcgcaccacggttatataaaataaaagataatgctttaagctcagatttaagtccaaagtttgtcggacattctaaaggaataatttgttttaaattaaattcctaatttggcattttgtctgtttacaacacaccggtcgggatctgtcgttttcggcgccggcccaagttttcggactagaacttttttattgttatccaaatccaactatcttgttatcattcgaaagcttaacatgtttagaagatgtttttaagctattgcttcgtgattaaacaattacctgaaaagttataatatgaaaattgcagtcgaaatttttgaaattgtttcttattaacttttgcagattagaaaatcttggtgttttttgtaagtctgacagagcatgcaaagggctttcaaatgatgctaagattgtttgatttgacgacaaagaaaaaagttagaacccaaaaattcgggccggcacgaaaataccctggtctgaacacatacatatgcctgcagtaaagttctagtacactttaataaagaccgaaccgagcccggtttttagagggcacggcggaagaatctggtcttcgggagaccggccttttgtgtggcatttagcccggaattcagtttaaatatttctgtagactttgtttttttgacaccaataatgtaggcattgaccaaaaaattgagaaagcctaaaagtcgatggtaggcctaaaatgcaatagtctgcgtgtttaacatatgcaaatcttattcaacaataaaagagaaaaggggtttttatctaaggatagaaatcattccactatggaagcatcggttcttttctttccttccttcacatttttgatcagttcgtcaattgtttttgccctttctttgtcgccacagcctttttccagctgagcaaatcgcataagaatagtcaaatctaagaatggcaaaattgcaaaatagaacaataaacgtaattaaatcatttcgttaaaagggagtgagaattaaggatttagggccggtgaaatttaaagggaagagcataatataaagctaaatttacgtcttttcttctccgaacattgaagagaacgcttaagcaagttttgaaatgcgtcggcatcgttttgctgtaaaggtgcctcccgtactcaaaccatggtccaagttcgaggtgccgaaactttttatcattgattcgtataattctctgatctcctgcaaacgatgctttaatgtttggttgatgtttctttttgcctgcctcttctcttccttttgcgtttgtttgcttcttcaacagtccaatcaaataccgatgcatttgtatggaattggacgcggcacacgcccttttgaacacttcctgcagcgattcttccgtccctaatgcaacttccaaattcaaataagcatgccaaacattggccaattcggtgtcatttctggtcaaatttgtcatatgaattcctaacaaaagggtatcatttacttactgaaatgtaatggtcttgagggccctttcagcaacagctcttccgcgttcgtaccttcggcacacttttagcccttcgtgggtcagataaaagcgaacaaagccaatccacgcggaggacaagttggaatcggcaatgagaagcttctcatattcctcggcagatgctagggaatgctcatccggaagaccgaaacaaaaggttggcttaaaatggggaattggtgaggagagggaaaacgaagtgcaaccaagggatgatatgactataaagggtttaaatcattccttatgaaagtttgactttcgctccccactcttttttcccgtttgattttcgcccctacttctttgtgctctccgtttgtttgcgcctcctctccatctctgccctcttcctccgtcttttccattgtgctatttccttcccctctctcctcattctctttttcgtcttcctctgattcctctttttcgttgttctttcctccttcttcttcttcaacgttctcttcagcagagtttacactctcttttgtccttttttgagtatttatctaaaattgggtaattaattaattcccatattattttctttttgtatctcacattttgtttcaactcgttgaaatcgtattcgtcgcttctcaccaagctcagacaaacaacgcgtcccttcttcgttttatttacgccaatcactcggccaaagcgcaattccccagagtcgaacatttgggcggtgttttcagactgatcagtgtccgtcccgtcctttttggctgccggttttgccgattgagtgatttgaattattgcacggaattcgggattgatctaaacaaaaacaaattcatttcattacattttaaagtgaaaaaaagaaagtttaactgacctccccggtaaagtgtgtctgatcagtgccctctttttttgccgtgtcgacgatgaacacggggacgacatttccaaagtcaaactgttctcggtatctgataagagagagcttctttcgcggttcttgaaccttctcggagatggcagtgcattcgacgattctgaacaatcaaattagaaattgagtaaacacactaactttcggggcccatattttgggctaaattacctgtcactctgacgcctttccatgagtaactcccgtccccgggcactgatcgatttggaacggctcacgcaaatcactttcactgttattgttttgcccgagctccgtgccataaagttttgcattgggaaagttccttcgctccattcgcttttagaatgagtgagttcgcttgcatgaagacgaccttaaacaataaagcagtttgaaaaccaaaatgtaaataatgcgaggggctggagtcgatgcccaccctttttttttgcatgaatcaaagcgtgaaaatgtccgccctcaccaatgcttccgcccgggagaaggagttccgccgtagttgacggagaagtgccgccgtaaggccattggccgaggacgcgggcggtgtacacgcggaaaggcttggcaggacgcacagttttggagggggcaatgcttggagctgtcgcattttgtagtgattctccggtggatttctcgttgtcttcggaggatggcaaatccaacagcattttgccctgtgcgacgtcgacgctttttaccaatacttttaagggcattccaatcgcaacagcactagcggccaacaaagcaactttactaaaaaagcaaaactnttaaaacgcatttattgtaaagcgtagtaacctggatggtaaaaagccgatagttcggtcgtaaaaagcgaccaaaactgatccaccgtccaaatgtttgatgactgtccccgttgagacaactcccaccacgtcgttagaaattgcaacaatttgtttctctgtctttgattgtttgacgagcgaatgtttcgcagttaaaaagagtttattcaaattgtggtcgaggtacaaaacacggcacgacactttttgacctgaaatttaataaataattaatagacaatgcaattactaggtcgttgcataaaaaagggcgctttttcaaaatgactttttttaagacttgattaacgtttgttatgtcttttttgtgtgtaattcttttat

SEQ ID NO: 1999 - DNA, 2473 bp, Heterodera glycines
  misc_feature (122)..(122): n is a, c, g, or t
  misc_feature (125)..(125): n is a, c, g, or t
  misc_feature (154)..(154): n is a, c, g, or t
  misc_feature (200)..(200): n is a, c, g, or t
cacagttttggagggggcaatgcttgagctgttgcatttgtagggattttcggtggatttctcgttgtctcggaggatggcaattccaacagcattttgccttgtgcgacgtcgacgctttntanccatacttttaagggcattccaatcgcancagcactagcggccaacaaagcaactttactaaaaaagcaaaactntaaaacgcatttattgtaaagcgtagtaacctggatggtaaaaagccgatagttcggtcgtaaaaagcgaccaaaactgatccaccgtccaaatgtttgatgactgtccccgttgagacaactcccaccacgtcgttagaaattgcaacaatttgtttctctgtctttgattgtttgacgagcgaatgtttcgcagttaaaaagagtttattcaaattgtggtcgaggtacaaaacacggcacgacactttttgacctgaaatttaataaataattaatagacaatgcaattactaggtcataaaaaacaaagctgttccaagtgaaaattaacgttattaagcttccctaaatacctttctgaaaccgtttttgccagtgtttgttggggttgtccaatgcgtgaattgctgacacatatccagaaatatcccgtccaaatgtcacttttatgccgttagcattcactgagttgatccgcccgctgattttcatccccggaagtgcttcttccgcacagacaacgctttgttggaggtcagccgatcgcgtagtgacgaacagttgtcgttcagacattgaaaatccgatgacgcgacattcgtggacggaaccaattgcgaatttggacactaaaacataaagaaacatgaagccataaatgatggacagtttacggttcgtctccacatcgtcaatgtgaattcggagtgctttcgcggtgagtaaatgcttctcactgtcatcgtccaatttgaaatagacatttcgctgtttgtccacaaaaaagacacatccattgatccgtgaaccaactcgaaattcctgaaccaattcattttctggtttctgcaagcagtgcaataattaccggaggcagcaaccgtttttcgcactttgacaacgcgagaatgtccgggtgagcagtgagcatcagcaccgaagtgttcggctgacagccaacacaacaagctcggaatttcttggcaattcggttggtgtcaaagcgcagccgaggaggcaaatggacctttcggatgaaagcctttggacctgaagagaaaagtatcaaagatacattcttatgagctaaattattaccgctattaatcccacaaaaaggccatcagtcacaattttctccggctcaacttcaacgattgaaccgggagtcaaatgcttgaattctaaaacatcttggccttcttcgccgatgagacagcccatttcggtaaagccggaaagtttgatcacacgggtggacggagtcggactctctttcactcggaaaagtgccacttggccaacatgtaatttgtccagtgaaagatggggcgggagatcatcgctatgaacgaaaccattgacagaacttgttgaaaagcccaaatcgattacggcacctaaaaaacaacaaataaaactaaatgtaggcacaaattttttcgcacctttctcttcagtgctaataacggctccatttaagacggaattggcaattagcaaagaagggatcaaatgactgttgacctcgtttggacagacagtgacagtcggcaccgattttctgcctaaattttgcatattttaacaaatcgctcctcttcgaatgtgcaactccctccgaccccgttcttttgttccaagagggcgaaaagccaatgcttggcccatggtgaacagctcgtccaatgttgcctcggtattcgccaaattcttcgaaaaaattctgctgatctgagtagcaggcaattttaagagaattccttcggcacattcaagagtaagctcaacttcaccgacctaaatagcaaaaaaaaacaatacaagaaaatgagatttattagttacaaatttaatgacggccaatccacgcaaattttgtgtgaggatttcacgtgtgaatttttggcgaaaaaccccagcataaggaacgatgtcatctccctcaatcttcgtttttttctaaagctatgaaaatttgtgaatggcgacgccaacggaccttagctgttgcgctgctaaaaggagaaattctcttcgctccttttctaaaaattgcataattaaggaattatttgttgaaagatccaattcattacctattatgcaatccgagttgtaaaacttttgaggttcctcctcgtggaaaatctatttctgtactcatttatatttgatgaatagggatgcaatttgtagttgctaaaaactaccaaaaaagttgttttaaattgtcaagaaaataaatacaaatttgagatgaatttttt

SEQ ID NO: 2000 - DNA, 3010 bp, Heterodera glycines
aaggtcctcccgctcgacgagttcgacgcgtacatggcgggcacagttcgcaacggactgctcgccttggatttgccttcgatggccgatcacgctgccgatgcgcctgcacaaatgaagaaaatgtggaaaatgttgtcggacggcgtgtggacgcacgtctcactcaatgagcacgtggacacattgcggtggcgcaaatcagagacggaaaaggcgatgatgcgacggacatgcgcagtgggaggggaggcactgaacgcgatggtccggtgagaacggacggaccgaacaccttgctgacgaaatgctttaaaattgacggaaatttcaaattaaatagttgccgttaggggtaaattattgcagagcacggctaaggattgtggggatattggagaggagaggatctcctccccattggaacgcgtatcccgggaccaccttataataaacatggcttttccatccatcggggtcagtcatcattcccatagctaacccttttcataaagtggccgataagacaagctcaaaatttcaccgccataaatctaaaaaaacttatttgttaaaaaattttcaagagaaaattatttaaatattaaatgaataatttgcattttcctgtttttctttgaaccatatatttcccatcttttagggaatgtcgtaaagcaacaaatgaatctcatgtaatgcaaaagttgcccaccaaacagtgctattcctgccaccctttcctcagattgtcggcttcctcgagttcgagtgccgtcgacgtggtgccaacttcctcgcctatccccccgtcgttgccggtggttcaaatgcgaataccatccattacattgactcgaacatggtctcatttgcagcaatgtgtgtccctttttataatgtttttgtgtgtttaaagccgatcagacccaacgattgcgtgttggtcgatgccggatgcgactttggcgggtacgtatcggacatcacgcgctgttttcccgtctctggcactttttcggccacacagaaaacactgtacgacgctctctgtcatgtgcagcaacaattgctccattttgtgcagaacactcgtccactacgactgaatgaagcaagttttgtaatatttgctgacacttggaagccaaagcccatttatctcgtaaattgagcctggattctcattctcttgattgagtctttttttatttgtccttttcgatttcgttttccttttttgtgtccatacatttcgcgctgttcattttagctttacgcgttcatgttggcaaggatggccaatgcgttgagttcgattgtgttcttcaaaagggacggactcagtgaggacgaactcatcgccgttggttggggaagggggggaggccaaaaggccacaatgaaaagaatctgtgccattccaaaggaatgtgacaaactgtgcccccatcacgtgtcccattggctcggattggatgtgcacgacacgtcgtaagtaattgaggggatttatttttaatcgaatattttttgacaggacagtcccacggaacatcgaatgtcagccgggcgtggtgatcacggtggagccgggcatttatgtacgacatgacaacgaaatggtgcgggacgagttcaaaggtggacaaggaatggttttggattgggtcatcaacatttgcggcgctcaaaaaacaattgtcgcttttttttgttcgaattcgggcttgggtttcgaaatttgtcgaaattgatgccggattcattataagtagggttataaattgtatgattttgcatattttttctgcgcatatgctatgaagaaaggggctaaaaaatagcatttctacgttaaaattttttgatttggtgaaggtttttagtgcgtataaaagcatattttgggggttttcgagaataaatgcatattttgccatttttgcatttttagagcatatttcggccatttttggaaattttcgtaagaaaaatggaaaaaagcgaaaaatacacccaccccctaaggatggactttttgagaatttttataaaaaaatacctttaaaaatcgaaaatttttgaaaaaaatttcttaatataaaaaatgtaattttgttttagcacaaaataaaaattttataaattctaaatttcatatataaagttttaaaattaaaatgttttgtaattgtctgaaaacgctccttagtcattgttttggtgttttaaagtcatttcttaacttatacacaatttttggcattttttgagggttaaaaaccatttttggcagtttttaagacatgttttagtgcatatttaggcatttttcgaatttttagggcattttttagtgcatataatttataaccctaattataagcgatgaaatcaaaaaatatggggctatgtataagaggcaatagtttaacaacatgcttttaaacatgcaatgcttttgaatggtaacaatttaaattttttttccccctccgttggtttcagttttctttttgccacacataaaaatgttttttccttccattttacctttcaaatggtttttgcaaatcctttgtgattgtatttatttctccaaataggcattggctttcgcattgaggacgacgttctgatcactgaaacgggcgccgaagtgctaacggcggactgtgtgagagagtccgacgaaattgagtacagtatgcgcatttgactgacacaaaccgacgctgaacaacggacgacagctgctcaattcgtttttcgctttaatgatgttcttttttttgtcattttgttgaaatggaataaaattctgctcttcgatttccatggctaattaattaaatggttggacaaacataaactaacaaattgctcaattaccaagtccatattcgtcatgttataatttgtaaacggatggatttgtttggtggtagaatgactggtgaatgcgttgagaattggattgtgtgttggttgggtgtgtgtgactccc

SEQ ID NO: 2001 - DNA, 3243 bp, Heterodera glycines
  misc_feature (50)..(51): n is a, c, g, or t
  misc_feature (70)..(70): n is a, c, g, or t
cccccccccattcctcaaattgtatttatatttctatttactccccgatnntaattgctgtcttttcttnacatcatttttgatagtttgctccctttttcccactcttttccttttgctgtggtgaaaagagtgcagcactttgcatttgctaattgtcaattactcaaattgtctttaattcttgtgaattttaattgtttttatttcataattccatagaatttcgtcatagtctaatagtcgcatttttcttcatagcctgaatctcctctctctcctcatcattcattctttctctcttttctctctcttttctcaattcgtcgttcattttgcccatccctcattattactgcgtttgtgttacaggcaaaatccttttgtttattcccttcctttccttgtgaggcccaaaataatttgggtaatactaccaccgaacgatggttacactcccccttttcgaaaaaaataattcaaaatctttttatttttaaataaagttttaatcggttttttggtcgaaaaatccgttccgacatccatttctaactctggacctgtgatttgaacaaaattcaattttcaactaattcaaagagtatgcaattacctaattttgactggattgatttcgtttattttccggttttttttatttgttataaatttagctttgtccaaacttgtggaattattttcctaatgtgttctggaataccggaaggcacttatgaattgaaaattggcgctagttttctctgctcaaacaaatcgcgcccacccgaatttaacacattgcgttgtgagttgggtgaaacgcatttactttccgtttttatatgttaattataattaatgcaaggtgcaaaatcgttgatttgcccccatctccccctaaattttttgttgtaaaagttttttaaaaggtcatggcgggtttaattgataaacagctcagttttactgggtgtcttttcccaaaagccgagtcattcccgacgaaccctccctaacgtcccttttccgtccgttttctatcattcctttatttaagttgacttcaaaccagcttcaatttcctccgaggcctcggaagcgtacgtcgttcagtcgcagaatcaaaatgagaacaatttccaggtttttcaacggaattcatcccattaaatgcttttccattttctcaggtcgttgtgtttggagaggcgcagaaaaagaccattttcaaaggggcgaagaaggaaatcaaaggggacaaggagtgtttgttggtgtacaacagaaagagcaaggagttgtgcttggagagagtgtcggccaacataaatgtgaagaagacgaggtgacaaagcacgagggaaatggaccgaaattggggaaaatagcgacgatttgagtaaaatttaaaaaacgagtcacgattatacaaaagttgactccaactgggggaaagaaaaacaaaacaaaaaaaaaaataataagaattacgtttctgcgttttctcacaactatcagtgcatttttcgttttgtgatccctcttttccagaaatttaacataaatgaaaaaatgacattttcagggacaccgatttggaccaaaaggcaatcagcgaaatcgaacggctgcaaaagcgtaggaggccaaagcaatctccgccatcgccaaaggctcccgtcgaaaatgccacggcagtcgaaccgccggcggagcagcgcaaagagcgcacattttccacttcttcggcaggggacgaaattgacgaggacgacgaagagaatgtgtcggcattggaacagctaatggtgggaaaaaggcgaaggaaaagcatttttattggaattggaaaagcaaaattaagtcatttgaaagttttagaaaaagcgagttaatgcactttctaaagatgttgtttaatacgtttccaccggaaaatttctaaatctcgaaacttttcaagacaaattagaagatttctttatatatatgaaaaatttatttattttttcgataaatacaaaccttaacaattcatcatagaatttgaaaaattattaaaaagttttgttttttcttcaagaaattatatgtttaattaattttttccgtgagaaaatggcgggcgaggggaaacaaactgcttccttctaaagcaactggaaaatcattttctaaattttaaaaattgaattcgaagccgtcgttcaatgattcaaaaaaaatttttttttttttgttaaggcgccaacgaaagtcgaacgatcggaggcggaggaggacatctttcacccagcacaacaacggccaaaaatggagctgaaaacggaggaacaccaaaatcaaatggaggaaagtgccaacggaacgacggaaagggaggagaaacaatcgccacaacagaaacatccgatggcggtgaagaagacgtcgtcattcgtacggaaaagcattttggcggaagatttgcagctgagcgagagcagttcggaggatgaggaggaaggagggagggacagcgaagacacggactgatcggaggagagaatgatcactgactgaccggagccttttaaatgtccataaaactgcactcacgggatgctcttaaacacttataattgatgctgctgttataagccaaaatggatgcttaaattatatacggtataaatgatgaagatgcattattttccatttattttttcagtgcttttttcactttcaacaaaatgagtccattataaccaatccaatgaatggaatggcacgcaactgacaaaagggaggaaaaggaaatggtggcacgaaaaagaaaagaaaacaattcgcccgaatcgattcccttccttactttttatgggatttttgttgctcattttcattttgtaaaatgaatgtgctgctgcctttcccttcctttgttcgtgaccgaaattttttcgcatttttgggccggcgatgggcgcccccaaaccggaattgttgggagtgccttgccttttttggcccttttctttaaaaatggcatctaatttttggtggctgtcgtttctctccccctcgccaatcattcctttccccagcacatctgtccctccccccccttctctcctttttgcatctttactttccgcccaagttttgacccctcccccccccccccctaagtttctcttctcccgcccattgacacattccctcgtttgccgccgcgaggggcgggggtaggacattttg

SEQ ID NO: 2002 - DNA, 2006 bp, Heterodera glycines
acccctcaatttgttcctcacatctcttcgccgaccactcccccgccgggggtgaaaatcgataggacgaaccaaaaaggggggaatgagagggagggagggagcggaagaccccccccccccccgcaccctccgtcccattttaaatcattcgttcaccgcactaaaacagtaaaagctgaatttaatgtaataaatggaacgcacaattggaacggaccacacacacaccacagctaaatatggggatcagcagcagatcagctgcattttcgcttacagtcactccttccgccccctcccccttttttggttccgatttgagcgtccatcgggtgcaggaattggggctgtaaattgcgacgcggtcggcaaatgtgtcttcggcgggtcttcgcttaatttctcacttacattttttgtgtcgttgtcgacggcggagtgcaagcgaaggccaacgctatccgcccaattggagcccaaaaaaaaacagaaatattttgtgcaagggcgtagccaggactttcgtttcggggggggggggccaactcaaaaagtcggttcttttacgttttcacttttttattttttgctggccattatttactttattttttgtatttgctcaattttcgctccattttcttcaaaatttggccatttctttcgtcttccgccaattcccttttttggtttgcatttccaattttcttcattttccttttccattttttttggtcagctcttttctccgtccgttcgttgctttaatgccagcaacaaaacttcatcagtccattgatggcattttcattttccattgtttgagccgaatccaccgaagaatttgaggtatgattaagaatttaaattgcaatttattttgaattaacccctcaaattccattttaaatgatttgcgcttgaataactcatcaattcctaattggcttaattacccaaaattctaacaattacttttttctaatttacccttttattattggcttcgattaattctgcgcttttcctttctcccaattgctttttacacttttttttaattcgttagttttcgtcttttcccttcccttcgttcgcacttcgctcccatcattctcttctcgtacaaagagcgcaacaacgagttcaggtcggtcggtcggtttgcatgcatttggcggccctttttgcaatggcaccgcttttgatgactaactccaacaaaaaataaataaagccggaaagtaccgacacttttcaaaatgcatttccatccatcagcttgataatctaacaaattggtttttagtacataaatagcatttaatggaatttgtttgatcagtgattgggagcggcaagcagcagtctttgcttttcacccttaagctatgccaacttgagacgacagaatcgcgtcgccgggggcggcgggggccgacagtttctgttcagcaggcgtttgtacgacgtcaacaaaggggtgcttgctaaacatcgcatggataacaaacactaacaaaccaaaaatctaaaaaaatataatccgattttgaattttataaaacaattaaaattgaaattgacacaccgtccttttcaattggaatcactaattatgccactgctccgctattgcatttcgctttttgctttttactaactccgttcctttttcattttccatttgcttccccactttttcaggaagagtcgtctttgtgtgacctcctcttggacagtgaacgcgactcgggcgccggcacttcgctttgcggtagcagcacaggtggagggaaagaacaaattgaaaggggaaataaaaggggaggggggcaattagccatggttaaagtacaagaatcaaattattcaaaacttttgaatttcctcccttatacaagacgccgactcagtccccgtaaccagacgtcattccctcaaaattgcacgggatttcctcccctggcaacggaacaccaaataaataccaaatctgctta

SEQ ID NO: 2003 - DNA, 1663 bp, Heterodera glycines
attttgtagaaattcatttaaaaaataatttttactaaatcctttttcattgtgtataggccgcacagccatcagattggaatagcggcgacaagcggaggaattgggccaatccgacgcaatccgaagaacgaaccgacaaaaagtcagcgaatgggcgacttatggggaggttcaatttcccattaaaaatttgttggactttttttctgcggatttctcctcctcccaatttctggccattatttcgtcttaatttaccccatttttagccgccactttgccttttggtcagtccaaacgtcgcgctgtgctgctcgaagttcgcaaaggggcggacatggcgacgccatcagcagcagaaaatggcacggcccattgtcagtcgccgcacaaagagaaagtgatcatcggcaacagaacgacgccggacggagcggcggagggggaaaaagcaacgcaaagagcaggtgaagcagggaaatggcacaaatggggagccaaaacacggggcaacggggcaaaagggttggcccggggtaattattgaggaaatcggaacttaaccccccccccccccccctcacgtgtataattcggtggcaaataaaacacttcccccggggcattctccgttcattccttcctcccctccgtattttttggttttcccctgtcctttttggctgcctcttcccccttcccaccgttttcacatttatttccatgaactcaattccatcattcagtttacgaccagcatttcctcctgtctcaaactcagccgagcacttccggcactgtcattccgttggcgccgtccgcggacactgaacatcctccaaacatccacctcaaacagcagcaaccacattttgctgcttccgtttggcatccgtcgcatggccaagaggctgggcccggctcgccctctgtgtctgtgttcatcgccttggccaaagagggacggcgcagatggtggcactgctggcgcagcggctgcgaagagcggcggagacagcgacggcacgagggaaatggcattggcaccgctgctgctgatcagtcagtcgctgcacactttgccaaattcggcgattgcttttgaatcactttgtccctgcagtcggacggcgccttccgtttttgtgttgggcgacgacgacgacaaaatcacgggcaaagttcggcgggaagaaggacacacgcggaaatggagggcacactcgggacggaacagattcttttgcgatgggcggtgagtggcaaaaaaaaaaaatagtaattaaagagcaaacggggcgaagtccggctcatttccgatggctattcattatcccgtcattatggcacattaattggccatttatcgcttttcctctttgaatacgttccttaaacccaacttgtcataaattggtccgattaaacttgaccttcattagggccgccatttgactccctttgccattgccttttcagttttatgttggcccgccaaagttcggtgtttctgctcacgttgtttctcatccttttcacaatggcacttttctgcgtttatgagtaagcattcgtaaattgggaaatggcatagtttttcgattattttcttctagtcggtcgggactcttttccaacttagtattggcattttcgccca

SEQ ID NO: 2004 - DNA, 2414 bp, Heterodera glycines
  misc_feature (114)..(116): n is a, c, g, or t
  misc_feature (1555)..(1555): n is a, c, g, or t
  misc_feature (1619)..(1619): n is a, c, g, or t
aattttggcattttctcccaatttgtccgataaaagtgagtgttttcgccccctctcttttcagtcttccctttctgagtgaactcgtgtcgttgctcatcccagccgcaggcnnnggggggttcctcttcgtcatggccacccttttcaagacggccttcgtccgacccgggcattgttccgcgcgcctccccccgcgaagtgctcgagtgggaaaggcagtgccaagagacgggtgaattcgatggcacccaatttccccccccccccccgattttcgggttttcttttccctaattaattaattgcccatttcatttgtctcccccttttttcgattccccctttttcgggttttccttcatttattcccctctccctcctgttagatccctatttcaacgcggacgaatgggcccagccgcgcacccgcgtagtgaacatccgcggccagccggtcaagctcaagtactgcttcacctgctgcattttccgaccgcctcgctcatcgtaattttattttcaacattttattgactcatttagagaattaacaaatctgaaaattcaatggaaatgcgtagtttttgttaaatgccaaaacgttgtctcaaaatggtcaaaaggcattcattcttttaccattttaacaaataaatacaatggctttttccccaggcattgctccatctgtgacaattgtgtgctcaactttgaccaccattggttggcactttcgctttttcggattccaattccttttactttcccccattagtccctgggttggcaattgcattgggctgcgcaattaccgtcactttttcctcttcattttctctctgtccgttctcgacgcttttctcggcgtttccgttggcattcatctttatttatgtgagtgatcaattaatcaattttaatgttaattagcatataaattttcctgttttcagtaagtctcgaaaagggttctttcgtcgaagcggtgaaactttcgccggcttccattttgacaggtcaatcaatggaagggacagattcatttgtttatttgttattatttgcatttccactaataataaacaattaagccttcctccaatttaatgatggacttgcagttctatggccagttaattgaacgggttcccgtcctcattttttacttcgagttttaaattgatcttaataccgattgtgaaaatgcaaccgcaaaaatcaaatgatatgacccttttgaatccaatatttcccggactgttttggcacaatcctctccctccatccattttttgccttttctgtttattatacccccccccccccccctccttttgggggacgggacaaaatctcgccgcagaaatttcaaaaatttttttttcaaacataaatttttcaaggaaaaaattcttagaagtttttaataaggaaaaatttaaagaaaaaatttttttaagaatttttaggcaatttttttgaaatttaatgataaattactgttttttcaaaaaaaaacttctttgcaggtctgatcaacatcatctccatntggtccgtgctcggcctgtccggcttccacacttatctgatcgcacttggccaaaccaccaacngaggacatcaaagggacattcaatcgcaaattgcacccgcaggtgaagaatccgtacagcagcggaaattgcgtcaaaaatctcatcgccacactttgcgcgccggagaggccgaggtgagagagaattacaatcgcattaaactcacaattaaagttgaatttcaaaaattcactttttcctttccttttcagtttgctcgaccgtcgcggttggcttccccccgaaaatttgggcccgacaatttacgtggatggtgccgttttggacggattggccctgacggcaaagcggcggttggcgccaacgtacggcacaaccaatgccatcgccacagccaacgacggcaacaaatcgctgctggcggtggctaacggtcgggcgaaagggaacgacgagggacggaggagagggggagggggaggaggacaaaccgcggggggagccgagtcgccgtccgtcgtgtcaatcgcagtgtcgtcggcgtcgtgcccacgtaataaattcgatttaaaaccaattttggacattaacacggtcgcgactttgccaagtatggcgattaatttaccaaaatcgccaagaaaagtgtgattggtttttaaattcacaaatttaatagtctcataagaaataaaccaatttttaaaataaagacaaagttttgtatttggtatcattcggcccagtattgttttccaaaatcacataacaaatgtgatggcagattcggaaataacacttctgctggttaaagaaagtcaaatttggatttaaaattattttggtaaatct

SEQ ID NO: 2005 - DNA, 1116 bp, Heterodera glycines
  misc_feature (1068)..(1068): n is a, c, g, or t
  misc_feature (1100)..(1100): n is a, c, g, or t
taccaatggagaaaagcctttcggcggaacattgctaatggagaggagaagaagcatttgattggttggacaattattgccgggttcaaccggcggatatttcaattaattatttaaccaaaaattaatgcataaattaaaacaaatattttaaacctgtaatcaaaaagcaaattctctcttggaaaatttcgaaagtcactttctaacataatactttggaatttactttaaaaaacttcggagaattgaaagtttgacggcgcgacaaacgcggccggggaaaatttgtaaattttgaaccaaaaatagatttatgatttcgctcccactaggtgccggaaaccggcttatatttgtcctcccaaaacggcataatctgaacctggctaagtctggttttttcccaaaaaaatgcccgacccaacctacgcgtgaccggcaccggcccaaccctaattcatgaattactgcaacaaataagttttttgaaaaatttcatctgccaattgtatgtccctttaccgttaaactgctcagtgacccttttaaaaagctcctgaatggctgttgaattgccgatgaaagtggcagacattcgaagacccctcgggggaatgtcgcagacggccgtcttcacattgtggggaatccattcgacgaaaaaggatttgttgcgcttttgaacagccaacatttcctcgtcgacatccttaacaaatacaaatatcaattgtccattgctttttctgcccattttcagctccttggcgcactttcatgctcattcgccctctaaaaatgactgccgctgtcaaataacggccgtgccgcgggtcacaggcggccatcatatttttggcatcgaaaatttgttgggttaggtcggcgacagagagggcgcggaactgctgagaatctgaaaaaggcgggctttgctaatggccgacggagtttggcactcactccgcgaagtgagcggggcgaagccgggcatgaaaaagtgaagacgcgggaaagggaccatattcactgccaatttgcgcaggtcggcgtttagttggccgngaaagcgcaggcaagtggtgacgccggacatntgtgcgcttatctaat

SEQ ID NO: 2006 - DNA, 4063 bp, Heterodera glycines
ttgagaaacattccttggccttagctcgggttttcacctatttccacgacagtgtccgaaacttttggcgatgggaccacggaataagtgctgattattctgcagggattgtcgccttggtattcagctcggaaggcatcgcccacctgtccgggtactcctcgcgaagtttgctcaacaaaagcgtgccgagccccgacccggtgccgccccccaacgaatgagtcatttgaaagccctcaaaggatgggatgggttgacatctgtcatccatcaattacctgaagacattcacaatcctccgcctccttgcgaattacatccaaaatcgcatccgaaagttccccgccctctgtgtaatgtccgcgtgcccaattgttccccgccccactttggccatggatgaaattgtcaggacgaaacaaattgccgtaaggaccattccgaacctaatttgccaaaaatacagttaaaaccaccaaataatgggaaacagaacggcgtccattgtgaccggctcgaggtccgccaaaacggcacttaatgcgagaaattgcgaaagaagcgccggttttctgcgaaccgtgggacaaatttgaactcagctgcttccttataataaacattgacacgctccaattgcaagtccgagtcgccccggtaaaagccatccggggaaatgccatgctcgtcggagatgacttcccaaaactaaacgagacacagcaaatttgttggcctgacggggaatgcgactttggcaccgatctgattgccacattgcccggtttggatatgcacaatctcacgcatttggatggacagaattgagtggcatctaagaaaacgtaaagtgggcaaatggcaaaaaaggcaatttgtgacactctctccaaaaattgggcgccttggaaaaactccaacagcgaaaaatgtcgacaattttatcgtaaaaaaggaatggtaaatagaagtggtgaaaagcgataaagccaacaaagtcagtgctgagaagaaagaagctcttcgatgggttggctgagctcgtctcccatccgccgcttctttgcttattctttcgagtccgtgccacgtaccacgggatgtgtgacggtgtcaccgaactttctgaacttggtcatgctcagctttcgtggcgatgatgaccgcctattctttagggtggctcgcggggaaggcggacgaaggacatgcggactgatggaagcgcgagactttgccggaaaatttggatatgccatttccggtggagaagtaggacagtgagtggaaggaggagagggaccgtccggagaagaggggtccgccattgaacagtcgctgctggcaaagtgagaagaggtggaaggggccaacgacggacgcggaacggcggcaccgcgacggcggaccggagaacgagaggcggaagagggtccgagcacagcggaacccaccgcaccatccaaagacgcgtcccggccccgcgtggccgaagagcctccggcagcagcaccacccaaagtattcaaagcaagcacctgctgagcggaaaaacaaatgcccaaagagggagaggaaggggggggggcgaaaggcaaggcgaaggagcggaaaacccaccgatttcctccgcgggcccagctttttgtcggacagcttctccaatctgtcccattcctcctgatacgtctcgtacaacttcttcggattccttccgtacttctccttcttttctttgaacttcttgggttccaagtcgatcattcgatgggtcgtgtcgtctactatcacttggggcggtgtttgcgccaccaattgggcgggggaggcaatgtcggggttcggctccaccaggttttgctggggacggacattcactttgggcggatccgtccagctcaatgcctgctcttcaggcagaacttctacggcatttggcaattcgtccatgtcaatggcaatgaatttgcacaattccaaattcttaacaattctcctttaattcacttttttattgcattgtccaccaattgtttttctcttttgtggtgcgattcgtccaacggaaatgtccgctcctccggcggtcctccgaagaagcgttggtccgccagtgccattggaggcggactcggatgtggcggcttcttcgggggaagcggcaaccgctgctgcaacagcggcttttgttcctcgggcgatggtggcctcggctccttcggcggcggcggatcatcatttgtgtcggggggaggctctctgccttcctgagagtttgaggaggggtgaaaagaaaagccaaagaaaaagccaaaatctaaggaaaagcaaaaagtgaatggaaatgccaaaagaaagggaaaggccaaaggcaaagagagcagcgacccacgttcagtgcaatttgcctttgcacaatgttctccaagtcgattttgtcgatctctgaagggtcaatgccgcactttcgacccaccgcatgcaaaaggtccttcactcgcaatctgaagcggttttagcgaattcttaattaattaattattcccattgttttcattttccttcctttttcgaattttcaaaagcgtgagaaatattcagtgatttggcaataaaagaaagaaaaatggagaaaaaggaaataaagacaaagaaattacaattgggaaaaggaaaagaaaaaggaacggagttcagtttctttcttcctttttctactttcttttgtctctttttctcttccaattttcttttcattccctttttctctatgctttactttttccttttttctttttttcacttccttttatccctttttctgcttccaatttattttctttcttttttctctaatccttcttttccttttttgctccttttctctctctctctctctctctcttgctctctctcctctctttttccttactatcctctcacttgttcccttttcttcttctcttcggctgattttcaatttccataaactcttcctcttttcctttgttctctcgcactctcttccgcaaaagctttctctgtttgttttgcatttcttactccaaaatccttttgccattcattcactctaaccaatgcccttctcttctcggcacaattcttcgaaaaccattttctcccgttagtgcggggttgtgcctttctgttggcggaatgccccgtccgtccctttggccatgcaaaagcggcgcctcccccctccccccccccgcctcctccaaccgttccgccgaacattttatttttgttaatcgttttcgcaatattccttcttgggcctctcccatgactctctttttaaatttgctgcatttccgtgccaatttatccttcaaaatttatttccgtgggatggatttcgaccggcgtttatcatttattccctcgctctctgttttaagctttgtccggcggtgtctttcctcgtccattggcccaatgttggaatatccctcggccacggctccgtccgtcccttcccttccccaaattggcgccaattatggcgagcagctgccaacaaatttcggcgaagcggatcgcttctcaccgcttattagcgcagtgaatggcggcagagtcggcggctgcccaatcgcgcgcgattccaccgtctcctccgatcagccgcaaatgcagcatccgcttgatatgttcacggattttacccgtcccgatggacaaaggacgcgccctctgttggtagacggcaaaaggctttatgtggacgaacattacatttcggtgggtcgcatgcgctgtcagacagctgagcagtgctaaccgaaggtgtggtcccccgtgcttcgttcttggtgcattgagtgcccagacagagagttgatcctggccaatgtgcagtacgaccacgtgttggagctgttgttggccatccaccccacgtacaaagaggtggacgagcagacagtgcacatcctgctgccactcggtttcgattaccaagtccgtccctccctttgcttcttccccatcctttcgcttctccaccacagatggatgggctgcttcatcgctg

SEQ ID NO: 2007 - DNA, 2605 bp, Heterodera glycines
cagagaattgcgtccaagtgtccacaaattgggacctttctggccccgatacactggactgtcggacagagtcaaagtgctgtgttggaacgcatgcacgggtcaccggccccggaggtcgtccattcgatttgcgtaaattatttatttgttaggcttaaggaattgccagagccccccgtggacatggagcatctgctgagtgcaagcgacctcaattttgccacggtgaaggcgaagacggggcgagcgtaccatgtgaacccatgtgggtccgttgtggacaatgcttagcttaaagccttcccctcagattacgtggccgcttggtcctctctctttcaggagagactatgcaatggcatttccagcgacggagtgccaaatgacgacgatttgatttactgtccgtgttccagcgaagaactgaagtactttctgatggccatttatccgccacagctgcgcatcacaggtggctggttgacgtcgcccggcccttttctcatctcatcccaatttcttctcagaatgtaatatcgcccccgtgctaatggccgcctgcaaattggagtcccacggtctgctgcggaagtgcgcctcccttctgctcagcccgcacactcagctcagtgtgtttgtgcgtctctctctgctggaccggtgccgacttcagcagttgttggcccaatgtttgctgatggtgcacagggcggagaacattgtggagatgagtcagcagcagacgtgtcagtgacttggccttttgagggaaaaagccttccttccgtcccttccgttcagacgaatgtttgtcggtgcgcgcaaaatcggagatggtaagcgaagagaatgtccctttataagacaccgaaatgagcgcagatggaccgcttcgctcagttggtccaacagcagggcggcccgaattggccactacaacccgtggcagttcacctctgttcgcggtattccgaactttctattagctctgtttatacccgcgcatttggcaggtgcaaaacgcagtcgaactgcgcggaagtgacttggcaatgtgtccaatgcaaaacgtacacatcgccgcagactatcgaacattcggcaggcggacggcattcatcgataagcagccaacagcagaaacagacgcaattgggcaatggcatcggaagcagcggaggaggcggacgagtggcacaccgatgagcggcgattgaaaagagggggggggcacttttccacaaggggggacgcactgttaaccctgatttgtgagcgaaactttggaatattcgcatttttgggcttcggaacaagagcttcgttaaaatatatccaaaaagccacaaaattggcaatttttgattaaatcttttaagaaacaagacccaaattgccttttttcggcggcacttatcggcacccccggagcccctaaaatcccttgagttttataaattgactcaaaaagtgaaagcactaagatttacaattttttggatttcaagtaaaattcactgtttattgcaagtggttacatatatctctcgcattcccttttattgaatatgccatgatcatgttttttgttacaagtgttttaatttaccacccactaaatttacaaggttttctgaaaaatttcgtgcttcgaaaatgggcttgctaagctccttccccactctcatcgcttattaaccattaatttcacttgccattcattcatttttcaatttgtcccttttcttttccattatcatttataaatattccgtttaacttacgtctttccaccgaaccaaatttttgtgctggctacatttttcatcttctttccgaaatgatgcaatttcttcatgtattcagaaccaatgtcaattgcgattgtggtgatggccaatccgatgcaaacgtaaagaaacgtaattggaaggaaagcccaacggaaagggaagagacagaaattggggagagggggggggggggggggggggagggactgaccgggacggaaccaattggccaaagtcgatggcagtcagacaaaggaaattgaagtaaatgccattgtaaaaatcgaactgaaacaaaagggaaaatccattaagaaggataaagcattgactaaaatggcaaaatgacctttccgttcaaaaggggcaaaaggacggcaccgaagcacacgtaaagcagaaaggcgaccaaaaggccgacggacatcacctcaagcagttcagtggcaaaagacgacgccatcgatcacctcaatggacgaatcgccgatttcttcgccgttgagcgaaacgcgcgaacggcgccgtcgctcgcgaaacgcttcgatctgttggagaaaaaagggggggggggcggcgagtgaagaaaaggcgatcataaaaagtgcaaatttgcaaacacaaaaactatgatttattattttgtttatttacattttttcgcgtggcgccagcaaattgattgagaaattggccaatgttagcaatgatctgtgatcagcagaaggaatgtcggaaatgttttaactgcttatcttacgatcattgtcatcggaatgccttaaatggtaaatacaaaagatttgttt

SEQ ID NO: 2008 - DNA, 2449 bp, Heterodera glycines
tgattggcgcgattcggttgtagccttaagcaatgttccccccaaaagtatcgaatcgggtcatgccatttcatcaaccgtttatgtacagtaaactacgattggaacgatataaaatattttttctcagcgattggctgtatcaaccgaaagtacagaattcaagtcaagtctctattttgtttggactcttattatgatcatcttactaccaacctaaagtggtgacaatgccgaagccgtacagagtggcggtcacaagccctgcaaagaacggaaggtaagggagagatggaagagaaggaaagaaaaggaagagaaaaaggaagaaaagaaggaaggaaagggaggggaaaagggaaggaaagggaggggaaaagggaaggaaagggaggggaaaagggaaggaaagggaggggaaaagggaaggaaagggaggggaaaagggaaggaaagggaggggaaaagggaaggaaagggaggggaaaagggaaggaaagggaggggaaaagggaaggaaagggaggggaggggaaaggaaagggagggaggggaaaggagtcgcctcccccacccaccccattgtgaacgagcatcgggctccgtcttgaagcattgcagaattagctgtgccgttttgttcagaggccaacttgggccttccaaaagcagcgatcggtcggctttttcgagtgcctgcgatggattttctctcttttaaaacagtaaaatgaaatgttttatcagagaaaagaaaaaaaatgtaatacttcttcaattagtaaaatactacatagtataattaaattaatgaaaaaacgataattaaaaggataaatggcaacgtttgcccattgcctcgggaattgccatcccatgggcttaaataggaaaacattggccaccgccgaacgaacctcgtccacacactcgcgcttcctttcccattcctcccgttgctgctctatcgttgcgtccgcttccaacttgttgaagataagacctccgatgagagcgtatccgaacacgaccagcagcaaagaacaatggagagtgaacggcttcaccttctgaagacgatggaaaagtgcgagaaagcgaaaattattggggggggggggaggacaattggcaatgagacaaatcatccgccggggggaggacagttggacaattggcaacgcgacaaatcatcccttggggttgcgccggagggaatatttaattggcccttccaatgccgcattttttgtcctttggggtccattaacgaaccttcacccgcggggaacgaatgagccgataaagcgcctgaatcagaaagaccatcgcaaatcggagaaaagtgccaaaaatgcactttcagcgtgctcaatttgcaaataatgctaaacaaaggctgtaggaaggacggaaataaaaaggaattgaaaagagatggggggggcgacgggtaatgaatgcggcgccagctgagacacagtggcggagggggcaaatggggaacggcgcaataaatggaagcgaattgccaattcacgagtaattagggagggagcgattgagaggaagctaattgagtgggggatgaagcagcggaagtgatcgcttctccgctcccccggcgccttcactcaattctactcattattgacagctgacttgaacaaaggcgaaaatgatgttttttttcgaacagattttgccagtcacacttattaaaaattatctccaaatgacttttccctcttttttggtccttttatttttctttggacgggtcaattcacgcgtttcctcctccttttaactcatattggattgcatcttttcgttttaatctttagacctcattgtcagaataaacactgccataagataaaggaggggcaaatgtgccgccccaacaccgacggaaggacgggggcaaatggtgttttggaggaacgaacgaaccattctttgtctgtctctatccttgccaatttaaaaaaagaagagagccaattgttcaatgggcgtgtggaaaagaattaaacccttcaattttcataatggacagaataattaacaacatattagcgtagtgaaaattcgacaaaataagcacattttcatgatactcaaaaagaagtgtttgtcggtcaatggtcagtggggaatttggtgttgttcgataaagaaattctgctgacggacttcgtcgggattttgagcggacggacacggcttggcgtacccatcgttggaccaaacagaggctagaaattgagcacactcaaaatcatttttgaaaatacaatcaatggttgttgacccaaccataaatgaactgacatagccaaatagaagcaaattcacaaatgatcacccggttggctccctccgctcgtttccgcgtcattttgagttttataaatcggctgctgtgctgagaatcgagagtctg

SEQ ID NO: 2009 - DNA, 1128 bp, Heterodera glycines
ggccaattttgcaaggctggcccagcagttgtgtctctctgaattcggccagcttttcaaggtattaaaaattccaactattttaaattttaaatttaaattatttaaaattaaaaaattaaggagtaggttggagcatggcaatggtttctttgcttgttggcatttattataatgtgattgtggcctggtcactcatctacatttttactgttagattcatttttaaagcatcatattttacttgcatttttaattagttaattagttcatttatttttttaattgctgaaataatatttaataaaagaattattttaatatttttttaaacaacttttattttgtttatttagattattactggtaaccatcacgatatatcatcatgcaacagcactttcaatacgatttgtgagttatgcatcggaaaatttataagtcaaatccctaggaaaattcgttcaaattataattttggattattttctaccatttattccttcaaaaaaattttaattcgtaaccaattgataattaaagaacctacaagaaaaattttaaaaaaatggtatgcgattttttaatttgaatgaatatttcatcaaatttgcttttttaatttaaaaatttttgagatttattgaaaactttgtactatctataagctcatttaattttaattactttgtctaattacttttttttttttattccatttttgattttttaatttataaatttttgtcaattttattaaaatatgcgacattcatatatatgtttatttaaaatttgtttaattaccttttactctaattactgattttgtttattccattgtttatttattttccttaatttaaagattgtgcttcttcgctggaagatgctcgttgtgctcatcaactgaatgccactggggcatttttcttcaacaaatcatgccatttgttgactgatcggctggcagcaacgctcagaaatgaaacatacaataagctgccagctgttagtccggcagaggaattttttgagtgcctatttaacataataaactaattatttagcataattatgcccagaattaattattatattttactataggaattatgtattgggaaa

SEQ ID NO: 2010 - DNA, 3607 bp, Heterodera glycines
tttaatttttttttaaacaacttttatttttgttatttagattattactggtatcatcacgatatatcatcatgcaacagcactttcaatactatttgtgagttatgcatcggaaaattataagtcaaatccttaggaaaattcgttcaaattataattttggtttattttctaccattatttccttcaaaaaaattttaattcgtaaccaattgataattaaagaacctacaagaaaaattttaaaaaaatggtatgcgattttttaatttgaatgaatatttcatcaaatttgcttttttaatttaaaaatttttgagatttattgaaaactttgtactatctataagctcatttaattttaattactttgtctaattactttttttattccatttttgattttttaatttataaatttttgtcaattttattaaaatattcgacagccatatatatgtttatttaaaatttgtttaattaccttttactctaattactaattttgtttattccattgtttatttattttccttaatttaaagattgtgcttcttcgctggaagatgctcgttgtgctcatcaactgaatgccactggggcatttttcttcaacaaatcatgccatttgttgactgatcggctggcagcaacgctcagaaatgaaacatacaataagctgccagctgttagtccggcagaggaattttttgagtgcctatttaaacataataaactaattaatttagcataattatgcccagaattaattaattatattttactataggaattatgtattggaaaaagcgccaacaatggacagttttggtggacttaatttgaaaatggtgattgccttgggctttgcttggctaatcactgttcttgtgctgatcagaggggtcgaagtgatgggaaaggtggcaaattataaatattatatttaaattttatttccaaaatcttttttaaatataatgactgttagcacatttttcattaatttttttatatttttataattgtcaaacgcaaaaaaaacatgagcttattttgacagattgcatggctaactggcacaaccccatacataattattgtcattctcttcatacggtaccaattaaaataatacattaactagttgaataaaaaaaatcaattaattcattaatgtttttagtgccgttacattggatggcgcaaaaattggattagacttttatttgcttaaaccggatgtcagtgcgatctttttggcaaaggttggcaccctttttaatattaaaatatattgaaataaaaaagatttcgattcagttgtcccgttaaatataaggaaaaagtcctgagacgtttttgaggcctcttattaaatttaaatacaaatcctttacactgggaaaattttccgggtttccggttaaatccaagaaaatgcgtccttgaaaattttatggcctacagttacgcattatatatacagtgtaacttgatatatttggtcgcctcctgttaggcctaggtgcatgtccttgaaaattaatcaggcccatcgccagaaaaaaatttcggagggtgaatccgaacgaagacctattttttcttcgggtcaaaattttgtaaccagcgtaattcaaaatttttagcggctgccgtgcaaaaaatcagatccatgaattatggccttcagttacgtccttgaaaattttatgtcctttatttcctctctgttaattgtccatgggagtttttagagcctccaattcaattctccaaacactcttgtccattaagacatggcgtacagctgcaacccaagtgtgctacagtttagcggttggcatgggtggactgctttcactatccagcttcaacacctttcacaacgattgcttcaaggacgcgttcatcatcacggcagccgacgcaatttcaagcatttttggtggcactgctgtgttcaggtatggaataaaaagtgccgagatttaaatgtgatgcaaaagcccttcttaaatatgtgcaaatcataaaaaaatgccaaaatatttaagttgctaaaatgaggacaaaaaagaaaacaagttgaacaaaacaggccatgctccaaaatttctcctacttataattacaaaaccacaaaaaaaaatttttttttttatttttaaataatttttaaatcaaatatttgtcaattgagcggagaaaatatgtttttcgtgcctctctcgtaaaaggttatctgcaaacatataaatccacaggcccacattcgcccctgtttctctctttaactctctgcccataattgggcaaataacttttttcattttctataaataaattctattacttttctaaaacaatttaaaaacaaatcataaacaaaaatgtgcataaaaagaaatataaaaatttttcttattcttatgtaaacaattttttgggaaatattattgataaaaaaaaaatttttaaaaatgttaccattaaatttaataattctaacagcacactcggcttcatggccaagcagttgaacgtgtccattgaagctgtggtgcagagtggcaccgggttggcattcattgcttacccggaggcaatgagccgaatgccgggctggacatggctttggcaactgttgttctttctgatgatttttatccttggcgttgcgtcccattttgggttggctgaagtgtgtgtttgttcatctgttcctttaaaaaaaactttatttgccacaaatggggtttcccctgtgaaaattatttttgatttttgaaaatagtccattttatgcgaaaaataggtactaattagggagtttgctactataccctcggggagagaaaattcgggatccgggtggaattacccagcaaaatttgtcctgaaatggctagaaaaattgtaaaaaaaaacatctaaagacaatgcaaaaaacaagcacaaactcctaaaaataattttgtctctaaaaatatctcatgttttttaggtctcgattggcactatttccttaaccataacaattcaaaataatatatgattaaaaaatgaaaaggctcctcctataagataaatgaataagaaatttataaaaattacaatttttttagtataatttagcaattaatttaaattaaattactttttgtacacattcttaaaaacatttaggtaatgtgtactgcattgtatgatcagtttccagccttacgacgttataaaagtggtcttgtgatcggagtttgtctttcatgttatttggcaggcttaacaatttgctcaagagtaatttaaattttttaattaattatatttaatttcaatttaaattgatcaggcgggcattttttattttaacattttcgacgattatgccgcgtctttctcaatgatgcttcttgtttttcttgaactcattttagtagcgcatatttacggtaaaaattattgaatctttaaaataattattcaaattcatttacattttttatgttaatttttaggattatttttttctaaaaagtaacaatgatttcaggggcgtagccaggaccttcgtttcgggggggggggggggggggggggg

SEQ ID NO: 2011 - DNA, 5236 bp, Heterodera glycines
ccccccccccttctatcccccccctgatgattgcttataaaagtttttgataaaatttctctgtttttgtagcttattttaaatacccataaattacaacatttttcatgttttttttttaatttttaaaataaatttattagtattttatgtatttttaaatttaaatagaatctttttaaaaaaagttatcttaaattacttaattaattttattgatacgattatttaaatcatttaaattcaaaactattcagggtggaataattataaagctgacatccaggcaatgttaggcactccaaggaatttgttgtccaaattctatgggccatccgggctgtgcatcaaatacatttacagttatattgctcctatccttttgattgtgagtgacaattttattcatttttatatatatttatatttaattatacaaataaatttttggtttattaatcaatttaaattttttagatttattttatcctttatgttcattgaatatttttgattctatttaatttagccaaaataaaaataagcatgatatatttagcattatttatacaaaaaaaagaagaagattgtttatgtgttaaaaagatcaaatttaaattatttaaaatttcatattttttttttcaattattaataattttttatttaaatataggtcgttttggtttttgcatttatgcaacaagtatttacaactcgggtcacctacgggcgcgacaaacgactttacgtgttcccggcttggtccatcgttttcgggtggtttttgtcgctgatctcgtggatatttttgccgggtctaattgtggcaaacactgtcaaatttatacgtcagggaaaggtccgaaaatcaaatttattaaaatgataattgaaaatcatttctaatatataatttttcgtgacctattttttttaaattaggcatagggtgtatttttgaaaaaaaaattttcagcaattcttaggtgtttattttttgttattgcattaattttgggcaaaatgccaaaataggtttttcaaaaaattaaaaacctaaaaaataggcactaataaacttgaaaagtagcataataaccacctaaaaaaaattttcgtgggtttcagaccaattgaacttcggaaaaaaatagaaaaaaaacacctaaaaatcgtacacattgttatcaaacatcaatttgactttttcggttttttcattaactataaatttaaaaaaaaaattcatttaaaaaatattattaatttcagccacttaatgagttgctaaagatgcagcctaaatggccttcctatgagcgtgtcacacgaggtgtgggcaagtctaagacttcaaatattatgagtgccaacagaaaccaaccaccacttaacataacaatgaatgaatttgcgaatggatcgtcttaaaaaaagaaattataaaaataattaaattgttataattaatgtaatttaaaatttaatttttttttattttaaaagaaagcaacacattttcttgtatcttcttgagtgaataaatttgtatttttgacaattttgttttaaatatttatgtattgtttccaagtgtacttttttctatcatttatccttggtttgaggcgtcccttaaattttgggatttcttaaatttagttaaaatccaaattttagtgacgaaagaattgtcaatatactttttttttaatttttgcaaataattttcggatagagaatatctggtgatattgactttttatacatattaaaaacatgcgatattctgaaaaattattggttaggtctcgagaaaagtttctaaattatgaaaatttgttaaaaaaagaacattgacataatgcaatattaaatatatattttttatatttttaatttctttaattgtttatttatttaaatcagtattttcttttaatttaaacaaaatcgcatctaaaaacataaaatttttaacgttgatagctatcaaatttcaaatatgccatcagtgtctggaaaaaattgttatttttcccatcatttttgtcaatccacctacattgaaacaatacactcgtttatttttaacaagaaattgtcgcaaaaataagtgcagaatgaatttgaaaataaaatttataatattaaattatattatcatttttaaaaataaatttaaaaaaatattttattctaaaaaatttagccaaattaagcaaaaaatgcagcctcttctaatgctatttttgactataatgagttataacttggtcccaatgatttgtgatggaaactatttgggccaaataggtacaggtaaaaatttaattactaaaaataaaagaattttgcaaaataaattttaaggaaataggcaacaacaataacctattaagagagtatttgtcgcgtggaatgtacagctgtggcgctgaatatgccgcagcactgcaaaaactgaacaaattaatcatggtaattaaaaaataatttgacaacttttgaaaatgccatttttcaaataccgaaaacattctaatctgtgaatattcattataattaggagacatacaaagaatattcggagtgtaagaaactgcttgaacaagttgaggacggaagacacaaatcactcgcaaatttggccgctgagttgggcatgttcgaccaacttgttgattgattgaattttggacaaaaaatgcttaaagtttgttgtaacgaaattgttcaatttattcaatatcttaccaatacgctgacgattgtaaaaaataattgataaatttaatcattttgaaaagccactttttgaactccgaaaatattcaaatccgtgaaccttcaaaatatttaggagacctcaaattttaccgctgagttggccgtgttcgacccaacttgtgaactaaatcttgacataaatatttcgttagtttgttgtaaaaaattaaataaaacctgaaattaaaaaatatttgccagtatagaacgcgcttgattggcggtactgaatttgcccttctttactattttttgaaactgaaatttgttgtttaacattacaacaatgacccactggaattcgtagaaaggaatggcatggtaaaagtttaagtgcaacaggatcaagcaatatccgccactttattggtcgccaaaaccgacctttttgcctatttacgtgtaatcgctcatagaatgcctgaataaattaatttgttcaaacatatttttaggaaatattctgtttatatgccaaaaaaattatttttcaaaattttagtttattgtcggaccgttcacttttatcggattgtcctcactgttggattgtccaactgtcggattgtccgtgagcctcgaaagcgtgctgagccgaatctaattctttttatgcctaacttttttggaacttaataaaaaaaattaactaagtaatagagaaatctttggtctgcttaatttaagtttgaatatttttcatggtattaagcgttcttttatttttatgttaaacaaaaaataagcggcatttaatccatcctatttttttcaaatacaatcaaattttgtttttctttatatatttcgacagcttgcagcttgcagaagtccaaaagacttcattaggtttccatagaagttagttacaatattattgagtttaaatttttcgaaattttttgggtttcgccccttggcgccttttttaggttcaacttagaacccatcaaaagatatcaagttcgcaaaattttgttgctcataaaaatgttaaagcatttctcaagccacattaccttaacctgtttaattgtaaaattaccgaaaattttaaaataatttttattttataaattttattaaaaataatcaataaacgtaaaattgttgcccacctttaagcgttggcacttacgaaacgaatactcaaaatcatattattattttagtgttggaatttttgccaacatgagcaggcagcgtgaatggaaatagttagacagcatagaaaaaaagacaaattcaatttctatgtgcattatgtatgcaagggttaatatttccatagctaatatatacaatacatgtattcgtgtgttgctatgtatgctttaatgcatagaaaattttatggccctctataagagttggcatattcctccacgtcattcttatgcccatcagcagcaggcaaactgagtggtagacagcgagaaaaaaagacaaattcagtttcaatgtatataagggttaataattaccatggctaatattcaatgcttatgcacatgaatatgcagtcctttctatcggcgatatcaatattacatagtcatacaaaaagaaacagaaatagagagagagaaaaaaagaaacagagcatgttttagcatataataatggaaatgcatgcattatagaaaatttatttctatgtatgtatgtgcccatgtattcgtgcgtttctatgtatgctttaatgcatagaaattttatggcctctataagagtaggcatattcctccacgtcattcttatgcccatcagcaggcaaactgagtggaaatagttagacagcgagaaaaaaagacaaattcaatttcaatgtatattatgtatgcaacggttaataattaccatggctaataatcaatgcttatgtacatgaataggcagtcctttctatcgacgatatcaaaattatatagtcatacaaaatgaaagagaaatagagagtaggaaaaaagaaacagagcatgttttagcatataatataagagttgcatattcctccacgtcattcttatgcccatcagcaggcaaagtgagtggaaatagttagacagcgagaaaaaaagacaaattcaatttctatgtatattatgcatgcaagggttaatatttaccatggctaatatatgcaaaagcagagagaagagagagaggagatagagagaaatagagagatagagagataatagaaatgtgtccatcatagaaatagaaaaaaaattcccatatctatgtatgtgtgtgctcatgtattcgtgcgtttctatttatgggttgtatgcggaaaattttattatcctccatgagagttggcatattgatccacgtcattcttatgcccgttggcaaagactggtggactaactgcataaatagagactgggccgaagcaaaattcatcacttttttaattgtggccaaacattta

SEQ ID NO: 2012 - DNA, 1551 bp, Heterodera glycines
atcataatgggtcagaggaagttccgactgcgagagtctttttgcctgttcaaaagcttttgttgttttggcccccattcgcaaggagtttccttctttaatagcaaatccaaaggagcgcggatggttctcatctttttaatgaaacgaccataataattaattgatcccaaaaatgagcgtaatgtgcaaaggtcatgcggaggcggcatttcaagaatttctgctgacctactcgggtccattgaaattcatttaatgttggaaaaagggaaagggcccttcggtggtgccgaaaggcgatgaccatgaaaaatggaaattttggtcatatgtatttttagccgaagttaaaacaacgaattttgaattttcgtgctgaaaaatttcctaataaaattaaagaaaactgcttttttgcaacaaaaaaaagataaaattttgttatgcttacttttcaccagccaaaaaaggggttttttacaacagcaaatacaacagacacaccagcaaatgatgcttaaccagcctggcagcggcaattacggcatgatgacgtcccagcagcaaatgatgcttaaccagcccggcagcggcaattccggcatgatgacgccccagcagcagcaaatgatggttcagtttcaaaaggcggtctgggaagacattgtcggggatatcctggagaaatattttaaaaattgttgtggacatttttcattaaatgaaaaaatcatttaatttataaaaaaagggatggtgggcccgccggtgccgatatgcgccgccttgggaaaaatagaaattttattaatgtttaaacagaatgttcgtgcttattcgctaaacgatagccgctgaataaattaagaaattataaaaaataaaaattaacgactcattcataacagtgataaattaggcattaaatttatatgtttcatttaattgaacaaaattttcccataaaataaaataaaattgtttggtttttctccaaaaaacttaaattatgttttcttcaaaattattcacctgctaaaagatttttttaaatttttttgataactcttatccaatccgaaccaataagacttcatccaatcacagataaataatttgataatgcaaatgcaacagctacaacaacagtatcaagcaacaaatgatcaaatgattcaatataatttgttacaacagtatacccaatgccaactatccttgcaaatgctgcagcaaccgcaaatgatgccgcaacatcaaatcatacagccacagcaaacgacgccgcaacaaggacaaattacaccagcattggtctgtctgtttgtttgttatatgcagcagggaccggatttttagggttttcacatattctttttgaggatagcatatggtgagataaaggcaaaaaaaaaaacattttcttcaatccatttttttagagcgacttttaaaccaacatttttcaactatttttcgcttatgaaacttttttaaccgactatttttggctttgggaacttttttttaaaaaccttactatttttt

SEQ ID NO: 2013 - DNA, 2024 bp, Heterodera glycines
  misc_feature (15)..(15): n is a, c, g, or t
  misc_feature (19)..(19): n is a, c, g, or t
agtaaaatttttttncacncagtattttttgaagactaaaaaaatctcgtaaaattctttcccgttttaaaaaggtgtgaaaggggcacctaaccggccggcagaaagtgcaatttattatttgaatgatcaaaaatttgcaaattaattaataataacgtaaaaaacattgtattttttaataaaagaaaacaattgaataatacatttttgatttgaaagcttttgactttttttgctgatctgaaatggacctaaaatgatttaaataatattttatactttttttagctgcttttaacatgcattaataaacgaaaaaagttacataagtatcggttttttgactctttttttagttttgtgacttttttgcgttgtttatggcctgtgacttaaattccatccctactaatgagttaatgtgattttgattgccaaaacattatttaaaacattattattttacttatttttagtttattttctaatccgaataacaattatttaaatttatattattattggcaatttggttcgattgtaagcatagataaaaaatctcgatgtttttttccaagtattatgaaactaatatgtcttaatcaattgattcaaattcactggtaagtaaatgtgatttgaattaaacaattttaacattatttttgaggggtcaattgatttttaagtctatttttcctggtgactcgaatagccttaaaatgatttaagttattttttaacattttctcgtaatctttgagcatacatttttctttggcttttttgaccatttcctaccattttggttttttatgactagagtgctcattttgcagcatatgctgttttttttttaacttggggcgtgataataagcatgtaaaaggcatttctaacttggtttgaggcttctaagtcaacttttttcttgctgatttctgattttttgatttttgtgctgagttggcattttggtgctttttttgtgctgtttcgtcattttgaggaattttttaaaatattttcagcaattttcaaaaaattaataacaaaaatgcaataaaacctaaaaatacaccactaataatcgatccgaaaaatttcagaaaaataaacccctaagaaatgaaaaattttgccaaaaataattcatctccaaaatttatttaatttatttttttacaaaattttgattttttaaaattatgtatctcattaccatttttagcacctattttggaggttttttataatcagggagcaaataaacgtctttttgacgacttttttcaatttttaatgcctttaatctcttaatttttatgcttttttccaattttttgtgctgattttgccttttttgttattttttcatgcttattttggaaaaatttggtgctgtttacagtgcttaaacggtgattttttgtgctgaaaactgagcactctatttatgacttttgctcttcataatttttaatgcatttttcattttttggcaatatgtcaaaaaacgaaaggcgcaattaattaaaacagggagcccaacgaaaattttccaaagtcagcatttagcgacaaaaaatcactttgctgtcaaaaaggagcattttgatttttttttgattttttattccaaatggacaaaaatgtcccttgataaacaacaaggcaattaaattccgaaggattcaaatgtcacaaacagaaaactcaacatatcgccataaatttgaaaatatggataaatgatatatctgatgagactttttgataaaaaaataaaagtttttattaaaaaatcagaattccaattttataataaaattcacgatctttgctaacaaagactgggtggacaaccggacagtgggcaatccgacagtaaattacactaaaagataagaaaatgccgtcccgaaggggaccgattgtgccgatctcaagaaaatagtaaagaaattatgagttttgggaataaccctaaaaatcaaacgaggtgaaagaatgataagtga

SEQ ID NO: 2014 - DNA, 3054 bp, Heterodera glycines
attctgatcaggtggcttagccaaatgaagccgataaaagagaggaagatgagggaatattcgctggcgaagggttcaaaaattctcgcaattaaaatatttttatgcagttcaataattattcgaaaactctagtccagaatttttaaatcctaaaatcgtcacagctaatttcactccaactcgcggatcacttccgacccattgtaaaacagcgcaaaattttgttggttagcaccaaatagaagggtccgagtgcaattgaatgtctaatgagaaaagttgtgaaaaattttttttttgaaaatcggcgaatgaacgaaccgccactgaccactgaccaaccaacgtcgccaaaatggagacggaaactgcaaaatgccgggttggacaatgctttgattggcgaaatgtaaatgactctaaaaattttgggaagtagggaggacgaaggatttggccaatttttaatagaccgatgcgattttgttattgtatttatgtaagagtacagatacactaaatcacctcgtccggtgcagtttgaacaagccaccgcatattccgccaccaccgttttgcccgcgatgctctgctccatacggacgatcgcctgctgctggaacgggtccaactcgaaggaatacagtaaaggaaaaataaataaaaatgacctttttatttaaaaattaatttctttgtaaaatttggtcgattttgaaaaaagttcggcgatggaggcatcctataaacaaattttcataaaaatttcaaaaaaatggagaagataaccttaagcttttggaccgtctcgtccaatgtgctcagagcagcggcagaacacgcaggttatctgctgatacgaaaatgtggaaagagtgggaaaattttaaacttttatttgaaaatttttgtgaaaaaaacaccccaaaaaacctttaacataaaaagtctgattttgtgctattttaataggcctatatgtcttctacaaattgcattaaaagattttgatcagtttttcaaattgatcagaaaaaaagtcttgaaccggtttgcatcgaaattgacaaaacagaaaatttatcgaaatttccaaaattagaacacttctcgttgtttaaaattcagaattagatggactaaaaatacaccgttggtaacgaacaccgaacttcactttaaacctgtttaaacccgaaaaaccgttttggacaatttcgacccaaacccttttaagtagtttttttctgaccagtttgaaaagctggtcaaaaccttttagtgcaattttgcagagaatagatggggctaaaaattagcacaaaagcagctttttctcacaacaatctttagagatttttcacccaaaataacagggggttatttttattcaacgacctagtaaaaataatttccctataattttttccacccagtatttttttgaagactaaaaaaatctcgtaaaattctttcccgttttaaaaaggtgtgaaaggggcacctaaccggccggcagaaagggcacattgggggacttgccgagcaaatggctgaacgcgcgcgggtcgggcgccctaaaaaggagcaaaatttaaaaaaatgtataaaaaatattctaagaaaatttgctaatttatacaaaatggaaactttaaaaaaaccaaccttttttaaatttgacagaatttttaaaaattagatatatttttagaattttgcgaaattttaaaacaaaaaaaaacaaaaactttccctgctgtggcgacagagtttaattactagggatgatatttttaggtgctaaaaactggcaaaataggtaggttttaggttctaaaaaacctcaaaataggtgctaaaaatgggaaaataggtgacaaaaagttccgaatttaggggtctaaaatcgaaaattttcttttaaaagcaaaaatattttgtcaagtcattaaggatatacataattttcaaaatcaaaaactatcgacaagaaaataaaataaataaattttggagataaatttttgagaaatttttcatttcttaggggcgcatttttgaaaattttctggtcgattcttagggatgtattttttgaaaaaaattttctggtcgattcttagggatgtattttttgaaaaaaatttttgggtcggttcttaggggtgtatttttcttttttattgcatttttgttaacaaattttgggcaaaacaccaaaataggtgaaaataagttttttaaaatttttttaggttttttaggtgctaaaaataaaaacctagaaaataggtgctaataactcgaaaagtagcttaacaacagcccaaaaaaaacatgtttttcgtgcgtttcaggccacggggagctcaggaaaaaaatatgtaaaaatctaaaaatcgcatccctatttattaccaaatttatccaaaatgcctcaaaataaaattaattcagcgactcgcaaatttgaagtagaaaaattaacctccgcccctctcgcgccttttatttgaaaaagttcaacattttcaagcaaatttcgtttatttctaaaaaattggacaacaaaaatccctaattttccttaaaaattttgctcaaaacaaaaaaattgggttttttagataaaatctgttacaaaatgaactcaaatttccaaacgattttccggcagtgcctatcgatcagggctggacgtaattacggattacggattacggaaattacgacctttttggagttacggattacgggttacggatttttgggatttttccgtaattttgatccgtaactgactttttagattatttttcgagacgatttcttgcaagattattttttataaaatgaatttttttttctatttttattaaaaggctacccatatttcgatttaatctgacttattcttggtaatttgtagtattataacatacataaaggggggggaggctagcaaaggggaaaagaggaaatgctaaaaatttggctattttttaacaaaattcgttaaaattctgaaaaaaaaattatcctcggcgg

SEQ ID NO: 2015 - DNA, 4895 bp, Heterodera glycines
tatttttttattaatttgaatttgcaattttcaatgccttccattttttcgaattcaattttagcgaaaatccaaatttgagtgaccaaagttcaaaaattcattgaaaatccgtttttagaccatttttgtggtgagttaacggaaaatggacatccaaatccgatttcttcgcaaaaaccttataattaaattttgagatggtagtggtacccgtagctttggcttaagccaaactctggaatgttccgcgttgcaaaatccaccgacaattttcagccaagtcgccgccaaatgacctgagtcactgcgttgtttttttggcgcaatcaatttgctgcggacattagtcaatcaggcattggcgtaaccatcagctgggatccttatcgtaccatttccttccttttcaagaggataacggtattgcagttggttcgcgtgccgatggacgactcttccgagagccggaacgtggacacgatatgtgggagacttttccaatctttcgatcatggtcccattaagccaaaatcgttttctacggttgaagtttagaagcaaaacgggatcctttggcaaaaactcaaccgattttgctctgtggttctgatgaaattgacgtgccatttttcgggcaaaatcagcttgcgatttgcgaattttggctgggtcgatgatttcggcgtgttcttcctttgggtggacgagagacaactgagttcgaagtcttcgaccgaagaacaattgatcaggcaaaaatccgtgagtgccgaatatgggtcgtcctgtaggcgagaaacatcttttctgcccaaaattttccatctttggcgcatttcttcattgcctttttgaacgtatcgacgaatcgctccgcttggccattcgactacgggtgatacggtgaagtgaaggtattcttgatgccaaattcactgaaaattccttaaattctgcggcatgaaattgagtcccattgtctgaaacgatttcttctggaaatccgagtcggtaggcaattaatgagtcgatcaaaatcaaataggagtgaccatctgaacagggaccggcgaaatcgatgtgaatgcatttgaatggtcgtgagcaagatgtccatagggctaacggtgcttgggtggactcttttgggcgctctggcaatctgaaaatacggtgacagattattgtcagtgcatttttgtggccagtcggattttgtgtgttaagaaaatttccgaagtatttcgtctattggtgtcatttctgaaatctctgctttgtgatcggcaattgatcggtagcagtttggcggatggcgttgatatagcaatctgtctccgtacagatatttgctatcaaaattcgccagcaatggcttgtggtccatgaaaagcgtgaatttcctaccaaatagcattcggtggaatttttgacaaccaattgttccttttcgatttggctgtaattctctgtgcgtcgttgagggtgcatgacgcatgctcaattactttttccgatttgtccggaaaaatatggctgattgtggtgccaattccgtcttttgatgcgtctgcaaagttggtccagttgttcgcgatttcgagcacggacttaataaatcttccataataattcaatgcgccgagaaatgaacgaaggttgctcaaatcatgcggtggcggcatttggcgaattgcttctgatcgtccggggtcggggcgagttcctttcacggagatgaaatgggccgagaaaaagcaacccggttggatgaatttgcacctttccaattggattttgaggcaaaattcctgaatttgtttgaagagcttgtagagcaaagaaatgtgctcttcaagcttttatgaggcgattatgccgtcgtctaggtaggcaaacgcgcctgggatgccagtgacgatttgtacgcgtctcagaggtcgagattggagaaatagacatagcagctgatggccgtgtaaatgtcttcaggccggggcaagaggtgattcaactcgagcaaattgttgaggccggtggaaaaaccgatgctaactcgtgtttttccattctttttcataacggccaaaatcggtgctgcccaatggctgaactcaattggtttgatcgctccaatctgcaaaagccggtctaactcttcgttgacggcattaaagggcaccgtgtgggacgggtcgtgccttgcagatgttgggtgagcatcgggtttaagaatcaaatgggccttggctttgtgcaacggcctaatccggggccaaaaacatccgaaaaatcagcctggagtgcctttgttagcgataccaaatccgaaattttgtgcgtcggctggggaatggccatggcgttgatttctgctggggctggttgagattttgggtggatgtcggggtacatgattttacgtgagatgacttccaaagcttcaatcaatggccgtccgaaaaggtcgtaattaatttctgagctgccataagccacaagctctttgggtgcttgattgggttggcaaacggtgcagagaaattttccttcgatgttgaacgggacttcattgcagttccgtgtttcaatgtcgggtttgtcaagttttggagagccagctttttccacgttttgattgcaacaggaggattgaaccaccttgccgcattccgaatcgtaatggaatttggcgatccgatttttccaatgagcttgctaaggtcgcgtttgccagtgaggatgaggccgcgtttgcaggtgccgcatttccggcaaatcgtgcaaaaactgcgtcaagcacttctgcagttgcgtggcgtccattggctttgcctcgtccgacgatcagcaataaccacacatagtggctcctcacaccacagaggtgctattggatgtcgcgaaattgaaaaaaccgcgtcttgcggaacctcacccgccgagggtctattggtttttgtctaatttaaccactaaaatttagcggacctcatccgtattgggtctattggtttttcgaggtttgctggcagtccgatgtcttcgctttggttgaagaacggctgctgactgcgccaatgttgtgtctcaattgtttgaacacacaaataaataataaacacaatttattggtcgacggacaattcgagaacaaaatataaaataagcaaatgaatggaggagacaatgtggggaaggagggagtgcttaaataaacaaatgaattagggggtgggattgacacgtcaccaaattaatcaataatcgaagtgcgccaaattcaaattctgtaatatgtaacactccaacattatttatttgaattggcgccaatactttaacagtaatgttgatgcttgtttctgttcgtcacaagcttctacaatttcgtctaattcattgttattttttatttttgaaaaatttagactgatcaattttgggtgcttgttcagactttttattaagaattctaatagttgtaaataaaatttacctaagtaatatttgagaaacgccttcagctgctttttggtgtaaaatggacgtgtttcgatttgggtttcgcctcttggacctttttcagtgggtcgctcaatgcttatctaaatgtctatttttattggacagcgcaaatgtcggacaccaaattacatacactgatgaccctcgtgcaatgctcatcgagggcgcaagcgagggcatgaccactttcatgtttcgcagccctttgctccccttgcagaatttcattgtacaacatgaaagcgcttgcgactttcaccttaattttattgcactaataattaaatagacaatctctaatatctacccgaggttcggaattactttttttgacctttcacatggggaaaatacatttgatgcgcccaaatttagcgacccatcgtctgtgaactaacattggtgactaataaataaggaacatttgaaatttttaccaaaccattcccatagattttatgaactattaaaaaataaattatagaagaaaagattttgtgaattttttaataaataaaatcaataattaaatcggcaaaaagttcaagtttaaatcattatccaacaagtattattggaaaaaatttcatcttgataaggccccagggataggttaaatgacaaaaatttttaacttaaactttttaaatgactatgttaaaatgagttttggtaattaaattactttgcatattaaaaaataaattaaaaaataccaaataaataataaaaaaatcgacagcgtatttgaaattaacttttttaatataaattaaaattcataataatttttatcagagattaattccttaaattttttgtcaaataattcccaacataaaaatgagaataaaaaatgatatacaaaatggcatcgattaacagtctcaaaaattcggcttggagggttttaaaaaattttgtccgatttattgcctagctttttcaggaaaaaataatcggaaatttatataagaaaattccaaaaaaaatattttaaaaaaattttcagcgatttttttgaaaaacttcgaatagttttatcggttgcataaaattgattaaacacaatatggaataaattcattaatcagaaaactgagccaaacgagctccatttttaactacgaaaaggggggaaggtctaaagaagcaccaatcgaaattttaagaataaaatcaaaattgcccggccaaacgcaccaccatgcctagccgtggcgaattgtgatggtggtgttcatcaccggctgaggacgagggcggtaagaaaacgtccgcggaagaggcgaaagcgtcgccaccgtagccaccaaccaacagcaacaggacgtcatcgtcactcgcgccgccgggtaacgatc

SEQ ID NO: 2016 - DNA, 2005 bp, Heterodera glycines
cctcatcccgtattgggtctattggttttcgagggttggctggcagtccgatgtcttcgctttggttgaagaacggctgctgactgcgtcaatgttgtgtctcaattgtttgaacacacaaataaataataaacacaatttattggtcgacggacaattcgagaacaaaatataaaataagcaaatgaatggaggagacaatgtggggaaggagggagtgcttaaataaacaaatgaattagggggtgggattgacacgtcaacaaattaatcaataatcgaagtgcgccaaattcaaattctgtaatatgtaacactccaacattatttatttgaattggcgccaatactttaacagtaatgttgatgcttgtttctgttcgtcacaagcttctacaatttcgtctaattcattgttattttttatttttgaaaaatttagactgatcaattttgggtgcttgttcagactttttattaagaattctaatagttgtaaataaaatttacctaagtaatatttgagaaacgccttcagctgctttttggtgtaaaatggacgtgtttcgatttgggtttcgcctcttggacctttttcagtgggtcgctcaatgcttatctaaatgtctatttttattggacagcgcaaatgtcggacaccaaattacatacactgatgaccctcgtgcaatgctcatcgagggcgcaagcgagggcatgaccactttcatgtttcgcagccctttgctccccttgcagaatttcattgtacaacatgaaagcgcttgcgactttcaccttaatttattgcactaataattaaatagacaatccaaaatatctacccgaggttcggaattactttttttgacctttcatatggggaaatatatttggtgcgccccaaatttagcgacccatcgtctgtgaactaacattggtgactaattaataaggatcatttgaaatttttatcaaaccattcccatagattttatgaactattaaaaaataaattatagaaaaaaagatgtgaattttttccaaaatttccaaacgtgctatttaattataggttcaaaactggatatcagtgctacaataatgacggacttaagcacaaaattactatataatgcccttagggtggtgcctcaacgaatcttctcagacaatgagaaaggtaaccctaaaaatcgactatcccaaaaatgatcaatgatccctcggaatactatttggtactcccgatcacctgaaggattgatctggtcagagttacgcattttttgatcattatcaaaagctgtgttatgccgctaatgtccgaaaagtgtaaataaatatttattaagaagaaaagggcaaagcacacaaaacatggattgggtcacagcaaagggaaatcatgtaaaaagtgaatgtaatgaatggaagagacaaagaagggaggaacggaaggatatttataacaaatgaaatcggtaaggggatgacgtggcaaagggcagtagaatgcaaatatatttagatatgattctttcctaacacctcgcccttcaaaaagaatcattttcttcatcctcctgaaaagcgctgaggaagccatcgatttcttttttggtcgttcttcgtgagttcttggctttggccaagcgtgtggaagagtattaaacggaagctttgcttcttcagcacaagcttgacatgatcgaacgaaatcttcgatttcctggaccatcccaagcaaataaaataaatatgttgtcaaatcgtcaataaaaaatacaaattcggcaaataacgatggttcaaacattggcagaaatccttcaacagctgaccaatgtcatcaaacaacagcagcagcaacattcaccaccactcaaccaagtcaaatttgcactttccggacattcatcaattttcggcagacatttcggaagaatttgaagagtggatggagcgttttcaatttgcgctggaatgcgatgcgccaaatatg

SEQ ID NO: 2017 - DNA, 1178 bp, Heterodera glycines
aaaaatttcctcaaatgcatcggcgttacgtcgcttagtcctcgcgcctaagaaactcacataaatacgagtccaacatttttttaaattggggtgtgccttcaaaacaggaaagtaccgacattttcgttgccctcgcccctcacacacacacacacatattttaaaaattcacttaaatgttgctattaggcccaaatggcgatcacttttagtcccaaatgccgatcacttttagtcccaaatgctgatcactttatgcccaaatgctgatcattttaggcccaaatgccgatcacttttggcccaaatgctgatcacttttaggcacaaatgccgatcacttttacattcgttgacattgaattacaattcattgacacctttttacaattcattgataaagaattatattcattggaattaatttttttaagggtaaaatgaaaattttcattattttaaggcacttattgatacggaactctgaaatactttggaaccatatgaacgtttgctgcagaataacaaagaagaagtgagtcattcctctgataattttcattatctgcaaagtgaatttgaattaatacaaatgctaataatctttaaattcctattagcaatacaaaatcaatcgccaaatgatgcctgaatttaatggcacaaaaaatgtggcaaaatttgcattggatagcatccaaaattcacatggccggaacagatgaacaattggaaataatggacaaattagcacaaaatgtaaaaaataattaaaatgattttctcctgactcacttaattaaagtgccgaactttgaacgttcaaacaaagcaaaaaattaaaattttcatcaaaccattaaaatatggctttgttatttttaggcaattaccgtattcttctcagtttttttcggataaaattgcgaaggggttccggccatgtaattttggcttgttttttcacagattttcatcaaaaattgccaatttttttaaacttacctaaattcttttgataagacaatcggtcaataaattttgaagacatttttacctaaaaagccgcggataatatacggtcttttaaattcaagggtcacgaatcgtggatcgcgcgaaaaaaacgataaaaaaggtcgcgtcccatctctgtttcgactaggactctgtaa

SEQ ID NO: 2018 - DNA, 6742 bp, Heterodera glycines
  misc_feature (5332)..(5332): n is a, c, g, or t
  misc_feature (6604)..(6604): n is a, c, g, or t
  misc_feature (6668)..(6668): n is a, c, g, or t
  misc_feature (6684)..(6684): n is a, c, g, or t
  misc_feature (6696)..(6696): n is a, c, g, or t
  misc_feature (6718)..(6718): n is a, c, g, or t
agaggcttcgtaaaatttgacaaaaaattattcgtaggaatttttctcaaattttatttccaaaacttaatatatttggtctaaaatgatttttaacaaacatattcagccattttagatagcaattattatattgcttcttcaccttgacagttgtcatggaaaattatgaaatttaacattgatttggatttaaagttaaatttttttgttatgtattcggaaaacataaaaatattgtcattttaaattacaaatttttcttttaccgtaatttcctcctcttcaatttgactgattttgtttatcttatctatacgatttaatgtgcttgaatctgatcgcacacttaatgaacgatacagaggattcaggcctgctggattcgttgaactcgaagcgccaaaagattgccgtccctgctcgaagtgtaatcccgaattgttttttaaatcctgtctcttcattaagcaaattaagtttattacagaaattattttgtaataaataaacaatgattaaaattcaagacaggatatgacccattccatttttaaaggttttcagcagaataattcatatttgctttgttttcaaaaatatttaaggtacccaaatttatttcaaatttgtttttaaaattttctaaatggtaaatgatatttaggcaatttttagcctatatttcgtttattttgccatttttaggatattggtccaaattttgtggggttttaataaattttgggttttaaatccatattcttaaattcgttatcatatatcaccttatgttcaaaatggaaagggatactgtttgggttactgtctctcctttgggttagcaaccgttgcaatactggctcatttagagagttgctttgttcatcatcaatccctggttcggttccagctttactactgctggctttgtactgtacttgtacagattttggacgaccaaagaaggtactgtcaaggttaatgccactttttggagtcattggagaatgaagatccaatgaacgacgagcctatttattaaattaaaaaatcccgtttattgttgtttttaaattaaatatggtttataaattattaaattcaaaaattcgaacatctttgcaaaaagtcttctctcctcttattgtacaccttttgattttctaaatttttgttttcgctatttcatgcgttgaatacaaatcacgaaattataattcaaatcaaacgtaattttatgaaagtactatgaactaaggttaagccccgaaccggtgcgggcaattgcgaatgtagtctgttatgtcccaaattatatgagagggtttaaatgagtttctaagattttttgctttagaaagttttttctatttttagatgaaaatttacttcccggaggggttgttccgagtcattttttaaatttatccagccatccacgacaaatttgtcagattttccccaccctcctcccaacctcctatgaccgcttttgtctccctgagggccagggtttaccaaatgtgaacttaacgtgaaaactgcttgaataattttgatcattaaattaaataagctaattgtaaaaaattatttaattgttaatgataattagttgagaacctcaaccaagtgtttaatgtgttcacgcggcactgacttctcatgcctttggacaaattcgttaaaatgagtaccttttttattttttgacaattttaatgatgacattaagcgacgcaaacttccctttttctttggtttttctttaacttctcgaggagtactctaaatattacaattctatggcttttatgatatcttcaaattctgcagggaagcagtttttgcccttatataaggaatttgctcctattttttagggttgatcttattttaagaaatttaactctaaattaagcaatttctgtcaaaattttttatttatctattgcattagacaatcttaaattgattggcattggctgttatcctacatccaataaaatggaatgtgaaatataaaaaggttgtttaaaaaatcataagatcgcattcctgggtcatagatttcaaaatgatttgtaaaaatccgaaaatcccaaaggggttcaaaagaatttaaatgctaaacattgttaaattttacaaaaggatttaaaaattttttttagagttttgcgcctgataatttataaatatttattaaaataattacaattttttagaattcctttgaataaatttaaaaatttccattaattgtttagttgttggtttcattaatcatatatatttcaatttcaatttccaaaatttccatgtttttaccaaaaaatttacctcgttcgaccaataaaatggagttgtgccagtgctgtcgacaccatcaaataaatcggtctctgaagaatttttaaacgcactggagatggaatccttcaactccgtccaacttgtcaactggtccaaaatttcttttacctacaaattttcggtacattttaccaaaaatttaatttcctttttcaatatattttaattttacgcgggactacaatttcgatatttttaaaaactcattatttgatgtcacagcgtatgatataacccaagtagaggaatatttggtctagattttttctacatttgtttttttaagaaacgacaaaagataatgacgaaggtataacattatataaattaataaaagcattcaaaattttttttaactttcttattctatcaaatgtctcagcacagaataaaaaattttgcgattgatcaattgttgcaatttgggcaaatgtgtaccttttgtcttaattcatggtcattgtacagtttgctagttttagggtcgcagattggcataattttttcgcatgggctctccatggccccattgtccaacgtcttataaatgtgttctttcattactttggggttttcagctttcttttcgtgctcaaaaagcttgacgaaccaatttggacgtcgaatgtttttcaaaatctgtgccaaatttttgttcagctcttgcaagagtttgttgaacaattccaactgtttgttattcaatctattgactgacgacgatgatggagacggagtcgtgttgttaaacttaaattttaaggaataaaatttcgtcacatggcaaacatacacataaacttatgaaaattgagggcaaaatttctccaaaatttcttcaaattcgttaaaattaagctaaaagtctctaaaattgctaaattttgaatgataagtcatttaagaagaaaaaaaaaacaaaataaagttgaaatttattaattttaatgaaaatagagaaaaaaatcaaaataatttccaattttatatttattttggaaaaaataccgaaaaaataatttcttgtgaattttttcgtccttcaaagtcattctttaaattatttttctttcttttttaaaacagcataaaaacccacaaattaacctaagacttcgacattttattttcatttgaaaaataattagtctaataatatcaaaaaaccttctactaaaaaatctcactttcttttgaatttttgattaaaaatcttaaaaaactaaaaaaaattttttccatttcccggcggggttcccgttaaaatttacgggatttttaagggattattttaatttcttttaagaaacgcacatgcgtttttgtgatgccatacatttcttggcgactttccttggtcaattccgcgctgaagcggtgagttttcctcggcattgttctgcttcttaaccttggcgggtcatcaacgacaggttgagcttttgaaaaatcaatttttgtcaggtccattccattggcggcaaatgtaacaaaacaaaaaatgatgagtggaaaaaggaagttcatggtaaaattttattggcacaaacttaaaaaatcaaaaattaaaagctatagacaaagtaatatatttgaatatacaaataaatgaatataataaaataatgcatattctcatgtgttcttataaaaatatattaatcttacacatttaaaatcaatatgctaatccatatatctattggtattgcatattttcattgagtcgaataattattaaaaaggattgtttttgtgttttgtagtaagtaagaattaattttttaattttacaaaataaaatgaatgaaaaattttcggcacattgagttgctttaaaattgagacatttttgaaaatgagcaaaatctcaaaacttttttcaatattaaaatgataaaatgaaaataaaaaaacaaaataactgtttttttaattctgttggttttgcagactgaaataaatcttttaatgggatttctattgtttttctaaattttttttttgaagattcttggccccacgagtttaaatcccctcaaacaaaaataaatccaaacttttgagttttgtattaaaattttgcattctttttaaatacctaatcaaaatatgcaattatggccaacaaaataattgagtaatattactgtcacagaaattggacgaacgccgctccgtttccacgccccccgccccgcccgctccctctcgctcaatcaaaattcacacttactataataaatacataattggcgaaccgcactgtaaaaatttaaaaaaaaatttttataattgggctggcatttttatcaattccataacttttttgattttttcccatttttaaaactctcctaaaatataaatttaatttttatttaacatttttactatatttgctattttcattttttcttctctttaagcgcgcaaaatttggttatttttacaatttctgctgcatgtgacactcatttttgaacataatcacaaaattttatgctttttgctatatagatttaacttttttgttgctcattttaaagcattattgcgttactttttcagttttttttgttttataattttatagaaaaaatttattgtttttaaattttatattcaagtttggaaaacttaatttaattttgtataaatccttttttttgacttgaagacattaaagattttatttattttttttgggtaaaattattttacataaacttcactgtttcgattatttaatttctttttaattgatgttccttcttatcattataaatttgggtttttatcaaaattacattcccttcctatatattcaatttatcaaaggcaagtaagtcgaacaattcagtccacatgttgaagattcatttttattgagttaataatgttcgccaatgcccgatccaattaattagttttcaattataattaattcctntaattttacgaatttagcaaaataaaaccttaattggatgatgaataatgttttaatttgcgaatgaattcaaaagaaattcgtcaattccttttaacacaaaaaaaagaaactattttcacatcattgttaaaaaatgaaaaaatgttgctttacaaatcacttaaaatttcatttcaaacctgaaatgttttaaaattaaattcttcatttttttctaaaacctaattcgctcattataaaaccaaaatttttaatgtatgtttcaatttttgaaaaacccctgccaattttaaatttttaaattcaaataaattttaaaattgtgccgagtcgtttcaaaaaacaccagatattttttataataacatttttgtaattagaccatcgataaattttccatataagcaagtgacgtattttttgctgaaaaaacgccaaaatgacgccaattaaagaagaattaaaattaacattgccgacaatgactagggatgcaatttttaggctctaaaaactgcaaaaataggtaggctttaggctctaaaaaaccccaaaaataggcactaaaaaatgaaaaataggcactaaaaatcctcaaatttaggggtaaaatgacaaaatgtattaaaaaaaataaaaaaattaggccaaatcagtattgagataaataatttttaaatcacaaattcttgtcaataaaataaataaataaattttggagatgaatttttgaaaaaaattttcatttcttagggatgtatttttgaaaattttcgggtcggttgttaggggatattttttgaaaaaaattttacgttgattcttaggggtgtatttttcgtttttattgcatttttgttaataattttgggcaaaacgccaaaataggcaaaaataggctctttcaaaaatttttaggctttttaggcgctaaaaataaaagcctagaaaataggcactaataactcgaaaagtagcttaacaacagccgaaaaaaaacatgtttttcgtgcgtttcaagccacggggagctcaggaaaaaaataggcttttgcctaaaaattgcatccctaacaatgactttcaactttttttttcctaatgtttttctgacgtcaaatcactcttcatttaatcaatatcacggctcccaactgtgatgatttttcatcattttgtggctttaaggtgcgaaatgagttttgaaaattaggatgaaaaatttttttgaggtttctcgctagaaatttttttaaaatgctgatttanaaaaatactaaatgccaaaaaggacagtgaaaaaatattgataattatttttggaatttgaggnctttaaaatcagttgngaaccctgaccnaatacattttccacagaaagtnataatgccaacaggtccctttttt

SEQ ID NO: 2019 - DNA, 7593 bp, Heterodera glycines
ctaattcgctcattataaaaccaaaatttttaatgtatgtttcaatttttgaaaaacccctgccaattttaaatttttaaattcaaataaattttaaaattgtgccgagtcgtttcgtaaaaacaccagatattttttataataacatttttgtaattagtgtccggaatgggactgggtcccggccggtattttccggcttctgatccggaattcggctgggcctaaattaaattttcaaggtgcccgattttccagattactcgaaaagaccatcgataaattttccatataagcaagtgacgtattttttgctgaaaaaacgccaaaatgacgccaattaaagaagaattaaaattaacattgccgacaatgactttcaactttttttttcctaatgtttttctgacgtcaaatcactcttcatttaatcaatatcacggctcccaactgtgatgatttttcatcattttgtggctttaaggtgcgaaatgagttttgaaaattaggatgaaaaatttttttgaggtttctcgctagaaatttttttaaaatgctgatttaaaaaaatactaaatgccaaaaaggacagtgaaagaatattgataattatttttggaatttgaggcttttaaaatcagttgggaaccctgaccaatacaattttccacagaaagtataaatgccaacaggtcccttttttgtttcgtattttaagaattggtcatcagaagattaaagaaaaatttaaatgttagaatttaagggaaatttattgaaatagaataatttctttttaaattgaatttatatttaaattttaggaagcgtatttattaagaaatgcaagcagattcagcaataataaattctgaattatgcgacgaagaatatgccaaaataaatctgctgctgtcaagcaaaacccccgaccaaattttgtcaatttttggtaaattaaaataaattaaaaaattcataaaatattatctataaattagaattcctcctaaatctttaaaggtgtaagaaacccatttattctttacatttggctttcaatggcaatggtttgggccctcgctgcaatgccaatgatgagcggagcctttttgattgacgatggatgcccagcagcagtgatgtcatcaaatcggacaagaattaacgcaaaatgcacaccaaaaaatgggtcaatccgagcggaggtcaaattttaggacataaatttgatttctaatgcataaataatattattttgcgctaaaactattgaaaacattacaaattaataatttaaaaattactttttaagttgggtttaaatgagaatcaaggctatttggtggatttatcaacctcagcgtttatgggagggatggccgttggcagcgcagtaacacctatttttacagatttgttcgttttattaaaaagataaatttaattttataatttcgtaaaattcaggttgggccgtcgctccgtattggtggcaattttactgatcgccggtggcagtggttgtctgtcggcactttccaccagcatcaatctgcttattgcgttacgatttgtccaggggttatcattttcggtttgttttttaattgattcgtaggcattctgaacaggcggccattttacgatttttatttatttttttaattctttaagcaaatccgttaaaaatttcgatcatggtggagactcccaatttaatttaaattttaaaccaaaattatcatcataatgagaataaatgttaaaaaactttaaatttttaggatttcccttcggtggcgcctgtcggcaccggcggaccaataatttcttttagaattttataaaaaatggttcagtgtcgcaaattttggtcctaacattagacaaaaaaaaaatttagcttaaaaatactcattaaaaaaatgaaaaggcatgcaaaaaattaattctgatgaaaaaaatatataaacattcgaataattaaatatgcctaatcgcatttgagggagtttcattgaccaattgggtgcttgcctacgagtgcattccgatggaacttcgcgcactgtctccgctggtgtttggccttgcctgggtatttggatattgcttaattgctccgatggcatattttacatcaaattggcgccttctcattgtgttggtttcggcaccatcgcttctttttgtcgtgattttctatttgtaagtaataaataaattatttgaaaatataattgagctcattctatctttagtcttattttttaattagatgaccgtccgctgaaaaacttgtaaattttccaaaatatttctaataaattggcgcaattttttagagcttatatattttttcgtgataaatctttttcctaaagtctacaaaatcctaaccccaaaagcagatgaaaaaaaacttgaaaatagaaaaaactcattaaaaaggagtataaaaatggcaaataaatattatagtatcttttaagcacaattcctgaaagcttccattatttggcaataaaaggacggattgatttgatcattcaatgggtccaaacggcgaacagttttgcctatattgcacagacagacaaagttgagcagaacgatgttgatcagctgattgagcatttggagcagcaaaaactgctgatggacaacactgatcaacccgtgatggtcaccaaatcaatcaatgaaaatggagtaaaaatggtgataatgtgagttaaattaagtcggcatctcacgacaagtcagaccattaatttatagttttctgtaataatgaaaaatcttgggctgcaattggttgacataggcaaaaacgcaatttttcttcggagagccctaaattgataacagacctatctccacttttttggcctatttttcattttagttattgtcaaataaataaataagcaaatttagacatttaataattaaattaagtttatttgtttaggtcatcaccatttattgagaagatcaaaacaaatgaaaagctgatcaaacacatttccattttcatcttattatggtacggagcaacatttttgttcattattttaatattattattattcaattaaatttattgtttaaagtaattaattaaaaattttatttatcaaaaaaattcctttaagggtatgcgacgcattcatttattacggggtcagcttattcagtacaaaacttgccggcaatcgctacatcaatttcacactcattgctttggttgaagtgccttcgtacgttttttcaccatggctaattgacaggtatcatgtttttaaataatcagaaccggcctttttaaattctcgatttccaagactctcatttttcgtgattttttaaaaaatgccttgacctattatgaatatgacccaaaaattacttgcaactttttggaaaacttgaaatttggattttattattggcacagcgaccggtaattcaattttgctggtctttctgcggggctggtaaaattatcatgaatttttgtttaaattatttaagaaaattttttggcataatgcattttccactacgggattgggattcaaattattgcgggagggttctcgattcaaatcccgcattttccaaaaatgcggggttgctgactgggatcccgcaaaatcacgcgcgggatccctcctgtgcagtttctatcagggatggaacggaattccgatttccgacatttttggggtcggaattccgatttcagacttccgaaaaatttttgggcctagggacttccgaaaaatttttgacccccggaattccgatttcctaaaatttttttggtcctcggaatggcatccctggtttctatgatttcatgttcattccggctataaatacttcattcaaacggcgtgttatagctaatttttactctttctgttcgtatttttgtttttttagaaaaatttttctattcccctaggaatttttcccgaatttacctaaaaagtccggcctctataaaacggtatgctgctaatgccaaattctttccatagaatgggccgtcgcctgttcactgcgtttacccacctgttggccgcgttggcattcttttctggcacgtccattctttggctgccgaatgtgccaccatttgtccaactgtgcctttggctgatcgccaaatttgccattgcttcctcgttcactggcctttttgtgtacgccagcgaagtgttcccgacatcgaagcgtggaatttgtatgggcatttgcacgaccgtctcgcaattgtgttgcatcattttgccgccaatgatccgagtgatggtgaatttatgcattttataattaaataaaaattaatttaataattgaatttaattaaatattatcttgttcaaattatattattttacggaaattttaattaataaattattttacgcatataataaaagtatagttaaacaagatttcaaattttattggcacttttatagcaaagggtacccactagaaaaacaaaaaaaaagtgtgaaacgctttacttttacttatttatttttggtttcttggtttagattagaacttcacgaaaattcattctttttttagcccctctaaactctgcaatttagcgtctctattacaactttcgccatttttccatcattttgacctttttttttgatttcgtccctactcatttgtaatttaatataagtaaatttccaacatatcgtttattgcttatctagtgcatttttaattaatgtttgtaattttgcactttatagctgtccttttcgcctatgatgccaatgtttttctttggcggttacgcattcatcgcaacatttttaacatttttgttgccagaaacgcggggaagagaattgccggattgaattgcacacgcaactcgtgtacaaattggccttaatttaattaattcatgcttttgtatattctcgttttaatatatttgagtatttttggctttttttataaatttattatttaaaggacaactagcagatgatttctttgaaaggacatgtagtaaaatcatgtacacaagggtgctatgccaaaatgataaaagtatgggtgtggagacatggccgagtatgcaattatttcagtcctaaaaaataaaaatcttgcgaaaatgattgttaaaattaataatataattttttttatagattcttaacatttctagttctttatacttcaattaatctttatttttaaaaaaatgattatttcataattttataaaagaatacaaattattaatcaacatttttagcgacttaaattaattttcagatgtttttaaataaatctgggtgattaaaaaaattgcttatgaattagttactgactgattgtccactgacggattgtccacttaccgacggattgtccactgacggattgaccactgacggattgccactgacggattgtccgggagcctaaataaggttttaataaaattattattttaattgataatttatttttccaccagtctataattaactattttaaatatatttattttttaatatttatccgaaacaattattagaattgtaataaattacaaaccacaattttatccatttaaccctgaccaattggtgcatcgacagttgctgatcaagttgcgcgagctggtcgccgttgttgtacacccatggcgaggctggctgttctttgccgaatcagaacggcttgtaattggcgctgcaatttggatgccaccggctgcacagtgatccgcgaccaaacactgggccgaccgtccgggttggtcatcgactttgcggacagtcgcctgtgcatgggtgactcgttgctgaagctgttcgcctgcatggactttgacggattgaattggcaacaaatccctgtggacgatccaatccctgtcgcaattacactgctgcaacgggtaaaaaaaattaatttaattgcaatttaaatggttaaatgttacttaattattatattaatgtatgactacttaattaatgtgtgtttaaccattattaagtgattggttaatgtttaattaccattgacaagtggctaattaacagttaattaccataacaatatttccctactaccactctgttaagtaccctaattaacaataactactatgcttaattacctttgattagtactaaattggtgataaatttcagctttaatgactgtggtgaacacgacttctccgatgaacatctatgtaagttccaaaatttaatcgacttttcaagaaaaaaggaatttcatttgtatatttaaaaaaattaatttaaattattttttccttaatttagcaatgtgttcatccttttctgagtatggagattgctctacggacgaattcaaatgctccaatggcaaatgcatcaatgccacacttgcttgtgatcggaaagatggtgagatgagcagtgatcagaatttttgatttttgaaatttcggagaaaattttgtccatcaaaaccaattctttctaaattcactcatactctcccctcttccgtgccaaaaagctttttttttttaaatttccgtttaaaagcaattttgtttttttgatttcctcattcaaactcgtgagtcaaattttctgatcacagattgcggcgatgccaccgatgagattggctgcgcgaaaaacaacggcaaaagttgccattccaagggggacaacggtgggtgcaagcactcgtgcactgatgtgcaggacggttactattgccattgtcgggacgggttcagaccagacccggccaacccgttcgactgtgtggtaaaaaaaattggaaaatttgattactgctcaagaccgaaatttcccgtgattcgagatcaagaaaaaaagagacttttctcggctcagggctcgagaaatcaaaaaaaaaacacaaaatcaattcaaaaaataattatttttttattaaatttccaaaactggtctctgtttattgaaatatatgttcatttttgaatacatacgtcgtaccaaaataaaaaaaaaatttttgcgaaaaacggacaattattgagctaatagccgatgcctaaggacgtcctttgtgaacccaaggacgaatggaaatttggataaaaattcacaaaatatttttttcaaggaaaatgcctgtactttaattctgcgttggatttttgctccccataattgtttgagtacacttgaaaaaatcgattttttttgttttcgggcagtccccccgaaccgatgcgcccagatttatggggagaccgaatccttcgggaatagcttccctatagcctgtactttaattctgcgttggatttttgctaacccataattgtttgagtaccccaaacggacaagttaagcctaaactttttggcctgttaaaaaaggaattaaaaatttttaaaaattttaatcatcttcctttttgatagaaaaagcatcagagagccttattaacatgtaaataaaatttatcagattcagatcgccatggaggagtaatctgatcatgttggccaaaagatttatttgttca

SEQ ID NO: 2020 - DNA, 1807 bp, Heterodera glycines
ggaatgttaaagcgttcagaaggtttgaatatttcattgggattcagatctgttcggccataaattattttatgagccatgaacagatcagacagctttcgcctgctttcaagtgtcggcagttgaaggtattctaatctttgttggtatggaatgggtggaaggctgcatttgaaaagaactcttttggtgaaatatttttgacatttttcaatttttttaatattttttagaagagatggattccaaacctcaggagcatattccaataacggtctaacataagttttgtacaaaataatccaaatcctagaagattttgatttaataacccgaaataaagaacgcatacgtaaatatgcattctttattatttgtgcgacatgattggaaaattgcaatttattatcaatatttatgcctaaatccctaattgtatccacaacatttattatatttccatcaattttatatatttctttggggtttttgttccctaaatgaagtacaaaagtttttttaattgagattctgatttgccatttatttgcccattctgataaattatgcaatgctttatgcataatttctgtgtcagctctcgctttataacaaatatacaatttaacatcatcagcatataatttaattctcactcctgatggcaaagcatcaggaagatcgttaatatagatcaaaaataataaagggcccaggacagagccctgggggacgccagagcaaacttttttattcgagaatgagatcctaaacaagtcagtaataacagttgacagagaagaatggcaaatttttaaaattttatagctaatattatctggagaagtgccatttttgttcggaagttttttcataagattttgggtctcgatgatgttaaaatttatatccgatataaagcattgatcattttctataatattacccaagtatgtattgcttgggtctgtttccttattattaaatgaattggcaaataagttggcaaatatttcacatttctcagcactgttatgatagcatttatcttcataaatcagattaggtatttcaaagggattgacattaaagttttgtatatatttataaatagaatttcttccctttgaaatagcctttttctcaatttggttatggtatttatttgtttgtatttttatatgtaaagaaatgctatcgtatagtgcttttttagatgggtcagttttagcttgcctgaataatttagccttttctttaatggatgctaataaatgtttgggtatttaggagtcaaatctttctttgttaaacgctttattggaatacactcatttaaaatttctaacaacatactgttaaaggcggaatatttttgatttatgctaaaccattcatatgacaaggcatttagccttgatgctatgactatattaaaatgtaacacattcgatggacaaaaccaacgaaagtttacgatctttgttttcggttttgttttaggagtaattaatgtgaaaaattgtgttaaatgatccgatgaaaatatgcctcctttaacagtacaatcagtaataattttttcattggccgaaaaaatcaaatctagccaggagttaatccttgttggctcattcgtggccaaaaataagaaaatctattgaaaagtcacaaaatatttcaccatatttactcattgaatagggatgcccatttttccctaccaaatccttattcggtaaattaaaatctcctaaaagcactgaatttttcttttaaaatttttgcaaaattttgaacaattttt

SEQ ID NO: 2021 - DNA, 1179 bp, Heterodera glycines
tttttcggtttctaaaataagtgctatttcatcgattttattcattattgacctaatgtttattaggcagcatttaacattccctttattttttgtaaaaaagtttggatgggtaattttttggtataaattttttaccgaccggaaaaatttttgtacttttctataataattatgggtaatttgtagtgatttggttggataatttaaaaaatttttcgaatatggtcaatgtcctgcctcagcacaacctgattggcataaatcacccaatcaccgctgtccgtctgccttttcttcgcacaatcctcaatcaattttcgccgctccgacagttgttccttggtcatgctctcgcggacattatggagaccattcaatgcctgcacctttccgcgcatgcggatgacgtgtcgcgctgcatgtttggtcgggaattccattttgagcgggcgcggtcgtccatccattcgtttgccgacgcggaagacaattggtgcctggtcgacgtccgtggcattcaaaatttcgtccacaacggcacggtcctcccgggctctctccgccgctttgtccgatttgctttcgggcacatttgtcacaacgacagttctcagtcgtcgttcctcctcgaccgcgtcgacagccgcagcctgtgaatgaattaggacggaggcggtgcttaaaagggaatgaagctgcttaataagcaacttggcgtagtcgggaatggagttgtctgagtcgatttctttggggatttgtagttggtcaaggtcggacagaaattttttggggcagtgttgtcagaaggaggagaaaaattcgccattctctttgccatcgactaaacatatagggctttagaatgatgccaaatttataaaatttggcccgctgagaaaaaagttatgatactttaaacttggctcagactataacggccagactatagtgtcccccaccccgaaccaacagttcgcatggtccatcattttttcagggcgacactaataaaaagggtacttttccgttttggggccaaagtttcagtttttttaaaatcaacagctggcgagctgatttgtaatattcttcattcccatagcatagtgaaaatccgtagcgcagacccattcgaagagatcttagctcaaattgtggcatttatgcctccga

SEQ ID NO: 2022 - DNA, 2602 bp, Heterodera glycines
tgctttttccgtcaaactcggcgcttgcccccacgcccaacggcactgtcagtgccagtctgatggcggcgttcacgaacggaggcgccagcggcggaattacgcaatatttcatacgacaggtttttatgaagatttccttcataagaaattttaatggcatttttattacgggtgggtaggattatcatttgttctttaaattatacctcatgtcatttccctttgaaattcatattccttctcttcatatctgttctctttgtcggaccatcatcagttcattcccttgattgtgtcgcaggagcagattgtgtcatcaactatgcagcagatagtcgaattgtgcatatgcttccgagctaattccgttgcatgtatagaatcgatcatgatgggcttctacttctagcgcaatcaatttcacattattttggagtttcttcgagtcatttcccacaattaccaaatgaacccttgaaaattgttgtttttgttaccatttaattgtttttttgttatttaataaagggttttttattttattttttggttttaccaagtatttgaatttaaaaaattttcgcttggtgcccaaacgagcgcgcccaacaggggtgcgattttgccctggaaacccggcatttgccgggttttgggggtccttgccgggtttttgaagttgccgggtttttgggtttttccgggtttcctattttcaattcatttatttgaattttattaaacattttgccaaaattaagagccaaatatagttttcgttaattgttcagatttattttattaatttttgatcctcattttctagtctgcagaatgtcccaaaaaactatttctgatttcatttccaaagttacatttcaacaaccggttcaacaggaaaaacgtggatgaaaaatgggcggctattttcaaaaaccccaattttgtcctgctaaaatcactagtctctgcaattctgtcaattttcccttctaatgcgttttctgaatcagtcttttctgttctgaagaacatcaaaacggacgagaggaatagtattggctagagtgccacgggaccgggaatttttgccaaaaccgggaccgggacttgccgggacctgagaagccgggaccgggacctcgatttttttcgggaccgggaccgggaccgcaagaaaaaccgggaaccgggaccaaccgggaaattttaaaaattcaaaaaaattttaaaaattaaaaaaaaaaattcaaattttaatttatatcaagtgaaaataatacaaaataatttggttttttatttaataaattattaatgaaaattttcaaacaaattttcttcaattatttcaaacaattaatcatttttggactaaataatcgaatattaatagaaattcagatttgattttcacatcactttttttcggagcgctttttcaaaaaacttttgggaaagaaggggtccggcggtgccgataggcgccgccgggggaaattttaaaaatttgggtgcaatttgttaacagattttcaacaaaaaaaggttggtttttgcgattattaagctcaattggtaggattttcatttaaaaaatgataaaatatgtatcaatttaaaaaaaactatttcatattttctttataggaaacccacgagtatacaaaaaaaaaaaattgaaaataatctaatttctgtagagggattgaaccagaggaaagaagaagggaaagtcaaggagactagccattaggccatttgcacacttgggcagtgttacttttaaagaatatattaattattattttttatttttccctttgactccaattttcttcactaatttttcactcagacccccattcttaccagtgcttgtttttcccggttcccggttgccctaccgagaccgggaccgggacctgagcttttcaaaacccgggaccgggaaccgggaccgggacctcggatgaccggcaatttccggtcccgttcccgtggcactctaatttaaagttttcatttgacgaatggcactgacggagtaaagcttatacaggttcgtgccacaaatgaaacgtgatgaagcaataaaaaagccctatggcattgaattttggattgcacatgacgagggaatttgcgacgaaaggtgagagaaaatatttgaactgatattgaattaatatgctatataatactatacattgttgattttataccgtattgcgacatttgctgattatgtttggaaattcaactgaaaatgaaatgttctgaatgagtgcacttgaaagaaccaatcgtgcaagtcaggatgcgagatatagtatatacatagaaaataccaacatgtataggacatggtttgaggagtgattcaataatttttttatggtgtaaaaaattgttcggcgaagtcttgtcttgattcattctccattgttgaaaaaccgcaacaatagattacaattaaaattattgttgtttctatctgaaattaggaagtgcgcaattaatgcgggacacttttccattcattttttcttgaaattgtctgcaaatgtcccaatgcaattttttagataactgatct

SEQ ID NO: 2023 - DNA, 1538 bp, Heterodera glycines
gaatggggatggcacatgtcagcctttaggtgggtgccgattgccgcccttttcaagcaaatgggagggacttagtgcgggcacattaactctctctcactcccatataaaaaaagatattttcatttaaaaaccatcagttcccctttaatacaataaattttatcattttctcctacataaaaatattgttctatttacatacatacatacaagatttattagctatgtattcattaaaaaaaagaaaattgccgcccgaacttctctcggagttggccagcgccttaccctttgactttcgctgggccacaacccgagtttcttcttcttttgattattttgtcaaaaagagacagaaaaaatggatttggaccgaattcattcgtgtaaataaacatttgatgggtttttttagggctcagattggtgaaaagtggaagtaatataatgatcagcggccgctatgaaattttcggggatttaaagttattttaaccatttccgacttccttatcattaaatttgaacaaaaaaaacgaggaattttagttttgacttttttcaagttcgggttagggatagaaattggtcaaaataaatgtcattcgtgttaatctaaaatatattttattaacagatgaaccaacgtaatgtatactacatgtggacggtgagttgtattttgatttttaattatataaatgaatttatgaattggaaattgtaaatgatagattcccctttttttagattggcaacttttcccttcgtcccgagcaaatgggcgaatttatgaagagttcgacgttcaggtttttctttttaatgttttttgaattatgaaattggtccatttttggtacttccttgttttgctaccccctccccctcgaaaatttttaaaatttcaaaaaatcatagatattttattaaatcgatgactagcattgcccgtgggacttgaattttggatttttgtcacatttccgccttcttacgccgtaaaatttgtccattggttcagtgccggcccgaacgacaagctgaagtggtgcctgcacatcaacccgaaaggcctcgacgaagaatccaaggactacttgtccctgcatttgctgctcgtccaatgcgacgacgaggaagtgcacgccaaattcaagttcgccatacagaatgccattggcgaggagacaaaagcgctgggtgagtgaattaagtggagggaattgggacgaaatgaatggtgggagatggaaacatccatcgccacggtgtcctgcctccaacgactgacacagcacaccgtgacttcccaactctttcagtagccgatagttgagataaccatttctcctgcagattcgcagcgcgcctgccgatttgtgcagggcacagactggtgctttaagaagttcatccgccgcgactttttgctggacgaacagaacggactgctgcccaacgacgggctgaccatctcttgcgaagtgtccatcctttatgatagtgtaagcaattcatttatgtcttctttt

SEQ ID NO: 2024 - DNA, 1001 bp, Heterodera glycines
  misc_feature (948)..(948): n is a, c, g, or t
tttgatttttaattatataaatgaatttatgaattggaaattgtaaatgatagattcccctttttttagattgccaacttttccctttgtcccgagcaaatgggcgaatttatgaagagttcgacgttcaggtttttctttttaatgttttttgaattatgaaattggtccatttttggtacttccttgttttgctaccccctccccctcgaaaatttttaaaatttcaaaaaatcagatattttattaaatcgatgactagatgtcatatatatataaacaaacacattttcatagtcagagtgacgtgaccttgaaaactccaagatatgattttttttaatttttcgaggggggggggggtagcaaaacacggaagtaccccatttttttggttgagtcgattcactcattgcccgtgggacttgaattttggatttttgtcacatttccgccttcttacgccgtaaaatttgtccattggttcagtgccggcccgaacgacaagctgaagtggtgcctgcacatcaatccgaaaggcctcgacgaagaatccaaggactacttgtccctgcatttgctgctcgtccaatgcgacgacgaggaagtgcacgccaaattcaagttcgccatacagaatgccattggcgaggagacaaaagcgctgggtgagtgaattaagtggagggaattgggacgaaatgaatggtgggagatggaaacatccatcgccacggtgtcctgcctccaacgactgacacagcacaccgtgacttcccaactctttcagtagccgatagttgagataaccatttctcctgcagattcgcagcgcgcctgccgatttgtgcagggcacagactggtgctttaagaagttcatccgccgcgactttttgctggacgaacagatcggactgctgcccaacgaccggctgaccatctcttngcgaagtgatcatcctttctgatagtgtaagcaattcatttatgtcttctttt

SEQ ID NO: 2025 - DNA, 4502 bp, Heterodera glycines
atcagcagcaacaaattggcgccgccgatgcctttcatcaatcgatgggacagccgccgccggcgatgtcttccgcgccgtccatggccatggcggcgtccggcacgaccgccgcagccgtaatggcaggcgcaacgtcacatgccggcaccgtcgtcgacgcgaaggatgttgcgggtgtaattagcagcagcaacttccaaccagcgcaccagcagcaacagtacccatgtaacttttggcgtacttttctaggacatgttcatacatgaaaaagatgcgggggtaggagaggggtcaacagccaattttagaaagtgggtacaaacgccgattttataatctttttttggggaagtaggtgtcgataggcgccgccggagaaactatagtattttttgagaaaattcgcgcccccccccccttccttcgctgcaaacctccccccccccctcccccgctagccccttttgcgagcgggggggggggggggggtcatggacaaatattgtgaagggagcggagcgatttcccactttgcccgttaacttttaaaactttcatttttagacagcacagggccgtccattggtcagccgatcacaatggcgacaagcagtgcgagtgcagccgcttacccggtcgccacgcctcaactgatgatgggcacggcgggtgtcggcggtggtggcaaaatgccgaacgccgtcctcaccgcgcaacaaatgcagcagcaagagcaaatgccggtgaggaaggagtcaacacgattcacttttgccactggttcatcgagtttttaagaaactgatttttatgtgtgaaattttggggcactgatgacaaagttgggccttgaaatttaacaaaaatcggttaggttatttgaaattggccaaattttgtcaaacttatgcaaagtccccgtggaaaacttattttcgacaatcattttcaaaaatttacaagccaaaagggttagcaaaacgtccttagagtaagagttttttcttactagtagttagaaaaatgttacatccaaacaaaaaattatattttttcaagaaaaaatttcaaaatttttttaaaaaccgcccagcagtacaccggcgccgccgcggggttcgactacccggcaacgttggcacccttaattgtgcaactgctgaaggaacttggggaggaggaacgaccctactacgagaaggtgtgccaactgcagcaattcatcggcttcatagacaattcgcggaacaaatacgcggccgacgagacgatggttggtcatttttgaacagaatttaaaatgggagatttgccagaaatgatcctccccccccccccaaatgatgggacagataaatccagaaatatatcaaaaaagggacggcacaaaatctcgctgaacgaaatttaaaaaagttgcaaaatacttaatttagcatccttttgcactgcattttttcagctctacactatcaccataatgctttcggtgttgcgcttcgaatggtaaaataaaaaatgctgaaattttgttttgtccaatccgtagtcttctttttaataattccaattctgccaacacaatttatgtatatgatattttttccacagtattgtgggactcaaggtactgttcgaaattgaagttgtgctccaatcgatgatgtcctcacatcaccaccaacaacaaatgccattctccgccgcgtcgatgatgttcaccacgtcacccgccgtacaccccccgcaaccgtcgtccatggcacaaccgcagcaacagcaaatgatgattgcgcaaaatgtatggagggggagaaacagcggataaaggcgcgggggggggggtcaaattcggcaggatttagacggacgaatcccaaacttgaaataggccaactcgtactgtgtttcgacaaataacgttgtaaatttaaccaaattaacatttttgatgtcataactgccctaaacttaatttattattgaaaaaagttatggacacaaaatttttttttactatttttggtcaactttttcgtgtaaacaataaaactttcttaagttttgcttgtagattaaaaagcttaagggtctattgaagggtaccaagaatgtttaattcggtcgattttgacagaagttatgacgatttttttgtttttttaaagcagtgcgagttggttttttgccaattcttacccttccaatcagatccagaaattgtcaaacaaaagataggatttctgcaataggtacggtatcaaaaaacgtatttgcacagatgccgccatatggtccggctcacaaccaacagcaacaaatgatgccaccgtcggcgctggtcggcgttccaccgggcgcagctgcaacgaacacttggatggattggaattcgtcagcggcgatgccaccacgcggcacttacccgatggcgccgacgaacgccatgaaggcgggcacacagacgggcacgtacattccgccgcagagtggcggaatgatgccaccgcctgctgggcaggtgccgtactacgccgttgggatgcccacgtcgaccactgctgtgcacggtcaaccgatggaaccggctgcataccatcagcaacaacagcagcaacattaccaagccgttcagcagcagtacacaaattaccaccagcagcagcagccgaacatgatatacaactcacagcaacagcaacaaatgctcttccatcagcagcaacaacaacagctcaatcaacaaatgatgatgcagcagaggcagcaacagcagcctaaaaaaacgctggggccgaatcgtgccggggacgaactgaggtagaccggttatttacatattatttcacgattgttcttacataaaaaaggaatccgtatttgagtatcatttaaaaaaaaacttgagccaaattatttcattaagtgattattaattaattacaaattaattaattacattggtgcagcatttaaactcgtagtgctcagcacagcaatcagttgacggttggccaagatttttaatgcaattgtaccatccgcagccgcaggtctccgctgcctttttgcactcgtcaatttgagcaatttgttttggcggtatctttttgaagaaagaaagtgtaaaacaatggcgcataccatagtagtggaaaaaatatggtacaaaaatttcaatcagtcatactgtagacgtaccggtggagccttaacagaaaacaaaaaaatttttatataaatatatatatatatatgatatcaagttccttgcgttttcgaggtcctgaccacgaattcggtatccatttcggccaattccgaccccggacccaaactcgaacaaaaagtcgaaagtccaaattttcgaatttagcatttttggttcaaaaatggcataaaagattccttattgaaggattgatggctttcagtttgtttccgggttttaaccttatttttaagaaaatactctaattcctaaaattttgacttttcgactgacgcattttctggtcacgccgtgggaacttgttggcacttttaaatttcccggtcgctaaaagcacgcggattgccttcacgcagcaagtgaagttgtaatgctccgcgcagcatgggctcgcccgttcgcccgctttcggaatgcattcggcccacccgcatgggcaagtctcccgcgcggctttgcactccaaatcgtgctcgatttgaggcttaatttttaaacgggggaccaattagcaaaacatcatttagagaattgtctaaaaagttgagtttttcattcgttcaattcggtgctttccgccgaccaaaacaaataataaatgtgtccataccggcggtggaggtttcaccttaaaaaggcaataaaattggcagccaatttaatttattagatgggccgcccccgaggggtcaaccgcttccttttactgggccatccgtttaagcaattctcttaactaattacatgagttccaaaaaattttcacggcggcgcctatcggcaccgccggaccccccaatttaccataaaatggactccacaagacctccgaattcgggatttcaaaaaaaaagggaaatacacccccctaaaaattgatttttgaattcagcccctcctccccgcctccgaagccatggatggatgtgtgtgcctatgccctttcaaatattttaagtgccagaaaatcttgcttccgtgcaacatgagaagttgaagtgttcggcgcagcatggagtggcgggagcgccctcctgtttgacgcatgcgaaccagccgcacttgcaaagctgattcgcagccgctttacatccgtcaatttgtttgacttgctccggggttggctaattaattacacagagaacaaagttttgaattgataggcatggaaaatgcacttacgggcggcggctaaattattgaataattggcatatttataaaatgcttgttcaatcgagaatgaacacattttttgtttgttt

SEQ ID NO: 2026 - DNA, 5174 bp, Heterodera glycines
ttcgctgattcttttggtaagagacgcagattcctcactatattctttgttctctctctgtcttaaatctcttcccttaacactctcttttttctttttttttcttcacaaaaaatgcttttgtatgactgggactgaatttaacactctctcacttttctgttatctctctccccattttatttttccgctaaaagtcatttgaaaaaaattgcttttaaaatttcaaaaattatcgtaattttaaaaatagcgttgatattatgttgatggcataatgtatgttgatattaaataaatatcaacgtcaatgatgatatttattaaaacaatgttcgctatgagaaaaatgttgatttgcctttctctatcgtcagctaattagcaaaacattataatggagaatgccaaagtactagaacaaaaaatcaattaaataaaacaaaattagccacctccgctgcccgacgatttgcttattttattgttcaatttatggctgggacgaatcggcacccgtagaagcgccttcataagaaaacaaacccagaaaacattttccttaacaaaatgccaaaacttttccggtgctgacccaaatgttgacaacggacggtgcaccgcgtgttccacgcgtgcaccgttgcgcggtacaattgaggaattggtgagggagttggaccgaatgaatgcgcggcttggctcattcttactgtgaaacatcgatggatcacttgatcactgggaaaaacgatcaaacaaatttattgttgggaatggatatttattacatttgccgatcaaattgcaattaaacgtgttattagtgattaaaaaaaattggcttataaataatgccgaatgtatgtagcaccattttggcaaaaaattactcattaatgtcatgaaatccgattgcatttttttccatcaaaaattatgaacaataattttatttatttttttcaatgccaagtgataattttctgctgctttcttgaaaatttgttaaatttttatgaaaggaatttttgtccgttaatttaatcggtgctgggacgttagtcaaaacccatcaaaatgtgcgttagtcaaaaaaccatcaaatgaataatttttgacagaaaattattcattatttcgtcttaaatggatcaaattttataatattgatatttttcgacagccctacgtgttttctattatcatgcaaaattaaaaaaaaattcttttagtttaaaaaagttatgacctgtgaagctcaaaaaaccaagtttttttgaacatttttagtcataactttcttgaaacttaacgaaactttgtggaattttgtaggctaatagaaaacacttagtgctatttaatgatatcaagaattaaaaatttagatgcttttgaacaaagttatatcgttatatcaaaaaatattttcatttgatggtttttgactaacgtcatagcaccatttaatcatctgtcattttttgaaaaaaataatcaattctatggaaaatgccgatggctgtatttatgtgcccaagggcagtttcaaaaatgccgttgtccaggaaagtgcgtctcatgtcttttgggctttttaggtggataaaaggataataatattcaacattttagtcagagctgagctgaagtgcgcaacagatgaacaacaaatgtacatatgtgtattgtatattgacgtgatcatgtattcgatcgtattgtattattgtatgtaataactgtccttgttctgatcatgactatgtgtatatattgtattgttcggttcgcgatcggataaatattcaaatggaaaattatttttgttaacccaaaaacagcttagttaatgagatggataccattcgctagattagtgctaatttagtgtgcccaagttttgcagatcccatacggattccgtgatttttgaaatttcggaaaagtagacggatttttcaatatgtctcccagggtgggatcgacccatttccatactgccgtttccataccgccatttccataccgccgtttccgtaccagccatttccataccggccgtttccatgccaccgtttccataccgccatttccatactaaggtatttaggccatttccataccaaaaatttttcgaaaattttcaggtaaaattcaataaatatgttgtgtccttacccaaaggaacgacaacaaatatagacaataaagtttattgaagaaacaaataaaaataataaattggtgacggagagaggcgaatatcgattggctttatgccacaataaaattggtgaatgaatgaaggaagtccaaatgtggggaagagagccagcaataaatagacagaaatggaggagggaagaagggacaaataaaggggcagagatcacaaatgtcaatggtcactatctctaacacctcccttcttaaattctgatcacttcctgatcagtggcggcggcgcttcttgatcgggctgggcgagtaaaattgccgcggcttgacgatccgttttgatctgcgcactgccaattggggaacatcatcggcgggctgctcgggttgttgctgttgctcatcattttgtccacgatcaatgtgaattggttgatttccgatccctttttggtcatcttcgaagatgagacgtcggcgcagctggtttgtgtgccggtggacagttcttcctcccaagatcggtacattgactcgaaaagttggggaattcttaaccctttccaaaattgtgccctgtagccagtgggatttgttgttccggtaattgaggagtaaaacggggtcacccggaccaaattccgtgtgttttgctccatgcttcttgtcaaattgatcagacatctttgaagcatattctctttttgcctgtttgatctgttcatgatcaatgtgttcaattggctctcccctcgggtgaacaagcgacattttggtacggagcttccgtccaaagaataattgatcaggcgagtagccgttggatgtcgcattgggagtcgtccgataagaaaggagcgctttctcggcccaatctttgtcatttatcgaacacttcttcattgcccgcttgaacgtgtcgacgaatctttctgcctgtccgttcgattgtggatggtatggcggggtgaaagtgtgtttgatgccgaattctgtgcaaaatttggcaaaatcggcggatctaaattatgttccattgtctgacacaatttcttccgggactcccagtctgtaaatgatcgatcggaggaaaccaaccgtggcctgagaatttatgctcttcatttggcagacttcgggccattttgagtaggagtccaccataataaaatacataaatccgtcgtcgcatggaccagcaaaatcaatgtgaactctttctaagactttgcttgttggcgtccattgaccgagtgtgttttttgtcggatttttctgtgcgttttggcattcttcacaggatttgacggttttctcaatttccgaatccaatcctggccaataaatgtgacggcgtccgagcgctttcattcgcacaattcctggatgtgacaaatgtaaagccttcaatgctcgatcccgtagaattcctgggatgatgacgcgctgttggtacagcaaacaaccttccacttccacgatttcgtctcgtttcggaatgaatggagcgatgttcgggttgctgcatttgtttggccaaccattctttgacagtctcgaaatttctgagagaatttcgtctttagctgttgcatccgcaatctcagccgctgtcaatggcaattgatcaatttggacttggaatacactattgatgaagcattccgtttctgtgcaaatgtttgcaatcaaaatgtcttcttctggccttgggtaatttgcaattagccgggaaaggacgtcggcttggccaaatgcttctgtgttgacatatttgatgtcgaactcgtaatttgacaaaattaaggcccatctttgcagtcggctcgcggcataaattggtatgcccttcttggaaccaaagatggccagcagcggtttgtgatcggtgagcagagtgaattttctgccaaacaccattttgtgaaatttttgcactgcaaaaacgagtgccaaagcctctttctcgatttggctgtaattgcgttgtgcgctcgacagtgtgcacgatgcgtgttcgatcactttttctcttttgttggggaaaatgtggctaattgtcgcgccgattccatctttggaagcgtctgctgcgacgacaattggcaatgacgggtcgtaatgcgtgagtagcaattccgacgtcataatctcctttgccttttcgaaggctttctgttgttctgcctcccatttccaattttcatcctttttgagcagttggtccaatggcgcacgaatttggcatatttccttgatgaaacgaccataataatttaatgctccaaggaatgatcggagggtcgtcttctcatgcggtggcggcattttgcaaatggcttctgatcgttttgggtcagggcgaattccttctgaagaaatgatgtggcccaagaaaagcaattccttttgaagaaatttgcatttttccagttgaatgtggaggccatattcattgaatcgcgcgaaaagttggtaaagcgctgacacatgttcctccattgtctttgatgcaatgagcccatcatcaagataagcaaaaacgcctggaatgccactgcatatttggtccatcaaatgttgaaaaatcgatggtgccgatttgactccgaatggaatacgttgacattggaacaatcctcgatgcgtgttcagagcgcagagctgttttgattgttcgtcaagttccatttgtaaataagcgtcgcttaaatccaaatttgaaaagtatgctgctccgttgagtgccgcataaatgtcatcaggttttggcctttggcattgcttccttttggatgattgtcggcttagtgttaacttcttggaacattatttccctgggaataacttccagcgcgacaatccatggcattcccaataagtcatgtttgatggcatcactgacgtatgctgtgagcatttttggttcgtcgttgcccatgcttacaatgccgcaaaatttgcctttgatcggtactgcttctccgttg

SEQ ID NO: 2027 - DNA, 2147 bp, Heterodera glycines
atttgtaaataagcgtcgtttaaatccaaatttgaaaagtatgctgctccgttgagtgccgcataaatgtcatcaagtcgaggcaatggatggcgattgagttcgagtgcattatttaatcctgtagaaaaatcaatgcaaactcggggtttagccatttttctttttctctgccaagattggtgcagcccaatggctgaatttgattggcttaatcgcgccaagttgatgaagtcggtccaattcggcatctacggcttcgatggcgccgtgcgggattggcctcgctttgcaaaacacggattttgcatccgatttcaaaatcaaatgtgcctttgcctttttgcaatggtccaattcgttgctgaaaacatcagaaaaatctttctgaagtgccgaaatcagtgatttttcgtcttggatcactttggcctttggcattgcttccttttggatgattgtcggcttagtgttcacttcttgtaacattatttccctgggaataacttccagcgcgacaatccatggcattcccaataagtcatgtttgatggcatcactgacgtatgctgtgagcatttttggttcgtcgttgcccatgcttacgatgccgaaaaatttgccttttatcggtactgcttctccattgcagttccttgcttcaatgtcggcaggcgacaatttcggtttgccaattttgcaccacgttttgctggtgatgatggtggcttgagcaccagtgtcgacattaatccgtatttaacgccgttgactgcgatcaaaattcgccaataccagtgatcagcagttccaacctctgtgcaggttgtgttcacttcaattgtgagaactgatcggccttttctgatgaatggctggctgttctttagtgggcaaactttgtcgatgtgtcatttcttctgacacttgtggcaaattgcatcattgaatttgcattccgatcgccaatggcctaaaaacccacatgctggacatgggtcagtcggctgtcggtgtttgcctttgtccacatttttagaacaattctgttggttgtgactccgttgttcagttttgacaaaaggttttgactttccttttgagtccttccactgttgaggacgtgtgtgaattgcgtttgttgcggcgggttgtgccattagcgagagtgcgctttcttttaccatttggatggtccgcaactcttcttcaatttgcttcagtgtgatgtcggtgccgtttttctggccatcctccaacattttcaagcacttttgccgcaggtcgtgatgctcatctcgaagagcaatgaccaaaataatgcatttgagttgctcctttgtgaggctcaaattcgcattttcacaggacgcattgatttgtgcgatcaatgaagtgatgtcctgatttggctgttgtctgattttgaagcactcatagcgtctgacaaatagcgatcgtgtttcggcgtacaaacttttcaatttgtcgagagtgtccgcccatgaaatttgatcgggttgggtcggacttacgctgtctcggtatttgttgtagtcctcgtccgataatttccccaatagaagacggacttttgtcgcttcaggtaagtcttttccatcgtcctcgattagtgtgcgaaaacgtttgaaccattgttcaaatgtgtttccgctctccgcgtcgtaataaaatttcgaaattcgggcgtcaattgaactcgccaaattggcattgttgaggttgttgttcgctggcactgcatttccaagcagttgctgcatccttgtttcggattgcgtaagcacagcgttcaaaatttgttccaattgtgccgcgttcatgtcgaatttttgtcgaaaatttgttgaattttcaaaaccgcacccagcggaaacttacaccccccaggtgatcagtttttttaaatgtccgatgaaaaccgcacccagcggaaacttacaccccccaggtgatcagttttttaaaatgtccgatgaaagccgcttaggcttttgttgctgactgcgccaaattcgttgtgtccttacccaaaggaacgacaacaaatatagacaataaagtttattgaagaaacaaataaaaataataaattggtgacggagagaggcgaatatcgattggct

SEQ ID NO: 2028 - DNA, 3599 bp, Heterodera glycines
  misc_feature (13)..(13): n is a, c, g, or t
ctgtgctcttacntctgctcaatcacaattatttcgtcatcgtcagtctcttcctcctcctcttccctccctttttgctccttctctctctgttcttcctcctccatttgcaattcgtccgttccgctgtcccttctttgcgtgatgttcagtccgttcgcaaataagctttcgcttgtcggttggtgctgcgtttctttttgcctttccttaacgacttgtccggcaggttcaaccaaattgctgtcttcactgtcctccggctcggaagattgattcagaaaatcgctttaattagggaaaaaaggttttcaggttccctttaacaaattgcactgactttttgtcggttagagtgtcctccctcgcctccttcctttccgtcgccctctcttcctcctcttctctgatgtgttcagtttcgctcttttcgttggacggaatcggcgactgcagcaagccgagcatttcagcgataagttcgctgcaacattcacagttaaaaatgccgtaataaaatgggtataatgctaattgaagttccaatgctttcaccgtgaactttggttggtgccagatcggtccaacacttcagcacatttatcggcagtcattggagggacacaagaatggacgatatttcggacatgagctgcctcttcttgtcagaattcgtcgatatgttttttcttaattggaattattgagttattttattttaaaactcaataaaaaacgttctaaccgattgttttcctcgccctctccgtttgatgggcccgccatttgttcgtcttcgttgccttccaaatagtcagccgatggttgcatttgctcactgtcatcaaattctaaagcaatgaaaatttagtaaggaataaatctgtagaccaaccaagtggaatttccattggcaattctttgtcaacggactcgatattttccttctcttcgagaagctccaactcattgtcatggacagaagtgctgaaatgcgaaacatttgtggactgaacaaagcccaacaaatcattttacccgctcggacccgcttcagtggaacaacgcttctctttcagtttgctaattcggtcttcttcaataattttggctgtgctgtttccgcccgcctgttgaacacgctgaaaagcgtcgtcgacagtgtaaaggaaccactttaaatcaaaattcaacaattgattcatataaattttctgaccttctctcccttggggtaactttcgcgtcgcatttcctcggcatgaaaaaattcgccactgataaggttcggttgtgattcaacttgaacttaaatttaacatcaaattggatatgtattactttaacaataccatcaaatgctgtccattcctctgggtttcggatataaacttccatttgcaatatgtcattaaatttaactctttttgctggcccataatttgacactgatggagaacgcttaagacaacttggcggcattgccattcttacattaataaccaaaaagcctaaattaattttttttgtttttttaacaggactccgggtgctgttgagcgaagcaggacaaaactcggtaatactatggcacccccacaaagtgtccaagccacgaaatgtccaaaagagtaaaaacccacgaaatgtccaaaatttttcaaaatttataaaaacaaaatgagtctaatttaggatttttaaggttttcggggtcgctgaatacgaatataccctttatattaccccttgcctaaccttaggcccatctgaataataaaaaactcaaattcgagacttggacatttcgtgggctggacattttgtgggtcagcgaatactataagatgggatcgacccatttccatactgccgtttccataccgccatttacataccgccgtttccgtaccagccatttccataccggccgttccatgccaccgtttccataccgccatttccatactaaggtatttaggccatttccataccaaaaatttttcgaaaattttcaggtaaaattcaataaatagataggtttcaactgtttgatgcttaatatgaattataaattcaatggattctcttttcaacgttatagattggaaaatggaagcaattctaacaaaaaagaaccgtaccaagcttcaacacaacggtcattcatacatttttcacaagccgagtgccgatggtgaagttcacttttgggcctgtgaacaccatcacgcaaaagacatcactttcaaagggcgccttcacactaacctcaacaacaacgttttgcgtgaagttggaaaccaccagtgtgaaccaagtgcagctcgaatggaagcacaacgagtgatcactggaatcaaacgccgtgcggaacaaacaatggaaccaccagcgacaattcgctcattggcactgcagaatgtggccacgccagtccttgcgcaactccctaccaagaatgcgatcaaaagtttttttttgttatgatatttttatgcttaggtaatcaagcgtgtacgtcatgaaataaacgcaccaccgccaattccaaacacgctcacagacttaatcatcccagacgcatacaaaatgtattcgcgtacggacgaacagagcgagcaatcatggctcttcccgacgaacttcctcccgtccttgactggtaaattgacaatctcagaaattgtttactatttattgttctttaattatttattaggttcatcatgaactacacgggtcgtcttaagcatgatgtaagcctaacacgcccgcgatttgacgcaaacatttggagtgtttacactcgaacaatgcaaggcgatgaccggacgaataaccattcagaagccgcgaacagacgcctgcaatgcgcatttgcctgttcacatccatcgatttggcatttcattgaccttttgcgaaaggatcaaaagttatccgatgatgacttcgcgaagtgttcaactggacaagaaccaccgcaaaaggcaaagaaatatcgcgaagcagaccgccgaattctcacgatggttcaaaattatttaccacttaacaacgtagacaccaacattttcccaattcatcagccttttaatcattagggcagcaacttttagtgacgaaaaatcccgaaatagttaactaaaatagtgacgaaaaagtgccaaaatagtgaaaaaagtccaaaatagtgacgaatagtgacataattttcagccaaaaattgagcaaaaataatttttattcactatttgcagttgcaaatgagtaggactgggatttttaagaccaaaaaacccaaaatagttacctaaaaaaatttttgccaagaaagtaaatttttgagaaaattttttttcatttcataggagtatattttgaaaaatttttgctcgattcttaggggtgtattttttttgaaaattttttaggtcgattctttggggtgtattttttggttttattgcatttttgttaaggaattttccaaaaaatgtcgaaatagtgaaaaaatagtgacaaaacgccaaaatagtgaaatgcgttttttgagctcctttcttcaaaacaattgagctaaaaaaacgtttttt

SEQ ID NO: 2029 - DNA, 1789 bp, Heterodera glycines
gtatttgcgcctaaaaatttatgtttgagtacttttagacataggcgcaaatctcggaggcgaaaagtctggatacggtagcgtcaagggataaggcccggtcaaaatagagagaaagtaccaaaaaaagatggaaattcattgctaaggtggcaaaatttgatttatttagcaaaatagttgttttttttcacaaatacaaattatagttttttttgtttttttttctgttactatttgtttcttttcttttttcggatctccttttttatctcttctgctatttaatgatactctgtaataattgcgatttaattatcttttgtcactttgtttttgcggcacatttttagatttggagccaatcttttaggaaaaaataggaattttatgggggtggatgagagaaaattggagaaatttaataaaattttttttttaaatatggtatttgactgtctctctctctctctctctctctcgagtacccttccgaatatataaaattgaaaacgtattagaaaaactccaaaattaagacaaagctttaaaaaaacattttttatttcaaaggatccgtccaaataaggacaaatctttaaaaataaggacattcccttcgcccattttaatttggtattttatcaatagattcgtgacgttatttttttttttgttaaattttgaaatttatttgaagcaatttatttctctttcagtttccttttttttttttcttttaaccgtaaaaataatgaattgattaattatacactaaattgatcattaaagtttcttttaaatattactattgaaatattccatttgtttaaaatgaaaaataggacacaataatgaaggagtttcctaaaaaacagagtcacttccaacaattaatattttattaatttacaatatttacataattttcttcttataaatttttaattaatattgttgctttaatttgtcagttaatttaaaaaaaattttcattatttaataataatgaaaattaaagaacaattaattgattttgcttgtataatccgacccaatattttgtaaaatgtaattaaatatttgggaccatcgtgtttgctaaataaaatactttaaaatgcaaaaattaaaatggaaaaataatccatttaataaagagagaaataaaaatattatatatttaaaacatatttatgtaaacttttattggctttgtccagattctagaaagttatttttcggactcgaaatttcatttccaataaatttgccggaacatttttcggcagatacggaaaaatatggatatagataaattttatgtttctttaatgaaacgcagtgttttctcatgagaaaaaaatggtttttgagcatttttatattaattttattttttaaaaaatgaaatgctttttgatgtcctcatttatacataagtaccattattagaaatactcaacataatttaatcattatatttttaaaagaatatttgtttacattttgtcgaattattattttttgtttattcatctttttctgtactttctgtatctctcgatattcatgtgaacttttttgctttgtccataaaataaaaattaaacgaataatttttaacaattattatttatttattttactttaattgcttattttgtaattaaaagcaataatttttacaaatttaatatcgttgttatattatacttttgaatttttcataaaattgctccgttaagaaacttaatttattttttcatcatttataattgaatatttc

SEQ ID NO: 2030 - DNA, 2044 bp, Heterodera glycines
aaaagctcaaaataaacgatagaaagggatcgtatccaatattttaatcgtcagcaaattttgaaaaataaataaatttttaaaacaacaggattattgttttcaataatcaagtgttttttccttaactttaaggtgtttaagctatctggcttgaaaaaaaaaattaaagtttgatccgattttggacatagcgcaaatgtctggacacggcggagagcaacccaaattcaggtgtttaaattttgaagatttgcttacaattcgtataaaaggcaactaatataattgcttaggttaagccaaggctttttacgcttcggcccaagcttaggctaggcctagacttaggcttggttggcttaagcttaggctttttttgtaatgtgtgaatccttttgtacgagttgccgccgccggaggggtctattgatttgtcagggagaggctttagccccctctaaagggaggctttatttttaaatccccctgaagccatcggtcaattgaaaattgggagaaatgtgaaaaacatttacttttgcaaattatcttgtgtccgttcattgcaaaaatggggcggagaagagaaaggacgaaaagaagtcattgaaaaaggcataaaaagcaaagcccaatgagcaggtgttcctacgtttatccgttggcccacccctcgggggaaaagcgcggcaaaaattcaaattgaaaattaaatttgaaaagtcaaaatgcagaaagtcagtcaccgcatttgttaatgaaaggtaaaaacttggatactttaaaaatgtcaaatgaaatttggtaaaagataaattgcaaatggaatttgatgtcaattcattgcatttgaaattagaaaaatggggcggagaatgaggggagggggaaacaaagcaaactcagaaaataaatttgcaaaattattgcattgactcgtcagcttttgaatgaattgaacacaaatcaggcgaggaggttggacaattttgtgtctatagggggtgggggttaattattcagaaaaattaaaaggattcgccccccacatccattaattagcaattttcgtgttattttttatcgaactaaaaggaaaaatttgttgtgtttcatctttagtcaatttataataaggaacacacacacacagacatatatcaatgctttatcttcttagtccaattcgtccacatccgaaatcaccgggccccacttggacgggtcgatctgcttccgacaaattgggcaagtctggaaaatgggaaatttcaaaaaaaaaggaactcatccgaaactcacgttgttacgcgccagccacggcttcaagcagtcggggtggaagatatgatcacagtccagcttcgccacagtctcatccagcacaaagtattccatgcaggtcgtacattgggttgcattttctatgtgtttgggcccgacctttgtagaaggcaatttgtcgatgtctgaaaaagtaaattttaaaaaacctttatgaaaggttgaccggaattggattcaaatcaaatgtaataattttattgttgtaaatccaccattttgtaccttcagggcgaagtgcccgcgtttgctgctgcgtcccgtcaaaagtgttgagaagagcagttagaacattgtcttacaatttgaaaataattaaaaaaggcatgggtgttttttacccaatccatgctcgccccaagcgtagtcctgcaaattgccatggatactaaaagatattatttacaattagtgtgggtcataagatatttggaatcgaaaatataaggttttcaaattctcctttcctttttttctggtaacgaggcctgcccgtgcatagaaggaatctcactgctccgactaaaccgggggggggggggaaggggggcgtaaagaggtgggggaggaggttcgcagcgaagtgggggtcgcaaattttggaaattttcttaacaaattcattaaaaatccaaaaaaaattcccggcggcgcctatcggcaccgccggaccccaaaaatgccaattttaaaaaaa

SEQ ID NO: 2031 - DNA, 2767 bp, Heterodera glycines
  misc_feature (28)..(28): n is a, c, g, or t
ggaaatgcgccgaatgggttctcgtgcncctgcaaaacaaagcggcggcggcgtttgctgcggtgaatcggacgcggaacgctgagaatggtcttcctgaatatcgtcgatttcctggaaatttaattgttaaattaaaaaacacgattccctcctttaaaccacaaaacaacctcaatgatccctcgtggcaacgcccacaactgaaaagttgaattacacaaattaagtaatacagaaaaatgtcaagcatatatgaaaaaagaggggggggggggtcatagctcggtagcgccggaccatctttcattacaagcccaaaattgcaatttggtgattctaaataacacaattttccgatggctaaacccacttggcaaaaattcggattgaccctttccccctccttttttcatgtatgatgtcaactcgtaagttgatttgcctatcgaaactcaccgcactccgtcctcatagcgctccaatgctatgcatcggctgcgacatttgtgactggaattttggtaaaaaattataacgaaaattgacaattttaactgtttattttagctaaaacccctcttcaaaacaaaaagcaacaattttttttttgaacccgaaaggcccgcggttaagttattcaacagccaagccaaaaacaatgccccaaaaacaatcaactttttcaaaaaccttttagtccccatcgccctttcgcattgtccgacttaccaccaaaatgcaggcatcgagtgtgcttgtgattttgcgcgacaagtaatttgagtcaaaaacgctaaaaatgcattgaaatgagcttttgtgacaaatcaaaaatatcaaataaattgttgatcaacaattgtctcaccatacactcattccccattcagtgtattcggctctctcccgtcatttaaaagtcacacacaaatcaatcaataaaaatcaaatcaaatttttgcatttcttttcctctaattttttgctggggcattgaaatgatggcaagtcgttcgcgcccgtccctccgtccgccgcgtttggtcacatttttgtcgctgtcactcgcattcgcttttgccgccgccgacgatgtccccgccgttggtggttgcggtggcggacgcagcaacagtgccgccctccccatcagtggcggcgtcgttgtccatcattggcacgggcgacacagcgccggagtcgacggcaatcgcaaaaatgttgcaaacagctaaattgttggacttatttggtacaaaaaagcgaaaattttttgatttggaattattccgacaatacgaaaagtcaaatgaaatctgcccctccctaccggtcacggctttgctctcccaacggacaacgaaggaattgtcacaccgtcggtcccaaaagcacatggacgcaacgctaagacccgcacccgaaccctgaaggagaaggaaatgttcaattgtgccgtaaattcgtggtccccaaagtctgcgaaaccgatttccatttccatttgctcatttaaatccctccctttttaatttgtgttgcctcacgcagaaatcattagaaaaatggaatttgtttttaagacacattgtttttcgaattcagtggtcgctttttattggcattaacagatttttggttcttcatttaaaacaaaacaaaccgtttgcatcaaaattacacacacctaaacgaaaatggatgaatatcaaaatttgaaaacagttaaaagccaaaaaactcacgcaatatttatagggtttttgaagctggaccaatctggcggtgattttctaaatttgcgtccgttaagttcagttcctccccccgagaaaacacaaactcgcctcaacgacactttggttccattttacctgaaataacagggacttttatgactttacacccattatttggcacattctcattgccagactcacaatcagcctttgcgagttttatcattgctagtaaatgaaaacgctcaaatcgaaatcttttcagaaaatttagcatcgaaaactcaaaagaattgccaatctattctttttcctgtccaataattgacgaactttgatgagggggatttcacccaaatgaggggaaatagcaaaaaggacaacataaataaacctgtgaaagtaagcgacgcaaaattttcatggcaaaaacaaaaagcccaaatggcaattcatttttgtgtacacctcgcaaaggctgtgcccgaccaccaatcacaaaacaattttaagcgcaaaacgtactgcttcggtatgctgataggttgaggcaccgatcagatctaaaagggagagtgaggagttaaaaaacgaaattattggtgcctttagaatttgagtgcccaatttttcatacataaaaaatcaaagtttggcacaacactcactttcgaggacgtctttgcaaattgtgttcacttcttcctgtgttaggcactgcaaggacatgcttcaactacatcaaactgcttaaatatggtcgcaatttcaattgttcagaaagcaaataaattaacggaaatgcactaaaaatcatgaatgaaaaaaggcaatgacttattcttgctgtataaagtctactttcttgatatcactcgagcgcgtaaatgtctagagaatttagatgcttaggtctggaaaaagtacaattcttttttgtgttgccttaatgctttacaagagattcttcgatcgaatttatggcctaagaaaccgagagtggtcagttgattggattcataatt

SEQ ID NO: 2032 - DNA, 2062 bp, Heterodera glycines
tgaagccgtggctggcgcttaacaacgtgagtttcggatgaattcctccattttcttgaatttccatttttcagacatgcccaaattgtcggaagcagatcgacccgtccaagtggggcccgtgatttcggatgtggacgaattggactaagataaattggatgtctgtgtgttcataacataatattaatatcttttattcaaaattgtcatttattcaaaattgtcatatttattttcattttattacgcttataaaaaaatacgaaggggcaaactgttaatcgcctgaagaaagtaaaaccgaaaaaagaacattaaaataaatgattaggcatttctgaacgagacatgaaactttggcaccgggaagtttgagcaccagagggaggaatttcaaaaaattaaaataattaagtctgtaaatgttataaaatacttaaaatttaattaattttaacacccctatgcttaatattttttcttgaaaattgaaaaaattaagtatgggaacctggcaatcatatattttgtttattcttttaaacgtagggttagacgtgtactagtttctgttttgacttagacctgaatgcccggttattggcatagtatgaattgtaatgagtttagaaaaaataagcctggttaaaattgagtggatatccattaaaaacttttgattcctaacttaattaaatttactatgcttttaaattagatagttgcaatttctagacaagtaaaaacatttttattttttgaatccttaattggtgcccaaacttcccccgcgtcctgaacagattcggttattttaatttgccataattaaattggaaatttttggagattttcgaatttaaaataaaaaattctgttgtaatcgatgtttgttacaaataaaaaattcaaattgacatgcttaaaagaaatggaattaaaaattattcgattggcaatgcgacgatttgtcgggcactccgagagaattggaaactgaatggcgtttacgcattttaaagccccgatttaaatgtgttgaagggacacagagttaccgctgccattggcgaataaatttaaaaatgccgatttaaattcgaatatgtccaaatggatatcatattcgtgagcaacgaccccgaaaacctcataaaattgttctaaacaactttttaaataaatgttttttaaatatgggaccgacattcatgattgccaaatttttgcttatatttaacatgcaatgaggcaatcaacagtctcagcaaaaaaacaatgtctccagggtgcgtatggtaagtatgtttattgtcagttttaaaatatattaatattgttatgaacacacagacatgtcaatgctttatcttagtccaattcgtccacatccgaaatcacgggcgccacttggacgggtcgatatgcttctgacaatttgggcatgtctgaaaaagggaaattcaagaaaatggaggaattcatccgaaactcacgttgcgaagtggccgtgtctgctgctgcgtcccgtttaaagtgttgagaggagcagtgggaacatgccctcgcgtgcgaggaggattttgcatcggcggcgcaccaaacggttgctgctgctgtggtccataggcgccaaattgctgttggcgaggcgactgaggtggctgcggccacagcgtctgttgctgaaagaaaatacgcaataaaaaatagacgggaatgagttaaggaaaatcctcggcccatgcaaccgacacgtccaacattgaccacctgatgttcggtggcgtcatcgccgtcgccgttcagcgccacagcgtggtggcggcgtggcgattgaagtttgcagatacaaacatagagaaaaagggtgtctttttgtttttaaatcgtcaaatttgaaaaagccgaaaattcccacctcggaagttcaccgtttttggtttttttaaacgaacaaaataagacaatcatcacgaattgttgtccaggcgaaaaaaatgttaaaaatttggaaggcaaaaaatgcgctgaacccgaatgcgaactttggtcttgc

SEQ ID NO: 2033 - DNA, 1919 bp, Heterodera glycines
  misc_feature (11)..(11): n is a, c, g, or t
gaaaacggccntggcccttttttaaaagctcaaattagcaggagggttagtcaattaaaaaggtcaatgatcaaatgtttatttttcactatccatgttcgcttcagcctctttttgtaagaaacaaacaatttgtataattttgagtagcagaaatcgtagtttcttttggcttcaattagtggtttgtgcggttcttacgcaatgagaacaaatgaacacaatggcaagtgaatgcggcgccgataaagacaatagtttttagttaaacggtattgacttcgtttatgaaatacggtatttcattgtatttttaattactgtgtttgggtaatatttcaatgcagtattttgattggtactttgcttgtatttcatggaaaatggtgtttttgttgtgtttataaatactgtattttgatgtgaaatacggtattttgagttttttaagggaagtttccccggcagtgcctatctaaagacagcaaaatccctttatttttttaaattgacccaaaagtgcttaaaaatggtcatttttggcaaaaataattgctattttttgccccacagtgcatatgaaaaaaattgggacttttatttattttatatacctatttggagtttttatacatatttacatatttcggaatctaatacatacatatttggtacatattttggactttttagcatttttttctaaattgagaatttttgataatttataaaaatttcatgtgaaaaattaaaaatgttaaaaatatgttcaaatttttttgatcgaataaagggaataatttacccttaaaatggcaaaaacacctcagattttcttggggcagattattccctttgtgccatcaaaaaaaccaatgcattaatttttaaaaaccgtactaattgtaatagagacccgggaggctctatttttcaacccacctcaaaagggggactttatttcagggggagggggctctaattcagtggggggctttatttttcaaccctaattttttcaaaagtccaacaaaaaatggcgattttttgaaaactttttactaaaaacaaaaaatttctacgggtttccgggttaattccaaaattcttgttcgttttggatgaaaatgatttttttgttggcagattcttgggacatgggagcacagcaacaggatgtaaatttcacaaaaatgctgatttttttattcacttcggagttgaaagggcctaaaaacccaaaatttgcccattctcgacagatgtaactaattaaacattggtttttgggccaagggttcagattcgattgcctgtaaattttttaaaaattatttttgggtttttttgagttcgggtcagggttcggaattgggcgaagtgaatgtcaaattcttgatcagtggtcccaaaaccctcgagaaacaattttaaaaatatttgcaggcaagtggattctaactcttggcccaaaaaaactgaaaattgcggattttgtgtatatttcttttcctatactttttcagaacagtgatattatccccatccaaaagaggctaaaatgtagaattgaagaagcgtatcgcccgaaatgaggcttccatttggaggttacacattttttagccaaacatttgaacgtgagtaaatttctttatgctaaaattaagaaaaaaaactaaagtaaaataaataaaacggaaaatgattaaaaaaaagtcatcaaatcttttctccacagtttcagcattaataacggcctctgaataattgggaaagcacgataaatattccacaaaataaaagtatagcagcagcaatcccaactgatcgctttcgacgtcgactccccattttcagtcctgaacagggctgggcaaagctcggctttgcactcgaagccaaagccgaaggcgaag

SEQ ID NO: 2034 - DNA, 631 bp, Heterodera glycines
aaaatggtgcgcaaccgatgcaatgtccctttgtttggccttctattgggtgcacttggccggtggacttgtcttttttgtccaaatacagtttctgaagtggggaaagatgatgacaattaacaaaaattcgggggttgatgatttaaaaagatgagaatggcggataaagtcgaggacaaatgggattgagtcctaccgtacattaataaatttgcaatattaataattagtgttatttgagtctcgactcatttgggtccaatttctgcctggaatttcgggtgtgccgggctcggaggcggcgcaattactgcggacattcgatcggttagcaccgagtcgacctcgtccaattcggcaaacagctcgaaagtttgggccgatcggtcactttgaggcagttcagtctcaaaaaaattcttccaaacagactgaacaacggcgccggagggcaccaaaccggtggcgaacaaaagcaaaatgggataatttggaaaaaaggggcgggggaaaagagggaaaagtgccatcgtgagagaaaaaaaagaggaattaaaactgaattaggaatatacaatacagcaaaagcaattattatatgaatattttaaataaaattatattataa

SEQ ID NO: 2035 - DNA, 10976 bp, Heterodera glycines
  misc_feature (3029)..(3029): n is a, c, g, or t
atggtcgctgttaccggcgctcgtcaccccaacagatgctaggtgcggaccagcaaggttatattgggggtggtgagccaaatccaaaccaggctgttgaaggcgtagccagcgtacggcggtgaagaagcagaagagaaaaatgggcactacaacggtgtagtggagtgcgaggatcagtgcttgagcggcacgttgtaacgtgtcgctgtcgggccatgcgtactcgtcgggctggtacacggttagaagagcatcggcggccgctggctgaagcggctcggccgtctgaattccaccgtggaagtagtcagcgaccggtggtgttccgttgctgatcatttatgttttttttttgagagggagggtattggtatgctaatttagtttcttgcttctacaaatgaaaagtgatgctggagggtctattttctcatctttttatgcaatttttgaatcggtcacaatatgacggttgtaatcaatcatgattagttgatcgaattcgccaagacaaatcatttcaacgccgccctgcggtatctctctgttgaactgaaggcgtacacttgtggtgcccgagcggagcagttcaaagccacagctgtcgtccagcgtcgaggtcatcggtacgacaaagaaggtccatccgtctcggaactgctccagcgtgatgtccatggagcgttccgagtttgccatgcccaacgcctcgtacatgtcgacaaacgggcgtacgtaggcagctccgacgaagttcatacggtgagggatggcgggatacgtgtttccaccagcatgtacactgattgcacgtatgtcgtatggacggaagttgaacggtgtgtgggcgtaggcgccgttgaaggctcggttcgccacaagggcgatggtgagtcggcgtgggatggctgccgagaatatgttgtggtccatttccgtgcggccagcggtcagaaagcaggatttgacctccgtgcgtcgtacagcataggtggccggctgtttttcgagggtcttgtagatggagatgttgagcgacggctgcacctcgatgaccttcacgtacagtttgatgtcgtgcactcggagtgcgtacgaagtgccggcagccccggcgcccagactgtggaccaggaatgcgtccttggaacggtagatggtgaacaggacgtccatgttgttgagcaggtacagttcttggttgcccaagtcaaagtcgaggcgcgagataaactccgccttacaaccgcccgaaaatcgtgcacaccgtttcttgaacccatcatcatttgcgtcatcgtgtgtccggcttacgtagtagccgttggaagccatgaaatggctctttgcatttgcgggaaatgacagctcgttggagatgtacgctttgaacgggtacagtgtcccgctgtcgtacagctccatgttttgcacttcaacctgaatactgatgggtgcgtctgcgagggcttctgctgttacccacctttagttgttgtacaaatgtttgcccgatgctctggcatacgccgacttccttgtccaccacactgtcaattggctccatgatgccctgcgcatttgccttctcaacggacagttcgaggtacaggtacacacgggacaggtcggcccacaggctatcattgtacatgcggaataggtacggtccctcttggctgatcgttgacaatggaaggagttcgcgaaaaaaggagcgcgccaccgacacgttggtgggtggtaccgcaaaaatgttgagcgcactgttgaacgctagcgcactctgctgactgatgcgcttcgcacaagtcattgtgtgcgcgtatgttttttgtggctctcagtaggcgccgagtgtgtcaaagcggggcacacgtcgcggtcccttcttgtcgtcgctgttggcgggcgttttcacggtgcgggagcgcttgcggggtgttgagcccggttgttgtcggcggagtatgcgttccagagtttgaagctcctttttgtgttgcttagcaggtgccgttggcggacccattgtggaaaagaggcctttctttccactttttatgccctctttgggttcggctgcattctgtctgtatcgtttgaagtcgaagttgccgccaccgttctgtcgactcttggccacggtgtccgccgctttgtctagcagatttttgaggccgacgcggccctcgctgaccagcgactccttcaagttctgtccgtcgagcatgttggagagaacgcgtgcgccggactcgagcccttggcgcccaattgcggcgccagcctgtcgaccaattggcaacaggaagcggaagaagcttctgaacatggagccaagcccggcgccgcgctggtacggtaggccggagaaaacggggtaggtagtatggccaccaccaatcataagatagttgtgtgctgctgctgcggcctcggcggttcccataggtgtcgggatgctgttgagtccgtggcccgcgtcggcggggcccgagtgcacgattgcgtcgttttgggcgcatgtgaacatgggggtccagtcgactccgagcggatcaaagtctacgtgcatgttcgccaccgcttatcagacgatgtgttttttccgtcaaagagtgtactggtgttgctgttttatatagtctcggcagcgtcagcatcgttaaaaatgaattggcgtgtgaacgcagccaccagacggtccggtggcgttttgcagtttgtcaaatgcccaacaatttgggcaagggtccagccctggcagcgacggtacaagaagtagataacatgttttccgcacgcgctcgaccggtccgactgaacactcatggggcagcggttgacatgtgcaaaacggtgtaagaaggtgcgaatgccttcacttgtcggtggccagtccgcgaacgagtcaaagtagtcaacagtggtggacgacataatgtagacggccacccaatgtgtgcctggctccagcgccgtgtccgtgttcaacaccatgcaatagggatacgatgagcggngggctgggatttggtcggccggaaacagccgaggaagtgctcgcgggtcaaggcacagcgcctcaatatcttatttatttgtaggctattcatttgtctctctctctctcacacaatgttgggaaatggaacttttatgcgcgtaagtgtctataaacggaatacaaattcagaagtagggagtctttttgaaatgtaaagtcagtgtacaggttccatactggaatggcatcaatgcaccggacggggtccgtatctcgatctgaatatccgaaatctccttcaccatcagcttctggtattgggcagcggtgtagcattcttcaacaatctcatccggcatcccacggatgttgacaacgcgaagcacgggcgccacaacgtcgccgatgatcaacggctcgatgagtcccggagcgtagacgtagaaggtggagacgccgcccttcatgtccggcgggtacgctgacacgttgactgggtcggacagcgtggaggtgccgaagccgagtatgtaggccaattgggcggacaactccaccaggcgtatgcgccgcttgtccagcttcaggcgaaagcgttgcagatgttcgtcaaaattgaattggcaggccatgcgagtcctccggtaggaatgggtccacagctccaggccgacgggcaaatgtgcgttcagcattgcgcggtcgcgttccgtcaatgcttgcgccaggctttcctccaacatagtggcaaatagttgtttgtacaattcctgatgtcgttgcgtagcgtgcggctgtacgctcgttccgccagggaccgcggggatggtggtatggggggtttgcgccccaccacttattggcgtttttgttgttgtgggcgggggtggcacggtgacgttgcgggggcccgttctgttttgtctctcgcgctcggccgcctcctctgtagcccgctgacggtccgcttccttggaggcgcgttgttctgcccccttcacacagcgctggtactcggagtgaatggtgcgcagctggtccgccaactgttcactgccttcgcccaacgcgtggtgaaggctgtccaggagctgagctgggttccgaatgttggccgccggcaccgggatgcgaatgtgctcgccggtctgccactcgacgcgtacaaactggggctcgctggtgcccagggagggccacgagtgggggtagacgagcacggccaggccgacgctccactgcgcgttgaactgcagtttgcgtggtaaatggacacggaatgagttggtccggttcccgtccaccggcgtgtttgacggcagcaccacgtagaaggaggaggaggtgaatgcggcagttgacatttcctttgatgatgaaaggcatgtgtttgctgttgacccattttatatgattgtgtgggccggaatccagctgttgtgacgcgtgctgtagcctttccatttgacgaggcagcactcggtgccgtccttccggtaccgtcgctccagaatgcgttcaatggcgtacaccttgttgttgttgttgttgtcgatgccatcaggtagacgcttccgcgttttacgcttatcaatgctgcctctgcttctgatgctgctgtcgtccagcgagggtggaacaaccagtaccagacacatgtcgttggcgtagaacaagccggtgatgggttcaccgttcatgtcccgtagcttgtaggtgatgggtcgtctgcctgtgcacacccgatccacggtgaacacctcgtcagtgaaccgaggcaggtagcctttgcgaaaggcgcccctcgcacgctcaatacgcacatggtcaccggggcggaaccgcgcatgttgagaggcacgtccaccgcgctccgcctccgcacggtcggcgatccgctggcgcagcgactccgcattgtcgaagcacacttcattagggcgcatgccaaagatgctgctgttcggcgacgcgttcagggagctgacaatgcgttggatcacccgcgtccagcattgggtgccacggtgcgtgaagtaacggtacaggcgctctttgatgctgcggtttgcacgctccgccatcccagcgtgccacagtggcgatgtttccatgcagtggtgacgcacctccgcttcgtcgcgcaagtagcgttggacagcggaggcggtgaactcacggcccttgtccgtcaacagacgccacggcgtgtagccacagcgggcaaaggtgcgcttgagcgctgcgatcatgtcgtccgagcgcttgctcttgaccggctgcacatacacttgcctgctcagcgtgtctatgcacaccaacaggtaggcgtacccgcggttttgcgcgcggagacgttggaaatcggccaggtcggcctgccagtcggtgtgtagaccggaggccagagtcggcagacggcggaagcgtcgtcgcacttgtcggtgcagggtgtagacacgttggcccgccaagtagcggctgatctcagcgcgcgtaagacgggcgtccgggtgccggcgcttcgcctcccgcagcaggggctctacgctggtgaagcaagctggcgaccgttcgtccttgtaaatcgggtccaaaagactttccaccgtcagtgagcggacggcgttgcttccaatcaccataattgaggcttaaaacgtttggcagtggaatgctccacagtgttgggcttcctcttgctcgtcgcacttttttgaaccgatttatgtgcatgatgattaggctgtagtaggcggctcagggaaaagcggcccgcgccagttttcttttgtccgcgcagaggttggtggcgccgaggttgtccgcccactgttgacgctgaatcactgcccgccgccgccgccctttcatccggaaacagcagacgccacatttgaagatcgtcacgcgcattgttgacgaaggttttgtagcccggtggtgccttagcgacactggcggtgggggtggtagtggaggaccgcggctgctgctgctgctgatgacgacccacaaagtggtagcggagcagcgtgtcaaggttgctgccccggatggggcgataagcgccctgggcaaggtgcaaaatttgcttaccgtcttcaccgccgacgccaagcaagcctgggttctgttgcgcgtacgccatcgcggcatgtatacgcggctcagcttgcttaggcagatcgccaattttttgtggagcagcagtctgctgggggagcggttgttgttgctcgttactgctgctgctgctactttttgttggccttgtcgaagaagaggaagacgcgctcggcgcttggttttgatgctgtaagccccgtcgtctggacagaggtgtggtccgttgggggcgagctggcggcggcgtcgctgttgccggcgaagccttctgcagcacagtgtcacgcagtgcgtttgttgtccgttgcgatagctgtacgttgagcggtcgttccgcctcctcttccagcaatttctggtagcgtttgaactcctgttggtagtggatgaggcgttcgtcgtcgttcgtgtgcttgctcgatgccgccaccattttgcgtgccgtgtgctcaatgggagttgcgggcgtgggcaacttgttcatgcacgtggtagaagacgtcgccgccgctgcactggggttgtccatcagacgtcgataaacatcctcggggatgagtagcatgcgtacagtgtgcttcaacgtcattgtttcttcgtgggcaagcgtgcgtgtgggtgcctttcagctactattgctggttgtctcgaatacgcgttggacgagcacgggcaccagcacgctggcgagcaacccgaccagaggcggtatgccacgaccagtttgcgctgttgacggtgcgtgggcgttgagcagaaggcgacgggcggagcgtgtgctacgcaccctgctcagtgtgcggacgtcgctcgcacgctgtctgaggcgggccagatgacgccgttggatgggcacacgcgcgcgtaaaatgttcagtgcactctccacaaggcagagaagctgctcgctgctggctccggcgaccagcgcttggcaacggggaggcgatccgcgtgctgcctttagttgtcggaagaaatcaatgtggcgcctcacgtgttcgctaagcactggggggcgagacggggcgagcttgcggctgctggtcgtctttcctcgccagacccttcggtcctcttcttcaatgtgttgttgttgttggctccgcccctttcaattttttttcggtgtcgactgctgtttgctaattgctctaagcgtttgcattaaaattcgcgcgcgctcgtggcatgtacaccacgcacatttcccccgggtatatatgcgttttcaggcgcaactgttgctccgtggttgggttcatgtcgaccaacaggtagccaaacggttcggccgttgcgtcctcgtacgcttccaagaagtagcgtagcgccccgcccggaaacagttgtgcgccgaggttgcggatctgaagtgcgccggccgggttgcgcatcaacaccatgtagtgacagttgttgcgcgctatccgaagctcacgagtgaacagatgctgcgtgatgagcaccacgctgacgccccagttgtgggagccacgggtgaacaccgtgtccagaaagctgcagcgtagaccgcctgacatcaggtcgtccaacaccaacaggagccgtccgcccgcgtgcttcccgctccacatccctctcctcgggcgctccatggcacattctgatcgaatgttttccctccgtggtgttgctgtcacttgaagtggtggcggtgttctccatacgttgtagccggagcacattgtcgttcacttccccataacagtagagcacgccagtgatagggccttcactgaccatcaggtcaatgtgagaaagaaggcggtccacccactgcgatttcccgctaccggtgcatccggcgacgcacatggtgaacgggtgcttgaagaacattttcccttcttcggttttttgcgtccctctgtatttgcacacacacacatatatatataaatatgtagataaaaaatttcttcctccattctactaaacccccacccccaaaatggattcattcggaactgtcgcctggattctgcgaccaacggctcagacgacaggcactgctgtgggctcaatggagtacgaagaggaggaaaacgggacaggaaagttggtccacagtgtcacagctactgtcaccacacctaccaccgccgagtttagactggaaaaagaagccccctcctccgagaaggacggtgctgaagagggcagcggcggccacggcacactgctgttcatcgaatccgatgatggggaggaggaggaggaggatgaggacattgaagacacccccgtcgccacagactccccctcggctgcgacggcaaccgttgtggatgactcctccgacactgttaaaggggtggagcagcagcgctccagtgagcacagcgacgtgacggacggagcgggcggtggcggtggaagcgaaggcgcaaaactgctcggcggaggagaggaagaggaggtaggtggaggccagctaattttctacctcccccccccccctactgtttgtagcctgttcgaatgccgctgctcaactacctgtgcgcgttcaacgactgttcaatgaaggagcttcaactcctcttccacagtgtccacgcgcgacagcgtatggtgtcgcacctgcaacaacactgccgacttcatactgcgcatctgaaaccggcggagcgtaacattgcgctccactgtcacgacctcagcgtgcaaaacgcgaaccggacgttcgcctgcggtggctatctggagcttaccgtaattcgatgactgtgtagaccaataatggtgcggccttctgtccaggttcgacaatacttcttcgccaaacacgggctaaagctgaagcacccgtacatgccgtgcatgatcgagttcgggggcggcacgcacgcctcctactatccgtaagcggggggtacgcaaaaatgggggaagtgagcgtaaacgccttcagcctggagctcgtccatgtcgtgctggagcgtacgaagcgcgccaaacaggagacggtgaagcaagaagagccataccgtcgtgaatccggcgacgtggctccgacaaagtcgatggcaatgccggaacgacattgttgccgctgttgctgtcgatgcgctaacaactagctttttgagagacatggtcattgtagatttgcgcgcgtgatcacgtgacttattgtgctgttatagtgtttgtgcacttttttttaaataaatttgcaagcccatggatttgtagatgttgaatactatccgaaacagtacggtcacatttacattttgccaaaacaatcggccaactgctttttcgcccacagaattccgtgcgatggcaacgcatggcatctgtacggagtacgcgctgcgacgcttccctgccatcgtgttacgcattagaggctacaacagcggtgacgacgccgttcagcccaatggagtggccacagctctgctgtttcgcagcggacgtgtcgtcatgacaggtgtgcgcgctcccgcgtgtggtatttgctcgacagtcaacgtgatggcccatcgggtgcgccaccgggttggggcggcgctccgtggggctggactctcagccgctgcacgagccttacgcataggggaagtgagagtgcggaatctggtgagcagcgtacgcttgcccttccgagtgcacattgaacgtttgtacaactcgttgatgagccgacactcggcaattgaccaaaaccacgacgacaatgttctcgctgacacccaatttgtcggcgtacgcagctgccgtctggacttctgtgccttcccagcgctacgttgcacgctcagcatggcactttcagagtcacgtttgcgaggacaacaacaacaaccgcagatcgtggctccgccgatcgccgtcacttttctgctgtttgtcaacggccagctgattgtgaccggtgtacggagagtggagcacatcgacgaggccttacagaacatcgagacgatggtcaacagaagcacttacaggcgatagtcgaaactcccccacccccctcccccataaagtgcgaccacactttcacttatatttttgcgcataaatttaaaaaattatccaagtaccaaaaaatcaacatcatcatcatcatcatcatcagtgtcgctttcgtccgagagttccccatcttcggcttcctcctcctcagcatcgtcacggtcagcgtcgtcgtcgtcgtcgtcgtcgtcgtaccagccaaacggtctggtgaagtaggcatttccggcgccgccgccagcctcccgggcgtcaagcgcaacgaccagccctttggtgtacacgggctggtacagcttggtgccgcggcgcgtgaacacctcggcacgcttcgtacgcacgaagcgggtgcaggggacggccactcgctgctccgcgtcaggcatcctgttcgggggtagcatacacacacacacacacacacattccattgttatcccacccaccccctcgtgctcaccggccgaagaagttgagcactgacgcatgcgctcgaacgggagcagttggctggcggtgcaggtgagctccagcccgcgcaccttgcgctccgcacgttcgtccccgccgctcgcggcgcaccggtgccggaaaccgtagttcttagggccggcgctgaagaattggacaatgcgccggccgggccactcgcgcatcagctgcccgaacgcgtcgccctcggagcgtaggaattgttgctgttgcgggccgggtggtcgccgcgcgcgtacaaagtacacggagtcggtgtcgcagtacagcatgcggccgcccgccaaccgcacctcctccagccgcccgtgcagatggaggcgggcgtgcg

SEQ ID NO: 2036 - DNA, 1048 bp, Heterodera glycines
tgtggtaattagagggatttgtttcataatgcaattttcttatcacgtaaatttattgatccgttgtaaaaatgactatcttctgcgtattggtgacttaccttcgtcctttcctcatctcgatccttggcctgacattggaacagaataatgcgatatgcacctgaatgagcggtgattgtacccacaagtttcgagagggctcaaaggcggacgacgagtgccagtttttcctccatgagaggtcggcaccctctctctccctctctcgttacctatccctctctccttatgtccatccttcgtttatccctcttcccctttatccatccctcttcccatttctctctcttccatctcctcctctgtctctctcttccctctccctcccctgtcccactattcctcccaactctctccccctccctctctatctctgcccaccgattattgcgtttcgggcgccctttccctgcgcgtttcttatcatttgctcgttgatcccataactgtccaacagtgtccacacttgcttctccaactcgctgtgcttcagttcgccttcgtccgggttcagcgacagttgcaaatacgactcggggaatttgcagtcgctgagccaataaatgcgctgaaagaacggcgaaggaaggcatttaaaaaagggcaaaggacgcgacaaactctgagctcggaaatgttcgcgcgacgggagacgtccatttccaacatgcgactgatggaatgttgagcaaaagtggacactgacaatgagagagaaagtgcaaacgaaaagcatggctacggtaagtcgaaccgtaccgtattcagggatgtagaaagacccgtccaaaatgttacgcttcaaatcggacacagtttcgcctcgaaaaggggtcacgccgaccagcataaagtagaggagaatgcccttaagggggggggggggggggagggggaaatatttcgtttccccggagggatgagaaacgttcacatgccctccgctccctcccttttctgcactatgttatcttttctaattttg

SEQ ID NO: 2037 - DNA, 5557 bp, Heterodera glycines
cccccccccccccaccttttatgtccctgtggcaaatgccctttccgtgcaaatgggccaccgcagaaacaatttgtgctgcaatggccgaatgaatgaatgccttcccaaaatgtgcacccaaccgaccgaatatcggcttggccacctcctccgtcagctttcccgtctcgtgcacataagtgtacagttcgccccctccggcgtattccatcaccaaatacgtcttcaaaagtgtcctttcattccattcttgtgtattccctcccctgatcactttggacagtgtcgtgaccacttcgaagagtcgaattatgttcgggtggtgccttcaaaagtgtttttttattcgcttttccgccgatttcctcacattaattccatgttttccatttcgcgtgtcagcagtctctgaattatttattcctccgcttttcctttggcttttcctcccccttttccctttttaccaatgccttttggtccaatttgcttttctccatcacttttatggccactttttctgaatttgctttctcttctcagttcgtttgattggccttcccttcgtccgtacctttggtcaaaacgtgtacgcccaacttcacttttgagaagtttcccgcgcccaattctttgcccaatcggtaaaatccgattcgtttgcccagggcgatttccttcaaaatcctttcattaattaatcgctcgctgtgtttcatttgccaatggcactttttggaagtgcgggtcattggtcagctgatacagcgtccgttcgtacagcgactgcgattggtccgttgtgggggcgggcagcgattgggcactcgtcgtacgggagaacagcggcgagtcggtgccctcctcggaggaagtgcactggagagtgggagcctgaaaggacataaagtgaggcgaacgagcggggtgaaattaggcgaagaaagcgcggatttgggacgaattcgcaaagggacccaaccgaaggacctttgtgaatttggaacggaggaatgccagcggagaaggctcaaagtcggcacaattcgccttcgggtggtcccggcagagaagtgacggttccgctcccggaaacataaccatttccgatttcattcagtttggcaaaaaatagtgacttaaaatgattgggttggcaccgggagtaatgttttatagtccaaaatgaaagcctctttatttaagtggtccttgtgccgactgtgggggtgggaatgattggaatttgaaaggactgccgctgagggggtgggggataaaccgcgcgacccaaatgccaaattccacacaaatccaatcactaagcccaaatggaaagcgaaggctggagagattagcggtccaattcagaagctaatccgaaaagcgctaattgaatggaacaaacagcagcaacagaaaggaccgtcccccgctcggctccttctcctaaatcagcttaatcctttggcccggggcggaactttcagcggacaataaattggcacaataacaaatcaaaaatcactttgccgggagtctcgaggttcagcggaccttccgttggataagattaaaatttaatggggacgaaaaaaacagaactaaaatttacgagggattagcatccattggattaataaagggattgtataaacagaaactgctaaattgttaataagataatgttaattcatttttcgacctttcgcgtcgtccgccggggacaaaaagtgccggaatttcctttggccggcgaatcggtgccattttccgcactgtttgaggaaagagaggcgaaagacgaagtgagggaggacaattggcgagagggcggaggcacctgaacaaaaatcggaaaatgaaatggaaaaaggaaaaaacattaggctgtgggttttcggcaactgtggcggccaattccaaagcatttgcgatggttgtcgcagtgtttccgctgctgaacgcggccgaggccgccgcacttatggtggcctacagaaaaggacggaattactactgcagaggtcgaggaaaagtgccaaatagaaagagggaaaaagttgcccccggggggtggggaagaagcgcggtgtaggcaccgatcagagagagagagagaggggaaaaagccatgcaaatcaatgaacgatcggcagggcatttagaggccgataaggagtgatcattcagcttgtgtccttcccaatttggcctctctcaaccccttttgcttttgcgcttttcggtcgacctgtctgagcagactcggcatggcactgtgctgccgcatgtgccggtatcgctgctgctgctgcgaatgcctttgttccgtcgaattgtcttcgtcccctctctctccccctccctcttgcccttcccctctctctcggcctctctgctcttcttccgctctctccgtccctcccactctttctcctccctccctctcttcctcctcttcgtctcgcactttctctgccagagagtgtggctccgaatggactccgacaagtcgcaccttaaactcccccattcttttctgctgttttcctctttttggctacctgccctcgagttgcgtttttcgtgtttatttgtctctgaattcttcttcgcgttgcgccgcccggcggacgattcgtcggactgccgcaaagcgaagggcgcaggggcagcagagggacagctaaacaaagcaactcgacgtttttcccctcctcaaattgtccgtcccaaaaatgccttttttgttttcaccgtttgaatcgttcggcggaattgcgcccgaggcaaacgatggggacgaagtgccgtcggaagggggcgaggccattcgctacgttttcttacggggcacgctgaaacccttcacaatgattttgtcggttttagggatttgtttgcccccttaacccttttcacatccgccgttgggacaaatggggccaccactgtccccctgaggggataatctctcaaacggtgaggaagccccaggggattttgcggacagacacaattagccatattacacattacgcggcggcaaaaattcgatgaacggtgggggagggaaataatgggaggaaaaagagggagttgggagggggacaaaaagaaagtgcaaatcgatggtcggtgccttcttcgcatattcccctttttgtcgtcccatcaaaagcatttaattggccattttgcaagtgcttctcaatttttggccctccctttgtgatgctccaattttggcatccaaacgcgcaacggaaaagtccatgaataataaaaaaaagaagtttaattccaacattttattgtataatcataattagtacataattaagcgtccgatttcaaatgaataaattaaaaaaagaaacccctgaagagaagcaaaagtaaagacaacaataacaacgatgatatgcatttgtataaaaatttaaaatttttccatatcgaatcacagaatctgttcgttttttggcattttcatgccgacctttccgccggttgtaccaatcgttttggctcgtaaccataaagaaaagtggacaaaatgacaatggaagcacccaaagtgaaagtgagcgaaggaacgaagtctgccagaaacgcccacgagacgaaactgctcaaaagaatggacagagagacggcgaaaccctggagaaatcggaaaggaagtgcaaatgaaaggcaacagaaatggggagggacaccttcagaatgttgtccgcgtatttgacgacaagcgcaatcacaagcccaccgtaagcctacaaaagcaaaggcaaacaccgtaaccaaacccaccgtatacctgcagtgcaataaccgtccaaattatctgaatgtttggcaaaattacgaaaacacgaaaaacataagtcatgcccaattgtatccgtggaaaaagccccactgctgaagctgagcccagtcgtaaagcaaagtcattgcaaaggcaccaaaaatgctgaagaacgctgaaattggaaagtgaaaagggaaattgggaagaggacggaccaagctgcaaattgcgaacccaaagttggacttgcgaagtctttaggattttctccaaataaacgccggcaaatccgcttgagcaacaggcggccaaaatggcgaaaagtccgacgaatccatcgccggtcgatttttgcggcggattgtcagccccaaatgccttttcatcgacagcgagggacggactttcggcactttttgggagctttaatttcaaatgaaatttagcaatgatcgactcaaataaataaaaataaagagttggcatttccgttagcgaaatgcccgtgaacattccgactcacctggacaagcgcaacgccaaaagtaagcaaaatgagagacatccatttgattaggtccaactttttgtttaacatcgtaacggagaaaaaggccgtggtcagaattttcaattggtaagtgacctaaataaatgggagaacggttcgccaaacgcatcacttttgacttggtaagtggcggcgtccaatttggaaagggccaaaaacagcaaattgttttggacaacctgaaaaggagggaacggctgacaatggacgaaaggcgcaaccgttcacataaagtaacgctggcacgccgactttcagcgaatctctcccgtcaaaatcgtgcaacaaacggccaaaattccatttgttctgataccctaagacggagacacatgtgaaaaacttgactatttcggccatcaaaacggcagtcgacgacaaatatttgggcccgtcggagggatgcgatttttgggtctgcgaataacgcaaagtcagcacgagcgctgtcgtttgaccaatgagcacaatcagtgaaacccatttgagggcggaggaagatttagcagaggaaacggcagccataagtcaaaaggtgccgaaataaacactggaaatggtccacaaaattaattgttattctgtaaatttcaaaaggtatttcgaaattggaaatgacaccaattatttttggggtccataatttcatattaaatgcataattaatacactaaaacaaaaaaaaattgtgtaccaattgtcataaatcttcccgtaacatcacaaaatcaaaaatagtcaagtgttttttgtttgcttcgtcgtttttccgacgtctctgtcggccctttctctgaccatttcttcgttcttctcgttgatcatccgactgacttccgtatttaccttcgcttgtttgacagccgatgccttttttggtggagcaattgatttaaagccctaaattaaatcaaattttcatgttttcccaatgtaaggtgcctttttgggtcctcttgtcggtgcccccttttgcgcccgcttcattgatttttgttttgcccccgcaggtaaagtcgtcttctttttcattccgtgctgtgccatttgcgctgctttaactttgagaaatattttacagaatatcatatgttaaaatattttgtaaagaacatatgtaggtacttttcccattatgctgccacacccccaaaattttaaaa

SEQ ID NO: 2038 - DNA, 2543 bp, Heterodera glycines
ccctctttttttaaaattttggggtgtgagcgcataatggaaaagtacccccatagtaaattaaaaaagtgtatgctaatgctttaattgtacaataaaacaaaaacaaaaaactgctcaaatacacaaaaaaatgagagtctattcatctgctggcctccattttttcccgtaaaatcacttcctcctcaaattcgatcatataagcggtgcccatgtgccaatgggcagtgactttgcacgggaaattgctctcctaaaaagtaaaatacgaaggttcatttttaaattttttgtttcttttacagtcaaaaatgcttcaataattccagcaatgaaagcagcgcaattcaaagagcctttgtccttgggcagtgaaatgaatgtgttcacaatcggttctttttcgatcagaaaatctgcaaaataagttgcaattgtgttgttgttcccatatcattttcacaacatttcttcgggtcctcgttgctcctctccaatttgtccgcctcctgcccgaaaaggttcttccagacagggcctttcaagaacatcaaaatgtgcagcagtttaacatctcttttgtaccctttctgtaacaaatgtatttacataatccgtttgttttgctctttgcctctctgattgcgataagatccaaaagtcggacaccgacaaactttccgtatccagtcaatctatgaaagttaacggataaaattaaagtgcaaaagattatttttatttaacctttcctggagtccttgaattgtggtcactttattctgagcgtagcgaaccatttcgacaaaaagcaaagcgaatgtggaaagatttatctgacaattacaaaaaatgagtacgcattgaatttgttttattggtggtaaatcaaacactaaaaatcaacagggcgcagccaaacttttgtaacaattaaagcgttattgtttttgttcaatcgcaaatatgcgtcgccaaattgccccttccgaatccaatgtccctaattccaacttttccgagtcacccgcacagagtgacacggcatcgcaacgaccaacccacctcatgtttccctttgctcaatgatttgtccaaaatgccaactgttcgcacggcactgcttctcatcatgcgtttaaaacactaaaattacattagctgcttatgtataataatatacaaaaagtaatgcgacaaaacccattgttacgcttacatgaacaggtgtgaattaaataaaaaattatttacacggaagaaatgagcaaaatacaaacattaattattttgagttaataaagaatgagtatcataagaagggatcaaatgattaaagcacaaagatttttagcgcaaggcaacggaacatacgaaaattaaatttaggagctaagtttcgataaacgcaaaatcggattaccgcagttttttggtttttgaaaggcgaagtttaaaaacacggcgagcaaacgcgtagagctccaaatccaataaattcctttgccgaatttgtcccaattgtcggtcggtgggaattacatgggcggatttgcttctgttccacaaggccaggtcactgtcaaaactgaagaagacataaatgaatcgcaatttgttcttctcacgttagtccgaaagttttctcaaagagaaattgactttccgtcatattttccttaagaccgaagaaagcaaaatgacgcaaattgaacttggcactctcgagcataatgcgatcccgaacagtcgaatccatcgaagatgaattgtagcaatttatgagattcaagtcagataacattcgtgtttgcctaagaatcatcgaattacccgaataagaaaaaggaaagcaccgattaaacgccaaattatatgggcatgagaggaacctttaaaagaaatatcagaattattaatttaacaaattcaaactcgtccagtgaaatgtttctccatccgactttcgggtcaaaacacgccggcaattcctccggcgtcggtgaccgaccccgacagaaaagccgagctcgtccccaagtcgcaccccgctcggacacgtgagtaaattcagaaatgaaacggtcgatcggattgcgcaaaaaagtggtcagaaaaaaacgacgtttatggcgacttcctaaaaaacgcatgtcgttgtgctgcagtgcatttgcttaccttctatcgcactcagtttgttgctgacacaattcgaagcgaccaattcggtgtaatcggcgtgcaaattgcacgcccaaccggtcgaatagcgcgaaaacagccaaatgcgcccaatcagttgccgacattgacaattcttctttttcatctcaacacatcttaaaaacagtaaaagatcattcaaaggcaaagaaattgggagagaataatttaaaaacagaggcggaagaaataaagcccaaacactccaattaattgaatagctagctttaagcttacaaagttaaatgacatttacatcactggtattagtcacgtcaaattttcctaattaaatgcgttctctatccctaata

SEQ ID NO: 2039 - DNA, 1417 bp, Heterodera glycines
tcatccataccacctaatccatacccaactcatccatatacccaactcatccatacccaactcatccatagcacgatacgagtcgtcgccgtggcatttaatgccacgaccgagaccgcataatcaaaaatgtccacggccaagaccggcataatcaaaaatgtccacggccaagaccggcataatcaaaaatgtccacggccaagaccggcataatcaaaaatgtccacggccaagaccggcataatcaaaaatgtccacggccaagaccacataagcagaaaatgccatgacgatgactcgcagcattatggatgagttgggtctatggatgagttgggtttggatgagttgggggtgactcccaaaaatctgatcaaaatgttattctataattgttaaaaatgggattttttaattttcgcctaatttttcaggacttttttgcattttttcgtgcttttttggatttttttttgtgacttttttgcctttttatgactttttttgtgactttttggcgattttttatgactttaagtcgactttttgaaggttttaatgacttaaattcccagccctagtgatgatgatatcgaataagatgtttcaatttctataaatgcacaattattattaagtaaataatataggaaatttgtttaattctcttcgatatgttgcttcggtcgcttcccttcggccgctcctttcccccgtgtcttctgcgacggagtgcctcttcattcacgtgggctttcaatccatcgatgtttacaaacattgactacttgtgagtttcgctttagaggcctcacttcggaacagttcatgaagagcccaaccaatgagccggtgctcgaatatcgcaagggaagcgcggaaagcgacgctttggagaaggaactgcagaaactgtgggcagagcccatggaagtgccgttggccattggcggggagaagacatttcgcaaggaaaaagcaattagcgttagctcagcttcgaaatggactaaaacaatgggcgaatacggagaaaatcaccaaaaattcacacctaaaaatattcaatcggtctcacgttgtctgcacaaacatttgtttggagaaaagaatctcgattgtctcaatttttctgccgatgaggtgcctatcaaatgcttttttacctgtatcatttaatatggtgaatgattgcaacttccctcaaggaccgtgttgaggcttgtctcgagttgcctcgtctccacgacaatggcaatttaatggaacatttccgagctgaggcatcccaacaactctctaggtttttttcatttttaaaattcttcatttaacaatgtttattaaaatttttagttacgaaaaactattgaatgaagcgacttggatggttcagtacaacaaaattcccaga

SEQ ID NO: 2040 - DNA, 2013 bp, Heterodera glycines
acctggatcatttaatatggggaatgatggccacttccctcaaggaccgatgttttcgattgtctcgaggtgccactcctccactaatatggaaatttaatgcaacatttaatagctgtacggagtctcactacaaatctcaatgcttattgattttttatcactcttcatttaacaatgtctattaaaatttttagccacgaaaaactattgaatgaatttatttggagtgctcatgacaaactaattcccaaaagaccgaagaaatgcacagctgatccaaagtgcacggtttacgatgtcttttattgaaatagttagaataacctaaattttctctaatgcgatgcatgcctactgctgcaccgacatctgagcctttccctgatgaggaattgctcttttttgatgtcgaagtgtgcatgaaagacccacgactgaccaccctgacggttgcactttccactaccaaatggtagatctaataatatcccgttttgtacaagcaatcccctcaatatttaaaagctttcgtggaatgtttatgtggggagatggacgagtctcacttttcttttttgctaaggtattcttggtgcagtgaacggctagctgatccttcgactgaacttcctggacttgttctgcctgaacatctgatcccgatgggcgacctcggccagaaaagtcgattggtcatcggacacaacgtcgcttttgaccgtactttcatacgggagcagtactatcttcaagtgtgtttttccacctaacaattcggttttacattttttatttggttaggaaactgcgatgcgtttttgggacacaatgtccatgcacatcgcaatcggaggcatggccgaccaccagcgcgacctcttcaacaaaagcgacaatgtgcaaactttggccaaattgtgtttttcgaggcctggacaacctgaaggaggacccgaaattgcattggaagctctgacgaaacggcaattaagtcgcttgaaggaatttagagtttgtgtcttttgtaaaatttacatttctaaaagtattgaaaatttcaaaaattttagaaaattgtgcgggagtggaaaaaacgaacatgcaaaaattcacttgaagcaatttatacgaaatactgcagcagagaaaaggcgttgattcaagtgaaaaacaacaaaaaagaagaggaaaacgaagagaacgaagcggagaaagcgacggaatgcgaaacggagagcaaaaaacagagcgaatgggacaaacggatgcaaagtttcttcaaaacggccacaattgatcaaatccggtcgaatgtgcaggtgtgtccatcaccaatcttaatttcatgcttttcttctcaattaactacgacacgcctttaaaattttgaaggttcttttcgattattgcgcttccgatgtccaagcaactcaggcggtgtttcgcaagctttaccctatcttcaaaaacaggtattttctgtctcttttgcattttatctgtcccttagattcccccacccggtcactttctgtggaatgttggaaatgggcaatccatacttgccaataacaagtgatggtccattctttttttgctttttatctttgaatttaggtaattggcgtcattttttcgagaaatgtgagaaggaatcctccaatatgaaagacaaaacggcaaaagatttcgttggctgtgcccgaagtttaattgagcaattggacgaggaaattgaaaatggaattcggaagtaaaaaaaatagaaaaattggttcttcagctaattagccattaattaaccccaattaacaaaactgtcccctgcttcttctgaaaatggcccccaaatgccttccgcctgaactttcgttagaattcgtgcttttcatccctgttgaagatgccattccgaatgtgctctcgtcctgttgcctgctttacaatattttgcggccacgtgtcatcaaatgggaaaaggtatgccatgccagttttggccaaggaatt

SEQ ID NO: 2041 - DNA, 3900 bp, Heterodera glycines
tttttgaaaaaatattcaaaataattaaccttattttttccgtttaaaattttagtaaaaatttaattccaagtaatttttggaaaagcgatcagaaccccaccaatttttgcagacatatctccccagtacaggactcaattctcttgaaaatattccaatgctaatttataagggcgattttttgaaaaaatattcaaaataattaaccttattttttaggcttataattttagtaaaaatttaattccaagtaatttttggaaaagcgatcagaaccccaccaatttttgcagggatactccccagtacaggactaaattgtcttgaaaatatccaatgcaatttataagggcgattttttgaaaaactatttaaaataattagacaaattttttaggcttaatttaaaaaaaattttcgaacagtcagacagtttcgggaggatgaatccttcgggaatagatttgatattccctatactttatatctccccgttaggtctgtcccgcccaaacttggcatagtgccggaaatgggcgatttattgaaaaaatattcaaaataattaaccttgcttataattttagtaaaaatttaattccaagtaatttttggaaaagcgatcagaaccctaccaatttttgcagggatactccccagtacaggactcaattctcttgaaaatattccaatgctaatttataagggcgattttttgaaaaaatattcaaaataattaaccttattttttaggcttataattttagtaaaaatttaattccaagtaatttttggaaaagcgatcagaaccccaccaatttttgcagggatactccccagtacaggactcaattgtcttgaaaatattccaatgcaatttataagggcgattttttgaaaaaatatttaaaataattagacaaattttttaggcttaatttaaaaaaaattttcgaacagtcagacagtttcgggaggatgaatccttcgggaatagatttgatattccctatactttatatctccccgttaggtctgtcccgcccaaacttggcatagtgccggaaatgggcgatttattgaaaaaatattcaaaataattaaccttattttttaggcttataattttagtaaaaatttaattccaagtaatttttggaaaagcgatcagaaccccaccaatttttgcagggatactccccagtacaggactcaattctcttgaaaatattccaatgctaatttataagggcgattttttgaaaaaatattcaaaataattaaccttattttttaggcttataattttagtaaaaatttaattccaagtaatttttggaaaagcgatcagaaccccaccaatttttgcagggatactccccagtacaggactcaattctcttgaaaatattccaatgctaatttataagggcgattttttgaaaaaatattcaaaataattaaccttattttttaggcttataattttagtaaaaatttaattccaagtaatttttggaaaagcgatcagaaccccaccaatttttgcagggatactccccagtacaggactaaattgtcttgaaaatatccaatgcaatttataagggcgattttttgaaaaactatttaaaataattagacaaattttttaggcttaatttaaaaaaaattttcgaacagtcagacagtttcgggaggatgaatccttcgggaatagatttgatattccctatactttatatctccccgttaggtctgtcccgcccaaacttggcatagtgccggaaatgggcgatttattgaaaaaatattcaaaataattaaccttgcttataattttagtaaaaatttaattccaagtaatttttggaaaagcgatcagaaccccaccaatttttgcagggatactccccagtacaggactaaattgtcttgaaaatatccaatgcaatttataagggcgattttttgaaaaaatatttaaaataattagacaaattttttaggcttaatttaaaaaaaattttcgaacagtcagacagtttcgggaggatgaatccttcgggaatagatttgatattccctatactttatatctccccgttaggtctgtcccgcccaaacttggcatagtgccggaaatgggcgatttattgaaaaaatattcaaaataattaaccttattttttaggcttataattttagtaaaaatttaattccaagtaatttttggaaaagcgatcagaaccccaccaatttttgcagggatactccccagtacaggactcaattctcttgaaaatattccaatgctaatttataagggcgattttttgaaaaaatattcaaaataattaaccttattttttaggcttataattttagtaaaaatttaattccaagtaatttttggaaaagcgatcagaaccccaccaatttttgcagggatactccccagtacaggactaaattgtcttgaaaatatccaatgcaatttataagggcgattttttgaaaaactatttaaaataattagacaaattttttaggcttaatttaaaaaaaattttcgaacagtcagacagtttcgggaggatgaatccttcgggaatagatttgatattccctatactttatatctccccgttaggtctgtcccgcccaaacttggcatagtgccggaaatgggcgattttttgaaaaaatattcaaaataattaaccttattttttaggcttataattttagtaaaaatttaattccaagtaatttttggaaaagcgatcagaaccccaccaatttttgcagggatactccccagtacaggactaaattgtcttgaaaatatccaatgcaatttataagggcgattttttgaaaaaatatttaaaataattagacaaattttttaggcttaatttaaaaaaaattttcgaacagtcagacagtttcgggaggatgaatccttcgggaatagatttgatattccctatactttatatctccccgttaggtctgtcccgcccaaaattggcatagtgccggaaatgggcgattttttgaaaaaatatttaaaataattaaccttattttttaggcttataattttagtaaaaatttaattccaagtaatttttggaaaagcgatcagaaccccaccaatttttgcagggatactccccagtacaggactaaattgtcttgaaaatatccaatgcaatttataagggcgattttttgaaaaaatatttaaaataatcagacaaattttttaggcttaaattaaaaaattttttcgaacagtcagacagtttcgggaggatgaatccttcgggaatagatttgatattccctatactttatatctccccgttaggtctgtcccgcccaaacttggcatagtgccggaaatgggcgatttattgaaaaaatattcaaaataattaaccttattttttaggcttataattttaataaaaatttaattccaagtaatttttggaaaagcgatcagaaccccaccaatttttgcagggatactccccagtacaggactaaattgtcttgaaaatatccaatgcaatttataagggcgattttttgaaaaaatatttaaaataatcagacaaattttttaggcttaaattaaaaaattttttagaacagtcagacagtttcgggaggatgaatccttcgggaatagatttgatattccctatactttatatctccccgttaggtctgtcccgcccaaaattggcatagtgccggaaatgggcgattttttgaaaaaatatttaaaataattaaccttattttttaggcttataattttagtaaaaatttaattccaagtaatttttggaaaagcgatcagaaccccaccaatttttg

SEQ ID NO: 2042 - DNA, 2323 bp, Heterodera glycines
  misc_feature (134)..(134): n is a, c, g, or t
ttttccattttacaaaaacaaaatcaaactatcatatttgttaagaaaagatatttatgcttaaatcgccaattactgggctcgtattttctttttgccagataaaacaataaaaaaatataaagtggggagtntaattttatctgtactgcttggtcttattgtattagtttttgttaaaataaaaaataatttgtttgctcacaatttgcaaccggcaaaaaagaaaaaaaagacctgatcaaaataaatggtcaattttgaagtaattataaaagcattttatgtaataaaatgattaaaaaaactataaaattaaaataattttacaattcccacttctttctccagcactttcactgttttttgtcattgtcaactttgacactactgaattattgaatttttacgccactttaactcttaggcaattaaatcttgccttttttgatgttttgtttaataaatgataactttggtttttgtaaaatcatcagtaggactgctaattttatgtaaatactttaaatactattcagaaaaattttttcataaatattccattaaataaatctctaaaaaatcctcccgtcttcatttattatcggaaaaatcaaaatttaatttccccattagtaaatttgcttcgactaattcccatttttttttgcaatttttaaatttaactctggcttttgacgaatatttccacattttacccgccagcgaaaaacgaacggagcggcaaaaccctcgccccgtcaaaccaatgccccagggaaaaagtgaaaggggcagcgaaccgccgccccgccagcgcaaaaagaaaaatcacgaaaaaatgttataatattttaaaaactgggttttatgatattaaatattaaatcattgcatcgcccaatgcactgaaacagcaaatttagtagcaaatgcataaaaaattacaaaattcaaccattaaaatttggattgatgggggtattcaatttaagttaaaaatttattttctgtaaattcttggaaaagcaaaaaagtttttgagaacttggggggaggaggtccagcggttccgataggcgccgccgtagaaaattttgaatatttaagggtgatttgttaacagattttcaccaaaaaatgacaaattttttgcgattttttgtcaatttgttaagaaaaaatgtgagttattttttggaagggcgatgggcggtgccattggcgctaaaattttaaacagattttcactgaaaattttcgatttttcggttaaatttagcaaaaattaatgattgttatgacaaaatgctaaaaatttgatttttttacataaaatgtacattttttacactcatacgcaaaaataccggtttccaattacatggaaatgaatacagttaaaattttctaagcacaaagccgaaatccgagtacgtacttggcatccaagtacgaatccgagccctgttataacacgtggtgagtcgaagtgcaaaaagtccgaatgagtgatgatcagaagaggcgggtcatttcagtaccgaataatattttaattaattaataacctgttttcgaaatccctagggggctggaaaattttttctagagaaaatggacaagctcactggaaagagcacaaaattctctactgatttgacttttgaataatggggctacgacttcttcataaaaagatatacttggttgaaaatttgatcaccataaaaatgatcaatttttgatcagcgtcataattttttctagaagcattcaaattaagcattcttggtatcatttgatagccctaagtgtcctctccaggaccccggcacatgcgacaaaaacattggggtgcttttaaatggtacatatatgaattttatcctttttctgtcaacactatccttggcctgttggttgtgctctggatttggctcttgggttcgggtcccccttatatgttgccgaaaattgaattaaaacaaaaaccctgggggtgttttaaataacaaatatataacatttgtcctttttctgacaacactatccttggtctgttggttgtactctgggtttggctcttgggttcggatcccctaacttgtgggtgaattaatcggattacatcctctcatgggtttggacccccgccatttattttttggataaaagggtttgcttaatttcttattatcggatatgaaataataaagttcaagaagtcttggtcttgtaccaaattttttggccttgactatgagggtgaaaggtttcccaaaaaattagctcataactaattttgcactatgggttttat

SEQ ID NO: 2043 - DNA, 3592 bp, Heterodera glycines
cattaataattttgataataacataactgggaccaatcaaaaatagaataaaaacttttttgagtattagagcttttgcttaatttcttattatcggatatgaataataaagttcagagagtcttggtcttgtaccaaatttttggccttgactatgagggtgaaggttttcgaaaaaatcagctcataactaaatttgcactattggttttattcactgcgggcgatgaacaacgaatgaaaaagttcgcgagggtagaattaggaacccaacccttgcgcatctttgtcatttccttccttgatcggtcagcggcgcacattttgctttcggcttcttaaccatatgttcataatgaaaaaagaatgtggaaacttttaccggtcaccgaagatgcgcaaaaatccggataaatttcgggtaatgcccattacaagggtcgtcgcaacaaaaatgtgttcttccgttgaaatttcgtatttttttccacccataatcacctaataaaatataatttgccacccaaattcaatgaaaacatgcctgaatgtagatggtcaagtaaaatataaagagcaaagccacgacagatgagtaaaaaatgtgccggaaaagggtggcaatgatcggtttgagaaaaacgggaaaaacatacaacggttgaccgtagccgaaggaagaccaaaggataagcagaaggccgagtatcattaacaccatagtgatgataaacacaaagccgatcaaactgaaagaacggtccacccattaaatgtaaaatccacgaaatgacgaggtttttgagtaaaggaaattgatgaaatggataattgacttaaatgaatatgccttacacctccctcctcccgataaaattgtcctcaatttttgattgagttcaaaatgaaggagagagtaaaataattaatagatagaaaaatgatttagatatttatgtagaaaataaaataaattttattaaaatttgaaaagaattaagcgaggaagcaattggtgtgccggtaatgtgattgtttttagcgctcgccgacgaatcgattggggcagtttcgcacagtgtggcctttcttttgacatcggaagcaaacgccttgtatttgttgggcattggcacctcgcgcgtaaaatgttcgtccgctgtttcggccggctgctgaagcatatgtgttctgtgctggaaatgcttgaaaatgggagggagagggggattgatttggctgattaatgggtcccgaagttttttgagtgaagtatggcaacttatttcccatataaaatccaaatgccgtgagcggctgcccatttggtccaacgagaatgttgttgtcacaattgtcaaatcggcctcgtatccctgtgtagagtcggcagtggtgacgatcacttcctcaatgctttcctcgttgcaccgctgagcaatgtcagcgtttgtccggcgtacaaacacaccacgcgaattgtgccttgtaaatttggaaccaaaatgtgtaaaagagcaattgtggcatcagtctgtcgtggattcgttgacgagaatgatgtttcctcctgctccatctgatcagtgatgtgcatgaacagcagcggcgaattttttacgggcaatttgaagttgctgttcttggttaaaagggtcatttcgtcctccgttcgtcctgcagcgattttttcccctttatcggcatatgtcccggcctcaatgcattttgtgatgaatgggtgcgatctgaatgaagttgtgagggttgttgagtcaaccgggagcgaattgtcaaagttgatgatggcggtgtcaagtccgaatccgtggtgcactgctggtggcaattccatcatgtttacgtgcaattggtacttgtcgccggtgaccaggacctttttgattgatctaaataaggagaggaaagacaaaagttgggaatagggcgctgtccggcttcatctaaaattatgtggctgacattttcaaaaatgggcgcaatttgttcgccaagtgaaagggtgcaaaagagtgcacgcctttttcaattccaagaaaaattttggcaaccgttccttcgtcagtctgtcggggatttgcggcacattgctccaaataccgtgacactttcttcttttcgagcccatctttaagagcttcttgaagatctgggccactcactgcggttgccaacaaatgctttgaaattttttggaggtgcacagcataccgatattttccgtttccgctgaaaagtgccaaaaggggaatttcagaacctgccttttgcaatgctttttgcatttcttcgcagagacgagcagttgcgatgttcaagggcgcaacacacagaactgtggcgtccggatcctcagaaagtatggccgccgcaattgtagctgaacaatacgtttttccggtccctggcggcgcctgcatgaagaccaatcgtcggatggggtccatcataaacagtgcggtttgttgttgtccttcgcatagagatgagagcgccgggtgccgttgcgtcaagctgtcccaagtgagtccttgaacaggcagtttttcgccaaggccgagcagtgcttgtccaattcgggcatcgtccatgtcgcctgaggcccaatctgaaaacgtgcggccaacaaatcgaaactcccttttgtttaatgagtccaacgactgcatgggccggaattcgccttcgtctcctccgtctcggatgcgcagaaagtcctcatacgcgtcgtattttttggcatcctgataagacatgaaaattttaatttttaaataaaatccggtttccaatttctcgcgccaattctcaatgataaaaccatgcccgcagggcttggctttatccgcttttgagagcttcatctgcagtggttgatcctcttcccatcgtttggcataatcaaccagttgcttctttgtctccagccattggtaaatccatgcagtgaacgagttcgtggtagaatgagtcacttctggcactgtactaattgtgaaatgggataatcggcttccaaacgatcggtgcacgctgaaattgctgctgccaaaacgccttcgctgaaacggatattgggaagggacgggggaaagggaaattcataattaaatggtgctttgttgagttcaacggccacaattggattaaagaccgatctttcgtcaccagaaaaaaatggacttttctctggcaaaatgtaaagttgtgaaactttgaaatttgaagggcgtgtgagttggactttgcctaccatgaccaccatgcctggctgaatttcctcatcgaattctgccccgaattgtcgtttgaaaagtcgttgataagggtggaggccagggctggcaaccacgatcgattgcatgcgtttctttttgttgtcgtaccgtacttcgatgacaattcctggctgatgagtgggctgctgtgggggattaggtgcgcagacagtaacgactgcttgagcattaattatccctttgtgaatccaaaatctggcatttcccccctctgaccctgacaattggcgaaaatcttcgcgccattcataacttacgaccctcacaaatca

SEQ ID NO: 2044 - DNA, 3038 bp, Heterodera glycines
  misc_feature (3021)..(3022): n is a, c, g, or t
gacgggcggccgaccttttcagcgcgaggcgcttcctctgctcaatttggccggcctgcaagggaatgttgtggaggctgcgccaatttttactttccattctttttctttattctgaacgccaaaatgtcttttaacctgttttttagggaatactttaatcgagacgccgcactcccattctcctgtgcctcctacgggtgctgctgtgactctgtcctcgaccatttgctgaattaccacataaactttggtattttttggattttcatcttcttcgtctgaagcgaccggtttttcgaacccggagttcgcaaatcctgagttggcaaactcttcaccccctttcaatttgaaagcctcgaaaggcacaccctttcgggcactctcactctccttcaccgcttttggctcttttgagccaaaatcaccgccgcccgtctccgtcgtttcgacaatggcatagcagtccattggcacaattttctgcacgtgttcggattgttgtttttccgtcggttgttcgctgttctccgtcggttggtcttggcaatgttattcaacacttggcgaaatttcgcttgccggaacggaatgaggcgaggaatttggagatggaatttttgccggttttgttggcgctggatcattttccgtttgtggccgttttcgatgactctttttgggcataataggattagggaaggcggaatttggaattatttttgctaaattttagttttttgattgagagagatcagatatgaaatgaattatgatgatgaagaataagggaaaaggaaatgtaaaggaaggacaatttatggtcggaaaaacgtaataagcattaggaattgattagctggaaattgattcatcgatgtttggcgccgtcggtgcatcctgaaagagggaaaatgaaacattaaaattaattaaattgattaaaatcattatcaaaagtcctgatttgtaattgattaaaaatctgacctaaatctttttggtattgttattttgtttcggtccctaagggcacggccattaaaattctcattttcattaactggaaaatcgttcggatttgtttttaaagaaatggtttccgaatttgtaagaggagtttcctcgtttaaccccagattgaccggttcatcagtttgttttgcctccaatgcttgctgcggatgatcgtagccgggcaggtcgttcatctcctccgcatctgctttttgaagagtttcctgttcgtctttcggaagtgcaggaagggtgcatgccggacctgttatatcaaagcacttttttaattgattaatatgaactctttttggttttgattgagggattaaacagctaacaattgttgcatgcatcccttctatgcctatgacacggaatagccctttccacggtaagtggtattttttggatgttccaattttggcgcaataatttttgaaaagtacccgatcaccaattttaatatccaatcctctgacatttttgtcatactgtattttcatgcgtagttgagcctcgtggctttgttctgctgcacttttccaagcctttctcaaacaacttatcaatcgttgtttgaattcagactcgtctgttattgcaatcggatttgggactctagagtccaaaatttggtctactgcaaaaattggatcccttccaaaaacaagaaagaaaggactttccccggttgattcatgaactgaggtattataacagaaattagcaaagtctaaaaaatcatcaaaatgtgggtcctgaggtgaaatgtatttggccattatattatggaaggttctaaaggtccgttcagttatggcattgccttgtgagtaatgtggagtggcaaatttttggtttatgtaaagaagtgaacaaaattctttaaagaattcagaagtgaaagaagttgcctggtccgaaattaattcagtacatccgccgaattttaaataacaaaaaccagtgacctgagggaaatgggaatgtaaatgcgtgggggcgaattttgaattttaaaataaagaattcctgaatttaaatataaatttacggactgtgctgccaaattgtccttctcttcgtcagtaaaatcaggaggaaattcgccagttgaaagaaagtcaatatatgtggcggcttcgggatcgtctctttgttcatccaccaagttcacttcgtaagtgttgccatcagtgtgtctgaaagtgagggaattgatgaaaggattaagaattaatcgggatttaagagaaatggacaaacaaatcggaaattcaattatgtcctcaatttcctttaaattttcaacatctttaattggtatatcgtctgcggccctcgagagagcatcggctaatgtattttgtttacccgctatgtgaactattttaatttggtaattttggagttcaattagccaccttgctaaatgagggtgtgtttccgcctttttaagtaaataagccaagggtttgtggtcagtatgcaattggatttcgctcatgaaaatgaaaggtttaaattcccttagtgcataaattatggcacataattctatttgaacaggaggccaacgcctttctgaagccgaaagtgtcctactgcaataggaaattgcagaaaaagtattaatttcttcgtttttctgcatgagcactccaccaagcccaactgtggatgcatccgtaaatatgtggaagggtttagaataatccggaaagattaaatttggtgctgacataagtaaatttttgattttctcgaaagatttttgttgttgttcgccccattcgaaaatggttttgtgccgtgtcaatttgagaagtggttcaacaatggtggagaaattttttatgtgccttctgtaaaaaccaatttttcctaaaattcttttgacttctttgacatttttagggggttcaatatcttagatcaattcaattcgactcattgttggggtgtagccacgggagagctaatgtaaaaccaaggaannattaatttcttttacc

SEQ ID NO: 2045 - DNA, 3213 bp, Heterodera glycines
  misc_feature (3175)..(3175): n is a, c, g, or t
catttttggaacagtctaagatgccatctacatatgctaaggagctatcatctaagccactaagcacaactgccattgccctcgagaaggcagctgtggcgttttttaagccgaaagggagatatttcatctgataaacattatcctctgttattaccccgcatttataagacgtttcatcgcctaatttaatttgtaaatagcccgaggcgaggtcaatagaactataaaaactacaatttcctttttttccatgatggcatccaatcttggtaatgggtatctgtcgggtactgtaacgtcattaagttttctaaaatctaagcaaggacggatcccaccatcctttttttgaactactacgaaaggggtcacccatggtgtatctgattcaaccataatttctgaggctaaaagctgatcaatgtgttttttgagttcctccctatatttataaggcattctaagagggggagaagaaataggttactcagttgtggtaagaaaattatgttccccgcctgtaaaagaacccaagtcgtattggctcttcgaaaagatgtcatcaaactcatttataagcgattttaacgcattaaggtcatctccttttaaattcgattttgaaaaatcgactttaaaagtaggatcaattttgagttttgtatttttatcgagcgacaaaatttgttccatcggacgttctgttaaaatgccatcattttcttgtaactcattaacaaaagctaagtgcatgcccttgtataataaaattggttcgctggtcggattaatgagggcaatgcgtattttaccctcgtgagggcacgagacagatggaattaggcctacattcgcttgaataagtttagactcgggattggtaactgttattgtattgattgatggaattatggcctcaatttgtgcatcaattaagttttggctgtttggtcctaaagtgcaatttttgagagctgcaattcttaaattctcaactaaattattataggatttccccaatggagtgctttttccattaataataagtttacgcgctgcaacgtcaaaagaaattacaggtaatttttcaaaggtgtccaatccgattaaaatttggtaattacgaatgtagttaaattcggaatcattcaaaaaatataatgttattttggttctgatacctaccaattcaaattcaacgtctgctttttctcggcataccatcagatgtccggatgcgctaattgcttcaagaaatgtcggttccactttgcatttgagctgatgtgcgatcgaacgtgggccaacagtgatgctcgatcctgagtccattaggcacctgactggtttatttgtacattgtaaaagattcggattattgtctgagttatttgttaaagtgttggaatgatcggaagggttatttaatggcttaatttgggtaaagatcagttcattatgaacactaaggcgttttgaggaatttgggccttttctaaagtgcgaaggtggtgcgttaccattagaagaatattgatttttgatcacaaagtaccatcgtaaaacaaaatcgacaaacaaaattattattaatactgtagcaattttccaaaaccaatcagaaaaatcaccaaggaatgtttcggttaatttctttttgatgtctatccattccttggcaggcataatcttggtaattgtttcttccttgtggatttggtaagaaatttggcttactttaactaaattattggcataagagtgggccaaaatgtcagtaacatttgcaattaccaggtgatgaaacgaataatggggaatttttggaatttcagcaatttcaaaatttagacttttaattgtattaatatttttaatatgtttcatgactgctgtgacttgatcaatagaataatattcgttgccaatgtgcagaatttgtttctaaattctacgcaaggggcttttcttgagtcaggaacaataatcatcgttatggtattcaaaaatgcatatttttcggttcccccaaccttaaatttcaatggaatatgttcaaaacattcattggcctggaaattgatatcctcgagaggaacaattaatctcttccaatttttgacataaggaggaaagggcgtgctcaaaagaaaattggaatgttttagaaatattccaacttaaaaatgaaagttcggactgcaattgtgagtccgtgatcagtccctcaaaagcccttttacttcgtgaagttttaattccactgttttgaattgttcggtgattctcgggttcctcttgatatccaaccgcaaaaccttggagagaaagggttaaaattttatcgcaattattgatttgttttgggtttggtgcaaattccagtaaaagtgggtcgtccattgctatccaaatattgtccataatgtgaccttttttaggtccccacgaaaggtactcacaatttttggtatctgagggctcccaaattatcagtgtgttgtcttctagaagacatttccctttctgatgagggcaatccgatgaatcccctaaaggagtgtgaataaatgattcaccaaatttggaagtgatttcagtttcaaataaataacaattttcattggattcatttttccaattccatgaaccgacgaaccatccccgtggggtgagatcaattttttgatttgtgtgccataatcctgactcatggattagagggcctattttacatgttttttgtttgaccatttggacacactcattataagacatttccagaacaattgggtcacgggtcttagaaataggaacaccagtgagagtcgtatatttttgaaccgtttttcttatttttcggcatgcccatgccttagttaaatgttcgaaaacgtttggatagtaaatccaataggtccgaaatattgggacttgtgagtgattcagtgaaatctgaggacatcctcgggttggaggaatagaccataacattcccatttgggaagtctggcataccatcggattaatcggcaataatgccataggagattttgaaggaatttttggtgaatttgatgacaccaaaggcaagaaaattgtgatcagacaaagaaatttggttaatttgggtccaatgccttcccaatttgttgttttggctttgcttttnaggtttggtgaattttcagaatggcctagacttgtgct

SEQ ID NO: 2046 - DNA, 1627 bp, Heterodera glycines
  misc_feature (1525)..(1525): n is a, c, g, or t
ttgagtcgcgcatttttcgtcatcgtccatgtcgtcctatgctgcaatatatcttaaatttttctgaccatcggtcaaatgcaatcactgattcctctccaaacgcttcaagacctactgaagtgagtgcgaaaatcccttggagttcatcttcggccaatgcaggtgtattctgtggaggaacgttcagttgcggtgccatcgtgttggtgcgttgtgagccgactgactgtgtcgatgctttgctcacgccagtgcctttggttgtccccgttgttggattcacaatttgatccgtcaaagtcgtgatttgtgcctgtaaagttgaaatatttaaattaatatcagctgcattattattaattgcctcagtgttttgattagtgcgcctatttaatgtcctaactgctcggttcattccgtcttctaaccttaagacatccagatgggctctttcaacgtcattcactttcacttgggttttgccaacccaaaaattccgatcaatgaccgaaatgcttaggtcattttggtctccgccgctcattttcgtatatgtggctcaaaagccaaaaagataaaaatttgggaaaaataaagaaaattgggaggaatgtgagaagaacgctgggttgtccaatgtctttgatttgcttgaatgagagagcaattagttaaatgtttagcctttgttaatgttagtaagctgaagcaaatgaatggctggctatgtatggttcatctgttttttatttgctttctccctttcagttaatcctttcaacagttaatctgatcaagcgctaatggcgctaagaaatgagcggaagcgagaaataatcgcaaatttgtaaaatttaaagcgtgagaaatgcttaatgtaggccgctaatgctttttgttcgcttggcttgcttatgattgtgaacagcgattatgtaaaatttttctcttatgactgcctacggtgagaaaggaatggcgagcgaatgattgtaatggccgttgaaaggcaaaaaaaaattttcgttaaaatgtcatatgaatatgggcgtaatatgtaaatttgcatgccaacatttagattttgcttccatttgaatttggtttgcctaagacatgcttaaaatttgaagttggcctttctttatgttgttaaataatttgggccttgcctcttttttctttttttttttttgcgttttcaaaataaattagtttggcctttctttgtttctcataatgaattaatttggcctttctttttctcaaaataaattaatttggcctggcctttttggtttttctcaaaataaattatcggatccgtatatagctctcgtgagagcgccgcgcggcatattcattccaccattttccttttgttcgaagctcccatcctcagtaacgttgtcatcctgaaagggcagacaacaccaaccatccggtgctaccaatgagggaaagaggtgttgggccgagaggatgcgctgatggggggaattgaggaaagggcttggggaangggagagggaactaaagatcgaatgccgagggaaggtggcactaccgctcggttggtgagttcgaaaactatgtccaccccccaaacccatcctgactccga

SEQ ID NO: 2047 - DNA, 3523 bp, Heterodera glycines
ttcaaattttaattttcaaaacttgtttacattggcagcctaaaaatgtattccggcgctgggagacgtttaatgggttagccgacatttgcggaccgacttttgcggaccgacttttgcggaccgacatttgcggaccgacttttgcggaccgacttttgcggaccgacatttgcggaccgacttttgcggaccgacttttgcggaccgacatttgcggaccgacttttgcggaccgacttttgcggaccgacttttgcggaccgacttttgcggaccgacttttgcggaccgacttttgcggaccgacttttgcggaccgacatttgcggaccgacttttgcggaccgacatttgtgactaaaaaattatcaaaaaaaaagaaaaaaaaatttaaaatgaattttcaaataatttttcgtaatcaccaaattgaaataatgactgaagatgataatttaatagtgcttcttgctctaacaaataagctatgtcaatttcgacatacttttttttctttaatcggaaaatttacccacaactaaacgaatttattacatatagtttattaggcaaattgattaaaaaatgctttatacaaaaatcatatcacaaaatatatagcacgcaaaatttttcgtgtttcacctactagccttagtttaaagagcttagattttgatcaggcatacctaacaattaatatcaagaacaaataaaagatataaaaatatatatctttaaaaagcaaaattaaatgaattactcacattatcaatgacaatataattcttgtaaatcaggaatttataaactaatgcattgcacaagttgatcagatcactacttaaggatgatatgaagtgatcaaatttttagcaccaagaggaattgaaaaaagaactttttggaaaaactttataaatttttcatattttcattcgcattaacttgcttaactccgaaaaatcacatataaaattcaatattcagatgatcatccaatttaagaaaaaaaaatttttttaaattaaatccagaaatgatgacccgcaaaagtcggtccgcaaatgtcgcactacgcctcaaaaagtttctttgaaaaaggcgccgcaaaaaagttttttttatcttgttttatgttttttgactataaaaagttgtagaaaaattgcacttacgtgtttagtaatttcgcgttcttgagcgggcgaaaacatagttgtaattttatgcataaagattccgatttttccaattttttgcatatatttttgcattcggcatttttattatttaaaaacatatttattatctctctttttgtgtactaatttcatattacaagcggacccccaggatcccgcatcaaaaacccaatttgcagatctgaggtatacattaagggatgggagacgacgccctcaaaaaattttggcaattgaaaatcggcattccactggcttaaaaaaatttgggaaatctgctaccggaactccggctcatgtcggaaatcagaatgtccttgatttcatatatgtatgtaggagaaacgcaaatcaatgatttattattatttagcactaatttataattgttatggcacctcccgccgaaaaaaagaaaaagcattcctccgccgaccgccgtctcatttcttcaactaatgcaaatcaacagaaacagccgttgggttcgcttgtgacatcgtatggaaaacggcgaagtgttcgcgtggccgtgaaaaagaaccgacggtaatgaaattttgaaaattaccaatttgaaatttaattggttttccgcatttttagctgggtttgcaacgacattttgatggacattttccccctttttgatcgtctccaactcggcctcaaattggcactgatttctccacgtttcgatgcgctggtggacaaacattttgatggcacaaacgaattgacactttcgagaacaatcagaattttgaaaacgggagtaaaaaccaaactaactgtacttatggatagcaatctcaacaattttgtgcgatttccgttccccaacaagccgatgcccatcaaaattcgttttcatttacttcgaattgagtaagtcaaagaattattatttattggttttcagtgtcgcagagcccgattctgacatccatttcgacccaatttgaattctgaaaccagattcggacaaaaattcaacaacaatgatgaaacaaaatgcacgaaataaacggagaaaatgatttttaattttcatacttttgaacagcttttgtcgagaattacatttttgtccgaatccggatttgaattgagtaattgggtcgaaatggtgtcagaatctggttcgccgaccctaaaaaacttcaaaaaaaatttttttcgagacctgaggggggggggggggaccaccattactcttatcaaaaacattccttttcaggcacatagaccattttgtcgtcaccttccttcgttccaaccagcaaatttttgacaaaggcacagctttccgtttgtatgtgccattatcctataaacccagtgtgcagccaatttgggatgtttttgtgcgtgaaatttggcccatctttgcgaccaacattcgccatttgcacatttgcgatggccatcatttggacaattttcgtcgtctcatttcgcccacaattctcaccgatctcaatcaattgaattcaatcgattccgaatcggtctttcccgaagcgattattggtgattttgatggaccaaatgcaactgctggtcaaattctgtccaaatggttgcacactccgacaaatgatggccagccgaagcaattgaattgccgaaattattatcacgcatcaatgaccgtccacgaatggctccgcaatttcaaagaggtcaaaagaacactaatctgtttttaatctgccatattttcaattgtttaggcatttctccgtgccaccgcttctgcttgctaccaaattcgtcttgaactttctaagtcaacgcaaattgagcaatttgaactgaagaacgaacggatcggcgaaaagctgacagtggagaaaaagggcgaaaatggacatacttatagtgttgattggctgttaaagcgatgccaaattgggaagacggttcagtgggaggaagaaaagacgacgaacaatttgaacaatggtccactttatactttttggagcttcatccattgggtgagagtgccatcagtttcggaacaggacaaaattttgccgtgaaaattttaagtttcagtggcgaaattccggcgaattttagcggcgaaattttgcgtgtaacccaacagttttgtgatgtcgtcacatttaaattgcacttcattagtccgttgtctcaccagcgactgggtaaaatgaatgcaaaaagtcgacaggaaatgaatcccgggaccagcggccagcagtagaataaagcgaatgaattattgagacaggacaatgtccgataattatgaagtgggaaagtgatctgataattgctctcac

SEQ ID NO: 2048 - DNA, 5671 bp, Heterodera glycines
  misc_feature (5358)..(5360): n is a, c, g, or t
  misc_feature (5363)..(5368): n is a, c, g, or t
  misc_feature (5370)..(5372): n is a, c, g, or t
  misc_feature (5374)..(5374): n is a, c, g, or t
  misc_feature (5378)..(5381): n is a, c, g, or t
  misc_feature (5384)..(5384): n is a, c, g, or t
  misc_feature (5388)..(5392): n is a, c, g, or t
  misc_feature (5397)..(5398): n is a, c, g, or t
  misc_feature (5400)..(5400): n is a, c, g, or t
  misc_feature (5419)..(5419): n is a, c, g, or t
  misc_feature (5422)..(5423): n is a, c, g, or t
  misc_feature (5431)..(5433): n is a, c, g, or t
  misc_feature (5444)..(5447): n is a, c, g, or t
  misc_feature (5454)..(5455): n is a, c, g, or t
  misc_feature (5459)..(5460): n is a, c, g, or t
  misc_feature (5466)..(5467): n is a, c, g, or t
  misc_feature (5470)..(5470): n is a, c, g, or t
  misc_feature (5478)..(5479): n is a, c, g, or t
  misc_feature (5484)..(5484): n is a, c, g, or t
  misc_feature (5486)..(5486): n is a, c, g, or t
  misc_feature (5488)..(5488): n is a, c, g, or t
  misc_feature (5491)..(5491): n is a, c, g, or t
  misc_feature (5496)..(5496): n is a, c, g, or t
  misc_feature (5507)..(5508): n is a, c, g, or t
  misc_feature (5510)..(5510): n is a, c, g, or t
  misc_feature (5517)..(5520): n is a, c, g, or t
  misc_feature (5530)..(5530): n is a, c, g, or t
  misc_feature (5542)..(5542): n is a, c, g, or t
  misc_feature (5547)..(5547): n is a, c, g, or t
  misc_feature (5550)..(5556): n is a, c, g, or t
  misc_feature (5561)..(5562): n is a, c, g, or t
  misc_feature (5569)..(5572): n is a, c, g, or t
  misc_feature (5576)..(5576): n is a, c, g, or t
  misc_feature (5598)..(5598): n is a, c, g, or t
  misc_feature (5602)..(5603): n is a, c, g, or t
  misc_feature (5606)..(5607): n is a, c, g, or t
  misc_feature (5611)..(5612): n is a, c, g, or t
  misc_feature (5652)..(5652): n is a, c, g, or t
tttcagtttacgcgcccaaattcatcatgatcatcctcattttcgggcgacacccagcattattattattttaatgaaaaagttttcctacttttgatccttcccccattaaaatggcaaatttttaatttgcgtgtggtcagtattaaccaatccgttcgatttccaaaaaatgtttttacaagtgaactcggcgattgctgctgatttcactaatggtgcagaagaatggacggcgccggaaaaatgcttttctttttttgatgggcggtgacattaaattattttcgcttgtaatatagaagaaagaattgcagaatttcttataaaaattagaatataagcagcgacaagccgtaagaataataagctcaatatatggaaatgctatagaaatttgctatagaaatggttaaataaaaccaaacttgcaaacgctgtaaaatgcgaacactgaagcattttttcagtttcaaaataaattacggtactcagccctcagcagtagaaataaggtaatgaattattgagaaaggacaatgtccgatatttatgagtggaaagtgatctgataattgctcctcacatttatttgttgcttctttcgttgcaatacatttacatacatttaatttgttttggtttttgcaaaaatggttttaaatcctcaaaaaatgccaaaaattgtgtaggcatgattcttaaaataaagtgccattggactaataaaagtcgattggcttataaagtgcaggatagtgaattttgcgagcaaaattttattctcgagttcgaaccgaaagtctcaaattgaaaaattttcgtatttttggttaagggtatgctctgccttacatcaagaaaataatttataattcataaatacgaacaaatattttcaaaccaaaaaaggaaatcaaaattcgaaaattatttttcggcattctgttcgaattcggggtgacgaaaagggtgatggattcgtgatcatcgccccaaaaaccctcggaaatatcttttcatgacttttgaaaacaaaagcaaattttcgaaaaatgggcccatagtattgccggttttttattcttaaaaaaggaacattttccaggtacataagactggaaaattggtgtcccggcaaaaataaatttaataattttcttttcgagttttctagtgtatctggggtttgttttcggaatcactgatcacgaatatgaccagggctcgcagatgaaaattttcaaaagcctcatttggcaagcaaaaaagcctcattttgggtcaaaaagcctcatttttacaaaatgtattctaaacacgcttaaaattttcaaatgatatatttttgattgtccatgatcaatttgagcaattttttgttcgaaataagcattttgtgaaattctgagcatgaaaaactgaagttgatttttttgcgacgctttttgctaagaaacctttttgaataaggggccggcggtgccgataggcgccgccgggaaaatttttgtgatttttaatacgatttgttaacagatttgtccacaaaaatggccaaattttgtgagtttaagtaaaattttttaagaaatttaggatttttagggtccggcgggagaaaaattgagaatttgtaccatatttttagcagattttcattgaaaaaattcttaatttttgggtttttttttggaaaaaattggttctattttcgttttgatgctctattaaaaacccaaattattaaataattgtcaaacattatgccaatttatcaaaatttaaaaagattctgaggattttccccaaaagcctcaaaaatcctcaaaatttctcaaaaagccatgaccttagtttttggccagttccgatcaaaattaatttactaaattatttgattatatatgattattagggctgccattttatgtaaaatagagtggtgaaaaaatggtgtgggaaaagtcggggtcgaagttaaaaacactagaggtgcgccatgactgaaaaaacccgtgaatcgtgaccgtgaattggttccgtgttgggaatttaagtcagatgacttttctgctgacgcggaatgccgtaaaattacttaaaaagggaggttcaaactatgcatttttgacttttttctactctaagcaaatttttgagattttttcgtgaattttagttgaccctttaaagactcgcgacttaaattgccagtcctactttttgttccggcccaaaaatacacagcacacttgcaatgaattttggtcgtctaaatttgactttttacccgaatccgatttcgtagttcgatataggtcggaactaaggtcagattcggattctgcgccccttaaaacccataaaacaaaaaaagagagagacaaaatgagaatggggtaaacccaactcatccatacccaactcatacatacccaactcatccatacccaactcatacatatacacaactcatccattgcacgatacgagtcgtcgccgtggcatttaatgccacgaccgagaccgcataatcaaaaatgtccacggccaagaccggcataatcaaaaatgtccacggccaagaccggcataatcaaaaatttccacggccaagaccacataagcagaaaaatgccatgccacgacgaagactcgcagcattatggatgagttgggtatggatgagttgggtctatggatgagttgggtatggatgagttgggtatggatgagttgggtatggatgagttgggtatggatgagttggggatgactcatgagaatggataaatttaagggacccatctctttttaaattttatagaatttttatacaaacaactgccaatatataggttttgaaaaagccccgaaaaatagcgaaaatgacttcgaatttctgaggaaaaattgttttacaaaaaagagcatcaattttttcatactttcttttctctaggggctggggaaaaagacaaaaattctatccctagtgactaaaattcaagattttgccagatttcccaaaaaatgccagaatacgtaaccaccgctgtctgctggtgctgagtttgctatcagtagcagggctgcacgcaagtggatttacaattacggaaatccgcaatccgcaattgcggcgattttctcagttgcggaaatccgcaatccgcaattacgggtgtccaaaaaccccgcaatttccgtaatttccgtaatccgcaatccgcaattaaaaaaaaattttttaaataattttaaattttattttaaaaaatcctataaatcttttaaagcaatttaaaagcatattaaaaagcaaatttataaaacaaaatcattcaattgagaaaccggttaaaagcaaattgtgatgaagaaacaaaagttttgcaagattttctggtaataaactctttcgcaagtcatctgaaattagaccggccgttgagaaaagcctctcactttctgaacttgttgcaggcggagaaagaaatttccgtacaacggcaccaatcattggccatttttgtgaattaacttcccagtataatgctggatcgaccctggatttaatttttggatcccgcaaatattcatttacttcaacttcggctttttgtcttgtctccaaggcagatggactgggggatgttgccttaaattaattattatgaggggtatataaagtttatttacagtattcagtattagaaaaaaattcattttataaaaaataatcttacaagaaatcgtctcgaaaaataatccaatagtcaaattacggatcaaaattgcggataaatcccaaaaatccgcaacccgcaatccgcaattacgggggtccaaaaatcccgcaatttccgtaatccgcaatccgcaattgcgtgcagccctgatgagtatagaatgtcataattgagacctcctatttatttattatttactgaaaaaattgaacttagaaaaagcaaaaaactaaattttgtaaaaaaaaacattacgcgaattttgctcatcaagaatttttgcacaatttttgtattctttccaaaatttttcgatttaagggagtccaaaattttaaaaccctgaaatatggaaaaatatggaaataaaaaggcatcatagaagcattaaaccaagctaaaaatacgaaaatttggagaatttttaatgatgcttaatatgaaatgacctttatttattaaaccggggtttaagcgtaaatttaaataaaataataacaaataaaagttgaattgcttttcgacgaggaatggtaaccattatagagaatttttttttttgctaaaatacgttaaaacattcataaactaaaaaataaattaaaaaaggcagtatataaaaataatttgctattagctgtaatcatcttatttatgagcacagttttagtggccgtatacacttccaaggagagcgccacggaattccgacggaaatgccaaaattcaattcattaaattgactgtattggcaacataaaatgattgattggcattaaattgttttgaggcaggagaaggattagaaaaaaatatagcaaggaagaagcatctctcaataataaattggcaaagaattagtaattaaatatcacgcgaattcgttaccgaaaaatacgtcagtgtaaaattcgtccgaatttataaaaaatataattcggtaacattttaagaattattgtataaaagatctatatagtaaaaaagcgtcaattgaatatttttggaaggttcagaaacatcaatgaaatttaaaaaattcaaatttgtaaatttgtcaatctcgattttaaaactcgagattcaagcggaggtggctgcgccgagaatctatataaaaagtgacttttttaattgattttttttaaacaaagtttgttctattcgggtggtgttcccccgagaatttgcattattttcgttttgcttttgtgtttttctcttcctctccatttccccactctttcattattgtatctgtctttcagccaaaattggcataataataggagggccaaaattggtatggcaaaacgagggccaaaataagcatgttggaaagctgaaattttgatttaaattccgaattgacaaatgcatatgaaggttttacccccccccccccttcccccttatctcgtgccaaaatatgagacacaagactaattcccgacgagaatttgtctccgacttttctttcccaaaagtcggggaaaaccatagatggcacacttgatgttggtcttttattcacacggacaatttaagcgaattacattgagataatgaaatgatagtaatgctctctttatgttggaaattnnnttnnnnnntnnntntttnnnnttntccnnnnngtgcnncntccccctggccctggttgnccnntctttgcnnnttcccctttcnnnnctgcgcnntggnngtgggnnggncctttttnnttttncntnttnttttnttctgcctttnntngtggggnnnnggcccgccgncggtggctccgncctgnttnnnnnnncccgnntttttcnnnntctncgcatgtaaaaagccttccggntttnnggnntttnngctttttttccctaaaataagtcttagcttttttgtcganagtattttttagaaattta

SEQ ID NO: 2049 - DNA, 2462 bp, Heterodera glycines
  misc_feature (2425)..(2425): n is a, c, g, or t
  misc_feature (2428)..(2428): n is a, c, g, or t
  misc_feature (2438)..(2439): n is a, c, g, or t
tttttaatgattttttttaaacaaagtttgttctattcgggtggtgtcccccgagaaatttgcattattttcgttttgcttttgtgtttttctcttcctctccatttccccactctttcatgcaacatcccactggccctggttgaccaatctttgcaaattcccatttcaaaactgcgcaatggaagtgggaaggacatttttaattttacatattattttattctgcctttaatagtgaggaaaaggcccgcagacggtggctccgacctgattaaaaaaaccagaatttttcaaaatctaagaatgtagtaaaccttccggatttaaggaatttaagctttttttcgtttttaaattgtcgaagtattttttagaaatttactgtctcactgacgcattttctattgacgcattcaaagcatatgggcttttagggattcttttttgtcgatttatgcctgaaatttagagcccggaactgggatttaggtattgagtcgagatttcgctagaactcacaaaattctcaatgaaaaataatgaaaatttcctcaacaatttttcccttattatcattagggcttgccaaatatgaacaaaattcgataatcttaaacaaaattgtaacgtaaggccggggacagaagatttttttgtcgatttatgaattatttttcatgatttttctttgaaatttttcgagttagtgcgaaaacaaggcttaataccttaaatcatggttctatgctcaacagaattacacaatctttatgctcaattcagtcaccaaataagtttatcgaaatttcgacgggttctcttttccgattctttcaggctcgagtgcattttgggcgtccatcaatgacaatcctcagtttctttggccataactttttttctcttaattggtcatgcgtttctcaaacgaatgcttaaagtctggggaatttataaatacaaaaaaattgcaaaattgacattataaatacatgaaattccgcttttttctaatatattcaagaatatttttttgtctgttgtttttactagagtgccacgggaccgggaattttgggcaaacccgggaccgggaccttttcgggttgaaaacccgggaatttttggctgggaaaaccgggaaaaaaccgggactagtcccggtcccggtcaaaaccgggaccttggtactcagttgtactcaattgtccgctaccaggtcccggtcccgtggcactctagtttttacccagaattaaattaaggagaaatttctataggctttaagcttcattgttaccaacaatgtaggcattgaccaagtgagaaaaaaaagttatggccaaaaaaactgaatatggcgccattgattaaacacctaaagtgcacttgggcctcctttgcatttatccatcattttccgtgttttctgatgcccatttcatccacattgcttccaaatatttgtcaaaactgtgtcgaagtaatccttggaatcccatgacggtttatgcttaataaccctagtgatacggtaccaacgaacaatgtgcgtatcgggaacagacaccctttagtaccgtattatagcggcgacgaaaaaacaaaagcatcaaatgtgctaaaaaaattcgatccctgacgattactgtactattacaaatgctgcgtcactgagtattgtaccgtctcaacaatagctgctgtacttgttgtataacaagagtacagtaacatcacacaccttgtgatctggtaagtaccgtaccacctataccatacgctttgacaaatgagtgaaaaatcaccttcataaacttcatcacttaatttctggttgtccggttttttgctcgccacttgtataaacagttcttcagcttgaaatgtaggtttggctaaatttaattttattaattttccaaataatttttaatgagtttaaagagctaaatttattttaattaccggcagtttttctgtatttcaacaattcgttccaatttagcaatttaagtttttgtggctcaacatcgacaaaattttctaattcaaatccaaaatttaaatttgaaattttgcccagtgcactaatgacatcaattagcgtaagaattgtgccgctcatttcaaaaattggcttcacagccgaagcaactccattatgcactcggaacaaaaactcataaaccatgtccaaatatgagcgaaattttttgcattccacattttcctcatactgtaccaatgctgagtcattactgtaattgggttaattgatcattagcaaaggctaatatttgaagctgctaaaagtgcccagggcaaaagattggttgctaagattttctgccatcaaattgctacaaaatcacggaattcctaacccaaaaatgaccataatattcgttttatgccttgnttnacgtcatttnnctgcgcgtttttgtcgctgctgc

SEQ ID NO: 2050 - DNA, 847 bp, Heterodera glycines
ctcaagtattttttaccttgggttcatattttcgacctactatttactttattttttgcacgaaaatagtcacaatccttagatttttcgtccattttaaatggtcttattttgcaaatttagaattattcttattatattaatttcaccacgctttccacttcgtagtttagcaaatgcaaaatgagttcgtcctttttctcgccataatttttgttagcatcggcattttttgatgccgatttcgatgatgatgatgatgatgatgaaaatgatggtgatggtgatggtgctaaggtcaatgaggataatgatgatgatgataatgatgatgatgtttgtgccatatccatgccaaataactgtccattgccagtcagaaatattttctgctccatttcattttgttccatttttgtcgcattttcttttgctttattatacattttcttcatgattttttcaaacttggcacgtgcttctgctaagttcttttcttctaaaatggcaacaaacagttttttctaggacatagtaatgtcggcgctagttaaaaagttgtcctttttgaaaattttttcactttttttccatgtaattttattttataaatgataattttttaaattcattttagcaaatggttaaagtttcaaggtattctattaatgattccaacaatctgccgttcatcgcttttccaacattggacgatataaatttgagatggcttttttcccaaaactctgaagagattttacaatttttggcacacagcggacttattcaaaataaatgtttatgccataattgttggaactatatggctctgacaaaacgtagccaa

SEQ ID NO: 2051 - DNA, 1014 bp, Heterodera glycines
atttccgggctctttttaccgtctgaaccattcgaataatcttagtcgcccttttaatgcatcccgccagcccctaaaaatttctttttcaaaatgtcaggtattttttcttttttggaaatttaattggaattttttcaaatttctaagaatccgcaatcctgcgtgggatcctgaaatttaaaatgcaggattgcaggatttgcaggattaatccggccgggtccggtcctgcaaaaatttttgaattccaatcctgcaacaggatccgcaaatttgaaatttccaggctcttattaacactgagctttattgatgcaaaaataaaaacaaatagatttttaattagaaagagaaaaaaataaactcgccaaaatttcgtttttgattgattggcacaacaaaatcatatgaaaaatcgcatgccaccatttccacattttcaagtttttgcctccatttttaggctcggcgacacttttgagatacataaaagcatcattgtcatttaaaaaaattaaatggaatttctctcattaaaagtactcaaaatgaaaattcacacattttcaatgtggaattttatgggcattcaaaaaagcagcactttatagcaacaatggtgcagattttttaatgaaaataagaaaattagtcattttcgttgtgcttacccaaatttaatcaaataaatttatattgcaacaatggttgcacagttatctcacaaggaaaagtaataatgaataattgttaggaaaatgttgttcatgttgtatgtcccaaactcaaaactagggttcgagccccgcccccgtccccggggatgggacaggttttttggcctcacccccgcccccgtgactcagacccgcgcaatccccgcccccgcgaccttcgcccccgcgggtggcgcggggtgaaaatacaccccctaagaatgacatagtcgtgggataaaatgcaaaaaatttgtacaattttgaattttttttttaacattgaaaaattttt

SEQ ID NO: 2052 - DNA, 6846 bp, Heterodera glycines
gggacaacagtcacaaaagtgcttgcagtttggccaatgcaatcggaccacagtgaatcagggagagcaggttgaactttatttttattttgtttttatattttcttttgttgtataggcgcatgcagccttgaggaagagcaccgattggtgaacactgttcgctcgttgatccgcattaagaatccgaatgatcgactttgtttggccagagctgtgttgtttggtcttcacgattggcgttcacggtcaccaggcggaggcggaccgacagcattcaaaagtttcgcaaatcgccagcacacccacgggcctgatgcacgtaacttattgagacgtgccgcaattccccgcaataaacataagtacacaattgatgacgtccaaaaagtacaagattggattgatcaacaatacgggccaggagaaattcgaattgcagtttttgagaaggaacgtgagtaccgaattgtgttcaaggcagcatccggcgaggcagccaagttcaacttgtgtcttttgttcgaaaatcaacacttcaactacattggtcgaattgagcaactgtttcgtgtgcaaggatattgtattgattgtgaacgtcgcgtgacacgctggtaccacccgcaggaatgcaaagtcgtctgccgtctgtgtttacgttttggcgcagggtatccatgtaaacaacaacaataacagcaaccctagcagatgggtcaactggcaatcgtctttgccgtgattgtcaattcgtttttccaaatgacgactgcttcgcctatcatctgagcaatcaggcacccgcaagcatgtataatcagggaggacgcacttttcgcccaatatgtgaatggagaagagcatgccgacaatgtggagccataacctatgcgaattatccacataaatgtccagcccaaattggccaaacggaatgggtgcgctgtgtacgatgctctggaccccatcaaagtggagacccttgttttattcagctctcaaagatgatcctatgaggaggaaaaggagaagaagagggcaacagcatatagctttctaggcaaattctatatgctgtgcgtattgcaataaaatcgctgttttgcaatttggattggtgacaacggctccgggacaatcggacagtggacaatcggacagtggacaatcggacagttggacaatcggacagtgaggacaatcggacagaggtggacaatcggacagtggacaatccgacagtcaaatatacaaatagataagaaaatgccggtcgccgaaagggaccgattttgccatatcaagaaaaaaaaggaaaataggcaaataaattaattattttttgcgaatgacctagaaaatgtaaatgatgtgaaaatgcgatgataaaaatgtttgccaaattacttgcaagtaaaaatgaccattctcgtgcactgcacaaattaacacttccttttccttcgaaaattttcatttattccctcaaaaaatgtattcctcatcttccgaagaaggcgaaattcacgagcatccacagccaaatcccccagttcaagaatttcatccaaatccacaagcccatgaccccctcccgaaccttcaaccaaatgaaaaaatgttttttgttgctgaaacaacacagcaccgagttgttcttttggcggacggctttgagtacaactttgaagccgatagtcgaatggcggatggtgagattctttggcttttctggcaattttggcttagggattgagatttatcgctgtgtacaccgaaatccctactgtcctgggcgtatacatgtacgtggggctgtacatcataatgccgctggacgaccatacaaaattggaattgtaaaaaatggcaatcacaatcatccggcttctcatgaaactgttcgagtggcacaaatgactttgaggacatcggctgaagcagcaaatccaatgtcaacgcgtcaagctgttgacaataccagagcaagcataccagaaggggtacgagctgcgcttgcaccatcttcttccgcaatggggcggtcctatcgtcgtgaagttgccaggcaacgagcagacgcaggtgacaatttgttggatgcgcaggatcccgacgcaattgtcattggacaaattcttcaaccaattacaatttttgatggatatgttgagggccagagggtaattgtgtttatgtcggaatttggccgaaacatggttcaacaatatggacagcacttgtcgattgatggcacgtttaaagttggtatcccggtttaaaaatttggtccacgttttttaaaaataggtggcacctactccgttttcgcagctttataacgtttcggttattattgattttgctgctgtcccatgtgcatatgctttactaaattccaaaacggcacagcattatcgaagcgtaaacttaagtttagttattttattccatataattttaggtttttgcggccatcaaaaataccatcccgggttgggctcccgtctccatcatgtcagactttgaacagtctgctattgcggcagtaagaggggaattccctcaggcaacacacagtggctgcctgtttcattttgctcaatccctttacaaaaaagttcaaacattaccgcatttgaacacactttttttggcggcaaaccaagagggccatcagacaaaaactcttatcaaaagtcttataagcttggcattcacacccccgggagagccactatacaattatttttgtgcggttattcaccagtttgatcatcatcctgacgtcgaaggtcctaaaagttaatgaaattcctcattgttcgtttatagcattggtccagtattttgttatgaattggattgggtgtaaccgtgtttggcaacttgaacccattccaattgaagaagacccggatttgggtgcttatgggcatgttgacgagtgggtgcgaaatcggatccaaaaccatggcttacaagcaaggaatgcaacttttccacaggaaatgtggaatatgagtgaaaggtcgaaataaaaaaataataaaaaatatattaaaattaaatattgtcagagttgaacaaaatgttatgaggacaaataacagcatagaaggatggcatcaatctttcaacagccaatttcgttttcttcatccaccattaagctattttgtcaaaaagatgaaagcagaagatagtcattggaatttggttgttcaagatttcaacaataacccgcagaacggcattcgtgggcggggaatggcaagaaagaatgtttatgttcaacaagacgaagcgatccgtgctatttttttagaccgagccaaccgtccctttttggcctacctacgcgcaatcgcttacagaatgcctgacccaaactaatttagaaagaaataatgttttagataacattcgtactttttttcgcattcatacaaaacttagcttttttaaaactttaatttactgtccgattgtccactgtccgattgtccacctctgtccgattgtcctcactgtccgattgtccaactgtccgattgtccactgtccgattgtccactgtccgattgtccagtcacggtgacaacctttgtagatatttttatccgtttacactaatatagcctttcttggcaaattctaaatgctgtgggtattgcaatacctagaagcatgaactcaatgttgccaaactagatcggaggaagcctcgcaatcttctgaaaatagttgatttctacattttctagtatgtcatcgtaacaaatagaaatactgatgcattgtagacgcattcgatgccaaaattcagcccatctacgtgtgcagaaagtcaaccttcctttctgtaccatgtttttgtttcgaaaatatttccaattttgtttatgatgaaatagacaatttacaaaattatagaaatattagcaccactacagtaccacaaaattctttcgtaaaacacccgatcaactgaaaagtctgatcgctagaatatgtagctttgtgccatatgagagaaatatgaaataatggtatgagggatgttccaattacatgcttatgctgttactaaggctacttttagcggcacatctgtaatttgtgcaacccttattatcagtgagattaaacacaggattagagaaatgccaacctagcaaacgaagcatagcatagctcaagcccatgtggaaatcgctgttttgcaattctgatttcataatattgagtaaatcaagcacgctgagtccaactatggtcttagatttatgctatgggttctcaatgagcctgtacagctccaacttcatgcatgaagttgaagcagtacaagctcaggttgaaaagataagtcagatttaaggcgatattcagattctacttgttcctttttgttatatcagatttggtttttgaccataaaaactcggaaaaaattagtgggccagtttccaattttggcatagttgggaaaaaagctgaaaaattgattaagcaaagaaaaagtgaatattaaaataaatacagaaattacggattatgttaaggccgacagaacttatgttataccctacgtatataattccgattttccattcctaattcttttaaatattttttcgatataaataaccaattttatttgattttgaaaattgttccttttggtaataaatggtcaaataaatgtttttcatctgttcaaagttcgtcttttggtgcgattggggcactcggccaacgatttggctgatcattttgccgttggcagtgtttttggcgccataccaacggtttggcttcgcccgggggagcaacagcaataggcaaagacgcattggcaccgttggccatttgcacacgaattgtcggtggtttctgctgaaatatttacaaggcatttgcgggttataaactctgttgaaagcccaatatttactttatcccgtccccttctcttccctcacttccactcttggaaaagcctttaacaaattttcgaaattttggaaaaatgcgagggttccgttttaaaaaccctcatttttcgggggccccatattcccccacattcgcccctatgatcagaaaatcgtttaaaaatttgtttaccctctcataagtgccattttgttgatcatttgtcggaggagatgacgtattattcatgggagcaggcggcggtgccgacaagttggagcagtacatgttgttgttgtttgaagttgtggcggaaggtgtcatcggcatacgccgcctttgctgcagcaatggggtggcaacaaaagcactgaaacggcaagaataggggacgaactcgttaaggagtcttattgtaaaagaggaaagcaagaggaattttgaatattttcaccgagaaaattccattttttccgataaaaatccatgagcgcaaccgcggcatttgcaaaaagcggagctggttttagaagcgaatctcggaaaattttcgagcacataaactctctgaattttgcggttgctagctaactgatgaggctcatgcctatgatgaggttgggtcgggaaatacgagactggcaaaaacccagggacgactgagacagaccaatcatcgtttttcggcgccggcagagtgccgtcccggccgccgttgtgctcctgcgacccgtccaaccgttcgtccattaccattcccacgttttgttcgtttgctgttggtccaccacccgcctcattattatgctgctcatcaacatgctcatgcaaaacactgatcgtatctctctgctgctgctgaaatgtgtggacagttaatgtttatgctcgcgaatgcgaaatgattaattatttacccaaactctaacattgtcatttggttcaagaacatgccgatacggactaattagagatgagtaagttttggcacaaaattgtccattttttattttcaaaattctttcctatcgattgataatagatttaataaatttcccataaaaattttcaaggacacccttggaaaaaagagtttatcaattccttggtttaaatcataagtttcaagtacgctttcgtgtcaaaatgttacccacaccagaccatcttggtcttcgaattttgttcaaactaaattgaactaattagtcctaattatagtcccccgaccaaccaatccatttgccactttctctcctccattccttcccatcgcaccattttttgttattccatgcgatttggccatgtgtttttgttgtttttgtgaagtttttcctttttttaattttttttttattaaaacgaatcttttttctttgggtttctaccgtagtcgtcgctctcctcttcatttgatcgtaacggtcgcttctcctccgcttgttttgtcagctgctggtcaattcgttgcgcaaatacaccaccatttttggttgccttacaattttgtgctttacactgttaaaaatggagaaaaatgatcaattagacaattggtaacggacaattggcccaaaaaatggcagatacatattcaatgggttccgattttatatttttccttcctcttttttatacagaaaatgtcccatctttgtcatcttttaggaaataaatgattttcataatttaacttcctaaaaccgaaagctgccacaaaacaatctgttaaaattggtggttaactgacaaagtgtgaacgaaccaacccggtactgacggtgacgtttgatcaccacaccgccgtagaggagcaaagcgatcagaatgagagtgatcagtgcggcggtgatcagcagagacaagcgtgcggcccacacggagtctgcgacaaataat

SEQ ID NO: 2053 - DNA, 3525 bp, Heterodera glycines
tgaaacgaaaccggcggtaagacgactcaatcgagaattgtaggaagttcaccgtaggagccaaccccatttattggtgtgcccacaagggatcatccttgtggagaataccggacgcggataaatcaccattctgcaaaccacctccaggcctcacctctcagtggaaaagattgaccatctcactttacatgccgtatcggaagccacaaaaagtgaagaaggcctacagatgtgccatcaaacgaacgaaggagtatttttatactaaccttctgggggatcagttcgttcgtacggagaaagaattcttgccagtacaaaagagaatctgcatggccatgatcgaacagcacaaatgccaatacgaagataagccaatgactccgattgaaggaggaggatggagcagcaacaacccactgaacgacgaatttccgggaaggttctcaagtctaatttcgggggagcgagagagcgtaacgctgaattgttttgtcgagaaggcgtcgctgttttaccgccctcacaattttgagttgatcagcccgctctacttacacttggaggattgcaactatttgaccggaaactgcaacatggcagacaacacaaccctaaattgggaaacggagtgcaacgagagctgtaagtcatgcgactaccatttcgtcgaaagtatggacggagagcacacgggatcaacggattgggcaggcggaacatggatatccaaaagcaaggaacaggcgctaacgtttagcaaagaggcgaaaatggaaacagcatgcaacggaaaaccgattcgcttgtcggaccaatcgtttggaatcctggaggatgagtacctgaagatcgtcaacgatcgtggattgggaaaaagagccatccaggaggaacaactcgcagcacaattaaccgcaggacaactcgccacaagccgatcaatcgcgcagcttttttccaaggaatgccgaagaagttccagaggaggaaatccgaccattcaggccagacgacttttacgacgcaaggatgtttggctaaacgaggacacgatgcaaatcttctcgtgcgctgagttttcaatgcaaaatgtggaatatcaagcagtcaataactgttaccgctacattccggtccaaatccgcattgacaagaagacgctcaacgcattcctggatccggagcttcacatcctcacagcgtcatcaccattcgcagattgtggaaattttcgctaccattatctgcaactgagccagagcaattggatcaaaatcgacacacgcaccgctacgatccagaaaatcgactccagcagcatctctgagatccacgaagcctctggagacaaatcgttgttggaaatcacgccgctagtttttcatcgatggacgatcgacaacgaaacaggcgaagggctattcgcgcacttggatgaatggctgcgtttggatcaatggaagtcgaaggagaaggagcacaaaacggcgcgtgcgctcacactgggagctctcccgaacggagtgattggcctcaccgaagaatggttcatggacaaacttcggctgctcgtctcctactggacaacggcatgctgcatttacgtcacattcatttttgggcgcgatgtcctgatacccttggtatgggtctacttaatggggcccgtcatcgttaccatccgcaatttggtgacgggaaatcagtggacgcagcggaacagagttactcgaggcacacggcgagcaccggcaatttcaaggattgaagcaattgagctggtaccgccttcaatgccccaggaaatgagagcgaacgaaacgtcaagttcacatcaagaggaccccgagccgtcaccgctggtgatggagctgaaacgacaaatggtcgcattccgttcgaagcgacgttttcaaagccgtgggaatgtcgcggctgaacgacagccgcgaatgtccgttgagcggacaaatgaggaggacggggaggagtgaatgaagttgcgaacaaggagtgataaatggatggaaagatgggaaaaatagggcaaacgggaaatgatgaagggaagggaggacaaaaagggggcgaagggagggacggcagcaggcgagcacgtgaatgaggggaaggaaagcgataaaaagcggatgtggcgccttctccgcgtgaaggacgcccgaggcagtgcaaaaacgccgatcggaccatcgcggtgcgacgggcgaaacaacacatcaccaaggcggacagccgatgaaaatcggcgatcatttgatggaaaattgcgaatttgcgggagagcaaattcgcccggacccttcccctcccgcctttctccggtgatgtgcccccctccccgcgactcaccccacttttgtgcccccccaattgtgccatttttccctttgcatttcccctcgcattttgtccccattgtcacaatttccccccattgtatttctcacacatttcttatgtatgggtttaattacccaagtttgagccataaacttgtggaatattttggtgcaaattcttgggcggcaaatttgggcaattggcggcagcgaaaaacggacaaatcggcgcagacccctcccccatctgcgtcaagtggcctagcccattaaatgccatcaccctttaaagatacttcgcaagaaaagcttaaataacaaaaaattcgaatctgttatacaattccatgctgtgtagttttctataaagcaattattcatccactcttaattactcacctattctagcccattaaatgccatcaccctttaaagatacttcgcaagaaaagcttaaataacaaaaaattcgaatctgttatacaattccatgctgtgtagttttctataaagcaaatattcatccactcttaattactcacctattcgagcccattaaatgccatcaccatttaaagatacttcgcaagaaaagcttaaataacaaaaaattcgaatctgttcttaattactctcctattctagcccattaaatgccatcaccatttaaagatacttcgcaagaaaagcttaaataccaaaaattcgaatctgttatacaattctatgctgtgtaattttctataaaatacatatttatccactcttaattactctgctattctagcccattaaatgccatcaccctttaaagatacttcgcaagaaaagcttaaataacaaaaaattcgaatctgttatacaattccatgctgtgtagttttctataaaacacatattcatccactcttaattactcacctattctagcccattaaatgccatcaccctttaaagatacttcgcaagaaaagcttaaataacaaaaattcgaatctgttatacaattccatgctgtgtagttttctataaagcaaatattcatccactcttaattactcacctattctagcccattaaatgccatcaccctttaaagatacttcgcaagaaaagcttaaataacaaaaaattcgaatctgttatacaattccatgct

SEQ ID NO: 2054 - DNA, 1300 bp, Heterodera glycines
aaaaaatgcataaatttggacatagtgacatttttatgtaaaaatataaaaatccgttccctgtatatttctcgtaaattgtagaatccgtgagtactgcacatatgaattttttgctacatatagaaatgaataaataaatttgaaataaatataaagtacataaaagataaataatttagcttaaatatttatcaaatcatatttacaaaaattattttttaatgctcaactttgttttaaagtaatgttgaaaattttgtaaatatcacattattctaaaacctttatattctttgttaactctaaaaacgtgttttgtacatacaataataattgaattttaaatagactaacatagatgtaaataaatatatacaaaagcgtgaattaatgattctaaattaagttataatttgatgctatagtagaaatattttcacaaaaaaaagtaataaaaaacacattaataactatattagtaaattttgcattgcttaaaaaaatgatgatggcaggcatgtgtctgttatttgtgtgcatatttttaaaaaaatttgaataaccgtgttatagtgtttttttgtatcgcgaaattccgattcctataatccatttttgcctaatttgcattgtgtaaataatttgaacaaaaaaaacagaactattattttttataaaaatgggctgggtccggcgctatttaaaagctcagcttttgactgaattcctaaatccattctgctaggtgctaaaaatgggaatgagataataattttaaaaataaacattctattaataaacaaagcaaaataaatttcggagaagagttataaaatttttaatttattaggagtattttttttgtggtgtattttagttttattattacacttctaattttaaaattttcaaattcctttaaaatatttttgtaaattgcctcattagacaaaacagcgcaaaaatttaaaaatcaaggaaacagttaaaaacaaaccaaatcagtgtgataaagtgacaagaaaaatgtaataattaaatttaattattttttatttttttctaagtaattaatcatttagcttaaatgtagccaaattaatggaattttattaaaattaattattacaaacactttttttttaattcgtccgcactgatatttttgtcactttggctcaccatgtaaataatgagcatttaattttaattaatgcactttaatgaaatttacaactagcaaagaaaaaaaatttaaatactttttgaattataaagtaaccataaaaacctaaag

SEQ ID NO: 2055 - DNA, 4293 bp, Heterodera glycines
cccctttgtattctcacacatttttatgtatgggtttattacccaagtttgagccataacttgtggaatatttggtgcaaatcttgggcggcaaatttgggcaattggcggcagcgaaaaacggacaaatcggcgcagacccctcccccatctgcgtcaagtggcgaccctgggcacttcaacggaccgtgcgtggacaaaaagcggccgaacagacattgcgcacaggagcatttgggattagtgagtaaattgggggaagaggaaattttgagacttgggcagggcaaaaaagggaaaaacaggggacggtaggaattgaacccggaaggttgcccttcggattttctgtaatccgtagcgcttcctttggtcccagagctgagtcccgcgaattttttgtaattcgtggcacttcccttgccaatcagcgcagccccacggattttttgtaatccgaggcgcttccctggtcccatagttcggcctcacgaattttttgtaattcgtgtcgcttgccttcccgagggtttggccccacggattttttgtaatccgaggcgcttccccggtcccatagttcggccgcacgaattttttgtaattcgtgtcgcttgcctggtttggcccctcggattttttgtaatccgaggcgtctttttccttgctcagttagcccctcgggtttttcgtaacccgaggcgtgttcctttctccagtgaccgacccctcgggttttttgtaaccaaggcgtcccccattgtgagcaggtcgctcctagggtttttgtgacccaaggcgcctctcgcttacacggtcggacccatcgagtttttcgtaactcgtagcgtccttcttcatacactgtaagactcttggtgggtctgaagtcaaactcactttgtccactgtttgtccaacttactgctattttgtgaccccgaaccccacacaatttgttcggaagtcgggtagcagaacccaaaagtgagcaaaaataagggatttttgcgtacaaaaatcgcaatagagctaaaggctcttgagaaggcgaaaacggcaacagaattgtatgctgagccggaccaaactctgacctcattggaaaatgcaattctcctggaaagcgcggcagagagaataaagtcagaggtggaggcagtgaatgccaaaatcgagcaaatttggataaccgcaagcaaatggcatgacgtcatacaaaaaatggacaaggacgaaagaaaaagtgagcagacagcgtatgaacaatttcaaacaacggagaaactgaacacaaaaatggaagcagccaacacaaagctaacagagctgaaggacctggagatgaaggtggaagcaggagcaaagctgcaacgctccaaagcagacagagacgcgcgagtggagcaaagagaacatgcaaaagcaatgtcgaagtcgaatgcagaagcagacaaagggaataaccgtgcgagaggcaatgaaatgactgccgcattgtaccaattgccaacactaagaattaagccgtttgggggagacaaacgggaatggcccatgtttgaagaagcatttaaagtggctgtggaccaaaagccaggaagcaaaacggagaagctaaatttgctgaaatcgctggttgagcgagaggccgcattgctcatcggaggcctacgcttggaagagaaaaattacgaaattgccatgaagctgttaaaggacacctatggagacaaaggcgaatatgtaaggaggttacacacggagttgtcgaacctcaaacgatgttactcggtggaagacacaaagcaattttgcatggaattggaacgcctagcaagagaattggaagcagcggaagaagacattgaagggccgccaatttatttaatgcttgagaagaagctatacaagcctttcctgcgtgaaattctggaagagaaagcaaaaaatccagacttttgggacacgtcatccctccgaaaggccttaggaagtgcattgagcaaagagctagcaatcaaagaagtcatgagggagtatggcttcgaaggcaaagaggcaaatccagagcatggattcaaacgacaattaaggcggaacagattcggaggctcagtcaatgtagccacaacacatttcgggaaacccaatggagagcgaagaaaaatcccggaacaaaaaatgccaagtccgaggcaaggccaacgaagttttcagcagactccacaaaattccgcattccgagaacgtaagggacaaggaagaagcccaaaaattcagcggaatccaacagcagttaacacacaaggtgaactgtttctgtgtgttttctgtggagggaagcacagacatgacagttgcgaaaaagcaaggacggtgcaacaacgatttgcagtcctccaagagaagggcttatgctacaaatgcctgaagggcaatcatatcggaagaaattgcccatgcccaatgaaatgtttcaagtgccagcaagcacacccaacggcattatgccatcaggcaaacccacaaagggcaacagagtggagaaacatggcaaacaaagtcatgaacgtccggaaagaagagaaaccggacaaacgggacgaattcaaagaagtttcgttcacgccctcacaatgcaattcagtgcaaggaaattcgcgagtcctgctgagaacagcagaggtgaccatcttcaatccatccaatccaaaaagaagcatggtcgcatcagtttttgtggatgacggaagtgaacgctcattcatccgtgccaatgtggcaaaacaattaggccttccggtgattgaaacggaagagtgccatttgactggttttggcgagaaagaagccaaacgctacgtgagcaatgttgtacgcgtaggatttctgggagtcaacggagacccatatatatgcgcactcaatgaaatggaattcattgtgaaagcgatgcccatcgtaacgctgaattcgatggatgaagcggaattaagcaagaaaaaactttcccttccatcgcggccaagacagccagacattctgttgggaatggatgtcagacatgacctgaaaataagagacgaaacagaaaagttgccaagtggattcacattgtcaacgtctcgagtcgggcggatgataagtggttatggccaagtccagggcccaatggacatgagtgtgcaagtgacgtacactggagcactcataagtgccttacaatgtgccagtagcagaagagatgctgacgaagaaatggaagaacagataaaaacatttttcgggctgaacataatcggattgagcgacaatcctgaagaagaggacaaggaagaagtgatgagaacgttcagaaaaggcttgacattcaaagaaggaagatatgaatgtggcctaccatggaacgaaagagtaaaggatttgccgacaaattttcaacaagcgagggcaagactttgtggcacagtgaaaaaattgcgagaattaaatttggtggatgaataccaaaaaattttcaatgagtgggagaggaacgggataatcgaaagagtgccggatccaacacaaataactggaccggtacattatctcccacatcggcccgtgataaaaatggacaaggccacgacaaaaataagaattgtgatggatgcatccgcgaagccagcaaaccgcaaaggagccccatcgttgaacgaatgcttgcacacagggccgttgttgttaaatgaattgaccgggatccttctaagatggagaagaatgaaggatctaatcctggcggacatcgaaaaggccttcctccaattatcagtgagagaggaggacagagacgcgaccagatttctgtggtaggaggatccacaaaagacagaaatttcaagcccaacatatgtgagaaccgttgtgtttcggttctgtcgggtctcatttggattgacaactttaccatttcttttaaatgcaaccatgtgaacatctctcattctacgacacggttctacagcaaaccataatggagaatttgtacgttgacaacatactgatcaatgtgaagaagaatgaagacatggcgaaaatttgtcatgaatcgatcgagctgttccgtcaagggggaatgaagctgcaggaatttttctgcagtaagccgatcgccatacgaagccttcctgcggaattattggccaaaaaccaaaaggagataaaagttctcggaattccgtggacgaatgaggatgatgaaatttgcttccgatttaaaaaatttgccggaaagcacacgaagag

SEQ ID NO: 2056 - DNA, 6019 bp, Heterodera glycines
ttacaaatatgaatataattcgagatttttatctctttttggaaaatggcatgcataaaatttacgaatacgaaaaagattttatcttgactagttttattcccaggggaatattcttcagcttgatatttgtttggataccatgtatgggtaaaattgtcataaatcataaagatcttatcaagagataaagggttattcccgtcgttttggcaaaataagattttgttctaggaaacataaatcataatgtggttgacagaatttctggaaggttacggtattcccaaggggattcttggtcatgtcatagtttagatcttatctttaaatgggacgttatagttttaggcaaaataaaattttgttctaggaaatataaatcataatgtggttgacagaatttctggaaggttacggtattcccaaggggattcttggtcatgtcatagtttagatcttatctttaaatgggacgttatagttttaggcaaaataagtttttgttctaggaaacataaatcataatgtggttgacagaatttctggaaggttacggtattcccaaggggattctttgtcatgtcatagtttagatcttatctttaaatgggacgttatagttttaggcaaaataaaattttgttctaggaaatataaatcataatgtggttgacagaatttctggaaggttacggtattcccaaggggattcttggtcatgtcatagtttagatcttatctttaaaaatgggcgggattttcatgtgtagtaaatatttccgctttaccaaaaatgtcaacaaccaaaacaacgaccaaaatcttgatgacttactactatgaaatgattctgttgggtacatttaataacattcgttcttcacatacacacgctctattgcttctcgcgcaaatcccatcatcctacccttgtcgtgtccttttccgctgtcccttttcagctgtctctttccccagtgtccctctccaactgtccctttcccgttgtccctttccctctgtccctttcctcagtgtccctctccaactgtccctttcccgttgtctctttccccagtgtccctctccaattgtccttttcccgttgtccctttcccgctgtctctttccccagtgtcactctcccactgtccctttcccggtgtccttttcccactgtccatttcgctctgtccgttccagctgtcactttccctctatcctttctcacattatcgtttctctatccttttgcgcactgtatcttttcccagtgcccttcctgttgtctatttcctctctaaccctttccgctctcccattttgtcctatctcttttacagtcatttattatacttttactctcctcatcatcgaatattattaatgttcgcaaaacaattaaaaaattgttattaaacaaataaaaaataaaaataaaaataaaattcaaaataaaaataaaattaattaaagagattaaaatcataataaaataaattaaagtaaattaaattaaaaataaattaatattaaagttaaattaaataaaaataaattataaaattaaataaattataactaaattcaatttgttcgactataaataggaaaaattttctcccattattcatttaaaatgttttttccaacaatcaaaaattgcgttgctgttgtagacaccaaaacaactctcgatattgaaaaaatttatttaatatcaccctccactaaatataatccacgtaaaattcatgctgtaatcatgaaagtctataatccaaatgctaccgccataattttctcaactggaaaattcgtatgtacaggggcagctaatgagaaagaatgtaggcaagctgctgagcatgtcacggaacgaattaggcaatgtggctaccaagaggcactaatccataaatttgatgtgaaaaatttgattgcgactgctgatgtagggttccatataagattaggagaactttcagactttcttggtgtaaaatgctgttcatttacccccgaacttttccctggactcgcctacagaaacataaatcccaaaatgtccataattgtcttctcaagtggaaagctaaattttacaggaaacaactcgattgatgatatcaaaattgcatttaatcagttttatccgattttgtacaaatttatacattcaccacaaagggtatgagtcataataatttttgataaaatgtgcattatttgaactttcttgcgctgaagggacaactttaggaaaattttgacccaaataaatatcagcttgatcattttcaatcattcgcacaagctcaagcggatagaatcgatcgtgcccattcttattcttctctattacacacggattgtttgcataacggagacaaattctatgccgtacataaaagtgctggtcgacggtcacattcttgaatccgttgtacgccatttgcttgcgagcattatccttcgtaattccgccataaataaattctttatgttctccaatttgatttttataagttgtttgtagagttttatctttgagaaaattttcaaccttttgaatttcatcaggatgatttagacgatcgcacaaattacgtgcactgcaattcagaagagaagcaattattgtgtctaatcggtccatttttataaatgagttaatgaaaaattccttaaatactttttatcattttcttaacaaaatttacaacaaagaagtcgggatcatattgtatcattaacttttttaatagatttaaaaaagtacttttaaaattaacacttcctgaacacatacaatatacaaaataaatacaaaaatatccacaattctcactaataattgattgtataggagttttattaccttccacagtcttaaattgacttaaaaatttttcaatacatttgttaggtgtacgtccaaaactgtcaaagtagtacacggtcttataatctttgataaaaattgaaacccaatgcgttccttccttatttgatgggtcgttgttcgccactaatactgatgggaatttgttgatatttaggggtattttgttgcatgggaaacatcctaaataatgttcttttgttttttcgttcattgttagaatccgatttatcgtcgctgtgtccattttcttctctacatattcgcataattttacacaaatttctgattaaagaattaaaatagaaaaaaatgcctgtcattacaacagctatccataataaaactaataatacgcaataaacccatcttgacaatgactttgtctcttcaatattacaaagttgaaatttatcaataatttcatcaatcattgagaatagttgactttgattcattttatttaaatacgaatgatcaaaagaagcaattttataataaatgtctgtcattcctacattagttgaacgttcagggtaaagaataggactattaaaacatgctacatattttattaagaataaaataaataaaatatacattttgaaatacaaaatgaaatataaaaaatacttaaatacattaaatggtattatcggtcattactgtacgatttttatctagaatcaaaattgaatccatttcactcatggctattagggtgatcccacccgatgggacaggtgatctaaattgaatgcacacggtagtcgtcccttctgtaataagatcaataccctcgttgtcctccatgctattagtcatattaaacgcaaaaattgtccaaccctttctatacttctcaagagaaattccgttactgtctgttgaactggccatacctaacgcctcattcatttcgtggaatgcccgggtatataagtttttgttgaaattaagctcaaatggcgctgcgggccattgtttcccgtttgccatcaatgtaacggatcgtacatcaaaaggtttaaaattaaatgggcttttcttttggttgcctacgtatgcagcgttctccaccattccaataataactcgtttaggtaattgacccgtaaatagcgttccattgtattcagttcgattctcgcttataaatgtggatttgatcaatgtttttctatgggcatattttgcttctttgctttcaagttttttctgtatgtctaatgcaagaccatcaacaacttcaagagttttaacatataatttacaagcggtaatttctattctatatttatcgtctgacgctgccattaccataaactcattgtcattaggggtaagttgtatatcaatctcaactccattcaccatatatctgtcctgattaaaaatatctgcatccaattttgtaataaattgtgcagtttgactttgtgaaaacaattttcttctcagttcaaaaccctgctgagtaatatccgttccgtcctgattttcactgtccacataatatccgctcgcctgcaggtctgactcctttacgtttttggaataagaaagttcggcatccaagtatgctttataagcataaagtgagtttgagtcataaatctcacgtccctgcacagtgatttttaaattctttatccaagtcgcaccaatcatattaattgttgccgcttgctcattcacttttaaattaacatatttatttgtgtaagaatccagctttttaattgacatttcggttaagatgtaacatttgttcaaatcaaagaaactggcggtagggtgaattttaaaatgaaaaggaatgtccgttaaaggattgagcggtaaatattcccgcactgaagaactactcactgacacattagttggtggaagggtaaatattgacaaagctgaagttatagaatttaccgattccttgtcaattttcttgaagaccattttaaaataattttccaaatacgtctgatctttttcgccttttttattactgtcttaggtatagtttttccaataattcttttccttttaatactcttttttcttcccgttccgaattgacgcccaaccccacctttttcgagtacattatccattcccttctttacttcattaattattacttgtttgtttggtgtttcagctttctctattgtatccaatacacgtgttccagtgtctaatgcctctctacctaataatgtaccagccgattttaattttggtaaaagtgctctccataaaaacctcaacacatctcctactcctccacctcgctgtcttccatatcctcgttggtatggaggtatcccgcgaaaataattaaaggcttctcccgagccaatctgctctactacaacaaaatcatcaaaactaactgagtttggatcaaatatttgatgcaccatatttattcaattattaatatatactataatgtgaaaatgaatatttaaatactaaaatacaatagattttttaaatgctaatacaagtaatgttgtaccccattggaatggaataagccttccctccctagtcctaatttcaatttcaatctcattaatttcctttactaccaccttaatgtacattggtgtgttataaatcttctcaatcacgtctccaaattttccttcaacgacaacaattcgcaaaagtgaagcgagttggtcccctactattacattctcagtgattccattaatgtacacacaaaggctgtctataccacctttcaagtcacaataatactttgctatagctccactcagaatttttgtcgggtcttcgaatcctagaatgtagccgagttgagccgacaattcaataaagtcaattctttggtcattaaaatcaattgaaaatttccgccgctccttcaaatatttaaataagactgtttcaatttgttttgaaacaattaaatcctttaatgattctccacgtgttttcacaccttcaatttcttcttctattggtttactagcccccatttttttctttaatatttcacctcttgtttttccttctgttttttcttcttctatcggtttactagccccaatttttttctttcatatttcgcttctt

SEQ ID NO: 2057 - DNA, 3147 bp, Heterodera glycines
ggtttaaaataaaagggcctttttttttggttgccttagtatgcagcgtttctccacctttccaattataacccgtttagtatttgacccgtaaatagcgttccattgttattcagttcgattctcgctataaaaagtggatttgatcaaagtttttctatgggcatattttgcttctttgttttcaagttttttctgtatgtctaatgcaagaccatcaacaacttcaagagttttaacatataatttacaagcggtaatttcaatcttatatttatcgtctgacgctgccattaccataaactcattgtcattaggggtaagttgtatatcaatctcaactccattcaccatatatctgtcctgattaaaaatatctgcatccaattttgtaataaattgtgcagtttgactttgtgaaaacaattttcttctcagttcaaaacctccgtgagtaatatccgtgccgtcctgattttcactgtccacataatacccgctcgcctgcaggtctgactcctttacgtttttggaataagaaagttcggcatccaagtatgctttataagcataaagtgagtttgagtcataaatttcacgtccctgcacagtgatttttaaattctttatccaagtcgcaccaatcatattaattgttgccgcttgctcattcactttcaaattaacatatttatttgtgtcagaatctagctttttaattgacatttcggttaagatgtaacatttgttcaaatcaaagaaactggcggtagggtgaattttaaaatgaaaaggaatgtccgttaaaggattgagcggtaaatattcccgcactgaggaactactcacagacacattagttggtggaagagtaaatattgacaaagctgaagttatagaatttaccgattccttgtcaattttcttgaagaccattttaaaataattttccaaatacgtctgatctttttctcttctttattactgtcttaggtatagtttttccaataattattttccttttaatactcttttttcttcccgttccgaattgacgcccaaccccacctttttcgagtacattatccattcccttctttacttcattaattattgcttgtttgtttggtgtttcagctttctctattgtatccaatacacgtgttccagtgtctaatgcctctctacctaataatgtaccagccgattttaattttggtaaaagtgctctccataaaaacctcaacacatctcctactcctccacctcgctgtcttccatatcctcgttggtatggaggtatcccgcgaaaataattaaaggcttctcccgagccaatctgctctactacaacaaaatcatcaaaactaactgagtttggatcaaatatttgatgcaccatatttattcaattattaatatatactataatgtgaaaatgaatatttaaatactaaaatacaatagattttttaaatgctaatacaagtaatgttgtaccccattggaatggaataagccttccctccctagtcctaatttcaatttcaatctcattaatttcctttactgccaccttaatgtacattggtgtgttataaatcttctcaatcacgtctccaaattttccttcaacgacaacaattcgcaaaagtgaagcgagttggtcccctactattacattctcagttattccattaatgtacacacaaaggctgtctataccaccctttaagtcacaataatactttgctatagctccactcagaatttttgtcgggtcttcgaacccgagaatgtaccctaattgagctgacaattcaatgaagtcaattctttggtcattaaaatcaattgaaaatttccgccgctccttcaaatatttaaataaaattgtttcaatttgttttgaaacaattaaatcctttaatgattccccacgtgttttgacacctacaatttcttcctctattggtttactagccccaattttttcttttaatatttcacctcttgtttttccttctgttttttcttcttctattggtttactagccccaattttttcttttaatatttcacctcttgtttttccttctgttttttcttcctctattggtttactagccccaattttttcttttaatatttcgcctcttgtttttccttttgttttttcttcttcgggaatttgttcaattctatttttcaatgcttcgccatgggttattctttcttctttcttttcttcatctttagattttaacttttcgcctaaaatttctcctcttgtcattactttttcaccaatagttgtttctggtttattttttagtacttcaccatgggttgcaccatctgcactactgtcttgttcatcaattttggcttttaatttatctcctaaaatttctcctcgtgtcttaccctcagttttggccttgctatcatctctttctttctgtacctgttctattaactctaccaaagattttccatgagtttttgtctcttccccgtctgctgtggtggtagttccctctatttttcctatccgttccttcagtgcttcaccatgagtcaaggctaaagccattggttgttgttggagtgcgtccctctttttagcttcatactctagcgctgcaaatctttttttcctataatcgacaagacgacgaagttgatcaatttcatcctgaattgactgttttttctgttcatcagtcaaaaattgttgttgttctcttaattcgcgaatttttttgtaatcgtcttgaagcccttcatattttttatgaatatgttcccagtaatctgttggatgactatcaaaaaatggctcaacgtaatccttattttgttcatagctcgtcctctcatattcttcagctgatatttgtaaatcttttttcaatacagccttgttaaaagcattcaaattttttcttctgtgtttcattgctgttctcattcttaatgcttcctcattcagagcctgaattgttctaccatctgttactccttggtattttttcatatggtcttgaatgttgaataaatctcttattaattctaatcgaacttcatttaatttctccactatagtgaacagaatacatttcgaggaattcttgaccagttctc

SEQ ID NO: 2058 - DNA, 1607 bp, Heterodera glycines
tggttgttgttggagtgcgtccctctttttagcttcatactctaacgctgcaaatctttttttcctataatcgacaagacgacgaagttgatcaatttcatcctgaattgactgttttttctgttcatcagtcaaaaattgttgttgttctcttaattcgcgaatttttttgtaatcgtcttgaagcccttcatattttttatgaatatgttcccagtaatctgttggatgactatcaaaaaatggctcaacgtaatccttattttgttcatagctcgtcctctcatattcttcagctgttgttcgtaaatcttttttcaatacagccttgttaaaagcattcaaattttttcttctgtgtttcattgctgttctcatctttagtgctgtttcatttagttcttgaattgttctaccatctgttactccttggtattttttcatatggtcttgaatgttgaataaatctcttattaattctaatcgaacttcatttaatttctccctatagttaacagaatacatttcgaggaattcttgaccagttctctcctccttttcctccttcccgtcatctctttgccttgctgcttcttcaagcgcctctattcttgctttcttagtcaatgattgattttggagagggtcaatttcctcatcctctatttttctcttcctatgcgtgtccgtctcatcatcacgttctcttgactttgtcactatcaattttaacaattctttatatctttgcctttcttcctcaattttttcccagtaatcatctggattataatgaaaaaacaaatccactccatattccgtttgtcttttaactcttgtagccggttgttttataccattttttatcgactcatttatagcattttccaattcttgctcattttggtatgacccagcgggaatatcaatttttattttatcaccattttttaaatgcactttaatccattggttctctgtggtaccaatggcgggccaagaatttgtataaattatactgtgcaacccacacaaccattgacctccaaaagttagggtcctaggcaaatgaaccctaaatttattaggcttattgtcataaccaggagagtcactaggtaaaagaacgtaaaataaatttgacatttttatttttctaaaacataataacaatacacttaaatacattcatctctcaatatcattgtctttaatccactccggttctttgtacccgtaaaatttcaccaaatgttctttatgtccacttcttgtcctagtcttcagcaccctctcaattctgtatgttgtctccgcgtcctttctggtcttgaccaagtcttcagcataaaatcgggtgtcaaacggctcttctttatcgtcttttatcccaaaccgataaggatttgcttttttaatatcataaacttggaaaatttcatccgaataattgggaaggtatgatttttcaaaactggatttatactttgcaagtctaacatgatccccctctttaaatcttggtcttctataagtttttcgtgaaaattcatttccatagacctttttcctaaattttttgagcattatccgggttaatatcaact

SEQ ID NO: 2059 - DNA, 5985 bp, Heterodera glycines
ggcaaaacgattggggtgaactcaaggcgttgctgctcgccattctgattgatgagtttgaatcagctgttcccctgccggaaattgtcatcacgacactctttgcacatgaacgtgaacactccgtacttaagaaattttcctattttttcaaattaaatattagccaaaacctttgggcgggccaatttccaaaatatggtcgggtactcaaacacattggtcggttgttttttgggcgattcatccactaaaatttggctaatttaaagaaatttgcagaaaaagccaaaccttcagcttccatggcttttgctttcttcattgcggaagcaatttcctcatggattttgtccaagcgaggcttgcgtcccctttttgagggccccggttgcaggtcaagcagtgtttgagtgttgttgtctccaattgtgatgacgtcatcatcattttgaggggaaaacttttcccgtttcgactcatccatttctttaaatttaaaattattataaaaaacccaaaaaatgattacttttgttctcaaacaccaattgatcattgatttttctcggggccattacgattaagaaatagtttatgattataattgttaaaagcataaaatgaacctgcgaaaaaaaacacgtaattattgattgatagtgagaggggtgttagcgcgcagcgacctccagacgggctgtcccttttaatcgataggccacgcccatccacaaacacatagacgagagagtagtggttagagaaagatacaaaagggcgccaattcaaacacacagtgaaacccaagccaatttattgattttttacagattatggtactccctctgactgctgccctatccaaactgctaaactgtaaacccgaaaatttagcagaatatttgaacaaccccgaggcagtgaacaaagcgaacgcttacttggccggcaaaaaactcaaaacaacctaccagggtcgtgattccaagaccaaagaggtcaagttcggcacattttcggtgaaagccgctgcgggaacctacgcctttgagggatttcttggcaagtttccaaaaattcagtttcggtctaacacacatgcgttcagaggttaaagtccaccagtatttctacataaagcaccggatccgcctactgtaccctcagctgaagtgcattgttgagtaccacaacaagggccactgcaaatactatcccttgggtataaaattttgtcaggaaaaaaatcaataatcattttcagagttgttggccgttgaggagggcggtgagagtgaacccgtcgaaagacctgccgctgaaaccgactacctggactacttgaactttcgcagtgggtggcaatcaacactctactgatcaatgaagcgtgtgcggcaatcggaaaagttgggcgaattcccggagattgagttcgccgtcaacacaatgggcgtcacggtgtactgcccgcggcacctgcaaacgcctcggtttgtgccatgggaccagcccgggcggtgctcgagctgtagaagcggaactgttgagctggactacatcatccagcccgagggggtgaccatcttttcgaatcggctaaagacagacggcgagaactttgtgccgtttgatgcaattggtaagctgcaggtgtatgtcagagtttgactcttttcttaagtggactttgccgatcgtgcgtccgcattagggcccggaataaggtgttcacgctgccgctgcgacacccggaggtgcacgccgccggcccaagcttggaagacggcgtaaaagaacaaaaggaaatgactcagatgtcataagcacttgtccatttttctttctattgttgatattctgatggactacccaagaataaatgaaagtgaactcgcttttcccatcccttcggggattattgtcagcggtccgtcctcatcgggcaagacccagctggtccttcgcctgttacggcatgcaaacgtgatgtttgacccgccgcccaaggcaataggtatgtgcaaagggggtttctgtgcagtgggctgttgctatttagtatgggcatacggtgagtactcgacgcagattcccgatctggagcggcagggagttgtcccccacgcaggtgccccgtctgacgagatgctgaaaaagctgccaaagccttgtctgattgtttacgatgacttgatgggtgacattgaggccaagaagttggccgatctgtacaccaaaaagtcccaccataacaatttttccgtgattttcctcacgcaaaacctgttcgataaatcaatgcgggtgccaaggtcgaacgcccagtacatcttcctgatgcgggctcccaacgacatgcttagcattcgtaatttggccagccaaatgttccctcgcgagcagggattcctgatggatgcctaccgacaggcatgtgctctgccgtacggttacctgttggtgactctccacgcgaacagagacaacattatacgcctaaggacaaacattttcccagacgacgaggagagaatcatttttgcccccaaaaatggttaagcgggaacagaagatcggtgagcgggttgtgcacaactacgactatttgaagaagttgggaaagacaacgtcggagaagaagcgccgtcatttgttgaacagtgccggttgtgaggaactgttaacgcttgtcgagatttgtctcaacgttttgaacgggagtttctgtctgagcaggaaacaaaagcagagacttgagccatttgccaaagacatcagacagttggcacgtgtgcgaagtgagaggggtgcgcgaaaactagtgcagcagtcaggcggatcactttttgcccctttgttggcccccattctgattgaggctgcccgatacctgctttcgcgcagcaataatggccaataaacttattctgctgccatacgaacactacaaggggctggttgcagcgagggagacaaagaatgacgacgacgacgacattgctgagcggacaaacttgggctttgtcaaacgacaggtgaccgctgcagtacagaagcggaagggaaacgtcagcgaacggaacgcaatgtacaaccagcacctgcgccggtacctgaagatgcgcaaggaacataaggagcggcccgtccgagtacagctcagcaacggcgctcaactgctaaataaaacagtggagacgggtgtgcaggtacggcctggtccggacgaaccgaaggacaagtccgtgatggttaccgacgaagatgaagaggaagagattgaagtgccaaagtttttaaccccaacaagcccgacgcagggaagcagccgatcacccaggaccaataagaaagcagcaaaacagcaaaaattgatcgagaagaaggaccacctgttggccatcattatgtctgatccgcagagattcggcgcaactgaccgtgggaaaatcattaacccaaagacgggccgagagtttatcgactcggacctggcctggtcaattgaacgcctggtggaccctcgcccggagaatgccccttcgccacgcggaaccaaagagttgaagaagaaactcgcacagaatccgctcgccagtagcctactcaatcgactgtttgttgggtctgggttcgtcggacaagtcaaacaaacgagaggatttgttccctcaaaatggacaagaaaataaacaaaatatacaccgatccggccaatccgggcgggtatgcgggtgcgagtgccctgtacgcggcggtgaaggagaagcacccgaagttgaagcgtgccgagtttgaggactttttgcaaaggaacaccacctacgcgctgttcaagccaaagagagacaagttccgacgcctacgcactgtgcctacgggtttcatgccggtgagattttgtgcggcctttttacactttattcacgggttcagatgttcaggcggacttggccgatttccaagccctttcgcgcaagaacagcggcaaccgttacttgcttttggctgtggatgtgttgtcgaggcgaatgttcggctctcctgtaaagagtaaacgaccggcggacatgaaaagggcttttgaggagcttttcgagcaaatgccaagggtgccggacacactgtacaccgatcgagggctggagtttgtggcaaaagcgttgaaggagttttacgcggagaagggcattcaaaagtttgagaccagttcaaagaagaaggccgccgttgcggagcgtgccatacgcaccctaaagactcggctgtacaaatatttttcctccaacaacacatcggtgtgggtggatgtgctgccaaagtttttgagtgccataaataactcggtgtgccgcgcgaccggacttagaccgagagaaatcagcgacaccaatgcgagggaggtctggaagagggtgtacggcgaagggcttgtacaatcgaacaagacaccaaaaatcagagcaggggaaacggtcaggattcccgagcctaagcacattttcgagaagggtactgtaattcacacattttccgatcaatttattttaattttaggttatatacccaattactctgatcacgtttacacagtagatgaggcccgctcaaccaacccccagcactatttgctcaaagactattatggcacaaagttgaagagaaaattttatttaccagaattaacaaaagtacaagtggatgaaaacacaatgtatcgaattgataagaaatacaaagaacgagtgagagatggaaaaagagaaatgttggtgaaatttattggatttccggaaaaatattgggttacaaatgaagaaatgaatgtataaaacaatgaaaaataaaattattattattattattcatgtttacaacgacaatcatcagcggggttgttggctttacaatattcccaagtactgtagccaaagggcaccaccttcaacccgtggtcccgaatcacacccttatttacggtcgggttaaatttcttcgtcaagggcacggtgaagatctcgcccttcttcgttatccggaagttcttcgtcggatagttgaagcggacattgttgtcctcttggcccatcttattcaacaccatgtccttcatcttctcgaacgtcatcctctcgcaggcgtccgagtccatggtgatgccgcgcagtttgaccttgtactcgtcctcccccgtggcgttgttgcgcagccacaatccataggccttgggtccagctgaaaatttcaaatcattttaaagttattttgcgcaaattcttaccgcacacaaattccataatggtgtggttggggtactcgtctgtgagttccccaagctgctggccgccaggaagagggtcgctgagttctgacttgaagtcgtagaagatgctgtccgtgtccttaaatttagcaattattattattattatttgttttgattttaccatatagagaaggtgcgtgtcatatcgctgcaccccattttcttgcttatacaccaaatgcagcgattcgagcaggtgcacccgcgctgccgccgttgtccagagggcaatggcaacctgagatatttgcatttaaaaacaaacgtttccaagtttacattgctggtgccgtgctccactacatcctcatcgcaggccttgtagcagaccatccagaatttctccgtcagctggtcgatgctgctgatttctattttggtgttgttcagcagcttggccaactcggcatggcattccacgatctccgtctttgtgagccggtttctgagtgcaaaacggccccacaacgagttgaggcatagcttcgacagataacgtaggccgggattcggcataattttgttcgcatcgaggcacactttgttgccctcccacggcttattgatgtagtcctgctgtcgacgctcacgctcctcttcgtcaatgccgacatctctgcacggtgctgggtatccacttgctgaagcatttt

SEQ ID NO: 2060 - DNA, 4353 bp, Heterodera glycines
  misc_feature (45)..(46): n is a, c, g, or t
  misc_feature (50)..(50): n is a, c, g, or t
  misc_feature (53)..(53): n is a, c, g, or t
  misc_feature (56)..(56): n is a, c, g, or t
  misc_feature (58)..(58): n is a, c, g, or t
  misc_feature (61)..(62): n is a, c, g, or t
  misc_feature (70)..(70): n is a, c, g, or t
  misc_feature (133)..(133): n is a, c, g, or t
  misc_feature (154)..(154): n is a, c, g, or t
  misc_feature (158)..(158): n is a, c, g, or t
  misc_feature (162)..(162): n is a, c, g, or t
  misc_feature (245)..(247): n is a, c, g, or t
  misc_feature (339)..(339): n is a, c, g, or t
  misc_feature (418)..(418): n is a, c, g, or t
  misc_feature (454)..(455): n is a, c, g, or t
  misc_feature (461)..(461): n is a, c, g, or t
aatcattttaaagttattttgcacaaattcttcccttacaggaannccanaanggngnggnngggggacncgcctttgagaaccccgagccgccggccgccaggaagagggacgcagagggccgacccgaagncggagaagaagctgttcgagnccanaaanggagcacacaaaaagaggaaaaggaccaagcgcacggacgacaccacacagagaaggcgcgagccacaacgcggcaccccaannncgagcagagacaccaaacgcagcgacgcgagcaggcgaacccgcgcggccgccggcgaccagagggcaacggcaaccggagacaccggcagngaaaaacaaaagaggccaagcaaacagcgccggggccgagccccacgacacccccaacgcaggccaggaagcagaccanccagaacaccaccgacagccgggcgaggcagcggannaccatngaggggccgaccagcagcaaggccaacgcggcatggcatcccacgagcgccgcccacgcgagccggaagcagagcgcaaaacgcccccacaacgaggcgaggcatagcttcgacagataacgtacgcgggattcggcataattttgctcgcatcgaggcacactttgttgccctcccacggcttattgatgtagtcctgctgtcgacgctcacgctcctcttcgtcaatgccgacttctctgcacggtgctgggtatccacttgctgaagcatttttgtttttaaattttgtattacttttttaaaaaatgcttacactcgaatttgatcttcagaaatttgttcatgtacgaatggaacacgctatcgctccaatcgcacaccagcggccaaatgtacgctcggtagacgtgcgtcactttgtagcctgatcggagtgccgcctccaactcaatgtgcgtgacagatgtggaaaaacctgtgaattcttctctgtaaaaattactttatttgcccattttacccctttcagcgtccgaaaagtgtggacaattgtagttggggtcaatcaggccgttcgggtatatcttcgcgcatgttcggcacagcggaaagagagtgcgcttgctgttccgatgcggcagcacggggatgtcaaacaagcaatgccgtgggggcaccgcataacatttgatgatcccctgaagccggacgccgtcctcgcctacaatatgtgccgggcagcgccaatccactttcttgtcgaattgcaccacggttgggtggccaaccgggtacttggtgaacatgttgcttaaaaattttaaatttttaaagtcatttcttgtgccatttcttaccgggatgggtaaaggctgttgaagtccttcacttttattgttcggcttttccattctccattcttcgggttgatcaccgtcgccgcaagccattctggtccggtacggcctaagaatttagcatattttacacagatttaatgggaaaattcaccgccaaagaaggcgtcgtggaagtcgatgggtccagagtccgggcagttgtcaaagtacgccctcatggccgggtcgtcctccagctgatcggcgatctcgcactcccacaccacttcgacctcgaaatcccgcgcaattgcatgcgttcgtttggcatccctggcacgaatggcaccggctgtctcacccccgcccacaattgccatatcatcttggaagcagcgtggacaggcgtgccaatagcacctttggaggggtaaataggcaaattttgtggcattttctttacccgttgacttcgattgccaggtccttctcctcttccgggcgctcaaccatgccgtccaagctgtagttgccgtacttgaactcccctcccgggctctccacgtggcgaatcgttcggtcaaactcgcgcttctcctcctcggaacgccactgagagaaaagaaaatgaaattttttaaaattattttttcaccttcaggtattttcgggcgacggtgctctgctttcctcgcttttcatatcccaggtgagggatgatggcaatccgctcattgtcgcagtgcatcaacacaacgaagaacttcatgcacgccgatgggatggtgatcgagtcggtgatgtcatgcttggtctgcgacagaaacagttgccgcatcttcaccagaccgtgggccaaaatttggacatctttaaaatttttaattctgtaagttaatttttcaaaattcttacccgtcttgcagtagtcggcaatcacctcgcacaggtcgaactccgtctcccggttctcctcgtaccactgctcgaatttcgtgcgctctgccggaaaaaggctgccggggtagtattcttccatcggtggcagggtgtccaggacagtgccatagtttttagcctgtattttttatcggtttttaatttctcataattatttatccctcaccttgttatatttgtggggaaaatactttttgttgtccaccccctcgatttcaaggtcgaacgtcttgacaaagctggccagtttgatcgggattagcttgtagctaaagtggggataaatttaaaaaatttgttcaaaatgattacctgtcacgaaatactgtggtggtgatggcaccccgtttgcgcgccttcatctccagcaggtggtttccctggcggatcagctcaggtcggactcccatgcgcaacatttccccataaatcagcacgtgatcgtagcgagagcctcaaattttaagattttaacaaatttttaaatataaaatttaccggcatgtgcataggcatacgttgtcactgattccggcttctcccccgcttcatcgtagcccaacatccagttgttttcggcatccagatccacggcatcatcctcctcatccccttccatggcctcgccgtcgttgttgttttcggcattttttcgctttcggcgcttcttcgctccaagctccataccgaggacttccgcctcaaagttcagcagccatttggtaaaagcggccagcggatcatcgacgacatttgcacattccacgtccgtgcgccagaattcgaacggcgcccatgagtaggtgcggaagcggccgcaaagggcgcaagcccgttccaactcctggtcccacacgcctttttcgatgcagcgcgtgcaggtcacgtgggcaaagcaaaaattgacctgtgatttcacaagttttaatttttaatttgacaaaataattttttacttggtgtttgaatctggcgagttgcgggtccggcttgaagtccgtggtgcattaaaagtcgaagaagatgatccgcttatccttcttcgcttttcgctggtaagtgatgtagcagtcccgcggtgcgtgaaacccaaggcaggttttgcagaatttgtggccgcatacatgtgctttgttcttatgtacctttgcataataataataataataataattgtttgttgaaaataatttttaccctagtttggtaaataataccgcagtcaacacattttttttgagctgttgcaaattgatttcacaattgttgtattttctgtgccacgtttgattttacaatgtgtgactttggcatggtgtttgtagcaatcgagacttttgaaagtcttaaaaacaaaggtactaaatattaatcgataagacgaccttattgcatcccaaacaagactcaaagaagttttgatgatcgtcacagtttcctctgaacgcccagcccacgcgctggcaattgtgacatttccatttgcatttggccgaatgttgagtgtgttgaaagtacggcatctcacacttaaacttttattaatattaaaaaaaaaaattgtttttgttaccccaaagcaataattttgtgtgccgaacagctttccaaccgatttcacagcgtcataatgcccattctcaccattcacatcctcagtaaaaagaacacacagttcatgctcgcggtcgccggcacatgacttccatgatggcttcatccgaccggacgtttcgaagcagtaaagccaaaacaacccgggatgaagacgctgataataatccttaattttttaattattattatttattttttttttaaattttgcctggatcctatcgccgtattccacaacacaataaaagggcaagtccatgtcaatattgcatgctcggcagagggcttgcacattttcgagttgtcttctttcgtccttcttgtattcggagaaacgttgctgaggcaatacgaatttcatccgcttttattcaaaggctcggaagaggcagaggttgtccgcattctgcaggccatacgtcgctccggcagagataccgaaaatcacattgaggacccgccgccctctgccg

SEQ ID NO: 2061 - DNA, 2904 bp, Heterodera glycines
ataatcagaacagataaccatttttaatagaatttttgaaattattcataatatttttgtaaaaattatgaacaatcaaaaaaaaataacttaatgagtgaatagaaaaagcaatattttaatacaaaaataattcatttaaaactttccatttaaatatatacttattaatatttaaaatatttgtaatgtaaaaagtgcatgaatatttggtgaaaacaattattttgttaacttttggagattaatgccatcattttaatcctaaaaatattttaaaacaatatttaattgaaaaaaataaaaattagcaccaatactttattaatcgtggttggccacttcacaaaagtgcaaatttgggcgcctcacaaaaaaagtgaaaaatcaaaaacctgattttttctatgatttttattaattttttaaattaaaacataatttaattaaattgtacttaaatacacattattcttaaagttttttggatcacgaataaaaataattaaaatttacctaatattaaaaatcatcagcaagattacttttaattttttaaatattcaatggcgcccaattacaaaataaagccaaaggtagtatttaagcatcaatttattaaatttaaaatatttataatttaaaaaattgataaaaaaacataggaaaatcagttttttgatttttgcactattgctaaacgccgatatttgcaatttttgtgaagtaacctagcacctttattaatgaattcaagaaaagaaaagatgaaaaaatttaggtattttaaaataattagaaattatttatttaaaataaaaatattatttacattttaaaataaatatttgtttctacaataattaatattaaaatctactcatagtaattacataaaaaaaataattgaattacaataattcgcattaagaaaggcaacttaaataatagataaataaaatgcacccgccatcatgatgtaaaactggagatattggccatgataaaaacatattgaaagaaaaaatttcgtctaattaaaacttattaaagaaatttttttgaaacacaatacgaaactaaaacatatgaaagcgctttcaaataaaagttgaaattaacacatctaaaagttcaatagtttgaataatttaaatagaaaaaagacggtaaatttttccgattttatttttaaaattaaaaaacaaatataaattcattattttaaaattaattgacggaaaaaattaattaaagagcatttgattgaaagatatgaatttcacagattaaagagcattaatacgaaaaggaattaactatcaaatcataatgaacttaaagtaaacaaaattaaaaaaacataaaatgaaatttaaattaatttttctaatatcttttatttcaataaataattaaaataaaatatattaagtgccgacgaaattaaattcaaaaacgaacaatttctatgttttaggacaattcattaaaattttaaaaaatttaataataaatttaatagcagattaaaaataaggagaataaatgacaattggcacataattcaaattaagaaataaaaagtctaataaaattaatattgaatgaattggaaaaagaaggtgcataattttgaaatattattgtttcaataaagttcataaataaataaatttaataataaacttttaggttttttaattatttgtataataaatgattgaaaaatcattaaaaacgatttctataaaagaaatatttttgaagaacttcaaaaacttttttattaaataagaccataactttttatcaactgaaaatatataataaattattaaggcaaagttaataatgtatcttgaataaaattaatcaaatatttgctacagaaaagtttataataacataacagttttaaaaaccacacaatattagtaggactattttcaaattagaaaataaatgtttaaaaaatgtttattgtcattaaccttaaaataacctttataatattattatcaatgcattagtaatatatattgaagaaacaaaaatataattaaggattttatttgctatatgtacatattgaatcaaaaaattcatacaccagccacactgggaaaattacatgcatccgggcaagttactgtataaaaaaattagatttttaaaattaagctggaaatatattattattaaaaaaatgcattctaacttaatttcgaaaaataaaatttcaacaaatcagataaaaaacaatttaaaaataaacttagcaaatgtgaaaattttttgctatttcttttttttagtgttgaaaataattgtatgaagaggcgctcgtaaaagcctcctgcccaaggcttatttgggcaatgaatctccatttgattctgttctgagtcaggaagttttgtacttcctgatccggacccggagcactgagaagctccagggttttctgagcgagtttgaaggtcgtagcgttgtcgctccaaatgatgtcgcgttttcctcgtcgacttatgaatcgacggagaaaattgatgaatgattcagatgtgaggtccaatgttgcctcaaggtagacagcgcgcgtcgcaaggcatgttatgatgaggatccatgcctttattttttctccggccaacgaaattgttgttggcccgagaaaatcaattccaatcgactgaaatggagcgtgtcggtaatgcaaactgttgtgcattcattcggcgacaatggagacagtcccgaagagtccgtttaacatttaaacgggcacttggcatccagaattcactcaagaattctgtcagagtggtgtccactccaaggtgatgccttttttggtgccgatccaaaatgatcagctttgccaaagcgaaatgcttggcg

SEQ ID NO: 2062 - DNA, 6918 bp, Heterodera glycines
aaactttgcaaaacttaaaattttccggggactttcccttgtaaaaatggaagagccgatctcgagttagaaaagaaactttcaaaaaacaaaagagaattcgatagagggggtcaaactatgggcctatgcaaaatttgaagaaaatttgaacatagggaaaaatttttcaactaggtgaaattttcaataattttaattcttttttagccaagtccacaatttaaggccaaaccaaataaaatttacaatattctccagaattttcccttcaaaatgagcataaaatggttttatttgctctagtattcaccaagttataagctaaaaaaatttcataaaattgtcgatgttggacgtaaccaacgctttttgaatatgattttttattgccacgaaaacttttattaatgaaaaaataattctgccttcttctttaaaagaagaaattgaaattaacacacaacatagggaggactcgaacttgagacccccttttggtgactaactcacagaccactaagacgaaaaatccagcataattgtacttggagcccaaaattgggccgctgtgtacacacaccgtccgaaaaaacgagatgtgtacaaattttgcatatcgatagagaaaaaaacaacacattcagtaatacagccattttatattttatacactttcatgaaaacccgggaatcccgttcccattggaaacggggtaaatttgcgaaaaaattcctagtgggctggaaatttcgtggaaacgaatatggcggacagaaagagtacaaaattttccacagcatgcaaaaaaccgcattctttgtcatttttaaattttgcttttgcatagaaaataatgacccgtgaaaaaatcggtgtcaaaggctgagagacggcgctgcttttttgacattcacatcgatgttgataggtcaggaggatgtacggaggagagcgaccatctcgcattggattgaaagagaggggtcgttttcttaagcggatgggcggctattgtggcgtttccttcagcgcattgtccaaagggtaagtgaatgaatagttcaaaagtttgattggggatggccattcggattggtcatatcgttttggcccagcaaattatttgtactttttttcctgtacaaattatttgctttatagaataaaaatgccctctccctctggactcccttggcttcccgtggagaattgccaatgtcctattttggacaatgagtgcattcgtccactcaattacacaaagcccgttatctgtgctcacaagagcatcaaaaacttgttggattttgttgcttccccagggcaacaccctggtactcacaatcatttacctatttattttttctaatttttaattaatttagtgttcgcgaatgtccatgccactgataatggtggctcgtgtgccgctcagtggtggctgattgtggttctgcagctactggttgtgctgctcattgtatgtttaaaatttaatttttaaaaatttaattattttaaattcttctcaatgttttcacgctatttaattaactgttttccagcttggtctgttttttgcggcgatgtggagcggctcccgttgccgcaaatatgtgatgcgcgggccggttgaaatgaccgcgcttcgccggcagagttcaacccgccgtcgtggtaaataataaatttatttaattaaaataattaattacaagtattaaaaacttcccgtttccatttagtggtcaactttcgtgatccacccgagcgcccgttgaccatttccgcacacatgcgtgcgcgatcggtaagacattccattgttaaatttgtaaaacattttgctttttcgttaggttcaatgagtgattgaacgatggattggtggatcgaaggatggatggatggatggatgaatgaatgaatgaattaattaaattaaaaggaaaataattatttaaataaccgtaaacttaattttttttttaaacaataaaaaacattctgttctgtaaagaatttaaagtggtactgtaattgactgattaaatttattacacaattaaatagtcatgttaaaaggtaacttaaaatggtaattaaatgggcggagtttattttataggcaactgtatataagcataacattttcaccccgcacaatcccgaaatcattcctagaaatttcaaaataaaattaacatttccaaatatggcaaccaatatgcacgacaaaaagacgctgctcaaccaaatacttggtgaagcggatattacagtttctaatagtgggattaccgtaagcggtcctcgcctctccactcctcgcttcgttccgtttgacgaaattggcagatgccactgctgtaagtcaactgaggtcgaagtcgacaccatgttcaccaaagaaggggtcacaatttggtgtagcagaattgacaaagtgcaatttgttccctttgatgtcgtctatgacctaccgggccattgctttttccgactaaagaataaagcacgagtgttcaacatcccgtatggagagcctccaccaatgacgtgcaaaaaccaaaatagtcaaagtgatcaacgagaattgaaacgaaaagcaaaggttgcgctcgatttgttggagaccggactaatggcagatgccttacaagacagtgagagctggaagaaagcaaagacagcaatgaacgtgctcggaaatgtacttttggccgagtctctacctaccgtcaaaaaagaaaacaaaaactctccggcttcccctgttgaccaaaatattgcgcagccaaaggccgagcctcaaaaagaaaccaccaaaaaacgagaagctagcgaagagaagaaagccccaacaaaaagccatcactcacaacgtcaatcaagtggcacacgaaaaagcagcaaagagttgatgaacgaaaagccatcttctcctcgtgctgagtccattcccgtacagcacttggactctgcttccacgcaaattgatgacgtcagcgtgcctaaggcggataaaataccaaaaagcaacaacgaagaagacctcggtgacattgataaaactcttgatgaattttttgctagcataaaagcagcgaccaccggtatgtaaaatgcatatttaagtcattcacgtcatcattacaacacaaattaaaatgcttaatacacaatcatttgttgataaagatatttgctttaaactgccttgtggaattattatttctggtccatcctcctcagggaaaacacagtttttgttgaaatttattgacgaattactaattattccgcagcctgtctctatactgtattgttttggggaaatgaattcggcagtgccggcacttcaacgggcgggtgttgccgtatactcgggtgtcccttcggaggaattgattaaacaacattgcaaacctctcctactcattctcgacgacctaatgctgtccattgacgaacgttatttgtcagagttatttaccaaaaaatcccaccaccaccaatttgcggttgtgtttgtaactcaaaatttatttgaacgaaaaataaaagttgcacgtctgtctgcgcaatatttggtgctgatgcgggcgcccaactcattgctgtccattcgaaatattggcgttcagcttttccctcgtcagcttgatttttttcttgatgcctatcgtaaagcaacagcaaaaccttatggctatttgattgtggatatgcatgcttcttcggaccctcaattgcgacttcgcacaaacatatttaaggatgagcaagaggaggatgggggtccagttgtattcataccccagaatggagcatcattctaagcaacaagcgaacataagccagcttgtgcgtgaaaatttcgggtttttgcgtgttttatcgagaacaaagtccccaacaaaatgtagccgaataattagaaaagcaaacaccgatcagctgttagcactggtcgaaatttgtttaaacattgtctgctcccgcttccaattgactactcgacagaaaaaacgtttaatgcctcatgtggagtttgtgcgatgcatgagcagagcgagaagcgagcggggcgcgaaacggaccattgttcagaaaggagcggggattggtacattcgctgccctattgacacctgtactcattgaattagcaaaatcagttatatccaaaactatataaacaattccctaacaattattgttgaatcattttaaatggctaataaatttattcttgttccacaagaaatttaccgtggtctcacatccgcacctagtacgggggatattaatttggataccgtacggcatgatttggaccgtaccagaggtgaacgtgccaacccttctactaaaaatgtccgctataatcaacagcttaggcgctacttacagatgagacgggaggtcgcagatcggccatccaaagttgagcttaccaagggaataagtgtgctgttaaaaagaggtggcgaagacggagacggccaagttgtggatacacctccccgtcctcctggtccccctcctcctccgccacatcgacctcgtggtccccctcctccgccaccgccgcctggtcgtccaccaagccctccaggtcccggtccctcgccgccgggaagtcctccgcctcgtccacaacgtcctcctagaccaagcagagctgcgccgcctcggagaaaccgtcgtctggagcaatggcggaaaaggcgatacgatatacaacaacgacggcagccagctgtgcgcgactttcttgcggaagcagctgcagctcctttacccgaaagcgacgaagaagctgattacatgctggagaatggattcgcgctgccagcgccttcacaatactatggtgacttgcctgtgctaccagacaatgcggatgaaattgaggaaatggacactgttcaacaaagattggctagcaggaggaaactaaaaaaggacgacgacgacgacgatgatgattggcaagacaaaaaatacaaaatttactatccacctccccctgctcgccggcccccgtctcgtccagcaaaaattgaaccaatgcatccaccacgtcctaacccgaagagagagccacagccaaaggtcgaccctcggccatccacatcaaagcaggccgatataaaacctaaaagggagccaaagtttgagccggatccgcgaccatccacatcacggcaagccgggtacaaccccgccccaccagctcccaaaaaagagccaaaacatgagtggaaacagacaaagcggcgccattctcctcctcgcaccgcaccccatcggattccgaaaagagagccagaaattgaagaaacaccacaagagcaacctccggctgctgctgctcctgctgacgttgaaatgccccatgttcctccgcctaggcgaggaaccaaacgccgttatcccccggaaaatgttgaggatggtcagccgcgcttacgtaagagagtgaggcaagcgagaagagcaagagtatattattcgccagagccaggtccatcgacctctgcacaaagtgatgaacaacaacagcaacgcgaactattttccattccgacaaatcagctgacgatggcacaaagagttgagctgatatgcatcaaatgcaatcgctattccgatcgtatgggtgttcggggaaacgcaattattaacaccaaaaatggacaaccattggtgcgaagcaatttacgaatggccatcaggtatataatagacaggagagcaggccgtcccacgattagaccaccaggagcggacctattggaagaacggcttaggcaggacccaattttgtattcattgacagctccaccaaagagaccatcacagagtacaaccaccaggacggcatcgaaaatcaaaaaagagtttcgcccgaaaaaatggaattaataaatgccactcttgacaaactgtacaacgatccatcctcccccgcggctttttccggtgttactgcactgtggaaagaggcgagaaaaaagataaaacaattaagtaaaaaagaagtgcagaactatttggaaagtcatcgtacctacacgttaatgcgcccccgacgggtgcacttccggagagcaaaaactgttgcagcaggattcatgacagatgtccaagtggatttggccgattttcaagcgctttctcgtcaaaatcgaggccatcggtatctgctcgttgcggttgacgtcttgtcaaaacgcttgtttgttgttccgttgaaaaataagagggccgaggagatgctggaggcattcaaggaacttgttaagcaaatgccaatggttccacatcgcattttctccgacaaagggactgaattcaaaaaccaattactcaaaaaatttttcgatgagcaggaaattcagaaacatgagccagtccactcatccgtgaaggcatcagtagctgaaagagccattcggaatgtaaagcaacgactgtacagatattttgcagagaaggaaacattgaattgggtagacattgttgaggaaattgttgaagggatcaatcactctccgtcacgggtccatggaatgcgtccaattgatgtgaattttaaaaatgcacaaagggtatggaaacgcatgtatcagactcggcctcctattaggcgtccgccgcgcttctataaagatgattttgtgcgaatgactcgtgagaagggacaattcgagaaggggtatctgcctaactacggtgacgagattcttgaggtagatgaagtgttaaaaggtgtacagcctgtacgatacaaactcagagatgatcatggtgagaagttcaggggtacgttttacgaacaggaattggcacgagtaagaaaagacactgataccagttaccgaattgagaaagtgattcgtaaaa

SEQ ID NO: 2063 - DNA, 830 bp, Heterodera glycines
taacttcaagtgaaaaatgtcaaatttgtaccatcaaatttattgtcaaattcgtatgctgtgtaatgtcagtgggacaataaaataataattaattagggcagataattctgcaacaaaaagagaaaagtttccgggtatcgttccaaaaaagcgaatggtttatgatattgttaggtgtgttcaagtagagtcaaagtccattgccgccgtcattcaccaccaaaactgtggatgttcattcagccaacactaaacaaaatcgtagcggaacttctcgcctccgggctcgcccaggtcgggcagcgaaccagtgacgatggcctttaaaatggaacggcttttcgtatttccgggaaaccatggcttaaaataatggaaagaaccaacctgaatgacccattcgctggacacggccaaaccgccccgttcctcgaccagcttggccacctcggcctggcagtccgtctccgccagcagcacatcaacgggaggctcaactgtagaaataaatccaaaataagtgtaataattcactcaaaatgtgtacttttggaacagaattccatcttttcctcaaggttagcgctcgatttggaggcaaacggttcaccaggaccaatgccgactaatgttgcgcccaaattttgcaggatcggtgtccaaatttcggcaaaactgacctaaagtgaaaattgtaatgtgatattttttcaattttcagtcatgttacaatgccagggtccgtctcggcggagctcgaccaaatcagcacacgctttcccttcatcagcacgcccctttagtggtctcctaaatttgcaatgttt

SEQ ID NO: 2064 - DNA, 7062 bp, Heterodera glycines
catttatcttcatatgtatacataaaatattgtccaacaaaaattattcctacaaatttatggtacaataattggtgggcaacaggcaacaacaaaaacagaataacggtgtccatatcattatgcttcttctcttttttttccgtaaagtcttcaatgatactgcccccgcgctcctcaatcacttcttggtgttgccgggcagtttgaccttctgttcggctgaggatgcatcagacaacaggctcgaaggaaccgctgaaaatgaaaaaaaaatattttcgcgttaactctttcgcctcaactcacaaaagtcgggaggagcttcatcagtctaaaaaattaaattgcaatacatagagcctcaaaaaacaactcaccactttggtgtactcaggcgaactctgtcgcttccctttcttcttccggccgaaacacattataataataattgcagagaaatacaattgttgaatgattacagagagaatgaaaatgagtgttcattccgtctctatttataaaggcgtaaagacaaaaaatgggtaattaatcggcggcactaattgaaaattgcctgtttaattaatgcgttgggctgatcatttaagccttaaatgggagttaattaaggcgggtggtttgacgtttaacttaatgctatatcttgttaattttccggctaacactaattgacacgaatcgctttttttgttcaaaaaaaatgtcaaatacaaatttcagggaaaatttttttgtataaaaatggaaaattttatgcgttttcttcacttcaacaattccctattcttcacaacaattatttgttcgtctccaagtctcgtcaaacgtctgcatttattgttcatcaatccttcatcggttgccacccgcgcgcacttcaaaatggacgccctcaaaagacttgcgagccgtgcacggcaggtaaaaaaggacggattgtggtgaatcaatttttttaaaattgccatccctgcacatttcagaagtcggcggagatcatcctgagcgcggagaagaccgaaatcggtaaggagggcatttttggatttccaaaaatcaaaaaaacaattccccaaaattcaggcgccgagcttgaacaattgctgaccaagaccgacaagacggaggagcacatgaagaagctggtgcatgccatcgaggtgtacctgcagccgaaccctggtggacacttggaatttgcaatttttggaggaaaacactaatttttcccccaattttcagcagtccgagcgctggacccgcgaaaggacaaatccggccgacagaatacgctggacggtcttggggaggcgatgaaggtgtggtttttggcattcacaacacattttaatgcccaccaaaatttaaggaagcagcatcgaaagcggtgggcgccgagtcgaccttcggaggtgagagaatttgaatcggaaatgctcaatttaattaaccccactaattgcattttctgttcttttcagctattctgctgaaggtgtcacagacggagtccaaaatggcagcaggggaacgccaactcatccaatcggtcaccacgcaaaccttggcaagcctccggcacctcctggagaacgaactgcgcaccgtccaggcgtggatttgcaatttttcactcaattttcgacaatttttaatccaaatccctcccttttcctttacagaaggaacgcagcgtgttgaacaagaaacggctggatttggacgcgacaaaaagccgttggaagcgcgcctcggacgacaaaaaacccgctgtacgtcgtgtgttcatttcgtcgccggggctccatttttcaaccatcgaccaatttcactgttttttttttcaggttgaggcagagttgcgcaaagcccaagacgaatttgacacccaactggagaccatcagcactgcgttggaggctcttcaaacggccgtggtgagaattctcaaccccaaaaaattgtttgacaaaatttcaattcttttccaggatcgtcaggctgaacaattggtgcagttcgtggcggcacagatcgaataccacagcagcagcctcaaacttctgaaggacctgaagcgcgacttgggagcctagtgattgatgagcacaacagcagaagaagaagcagacggatgatgagagacgaattgccatggagattcatattggacatacccatatttgtgtattatactggattaatccaaattgatgcgtatatattacttgtacttgtacataattgtatgtgtataataaacactaattaacccgtgccatttgtgtgtttaaaatcagattcgctatttaacaaatttgactttttcgtgacaaaatggcggttaaaaaaagaatgcattgtcattgccgaaattatgaattgaccttcattctattcttgaaaaccaagataatgtttaccaaaaacacggcttttcgccaaaaaaaatgccgaattcggcgttttggttggtccgcttcaattcctaaaagcagcaaaaacagcgtatgtaacgtacgcacttcacgaatccgtggtgaaagagttttacggatttatgtgctcttatttctttgtcattttcaaaaaacttttactaaattacgaatttctaagccaataatggctagaaaagagcgttttgatcagctttatactcaaaatttttgtttgcttttataattcagaaaaagaaaatacgccgacacttttgtatggcagagcagagaaagaaaagcagaaaaatagtgcatgtacatgtacaatccggaaaagaaacaaaagaatagttagaaagtactgttcgaatcttccctttcctcgcccctctttcatcccataaattaacacattcattcaacttttgcggtgctttatcccccccccccccgcaaaacgaatttgaaatgttcggcaattcattcatttattcacaagcacagaattgaacgaattggaatgacagcacgtgaaagtcacacacaaaatgcttcttctcttttcctcccgcgtcggtcggcggttcatttggcgtccgtcggcgcttttcctccttccctttgtttgttaagccgcttttcctcctcctcctcctccgcttttctgccgttcctttcttttgctctctctctctctttctctctctgttttctttgttctttctttctttgtttgtttgtctgtctgtccgtctctcctcccctccccattcaaacatttattggcttttagtttagcgtaaaattcattggaactgacgagagaacaaagaaaaagagaggtcatagaacactttgggaacgaaagcttcacaaaaaaacataaaaaaaattgagagatggagatgaagcggctaaaatcagggaaaatgccaaaaaacatttttttaatttcctctttatcttttttttttttgcatttgtgccatatcgaatgtagcttaatttttttccgattcccgagatatttaaaaagtattcaagtggtgccaacccaaggaaaacaatcccattaattttttaacattttgtgaaatttattgactgtgaaaaatacttaggctgaagcttgtagcagggatttgtgaaatttcgtgcagttttcatttcgtcaattttttcgacactttttttgttcgtactcaattaaaattttatatttaaagattgtaattttcatttagtttttgaaaatttttgatttttacacatcctatgcttgtcagcgatttaattctgtctggaaaatccggcatttgtcgagtttttggattttgtccatcgtatgcccgggatggcaccttttcaagagcaaaaccttggcacgcttctggaattttttacatgaaattctcggaattacagattttgacttttaaaacaattctgctgttcacctcggttggcacaaatttaaatttttctagaaatcccgaaacattttaaatatgtaaaatctttacaaaaaattcccaaatatttttgtataatttttttaaaccctaccacatttattctgctgactatgaaaattcctttctatttttgcgcatttaaatgaatgactgacatagtaattagtacataaataattatgatgatcactttttgtcctctcggcgacagcttctcactttgagatcgatttgtttgttgtgaaagaatgaattatttttgtaaaaattgccctatttttgcaaatattaattaaataataattatgtctttttggcattttaaaaatattttattatttttgtgcgctttttgcaaatgccaatgccatcggcggaagaaacaaacaatgaacaaggcaacaacaatgaacagcgtttgctgctcaaccattcatcgaacactgaagaaagcttatgcagcagcgggtgaaaaaaaaccaatggaaattaattaaaaattgaaaattaaaattgaaaaatacctaattaacagggatagaaaggatttttacacaagattttctgcgggtaacattttaggagataagtacgaaaattttgcggatttttccgcccaactttaaaattaaagcgatttataaacacccaaaatgcccgattttgggagtttggcacttcaaaacggatggcacgaattccgactttcggttttcgccatttttggggtaggaattccgatttctgaagaatttttgggccacggaaatgccttccctgcttcaaaaccaagttgaacctttatttgtcgggccgctaatgtccgattttcagcaggccgcaaatgtcttaacacgtttggcacataaaaaccggtctacgtcagttgggccccagcatgtttttggactataactttttttgtttgtcatccaaatcaaactttattggtatcattcgaaagcccttaaggctgtattagcctgcaaaattccaaaaaatttcgtcaattttattgtacgaactgccatgaccccctccctgattgtgagctgattgccggcaattttcttttcttttttgtttctgatttgttctgacgttagtttgtggttgcagcggagtttaaatttgccaaagaatttgcataaactgaaaattcaaatccgtggcgaatgccccgcggggtccgcccaattctttccgtttctccacaaattatgcacatttaaacattttagtaaaacatcaaacaatagaaaaaagcttttgtttcagagatgccataattggtgatgtattattaaacaaatcattcgtcaaaaaatgaaatttggtccataaaatgcgggaaatatttttaaaaatccaatttagggcataaaaagagacgaaaatttttaattaaaaaaagaaacaaaattcaaaggtgtcatagacatcagtggtggcattccgaggcccaaaaaagtatgggaaatcgaattccaacgtccaaaaatttaccggaaatcggaattccgaccccaaaaagtcggaaatcgggaaccgaaataatgaaaagcttttttttgaaattataacaattttccataatattttttttactttaaaaactaaaattaagccaaatggcaattctgaattatttagcattattttttaaatgtcactaaaatttgaacctttttttaaaaaatgtttacgatttataaactgctgatgatgagaaaagccgccggcggtttttgatcagcggaattgcgcagcaaataaatgtcaaaatgaattaatacattaaacacagtcccgaggtgaacagcagaattgttttaaaagtcaaaatctgtaattccgagaatttcatgtaaaaaattccagaagcgtgccaaggttttgctcttgaaaaggtgccatcccgggcatacgatggacaaaatccaaaaactcgacaaatgccggattttccagacagaattaaatcgctgacaagcataggatgtgtaaaaatcaaaaattttcaaaaactaaatgaaaattacaatctttaaatataaaattttaattgagtacgaacaaaaaaagtagggttcgagccccgtggggcgggggtggcttttcacgggggcgggggatgcgggggtcagagtcacgggggcgggggcacgataattccgcccccgcggggacgggggcggggtttgctttgaattaggtccaaaaatctcacaaaaaaatattttttaagaatgatttctttggctccacattcctttatttgttgatcgcctcgatactatttcttttgacataaattgcacagatttcgactaaaaagtaaccaaaatttagggattgttgggtaattttttttaagaaaaaaatttgccactgttgccacgtgaaaagaaggcttgggattgttggagatggagcagcaattcgtttcactctcatcggtttagtcacaatcaaaatttgtaattaattttaattcgctgtcattcattggtcattgttactaaggaagaaattgcccgggtggtgaaaacgcagaaagagtgggttgtgtcgagtggttcgattcccacccgaggctgacaccttagacttaagctttcaaccagacaagcacttttccttaatttatataaacatttttcttaaaagcgtaaagtgccaattggtggtgtgtgtaataataataataatgcataatttgtgggaattgggtggtgaatgagggtcacattctccgatcagtcagccaaaattggtcgattctgatcagcaaacggtggaaagcataaattatatgtaaaattgggggggggggaaagaggaatgtctgatgtttgatgggttaatgatgggacacaaaaattgatgatggaaacgaacggggcgatttgtttttgtgggtccagcggcggtggtcggaacggaaggcaagaataaaatagaatttgagagaaagagataaagacgaaactcatcgttacaacagatgatgatgatgatgcaagtcgggaggagtttggcggaggatttgaaaaataattaattcaatttaaattgtgtaataattaaatttattgttccatgacgtcatatgcaaaaaa

SEQ ID NO: 2065 - DNA, 2495 bp, Heterodera glycines
gtgaggggaagggccaagggacgatttccaatccgagcacagggaatggcgcgcgacccgaaccaatcgaacggttaagccattcccaaacgccggtggtcaaagcatcggggagggagctgagctatgtcctgttgttctcctgcttgctctgctattcaatgacttttgtccttctgtccaagccgagttggacagtttgtaccattcgaagaacaggtgaacttggaggggagggagggattgggaagaaagcccccgggggagagaaatgggcagagggaaggaaaagccaaaatgggggggggatcggaaagtttgttgtctgttgacttcatcacttgctcatgttaaggcatcggcctcgctttctcctgtctgtactccgcccttctggtcaaaactaaccgaatccatcgcatattttcccaggtgttctcactgctaatgaattccttttaattactaattaattgactcattaattgccctctgtccatttcctcctctaaggccactcggactcgacgtgcccctccgctgatctctcccatctctcaactgttgctcacttccgcctttattggctccaaaatgatcttctcattggtttggcttatcattcagccgccgggtaattccgctgggtgtccattcattaagccctaattggcaacatttaattacgcaactgtccttccctcaggcactcgccactttcatcccacccgtgccgaagttgtgctcacttgcattgtgcccgaccaccactttctctattccctcgcctatgaaagccttctgttaattatgtgcacagtttacgccgtgaaaacacgaaaagtgccggaaaatttcaacgagacgcgttacattggcttttgcatgtattttaatttttgtgtgatttggcgtccgttcgctttttcaatttttcccttaaggtacacaacgtgtgttctgtggggctgtctgattctgttctttttcggcaccggcagtgacttccaattgcgcacaaccgcactttgcatgtccacttcgatgagtgccaacgtggtgacaaatgggagaaaggcggggaaagggacggaccaatgccaatgccaatggcaaatttggggctgcaaatgccaatgtccaaaagatcaattccctctcttttcaaggcgttggtgtgcattttttctccaaaaatttacgtgattttgttcgaaaaggacaaaaatgtacgcaaagaaggaagtgggagcatgctgaacaaaaagagaatggggtcgaggtgagcgaagaatgaccactcatccattggctaatcgggggtaattaacgcactaattagggacggtgattaaggaaggagtggtggggactgggccattccgttgatcacattcagttattacgccaacaatttggccaaaaacaacaaaaacgcggccgcatgttgtgacgagccgagtcgagcgctttgctcctccgctgaccatcactcgtcctcctcgcccacagtgcacacggcgctgttgggcaacaacaaccacaaacggcaaagcaatgcttcgtcttgtcgctacactgagggccatgacagcacaacgaccgcgcagcagcaaagcggcggaatttgtggccaagacacatttttatgacgaaaattagagcaaaacgaaattcaatgatctcacaaagccgatttttattgttactattgcctcataagttttgtttctttaattttttgcgggttttattaacaagaaaaggtaacagtttgtctgccccccccccattttctaaatcttctaaaggacatgaaaactggtgcacctaaaaaggtcgtcaaattttttttccttcaaaaactcaaaatttgccaaatatcagaaaaaaagtaaaaatctctttgaattcatttttttcttttcggcgacatttaaaacttttatcattattttccgtactttttcgattgtttaatgaaaacaaattataaaggaagtggaattaagttcaaatatgttctgcgcttaaagttcacatcacttttctacaatgaaagggtgtttcaaagcatccgaacacgaaattcgtttggaggggtccaaagctgtcatctgttcgagcaaagaccggaaatggtcaaccttggcaaacccatctctgtcaagttcctgatcaccggagagttcagccggaagattgcgcaacaatttgatgttggtgagcactgtaactttgtcctgacaatggaaagacaaatgcattcaaaggtttactcagaatttatgattgtttgtttgtcagtactcactttgccggtgactttgtccgtctcatggtacaaaaaattgcagttgtagtcgaagtgttggtccttgaagaccgcctttcgaatcaccttgttcgggaacttcccgcgcaaatccatcatgaacttgagcatttggatatttgacttgcccgggaacattatttttcccgaataaacttca

SEQ ID NO: 2066 - DNA, 1838 bp, Heterodera glycines
  misc_feature (1752)..(1752): n is a, c, g, or t
  misc_feature (1766)..(1766): n is a, c, g, or t
aaagagtgagaaaggttttgcaagaacccttaaaagcgtctatgtaattaggaaatggtgcaaagacacagaaaagcaaacaaactttggaataacaacccaaaacaacaacaacacatcgaacggcaaagttcgcgaagctcaacggacagttccgaagagcactttcaagagcattgtgaacatggaaaattccgttgaaagacaaaacgtttcagatggttaatgtttttgcggcacaattttccggttaaatttgtgttcttcggaacctttcctaagacacttaccaaaatattgtccggctttatgtccgcatgcaaaatgttgcattttttcagcagtttcattgccaaaagtaattgttgtgcataactgcggaccgctttcatgtgaaggccgacgttgttgccgtacttcttcagcacttccctcaaattcatgctaaaggggggggggggggggggaatctgttactaacaaagtgacgacaaaagaaaacacctgagattttcgaagaccaaacacaagtgattccgatggtaaaattgcctgtaaagctgtaaaatgtgatacttgtccaatcggtcggcctcgttcaacttcttcaacacttccaattcccgcacaccggtcttacgcctaattaaacatttaatgaatattattcattcaatagaaaaaagaatttatttaacggaatactgcagttttttgtgtctcacatcatgtcgttgttgcggataatttttatagccacttttgaatttgaacggtgagtgtcagttgcccggacgacatttccgaacactccggcccctgtgtagccgtaaacgcggtaacgaccgtccaattgttcgccgattcgcacaccttaaaataaaagaaattggaacatataaatagagcaaaaacaccataagattaaaaaaacagaacataaaatctaattctgaaatgtcatttaaatttattttttttatcgttaaaatgctgaaatttctaatttcttgtacattaaaccaatttaaaaaaacaaacgatagtatccttcggtgtcatcccaattatccttcaacgcagctgtggttgtgtccagggattggattgtggctgctttcgaaagaagctgaaacaaaacgaattacaaaggatatttggtccgttttacctcaacgggggcatcatcggcgaacatgtcgaactgaagggacccatccgcagtgtccgcctccttttgctgctgctcactttcttctacaacttcggcactttcccctttgcagcgttcaattttttccctttgcttctcctccagaaattggcgcattttctcttcccgttcatattcctcggcttgttttgccattcgttcagccttttttaatgttttataaatgttaccaagtcaaattcactgacctcatctcgatttttcatgtgcgatattttctccttcaaatctccaaagaaatcaatgttcggactgtccaaaatgcttggcgagtgaattggagatgacccagtcgtgccgggggtgtcttctccgtccatcttcggcttcttcagaacgtcaattgcttccctcaacagacggtcaacttgggattcgccatctttcccttcttcaccatcctccaggccaatgcttttgttacagccactgccattgtcttccgaatcactcgaagagtcgctgcttgacgtgtgctttggagatgaagcagcactcgtcttttcttggatactgtngtgaagaagaaaantgcaaatttaaataaaaacatcgcgtcgaattataccgatcgttttgctgctgctcattcacatgatcagtc

SEQ ID NO: 2067 - DNA, 5367 bp, Heterodera glycines
aatggttatttttgggaaaaaaacccttgtaaagtgttaaataggcgtaaaatggcataaaatgacctaaatatgttagaaatcaccttttaacatttaaaaaattatttttggaggggtacatttaaaaaaagttttttttttaattttttcactagaaatttctaaaaattttcaaaaattctcaaaatatgtataaaaaaataaaaaatttgccaaaattttggattttttttgaggatttccaaaaattttccgtaaaaaacccgcaaattatgtaaaaaaaaatcaaaatatgtaagaaatagtctaaaatatgtaccaaatatgtataaaaccccgaaatatgtaaaaatatgtaaataaaagtcccaacttttgtttgcaaacataaaaaagaaagtgtttttcctactatttagagcatggagaagccaggaaaaaaatatgtatttacataaaattgacatccctaataattagggttgtaaattatatggattaacatattttttctgcgcatatgctatgaagaaaggggctcaaaaatagcatttctacgttaaaattttttgatttgctgaaggtttttagtccatataaatccatattttgggggttttcgggaataaatccatatttcgccatttttgtctttttagtcaatattttggccgtttttggcaaattttcacaaaaaaaaatgcaagaaaagcgaaaaatgcacccctaaagatggactttttggaaattttaaaaaaattagaccccaaaaaatccgaaaaatttgagttttcgtcgtcattgccattttttgcgaacttttctttttttaaaaaagaatttttttgaaattttggcaaacttggaaatattttttatacgatggacgacaataaaaaaaatttgcatttttatgttttaaatccatttttggttgtttattgtttttttaagtttatttaagcaattattgaacacaaacactttttttggaatttttgagggtttaaaacacatattttgacagtttttgtccatattttggtccatatttggccatttttgagctttttagtccatatttcgggcttttttagtccatattttatgtccatatttgacgttttttagtccatataatttacaaccctaattattacctatttattttcttaccaaaaattaaaatactgatttggcttaattttgttacttttgcaataagcccacaccgtttcaaaaaacgagacatgaaccaataaatagagagtgcagagaaaaaaacatctctctttttggcgtactatttctttatctctgttaatagagaaaaaccgaatttacttcgctacgtttaattttttttctatacgttagatccactccaaattttgcatatcgatagagaaaaaaattacaaacaaaatgtaagggtttttaaacgcaaaaaaagggttaactaaaaagttattcgagaaacaaaatttcgaaccctcatatctttttcctaatcaatccaattgcttagcagttgcttagaaaaagcttctcctcataaagagctttcgaatgatatcaagtttttccaatttggttcggaaaaaccttcaaaaataattcccaaaattcgtcattttttaatattttggacaaaaataaataaaaatattcatgttgcacaacggactcgaaccaccaccctttgttcctttactatcttacaaaaaccacttcgccacacatgcaaatgtttttggaactgagaggccaaaattgaaacggtgtgaagccctaacaatgactggtattatttcaaccgaacccagtgtaaatacagtcgatgattccaaaagcagtggttcttctgcaagtaagcgattctcagctaatggactaaccgatactttgctcattcagaccctgaaatcagtgctgaacaggaattctgtctatatgaacttgaaacactttctgattcttctagcattggcttggttctgaggtatctatttatttgcatactttggcagtaattactttccaccaaaaagagcaatttatgattctggagatgtgcacaaattcacacatgctttggagaagcgaataactcactatgacaagagcatattgaaggtgtgcactcatcattatcagggctttctcgattcgatcaaacagcttcgtgggctcaaagaaaaatgtgcggagattcgcgtaattttctttttttaatgtttttcaatttatcatttaaacagaaaatgacagagacgactgatcaccaggttcaagaggaaagcaaggaactgctcaagcgcagtgccgaaattgtccgatatcgacgattacaccgaaatgccaacatagccattcaacaactttcgatgtgcttaccaatgttggaaaattatacacatctgcaaaaattaatggagcagaaaaagtaatggttctaaacgcgattttaggaaaataacattggactgtctatcatggctcttatttatgggggttaaactgtatgatagtccctatcattgcactcttcgagatcatatttttttaataaaaagaccatttccaggtatttacaagccttgaaaattctcgaagaacttgagcataattacttaaatcagcttcataaatatcggtttgcgcatcaattcgtcaaatcaatcaagccgattcgagaccagattagagagaaatcgtattccgaactgaccgacttcctcgaaaaattaattgtaatttttacatttatgatttaaaactgaaattatttgtttagaaaatctcagaaacaatcggtgaagacgcatgcaaacaagtggacatttgaatgattgaaatttatggaccttttatttttagaccgagaagttctacacacaatttcattcgaattccgctgagaaaacacaaaaagcaaaccaaatgggcagtgcaaatattttagtgggcaaaatggaattgttggatattgaaatttccgaggacggatcgttgcttagaaagacagcaaacgcagcgaaaccaatgcaaagggacaacgaaggaaaaacaacagaaaaaccgaaaccgatggctagaaagatgcttccggcgaacaaacaacaacatcagcatgttcaattccattcacaggacaaattggaattggggccggtccaccgatgctgccaaatattcaatgttatggtaggcatttggagaaattcagaaatcacagcaatttttaattcttttcaacaacagttaatgttattataacagggtgaccgcgacaaatttgaagcctactacagaaagcaaagatgcgaccaactccaactgattgttggacgacaaatttcaatggtaagttttttatgaatatacgaacaatttcagaatagtcaacaaataaaaatggtgaagaagaatgccaaaacggacctgtcaggattttcccgggatcctgtttgtttattgatgctaaaattttgttaattttgcataatgtttatccaattttcaatttcgctttttaaccccaaaagtgttcctttggtgtttggaacacactgccgaaccgtaaccgttcctttcagaaaataaaaactagaaaaattgattgaaatattttagctctcttgtaattttttaggctttttgtattctcatgtgggtaatcaaatgtgattcgatccgtgtcctatttccaaaccccaaacctgaatttttcaaaatatggtctcttttttatttaattatatatgttttttatttataaatagcaaaagtgttcactaatcaatggcgaaattatgaagtttttacgcttgcaaattaaacaaagaaatttatatgattttttattatgatttcttttgcaaaaaatgcctttgaaaataaatgattgacaataagagaattttgtctattttttaaacatccgaaaaatttagacagattccgtggaagtgttcgtaccatatctcaacgaaatcgtcggcttttttgtcattgaaaatcgaatcgctcaaattcagtcgtcgcttgtaaccgctggacacaaagacgaggcctgggaattggccttaaatagcatctcagactcaataaacgcacattttgtgagttttttttaattaaaatcttaacattttttgatttagggctcatgccaaaatgtttctctgatgttagcaatgaagaaactgatccttctgtttacacttaccaccaaaagttgtggttacgacccgaccactctctacagtctacttcaaaactttaggtaattatcgtttttctaaaaattaatttagtttctttttctgggataaatacaaccaaattttgatcgaggaatacagtgaacagtttgaaaatgcgttagagaacgacgattacacgcccattcaagtgaaggatgagcgcgagtatcgcaaggtggtcgaagagtttcccgtcaacaaaagaagcgttgaccaagaggtgagttgacccctttataatttggttataatttgattgattggaactcactcattttcaggatgcatttccacgaaaatttcccttttctcggtttgtgccaaaagtttattgccaggcaaaagaatttgtcgcgaattgtgtgcgctttatggaagacctgcaattgtcccactcggaagtaagcgacaccgtcagacgatatgcaaacattttattggccaaatggtcaaatgcgctgagaaagttcgtcagctcgcgaaaacgatcgcttattcaggtggggtttcccaattcctttatctgcaccaccgcattttaagctcatccaaatcaccattaacatgggatatcttgaacgatcttgcgaatttctcgagcgatttattgcggaaatggcgcgtaatttaagtggcgaattcgttggttcattgggcaacagtgggggcactttgtttgaaggagggggccatttggtcgcattgaagaaccaatgtatttatccgattggacatttattttctatgcttttcatttttagtgttcagagattctcgatcagaagttgagcaactcatagacgaggctttccgggagaaagtccaagtatttttggacaattgtaagttaacgtttgccggaatatgcacatatttcgatacttttagcgcattacgtttgggagttggaacagtcaagtggagtcgcaagtgaatttatgtgagtgatttcttacgatttgttttccgaaactctcatttcctttctttgttttagcactgatctgatcacttttctgaacaccactttcatttccttcaccaacttaccgcccgtacttgccagacatgtctgtatgcaggtaggaaactcacc

SEQ ID NO: 2068 - DNA, 2004 bp, Heterodera glycines
ttttctggttactgtggcctataacacactttaccttatttcatatgttttttagacgtgcaaattccttgccgatcgcatgagttcgatgttactttcgtcggagcatcgttcggttagcatcggtgcacttgagcagttttcgcttgatgtgatgcaatgcgaacttttcactgcccagtgccctgtgcccggtttcgaagataatgctctcgccattactttcgcacatttgcgtcaattgttggacttggtgatggggcccgactggacaactttctttgccgaaagggatgaaggaaattcgcatcgcaagggcggaagcagcggcaccaaatacgcccgagtaaaggcgtcgagtgccgcggcacttttggaaaagtaaacctctgaaatgttttgtgtccagctttttaaaaatttcagagtaattgaatttgaaaagaaaaacagtggcttttttgctattggtcgagcggacagtcgcgacaaacagaaactatatgagacaattctacgaaaattgcgatcatttacagattaattatttaatactttgtgaatatgctataattttactacctaacaataaaaaattgtaattcttcagatgtattattagattttcaacgggaagtttcatttttgtgaccaattccgggttccttaccccaaattcaaaacgaaaaatctgaatttttgaagttttgtttaaggattcggaaagagtagaaattggtattcgtgagcatatacctgctgaactgaagtattttaaaatataaactaagaaatgggcgaaaaattgagaattttttgtggtttcttcaaattttacgccaaaaatagctattttaaaattttgctttattttctgtaacagtgatttgtatcgatttgcgccaaaaaggtcattttttacaattttggagcttagatttcaaaaactaacaataagatacataaaatgggggtacgacggtgcccaaagacgccgcaaaatctcatgcaatgcatctatcgttgcagcctcctcgaagaagctgaaaagatgacatttttcgaaaaaaaattacacagcatcagaaataccgatgaaaaatctatcattccggtctctgatgtacatagtaaacattcttttaattagattattgtaaattcctataacatatacctacgcagtgtcaattactctttcttaaatcggacaataattagttggttttgtctttatgtctgacagtattgcgtcacgtgttaaactctcgcgacggaaatgtgtaaacgtaagtttaagcttttctgtccaatttttctgttcacttttccctttccaaatataaggcgccttttttagattggaaagtttgttttacaaattcggcaacggtcggagaattctctgctgaaattccatcggacatatcaggcagaattcattgattaattgtaataagtgacattctctgacatctttccccctcatttacacagtttaatcgttccaacacaattggcgctggacaatttgggacggtttatgcgggaacaaatgtaaaagatggacatcgagtggccgttaaagtaattagacaaattacctattttagtttttgacttattttttaatggttatttcctcaggttcttttaaaagagaagtttctccactcggccttttgttgtgttggctcgttgagaaatgagttcattttgcttaagaagttgaaacatcccggcatcataaacttagaaatgctgacggaatcttcgaaagaaatattcgctgtgatggaaagggcggacaaagacatgctcgagttcatcctgagccaggcatatttttcaggagttttttttaagaatgataattttttaggaaaacaggcgactggacgaacgtcacaccaaatttttgttgcggcaaatactcagtgccattcattttctccacggtcggagagtcgcgcactgcgatttgaagccgggtaaagacaaacg

SEQ ID NO: 2069 - DNA, 3604 bp, Heterodera glycines
atttcgaatgaatgccaatgattaatttcaaatgctttccttttcgtccctcttttctttgtggcgtcgtttctccctttaccattcatttttcccctttttattgcgcgaacgtggacttggggagggaaggcgtgccaatgcaatgacaaaatgccgtcaaattggtgccgttttgcctcccctgtccctccgtccttccgttgactttcttcccccattcccccaactccaaaacatcattcatcgattctgttgtgctcctccgctcattcgttcgccaattaattgtccaccaattttgcatttgccttccccgccccagcgaaaatgtgccaccaaattcgaatgccatgccaatgttttctctcttatgagtgacttcagctgttatttgcatttttatgaggctgccaaaagtaacacaaagaagggaagtgattaattggggagaaaagggaaaagcgacaaaaaaaaaacaaaaaattaattaaattaaacgaccattcgacttttgttctgttgggctgtcgtcgcttctcactgtccttttgctttcactttcgccgattgtttgtcctactccgttacacaaattacaacaccaccccactcgaactctttctcttttctctacccttcctttttctatttccttcctcttccgttttcatctttcctcatcccttttctcttttctttccctttctccttcctcttttctccccttccctttcatctttcttcttcccttttctttttttctcttcccttatctcttttccttcctattttctcttccttttcctcttccatttttctttccttctcttcctcttttttcctctttctccctttcctcttttcctccctaatccatattctctgtcctctctttttcttccatttcaattttccctcctcttcctccttttcctctttttcttttccccttcccttttctcttttccccatttttcttccccttttttatcatttttgcttttctcagtttcgtttatacaattgcccaaacaaaaatgcgaggccatcaacggtttgttttgttgtcgaattttatgaataaacaaatcgttagttaaaggggcagagtctcccaattcataaaactctttttgtgcgtaatataataatattaaatgctcagcaaagtccgatcaatttgctctcattcgccactgatccgtcgttgatcacttccttctctgcccccccccccacttttctgatcagttctctccctctttggatcataattattatttgtttctaactcttttcgatccgttttaattttgaattttggtcatttttcaaattaacaaaatttttattttttataattcatttcatttcgacaatgggcaaaaataacagcaaattcaaaggcaatcggagcagccaaaatgaagaaaatgcgcaggcgacgattaatggccaaaggggcggtggcgatggggcgacaaaagaaaaagggaagcggaggaaggcgaacaaaagtgggggcaaagggcaaaacaattaatgagcgctaattgaattcgtttgtcattaattaggtttgagtgcggacgaattggccgatttggagcagaaaacgtactttagcagaaaagtgaatcgaattcaattgaacaaattggcaaaacaattaattaccatttaaggagctgagaaaatggtataaggtaaggagtaggaggagaaaaatgagcctaataaatttaaatttttgaggactttgtccgcgactgcccaagcggagaattgagactcgacgaagtgagagacagagagatagagagggggggggggcgaagagaggggagggtgggcgtaaaggatcacggaggcggatcaaagtgtttatttatgattttggtggctttagttccaaaatatttatcgtcaatttttccccaacggcgacccgtcaaaatttgccgcctttgtgttcaatgtgttcgacgacaatcgggtggaattgcgaagggatcaatatcattcagttaatttgaattctgttcaggacgggcacatcagtttcaaagagttcatcgcggcactttcgatcacttcgcggggaacgctcgacgagaaattggactgtcagtggggggggggggggggacgaattgaaactcgaattcgattaatcgcctttttcttattttcaggggcattttcactgtacgacgtggacaaagatgggttcatcaccaaagcagaaatggccaatgtcagaacaaaaaagcaattgaccaatattatttaaattatttgagtaattttaatgaataaattttgcacagattgtggacgcaatttactcaatgattggcaatatgttggaattgccaaaggacgaagacacaccacagaaaaggtgaatgaaaatggaaaacagtgcaaaaataaaaaattaaattaaaaatataaataaaataaaaaatataaaaataaaattcagagtggagaaaatctttgccaacatggatttggtgagaaaatgaaaataaattaattctccaatcagatgagggtttaatttgtttttttcattctcagaattttgacggcaaattgacacgggaagaattcaaacagggatcaaagaatgacccatggatagtgcaggtaaaaaagaaggggggagagaaagggggaaagagagagagagggggagagagagagagagaaaagagagaaagggagagagagagggggagagagagagaggggcagagagggggagagagagagagggagcgggagtgagaaagggagagggaaagagaggaggagagagagagaggggcagagagtgagagagggggagagagagaaagcgggaaagagagagaaagggagagagagatggggagtgaaagagaaagagggggagaaagagaaaagagagagagagagagaaaagagagagagagagagaaaagagagaaagggagagagagaaaagagagaaagggagagagagatggggagagaaaggtggaaagaaagagagaggcgggagaggacggaacttaccctgggaggggcagaatggagaaggggaggggagaagggcgcttaaaacttataaaggcttataattgaaaattctccaggcactgacaatggaaatgaatggcgccgccggcgaagagcaaacgcctcaaaaagccgcgtgaatttgtctctctctctcacttctcattgaaatccattatcttttactttgagcttctccctccctctcaaatcggtgaaattatattttcttctcaatttgtctcccaacgctttacaatttattagaacaaacaaaatgtcccaaaatgagcagcgtctcgtccgactgacaatgaacagtcaaatcgacgctttttccgcttctttttttgagtgcaccaaattaacccaaccgagcaaattgcatttactttttattgtacctccattcacaaatctcctccccgctgaccattttaattattttccatctcaacttttgtcaccaaaaacgcagactctcggctcgttttttgggttaaacggtgggggggggggcagggggggggga

SEQ ID NO: 2070 - DNA, 805 bp, Heterodera glycines
gagagagagatgggagtgaaagagaaagaggggagaaagagaaagggagagagagatggggagtaaaagagaaagagggggagaaagagaaagggagagagagatgggaagtgaaagagaaagagggggagaaagagaaagggagagagagatggggagtgaaagagaaagagggggagaaagagaaaggggaaagagagacaaagggagagagagatggggagtgaaagagaaagagggggagaaagagaaagggagagagagatggggagtgaaagagaaagagggggagaaagagaaaggtggaaagagagacaaagggagagagagatggggagtgaaagagaaagagggggagaaagagaaagggagagagagatggggagtgaaagagaaagagggggagaaagagaaaggtggaaagagagacaaagggagagagagatggggagtgaaagagaaagagggggagaaagagaaagggagagagagatggggagtgaaagagaaagagggggagagagagaaaggtggaaagagagacaaagggagagagagatggggagtgaaagagaaagagggggagaaagagaaaggtggaaagagagacaaagggagagagagatggggagtgaaagagaaaagagagaaagggagagagagatggggagtgaaaggtggaaagaaagagagaggcgggagaggacggaacttaccctgggaggggcagaatggagaaggggaggggagaagggcgcttaaaacttaaaaaggcttataattgaaaattctcctaggcactgac

SEQ ID NO: 2071 - DNA, 1297 bp, Heterodera glycines
gaagaagttcaccttttccctcctccctggctcagcccctctccccttggctacgcccacactgtcacaataagcatttaaatatatttttatatctcatggtaaattgcaaagtgaatgaaaaagagattcatttctgtccgttttcggtgtgtttattagacacgggcaaatatgacgagagaaggaatttttcagcaatggtccgacacggacggacgacgcgagaaatgtaaaaagagagcaaaacggacgcagaaagggcgtgggactcgagcacctggtggacggggttctgaaaagacaacagaaacgattaacgggggcatttttgattggaatgggtaattaattggacagactttgaaggcggcgatcggtcgtccgctctttctctgctggtcggccaaagtgcgcaaatgtttggccattacgtccaactttttcacaacaactgccactaactgatcagcaacggcgtcagaaattgctaaaaaaagaaactataaatttcaaaaggaaaaaaatacggcgaaaaaacactttcgaagccgtggaaaaaagcgcagcaacagacggcgagacggacaacgcgaagcatttgctcatcagtggcattgtgtgggagaagagaggaggaggaagggacatgaaaaatggaaggaaaaggccttaaatggggaaggaacatacgacagcgaaataattgcgaagaaaacgaatgtaattttacccatccgcagaaagcagcgccatttgcgaatgatgagacgaatcggccaaaagggacaaattgcgcaaaagttgaacagcgagcactgaaaaggacaaacaaaatgagaatggaatcagacaaatgtttatgagtcccagaaaactgaccaatgtttgggtctatgccacaactgaaaaagaaagcaaatggaataaaccaaagggaaacgccgaaaaaaaacctcagaaattcgtggacatcaaaggcaaacacatccattctgtggcacttttatttatttttggtggaatttaaaagtaaaaaaataatttcggattgggccaacaaaatgagagcattcatttgttcattattgtaaagcaatgaatttatataagctaaacactcttcagagaaatggaaatgattgaaatctcttctcggggtctcccactctaaaaataataaattttaaattaaaattcgcttacaattaggaaataccttttcatagacgggcacttggttgatcttttgtaccacgttgaaatcctgcagcaaaataaaagtgaaacgcactca

SEQ ID NO: 2072 - DNA, 5582 bp, Heterodera glycines
  misc_feature (4733)..(4734): n is a, c, g, or t
ggccaaaaattgtgttcttttcggtcggagccattcggccggagcaaattttgatgaaaaaattgggaaccgttagtgtttggcccggcatgtgccattgattctcctgaaaagtcagaagacgaaggtgtaaaagcacagaccgaaaaaatgcgaagacttactgaatgctttgtcatgtcgtagtgccgggtgaaattcgtcctcaaaatccccgccccaaatggactgtccgccggtgcctcggcctgtcggatcgcccgtgtaaagcgaattcagtcagaaatgctctgtctcgcgtctcactgacttggatcatgaacgacttgatcactctgtgaaaggcgtgtccgttataataaccccgtcgtgctgaaacaataccaaaagtttacaattacattaataaatctatcagagaaatgcctgttgagaattaccgtgtgtacagaaattttccaccgtccttggcgttttgtccgggaatagtcttaaatacataaaatttgataaaaatggagaaatgaatggatgggaaagcacaaaacccactcaatgtgaatgtcgccatatgttgtgtaaacaattgccctaaaagagcaaacgcttttggcactttaattaggaattacttgttgcacagcttcgattggggtgcttcttcctgcagtaataaaaataaattaaattatttcccacaattggctcgtctccctaactcacttctattgcggtgatcatgtcctcctttagcggcttttcgttgtacacgtctctgctatgagtggacccttaaaaagacaaaaacgatttttaatgactgtttttgcataacaaaacacaccatccgcttcttccgcgtacggttcgacattggtaaacaaataaaaacgattgttgcctgggggaagggaaattgtacaaatgtattacttataaggagagggacgggtgggcatgcccgaggacagctgagttcggacacttcagtatggggaggggacacaatttggtggacttttgaagttcatttttgcattttattgaatttgtgacagtaaaaacttacgatgcgcacaagtcacctgaaaaatgtttaatttagagaatgtattcgttggtgggttgggcaaataaataagcaccagcattgggtcgggttcgttgatgcgaaggttcggattgtccgccgcctcaaccttcacacttgttgctgcaccttgcagtttttcctgtgcaattccattagaaaaatctattttaaatggtcaaaaggaaatgaatggcaccgttacgccgggaacagcgcgacacaacgcaacgccaacaaagcgcagattctctcccgccccaatacgccttgccacttggtcgctgaccaaattgtacacctgccaaaattagaatgtgccaaaataattggcaattccgcgacggtttacggttatgccgagcggagttgggaagatgagaaagttgctggaggcgtcgtaagtgatgctgatgaatcgcagtgcgttcgggtcacggctcatttccttttcgagcgcaacacggcgattccattcgatcgccggcagtccgttgccccttaaccattcagtccaattcaatgaactttttttgcttaattcacttagtctcctttcccatttcgatgtatcgttgaagagtttcgtcgagttttttgattattttgccgcttctcaagtcaaaaatgtaaatgtacgaattggaacaccaaacggcgaatgtccgtccgtccggactgatggccaatgctttgggcatttgttttatctgtcaaatcaaatgggttaaatgaatgacatcacagcaaacgaaaccttgcaaaattcgtataaatccgtgtccgttttaaattcgaaattgaccgtcttgggaaatgaaaactcatttctgctgcctgaccaatattcaaccattccaatttcgtctgtaaaattggacaaattcaaaaaatttgctttctaaactcaccaaaggaaattgctacatcaaatgccgctgtgtactgtaattaaatggtaaaatgctttttttttgaaaaatataaaatttccgccctttgtgagcgagtgaaatgcaacaaaatgtcaatttatgtattgtaatagtctggtcgtttcagcggtcagtttacctgcatgagaatgaccgggtgttggtggagtgattcgaaaacatggatcggctgtttgtctccgtttgcgtccaaaatgtaaattttgcctgaattcgcatcggaaatggccaaggcgctgatcaaatcggagccctggtggacaaagcaaacgcagcgcggactgaagtccaatttgaacatattctgagtagagggagaaaaagaagaaatgttgcaaacaattcgtcattttaacagcgtacgatcatgtcgaagttggccacgtcgaacactttggccgatttgtcatgggcacagcaagtggccatcagtgttccgctgtgattaattgcaatgtccgaaaatccttctaaaaaacaaacaaataataataaaaaaaaaaaaaacggttgcccactcaaatggcaacgaaagtgcttcacaaattcgatgccttcgttgtgctttttcttccaaaatttcaaatgtccgtcctcactggccgtgatgataaaatcgtttcttaattttaattcaatttataacttcgaatgtcccataaaacacagcccactccgtgcatttgacgtgagttatcacatttctgtgcataaatgacttttcgtattggtccgaccgcgggatggcacgcaaatacacttcctcgtgtttcagagctgaaaccgggggattgtgttggtttggtgaatgtttggctccccaatttgacttttttgctgctcaaccctcgccttcttcgctcgtcctccattttccttaatatttgggtccgcgggtcgtcggaattcctgtaaattttttaaatttacaataaaaagtaaagaaaactaacatttttgggaattgactcagatgatggctcacttttttgttgatcattcggagcatcgacagccattgaaaattggaatcaaaaaagaaaaaatgatcagcaaaattaaggcaaaggaaggatttgttatgcagaaaaacattcaaacagaagcacaaagaccaaggtataatttattttccaataaaattgataattagggtatctatttttgcattcttttacagattctcggcaataaacatctcagctttgttcagaagtttcttcatctcatcaaatttggccaattcaagcgcacttttaagctcggcccatttccaattttgatgctcatcggacaacataactttcacttccgggtctgtggattcggcaagccaataagtgacctaaacagaacaattttatgaaaccaattcaaatgagaaaaattcttttccaaaatgtgttgaattttcaaaagttaattttttaaatgtccaactttcttctgttcctccccgtatttggtggattttgacaaatagcgcatttcgtacataaattccttgtggattcgcaatttgttcacgtcaatcccggcctcctccatcgtttctctgattgctgccgtccattcgtcctccccggggtcgacatgccctaaaatcggcccaagcgatagctttacattttgaataacaatgataggtcttttctcgagattagcatcaaaattacctttgggaggcgtccaatggaaaggctcataagacacttgaagcaaaaggtactcaatttgtccagccgtattcttacgataaatcaaaaacccagcggctctaacgagcgattcaattaaagaatttgacattttatttaagcttaattttttattttcaattaaaaatacatacatatttattttggagagaattatataaaggtgtcaaatttcagtatcctttttcgtaccggtggctgtataaatattttttctttttgttcattgtgtattaatttgatgtgatttatgcaaatgtttaagatccctcttttctttttctttttttttccattttcatttattttttctctcagttcgatatgaaacagcgatgcctttatttgccgaatcaaagaattaactgcgtaaaaaaatatttgaatcatgacggaagaaaggaaacagaagaaaatcggacgctgcttttggaatgggcaaggagggaaacagaaagggaaaatcgggcactgatggtggaatgggcccaggtttttgcatttccacttctttgtttttgttatttatattgtcttttgcaggtgctgctgttcaccttagttttcattgtactgctcgaactcttcgtcttgccttggtcgctgccaattcgctgatctgataaatcgcatctattcaaaattaattgttttattgatgatctcaaattcctttaaaaatcccgaaacagaagcagtcagagctgatgaattaaaaaccaaaaaatgatcttcaattttcaatccctctataaaaagacacagaaaacttgagaagtccaaaaaaacaatgcagttgatctacctaattatgcttaattgttggaaaatttatgatcaagaatcacttgggatcaaccaattctcgttttttactccgaacttctcgtctctatagacttttaaagagacgagattattaattctaatgagttcgcttcatgaaccttctcatccattttatgtttnntaattatgtacctgtcaattatttattaatttacttttgcatatgttagaaaattattatatttagacaatctgaataaatattgatggtatattatgtacatataataagtaaaatgcctccgcttggcttcgattaattaattatttgttggcactgttccgttttctgctgttcgttccatttcctttccttcgttttgctcctcccttttttttgtccgatttccgtttggcgtcgtccccattccctcctcctcgtcaatcgcaattaaagtgacattttccgcctcgccgctttcattcagcgaagaaaacatcacttcgtaaaatgcgctggccattggctgttcgtccgcaattctttggtatttttcgctcgtcgcttcgtccgtcacgaaatctctgagcatttcggtgcctttgaaacggcttccctccagcgccacgcagaatccctaaacgcccaattagtttagtgatggcattcgaaggtgccattgtttcccctcgccttctccgttcggttgccaatgtcgtcgatgtgcaattcgaagcccggtcggcactgacatgtcatcgacttctcactacagtaggcgttgtccaccacacactgttccgtcaccactaccgtaggcaggcaaaatccgccgatggttccgttgtcgcgctgctcaacagagtccatgaaaacaaccgaagtcaaatcgtggcatctgccggcaatgttcaaaaagccttcggggcactgaaaaggaagggaaaaccatttgcataaacttgtcaaaaatggacctgcaaaacgaatgttgactcatggattagcaagggaagcggacacgcgca

SEQ ID NO: 2073 - DNA, 7243 bp, Heterodera glycines
  misc_feature (3772)..(3772): n is a, c, g, or t
  misc_feature (3808)..(3808): n is a, c, g, or t
  misc_feature (7143)..(7144): n is a, c, g, or t
  misc_feature (7148)..(7148): n is a, c, g, or t
  misc_feature (7150)..(7151): n is a, c, g, or t
  misc_feature (7154)..(7154): n is a, c, g, or t
  misc_feature (7175)..(7175): n is a, c, g, or t
  misc_feature (7181)..(7183): n is a, c, g, or t
ggctgtgaacgggctgttgtcggtcaacggttcgagaaatggcccggcgttgggcatttgctcggcaacaggcgggctggggccaaacacgtccgtgaagtgctcatgaagcacttcagccgagagctgacagagcggagatgtctgctctgtaatttcccggtatgcccttgcgcgtgaagcgcggtacagcttttgaatacgtgcggcggcagccgggtcaaatggcggaccgtcgtcggcattcatttggtttcggcgtcggccatgttggttcggtggtggtcttggccgacgtttttgctgagcgggcctttgcgtgaacgccacttgcgcctgctgtcggacggcgttgatgaattcgttcagtaagtcgtcgagctgctgtgcgcttgtcaccgcattgaaccgtccaacccattcgcgttgttgtgcgttgggttgccgtggagcgaccactggaacggcttgatcatcgtgctgttcaggttgggcattgacgaccaattgtgtcggtggcgtttgattttgacgggcggtacggctgtgcgctgtgcgagcgcttcggtcacttccattgggcgaggcggtgcctgccgagtgccgttgtgcaaccaatgcaggcggggtcgaacgaccagacggtacatccgattcgcgccggcactgcatgcggtctgtccgtgcccccgtaccgctgggagtggtcccggactgatccgcagcagcgggttgagccggggaaacgggctcctggaggcgaggagcccgcggtcggacctggcgaacaacattcgcgtgctgtggttggtgccgttcttcttggatcggctgtgcgccttggcattgtgccgacttcttctggtgggcattgcatgtcctcagctgtgtaaaagtttgtcggcatccattgcagcggaaggccaaattccatgtgttttgcggtgtgtggtccttctttagatgctttgacagtccggcatgtgtgttgaatgatcggccagcgcaaaaccgacatggcaaaggcagggcaattggcactccaaggacgtactggtgggctacgtcctcttcgccaagttcgccactttcatcgccttgctcagtacgattttgagcactgccaaccgacaggtcgatatttgggtcggattgggcagatcgtttccctcaatttgacaaaatggtgatgattgttctgtgatttctcggtatgcacgaggacgactttggcggtaaagtttttgaattcgagaagccgcaacagggtcgtatgccggttcttgggcagcattcatggcgttccgtcttcccccatgggggttttgtaattggtttcgattattaccccttgggggacgacgctgttgcggatggatgttgattttggccttttgccgaacttctgccaatagttggaccaaatttgtttcaaaatcgttcgagtcatttactgcttcaaacaaccttatccaacgtttttgatgttctgattttggcgggataattatcagcggattttggtgaattgggtgttcggcggcctcgacattgactggtgatggataatgttgaggatgatttaatggccgtgcattgttttggccaagttcaacagactcagacgacgtggagagatgttgtggttggacgggttccaccggggaacgccgattgtgtctttctctaacatttctgtttgcttatcgagtgtgagaagaggcggtactttgactgtccatatttaaatcgacaacaaattcgctgtctgcagaagcaaaagaggaatcactagagacactcacttgccttctgtcgtctcttatttgtaattgcggtggtgactgactcgctggggtgacaagcctttgaattggctgtggccggtcaacattctcaacctggcgtgcccgcgggttgaagaaattgcgctgaacaattgcagcaccgggggcagccaaaggacgctgcggcatttcctccgggacagctctcgcatttcggcatgctggcgtcttttgctgatgagctttgcactttttcactgtatcgaaaacgataagacaagtgttgcattgaaagacaatccgctggttggggtgataacgctttaaatgcttcgacagatcaccatgccgtttgaaaatttttggaattggaacacataagcggcaatggaaagactcgccgatggtgtccagcaatggaactcccaatacgtaattgatcggctgtgtcgctgcttcgccttcctctgcattgatttcctcctcttctctgtcagactcccccagtcgttggtcgcctcctctttgtctgtctccttcggcgctttgtagtgtttcctctgcctgtcttctccggcgtgtgatgaccattatgggttagtttttcgtccgatagatgaattgggattctacccttttttggaagataagactctccgagagagaccttaatgaagtgaagtcggattgagatggaaaaccgaattagttttcggtgaagaaagtagagaagttcggggttttagtcacccttttttttcgtagtgtcgaacgaattgatgaatttgttggaagataaaccgcacacagcggaaccgcacacaacacgagtgtttggtttttttgtcggatatgaaaccgcacccagcggaaccgcacacaacacgagtgtttggtttttcgacggatggatggacgatgggatttggttttcccttttaagtttgacggatggacgattggcgatcgatgggattttgttttccccttaaatgaaaattgtcaggcagaattgtgaagaatcaatcccctggcatttgcattgcttcacccaatgcttttgctcttttgatctcccccgcgggggagatgcgccgctcccggaggtaagtgcaataccgggccgacgcgcggtcgagagggggcaagccccctactgcgacctttttccaaaaattggttaatctctttgaccccggtaggggtcgttacggagattaagccgtaaagaacagatactacactttgatcttagccaaaaggccgagaagcgatgccggaacagcaaaatgggttccggaaacggaaccggcaccatcgaaaacatatgggtagcattttaggcgaccaaaattgcacatcgtgggagcagagatattgaaaaaattggggaaatagcgtttaacgggagggacaaatgggggaaagaaacaagacggacgagagagagtgcttcctgaagaggaaagcgtaggagagagtgtgtgccacagacatgggaagggagaaagtggggggaggcagcagcaggtggtcgccatgtcgtcgcacgccgacgaccactttcgttctactctcattaactctcgctcgctctctctcactctctatactctctcatctttctttttcgtccctgtcctctcattatcgcacactctttcccatttaaaataaataatttttttaaatttttgtataaattaatttgctttttattttctctctctgactctctcacacacactctctcctctctctgctttgatcggttatgtaaataccccatccccccaagcacccacttgatctgccgtttgggctctgccgatcggcctccgctgttggcacgaccaccgccagcctcggccacccgatgtgtcgtgatcattgccgccgggcccattctgctgttgctgtttttggcatgggcaccgcttccaccgccgccgccactcgtcagttggcacagcgtttggcccatnccgttgggtgtccttcagtcgctgctgactgtgccngcttggtgatcatataaatgcgcatgtacaccacgacgagaatggccaccgggatgtagaaggagcccagcgaggagtacaatacgtagtccaactctgaggatacggtacactcgccgggacgctgaacaaaatttgggaattatgtaatatttggtgccaaaaaattccaaatagcggcacaatttgccaccctacggtaaaataaggaatgacggtacaattgagtaccaagcactttgagctaatatgagtcccagtcattttaagcaaatccttttttgggatttcgaattgccaatgaatttgcgtatcggtttttaaaagattaaatgtgaaaatattttgagatttttttttggggggggggggggtttaatttaatccaagttttagggtgtgtatcagggaaaaaattttcggtttttatttttcggaaaaatgatcgtcgatcggaacttctatttcaaacaggtccgaaacaaaacaaggattttttacaaaagaaaaaaaatcaaaaaattttaatttaatttaattaaatcgtttgcttttaattttacaaaacaaataaaacaaagccatctcaaaattttaataaacaataatcgaaatcaatttacttcgctttttttctctaaattcaaaaaaagataaatttattttagattttaaagttttcctaaaatcccttagtttttgtgggatctgctaaaaaaactctcaaaaatttttttgccgcatatttttataaaattttttggtggaggaggggccgacgatgccgataacagttctgttgtgaatttttgggttgaaatttaaaattttttagggcactcgtggcattatagacaaaaggagcttaaaaaatcgaattggataccctaaaaatagttttaaaaaaatcggaaattgaggcccacgcaaattcaatcttctgctgctgatcattgcaatgaagtgagagataattaactaattaggaccaacagaagcccgaggtaataaataattcaattggttactgtaggatttttgaaagaacgttcagattgcttactgtatgcatgctgtatactgtagccttgcccatttaaatattttcgaaccattttttaatttaatttttattaattactccttttaatcatcaaagtctgccgcgaacataagtgttatttttcaaggcttttccaccgccgcccccgcaggggaatttcacagctaatttaatgacccccccccccccgcggggttttcccgccggtcgccccccggggctctaattgccaacaacttccgccactttcctcgcccctacagtatgccccatcttagtgacttcattagcaacagcagcacagttcgcaaattagtttttttcaaatgtaattttctctccccgccacaaaattgcatttaaaaaataataatatatttttaatgaaatttggcaaaacaaaaaaatgattgaaaacaaaaatatttttaaaaaaagtagagacagaaattttgaaaaaatgattagctgtaagggaatttccaggaaaatccaggtcgagccctaataaaactcctataaaaaatcaaggaaaacaccaggtcaaggttaggggcacgaaaatcccaaaaattctatgccgttaaaaaaggcaaatgccgttttgtttttggaattgttttttttctacaaataaactcacccttttcggtcgccagccaagcaatggggggaaacagatgagcagagagaccatccaggccacacctgaaaaattgggaaaaatgctgtcaaattgataataattactgttgaaatggttaatttggttactggaaatgcccgtcattaccgtataaatattctcaaaaaatagtgcattagagggtactgtaggtgctgttaggcaccgaccaacaaaaaaagccaagcaaataattcaagaattttgtgtgccagaagtcgagataaaagcaaatccaataaatactttatagggcatactgtcagcgtccaccctactgtaattgaacaatggtactctgtctctctataaactggctgatcactcactgtatagctgtgatcagactcgattacatcatcatttgaggaaatctccggctgtacaaaaccgatcggaaatcggtggcactgatcccacggcccggactgatcagtattggttttagccggaaaccgagacagagaaatcgagagcccctgagagactggattctcgaaaatttaatgatttttgccgggaatcgagacagagaaatcaagagtccggggaacgggtaaatgggattattcgatcaatttaaaagtcgggactctcgaaattcccaaccgatcatgatgctgatccgtctcggcgtgcgcttggccggataactgagcggctgcgtgacggaccaatagcggtccagggaaatgatgcaaatgtgcaggatggaggcggtgacgaacagcacgtccagcgccagccacagctcgcacagcacactgcctggaaaaggattttggattgaatttggcaaaatcttttttttttggcaaaatgccaggagagggacttcaaaaaatgctaaaatgtaaaactatgggagacgaccacgacggcactttccgatggattttcgagttacaaaattaatcccatcttcgttggatttctctggaatcggctttgccaatctctgcaatagctccccgaatcttgacattattatgaaaagagtggccccagtcccgaggcttcattcggcagaaagtgccaatggtccaatcttgtcatattacgaaggacctttcagtccagccttgattttggcaaagtcttgcgacttggcaaaatgcaatttttttttcttacattcaaaatcaacggttgtgaaaaactgtgaatatccaaccgaattcaaatttctaaacatttttttaaagaacatataaaactgtcaagagtctcgattcttgacaattttaatgttaaatctatttttggtttgcatttatatataaattccgctaaaaattggactgtaaaatgaaactcacccagcacccaaacgccgacaatttcgtaaatcagcgtcaacggcatcaccaacagacccaccaacagatcggccatcgccctgggcgagaaaattggaaattttacaaatttactacccaatgaaattttaaaaatttattaccccttggaaaatttacaaatttactaccctctcgaggagggctcaataaatttatggaaaattcattggcttggtggaattttagattttaaattttcagtttccagtaaaatgcaaaaacaaannctcntnntcnaaactttaaagattgtatttnactcannnaattaattaaaagacccggggggagttaccctatgacgtttttttgtagaaattacaatt

SEQ ID NO: 2074 - DNA, 2792 bp, Heterodera glycines
  misc_feature (62)..(62): n is a, c, g, or t
  misc_feature (96)..(97): n is a, c, g, or t
  misc_feature (122)..(122): n is a, c, g, or t
  misc_feature (142)..(142): n is a, c, g, or t
gtaaatcagcgtcaacggcatcacccaacagaccccaccaaacaagatcggcatcgcctggncgagaaaattggaaattttacaaattactacccnnaatgaaattttaaaaatttattacnccttggaaaatttacaaatntactaccctctcgaggagggctcaataaatttatggaaaattcattggcttggtggaattttagattttaaattttcagtttccagtaaaatgcaaaaacaaaggctcgtggtcgaaaaaaaattcattgtatttgactcagggaattaattaaaaaatttcaaaattgcttaccctatgacgtttttttgtggaaattacaattttcagacattagagactaatttttgccaattttaaaaccaaaattcaactgtctgcacgcacaaaaataatgtaaattataaaaatttaaaaaaataaatacggcatttttgtaaattcaattaaaaatggcaccacctttgctaaaagggggagcacataaaactcacaatgagacgagaagccaattttggcgttggcttcgcattttcgtgtcattggacacagtgagcacaaccatcaaattgccaaggacaatcacctgacaaatgaggcgtaattaggcactaattgggtctctgtacgtttcggcgtcgccgtttctgcgccataccaagtttttggctttttggcaaaattccgaaatcggcggagggaaaggcaaaaaaaaaatgccaacatttgccaatcgaaaattttggcataacgtcggatgcttctcccccggcccaccagcatgacgatgagcagaaacaatgccatggccaaggcttctgccagcgtaatgcacgagggccacacgacggcattcgacacgttcgggcaccattcagccgcaccgtggaacagaatgatggtgcttaacacagaatgtagaaatgatcgggataatatgaatggataaatttagtgatcaaaatccttatgtgattgaaatcgccttgaaagctgatcagatcggctcgaaaggaaccgaaatttatggccatttattttgatcaatgaacggcattatttacagagctaaatgaccaggtggcttaagacattttgggtgcgaattataggctttaggaatgacaaaagaccatgtaccgtattgcttttacaagcaatcagacggagaatggggcaaaggaataaaagtaattttgaccaatcagtctgatcagtgaataaacagtgcaattggctttgttatgccattttgtttcggtgccgattcaatccgatatgtttactgaatcgccattcctgcactttcaaccacctatcaaagcagacacttttgccgtctgatcatcttcatcatcactaattttgcttacccatcagcaaagtaatcagaatgccgatcgccgtcgccccgcactgtcgcgtgtgccaattctgttatttcatccgtcaaattgttgttgttgttgaatggcaacagaacagcagcagctgctgccgcggcatggttgttgcgatggttgtggtgatggttgttcagctgctgttgttgctgatactgcttgaccaccaccaccaatgtgctgtttgggttggtaaaaatcgaggaggaggaggaggacaatggagcagcagctgaagatgaacccaagctgttcagcaagtccatcaaaatgaggagcaggacggaaattgttgtggagaggaatttatgtcaaaaatcgtaaggcttttggacatttttggcaattttttctgcaaatttttaagtaagcaatgattagggtgattagagaacaatttaagtgattgggtgatgattaaaaggcattgaagaaatggtaaaagaaatgcttaaaactgtccaaaatgatcggagtgatctggcactgatcaaaaggtatgtgagtgaataagtgatcagcaatgagtgagctttttggaattagaaagcgtttttaaagtgatcagtgggtgactgactgatcacggaactcacaatttgtggtgagcaaatgatcgggaaaagattccatgatgcggaagtgatcatttcaaagtgggaaaagagcaagaaaaatgcgagtgtgtaaagtgatcaggcccaagtggcgtgacgagggaaaaaaggaaagggctgggacactttgaggaagcaattggacccccggggggggggagagtgacgacgacgccgcaggggacataaaatgtgcgtgcttactaatgtggtgacaggtgagggtgacggggccagatgaagcgggaggaaaagcagcagcaggagaaaaagccatcgtgatttgcgggaggaaaggacaaaaattttcgggaagggaattaaagtcattaatgggttaatagaaaaaataaaattttccgggttttttttgggttagggccccttagaaaatttagagggcttacgagagaaatgtataatttgtacaggcccaaacgtgttgcccaaaaaattgttggccattaaatgcatcctagaagattgacagtccaacgaaaaattaatttccaacattgctagcggatgcagcaaaattcgtaaaaaaaatacttttttttttgcaataattgtaaaatgccgtataattacgatgggcaaataatgaaaatgccatgccgttagtccgtcccaaaatgactgctaccaacccgcccaattggccacacacaattcgaccggcacaacaacttcgtcgtggtcttgcgttgcccttttcgtggtcgtttgtgtctgtctcccatgcacctc

SEQ ID NO: 2075 - DNA, 1728 bp, Heterodera glycines
aatttgtagggatgcgatttttaggcacaaaaaatcgcaaaataggcagctaaaaaggcaataaaaaattgcaaaataggcaaaaaaatcctcgaataggcactaaaataggcaaaaaaaatttttattaacgctttttaggtagcgaaacacgtaaaaattaataaaattattttgcttatacatatttcaattgttttaaagttgttttcgataaaaataattttttaaaccaaaaatttttatttaaaaaataattgaattttgaggatcaatttttgtgaatttttttttttcaattcttagggggtgtattttctaaaaaattttcaagtcgattcttaggggtgtatttttcattttttgttaacgaattttccggaaatcctgaaaaattcgtcaaaaatggcgaaataggcacaaaaataggcaaataggcattaagcacaaaaaatccaaaataggcaaagttaggcattataaaagtcatcgtagacacgccaaatcaagcggaaaatgcgtttttcgtgcttaactgtacgtattaaatgcgcaaaaattttaggcatttgcctaaaaatcgcatccctactaatttgtaacaaaataaatgggttttaaaaaatccgaaaattttttgataattttgaaaaaatccaattagaaaataaatattaatgtgactgatgatcattggtcaccggaaacaaatttgctgtttaaaatacgcgtgagttcattatcattttgaaataatttctcagctgaaaaagctggacgtaaagcagagatcgcatttttacagcagcacttaccacgtgctcttgattttgtggcttattttagtgcttttttaaaaaaaaaataaattaaaaaaggaattaaaaaatggatttattttatgaaaaattaagcgacccttttttaattatcccaaaaattttgatagaaataaatttaaaaagctaataaatttgtcaaaaaaggttgattttatcgagtaaaaatgctttaaacctaaagagagagttttgccaaatatttgagtgccgacaaaagtgacgagagtctcgagaaaatgtgccaaatttggtaaaatatacaaaaacggcggatagccaaaaaaattgagttcaaaaacattcatgtaataagacaaattgttttactcattttgctaacgatgcttttcctcctcagctgacaaatgagtgaaaagcgaagcgaatgtttggccaattgcccctaaaaaatgtctcccgtccgcccaacgaaaaacaacacagcaggccaaacaaatttttcaacaattttttttttcattagccaatgttttcagctgccaatgcttctccctccctccttcttccgtcgaaggagtgaaaagaaaaattggttcttttttggggggctatcggacggaagcaaaacctaatgaaatttgtttggcacaattcatcagcagcagaatacggcacggcggcggccaacaacaaaggcatggccatggggaccacggcgtctctccgaaagaatttttcatttgcatggaattgcatttttttccccggccctgctaatttacctggaaattcttttttcaatttaattttatttttgcggatttccgtgccctttgttttgttatgtgtgccgtggtttgtcagcagtgaagtgaaatggagagagggcagaacacacaatgactggtgactgaataggaaatga

SEQ ID NO: 2076 - DNA, 3664 bp, Heterodera glycines
attaccgtaccccttgcaatttgcttctattattattatactgtagtttcatattttgtttgtggcgtaaatttgttcacacttcttttcggtttttcatttttggtttttggtactaatttgatctttgggaacccttttggtttcagttaaacaaatttaattaaaaataattaatttaattaaaattataattaaaaaactttcaatcccctttaaaattaacaatgctccgattaaactttaaaaaaattctcacttttactgcttaataaattatttcgatttttgtctcacaaaatttcaaaattttccatatttttgcgcccaaaaattccaaaaaattttctaagaggcttaccttttatttaaaattaagtaacaaataaaatataataaattaaagttcgcccctcccctctgtgtggagaagccctgggttttagccccgctcttatcgtgaaaattgatcgtctccattcaaaagcggatgaaggaggaggaggaaaaggggaagcaatttgggagagatttggcgataaatccctgccgcttcacactgttcttaaccgactcactctcgacactctctcgagtttcgtccgtccgatcaatatttctgatcgctcactctcgacttttccaaatggcaaattcacacccgtccgcagattggtcgaccaatttacacacatacatacaataaaatccacaacaaaaaacaacaaaatagtccagaaacatagattgagcgggtgagagaaacatagattgagcgagtgagagagagataaagagagtgaggggaaaacagtgtgagtgagtgagagatagagagagtgagaggaagacagagagaatgagagggactgagagagagagagagagagagtgggagagagagagagagagagagaaagagagacattttacaggggcataaatttgttttggtgatcggcagatgggataaacttttatgtgtatttgtgtattgaaccggtggaacattcgttattagcatcggcttgaatggccttggccagcagttgttgcttgttgtccccccaccccatctcttctctctcattccttctcgacttattcccgaaaataaattggtgccaaccacacacacattcattaaagaattaaattcctgtttagcgtttttctctttttagttaaaaaaagaatatttgaaaaatttaaaattgaattaagaaaaagcaacccaaaaggtaaaaatatttttgaaaattttcgagagaaatatttttcaaaattcaaaaattttggaatttgttttaaatattaaacagcactcaaacaaaatcatcagctcttgctcgctaacattttgtaatgtcgaaattcgcttccaaaattttagtttactaaaataattattgttaaaagagaaaaatccaattaactcagctcatcaacaagcaatttccacgcctaattacggcacaaaatgagcacttttgccggtttccctggtggtggtagtgtcggtatcggcgtgccaattcggatagaaagcgcttcgcctcaccaagcaaccgctcaaccccaaaatgccaaccaccaacaacgccaaaacggtgctgcagcacaaccatcatcatcatcatcttcctcggtggtggaccgtctccaacggcttgaggcggagatggacgcggaagcggtggcgggcgccatccacttgccggatgaccgggagttgaccgcgcggctggccgccttcctggcggagcgctttccggacgcggatttgcagctgaccgtgagcagcgtgcggcgcacaatcaccaccaagcaacagtacgagacggagacgccgggcatggttggcctgccggtggatcagctgcaggagttgcagcgcaaactgatggccaagatcagtaagctgtgcttgtctctctgactgaacagggcaacaacacgtaaaaaaatgagaaaaatggtggcacaatgccaaaacgccataagacttgaaaatccctaaaaaattcaaatagtagggttaaagaatggcacaatgccaaatgatttgaaaatcccaaaaaattttatttgattaaagaatgaatgactcaatggcaaactcagttaacctgaaaattgctaacacttacaattaaagcatttatttaaacgcttaaaaataaatttaaaatgtattaaaattattttagtaaattttttggccgatggggccaaagaattaacaaaaataaattaattaataaatcaattatcattattttacatatgcacttgtactttttatcatgtttacttatttatttaattttttttttgcactgcacaattttatttttatttcaattttatttttatttcaattttatttttatttcaattttatttttattatcgattgcttttccttttttcttctccaagtgctttactttttattatgttagttttgtgtgtgttgctttttgcttctttttgttgtatttacaatttatgagtatttattattttaacattaagcgaaggcgacggcgttaattttaaaatttaacaacaaaaaaattctaacaaaaatgggtacgaattaggggtgtttcatgagacccaaaaatctctggaatccggaatttcgggtagaaaaagcctgaattatggaattatgatttgtaaccatccttggtatggttttttttagaaaaaatcctaagactggtgttccgtagcttattgttagcatttttttttcattttatgcaaaaagaatttgttccaggcgcccaaccattcgaacacgcaaaatccactgaaaagggtgaagaaagtgaggagaagcgagaggaatgggctcgtcgtgggcctgagggtgagttttccgaaaaattgtaaaaaatttcaggggcctagccttggttggggttagggtttaggcttcaccagttaaattaaatttgaaaaaatgggattctccaaatggaaaacgaaagcaaaaacttttaaaaaaatttcaattaaaatttttgtattttaaaaatttgtaaaatgttttttttacttttttaaaattctctaagcgtcgccatcgtttttttttttgaattttctgtgtctttgtcagatgtgcaacaaagtgagtcggtcgaggagggctttgggcctaccgacgacacgggcacaaccattgccaagaagcgcatgcacgtgctggccaccagccagtcccaagtgcaaggtgataaatatatctgtgaaaaattgtggtgaaaaaacccaattaattttgtgtggcgaagtgtcaattttttgtggttttttttttgtcttaaaaagggaaatcgaagtgtgaaggaaatttttcggaatttttattcttttctttttttttttttgtaaaactaattttttttattaatgcatattttattttatcccatttttcttgctacttgtgtgttagctgtgggcagattttcaaaaattttttttttgagaataaacttgttttaggggtttccggggtcggaaaaagcgattctggcatctatattgggccaattcaaaccctgaacccggattcgaacaaaaaagtcaaaatccatttttcaaaaaaattcacattttagacacaaaattgagtcctggccttttt

SEQ ID NO: 2077 - DNA, 6262 bp, Heterodera glycines
atcctaactctaattgaatatttttttatttatccctaatctatcgctttaatattcgcttaataatcggtacagtattcagaggatgatcataaaaacagacaaatgtaattgaattgacactttgccataatttataattaaattctgattgaaaataaatgttttttcattaaaagatgaagccttcgtccatctttcgaataatggaaaataatttagaaaaatttttaaggcctcgaaggtttccagccacagcacacacccagcggaattcctgttttccagcagcaacaccgaggcgaagacggtaattttgttttaataacgcaatttttaattgtttttttaatttgccgtgaaacaaaattttttagaaaaattaattaataaaaaaataaattaattttataaaaaagaaaaaaaaatttttattttatttataaataaaatgtttcttgcttgtccttccaaccgttcgtttgtctgtctgtcatactaactgttgttcgaaacctgtaaacaatttttttttaccgttaccgtataaccctcatatggtgtgttaccattaggatatttgttttttatttaaataatttttatcataatattaaaatgatggtgttgtggcacctcaaaaactatcaaaatgggcgttaaactatcaaattaaaatttttacttataagctttacaatatttttaattattcatatcattcgatagacctaaatgttctctattttcctgccaaattttaaaaaatttcgtctttccaaaaagtaatgcccaaaaaatgtttgaaaaagttggtttttattcctctggcaatgacttttttaaaagtaaacgaaattttttgatattttataggctaattgagaaaacctagagctaccgaatgatttaaaaaattaaaaatttggttccttttaagcaaagaataattttttcccaaaaattttccatttgatggtttttgagtacggcttcagtaccaacatgataatcattttttggaaactaaaatcggcgggggcggcactattaggagttaaaatatgagcaaaaattggcatgcatatttaataagaaaatcactcaaaaaatgcaaattaataaagatgctcgtaagactagaaattaaatttaaattctgggtgacttgtgccaattttttaaatcttttattcatttcaatttaaaaaatatcttggtaacattgcgccaatatttttttttattgtgttcctcccaattttgtcgttttgtgtttgtttgtcgtgcccgttgtgtgtttgtgtgcatttattgtcttatcattcattaccaccgtaatttaacaacaaacacagtgtcccttcatgtcagttacagtatatctttgccaatttcggcacatttttgcaggaggcattcgtggcataaatcgcaccaatcagggacaagcggcagccgggcaatctcagtccccaacaacattaattccaatacgacgaatctgatggattactactttaatttttcttaatcattttggaattgtatttcacactcatctggcgcttgtctccgttcaaaatttgacaaaaattaattttaaaatttaaatttaggatattttcggaccagaaaatattttaattggctggcattcataattttgccaagaaatttttaaaaaatttgaattaaatgaaacaaagtatacggagacaagcgactcaattttatgaataaagcctaagcataacaacaatataaacttttaatttccaaatgcttttgtctcattatttggtttttttggtgattggacaattggcattttgccaatgtggttggttcgtttcacatttatatggtgatggtttcaacataatttatattttgttggtgatggaaaatgcttcaatattggtgctggtaaattcaaaaaaatcttaatggtcactcttaaattaatgaataaaaaaactaataaaatttattaaatattaaggtttaatcgcaaaacttcaataggaattaagacttaaaaatttactacgacaattttttagtaactgaaaaattctctgtattttttttttttgtaattttagataaattttcgtcgacgttttttacttttttcatttcgtatttacctaaaatatgtttaatctaatatagatatgtttatttgtaataattaggtattaatttgaatctgtatcatttcatttaatcatggatattttaattattaattgctcaaatacaaattttattaattctaaaaacttaataaaaaatctattaaatattacgcattttaattgattaattaacaatcattgctttttcctttcctctagactcagccggctcctcaaccaccgcttccgcttcgtcagtgcgcgaccgcatcgcgcattttgaagcacttaaacggggtgaagcggaggcggcgccaactgcgattcctcgtcccacagccgctgctgcggccagtcctgtggcggatcgtccaccgtcgcgcgagcggcctccgtctcgggaggaggacgaggcggcacgtcgccgcttcggctggcgaccatcgaccgccgaacggcgcacaatgcgacgtgaagcggacgaagttgtgcagcgagaagctggaaggtaatttgtatgaaatggtcacgtgtttcgatttaggtaataattaagctgtcgaaattttgagcgttggtagttcagtggttagagcgtaatacgcattgtgttaaagcgcgggttcgattccgttgttcactaacattttgtttttttcagactgtttcatttttatctgatcctctttccatttttataaatatatggtcaatattcgaaaattcatttccatttttaatgatatttttaaaatttacggtatttaaatgcttcgtgtcgtactgagacgaagtacgaaaaagtgcaattagtggcgaagtacgaaaagtgaagtgatcaaattaaaagcaaaataattattttaatgatccgaagttacattatttaaaatttaattaattatgttaaaattacagtaaatgatttttcatattttgcgctaaaaattcatgaccgattgagatccgcttttgtacccaaatatttatgagatgcttcttcttggtttttaaggaagtcttcattagtctaacagtgaaactcaattaagcataagcaatataaaaaattaatagcttttaaagcttttgtttcaccatataatataaagtttattttgcttttaatttttaaataattatttttctttttaatttttaaataattatttgcttttaattttcaaataattatttttcttttaattttttaaataattattttgcttttaattttcaaataattatttttgctttaataatttgatcacttgcactttttcatacttcgtcatagcaccgtatgatgtcataaaatttatatattcaattgaaatcttggattatgattccttcctgattacattttttgctttaacatttaataatgaaattttttattttagacaactcaaagctgaagacgaatctccaattagccccatcaaaggaacagacgaacaaattgtaacaattgtaacgcaaccgattgagtcacacgcggaggaattagcgacacaagcacaagcagtaccagcacaacaccaacagcacagacatggagaggaagaagaccatcaagcagtacaagaagaagaaccaaaacccgaaaaaattcgcaatgaaattgaaataattcaacaagaagccattgaaacgcctggatcagttgaagtgaaggaaattgaatcaccaaaattgatcagcagaattgagccgatcattacggtggaaccgccatccggagtttttgaagaatcgcctccagaaagtccaacacgcgatgaaatgaaaactgtgcaagccgaacaagctgaacgccatgacacggaggttgaaaagtacgttcctgaagaagaagaagcatttgaaaagcgtgttcctgaagagacttttgaaaaacgccttccggaagagatgattgaaaggcgcgtcccggaagagaaagaagcatttgaaaagggcgttccggaagaggaagcggaagaagaaacattcgaaaggcgtcttctggaaggagaaccgaaagaggaagaagctgttgaaaggcgtattccggaagaggcgtttgaaaggcttattcacgaagaggacaaaccgtttgaaaggcacgttccggaagagaaaggagcatttgaaggacatcgtgtggatgaagcatttgaaaaacgcttcccggaagaggaagaaatatctgaaatgcctttaactaaaatggaaaagccaacagatttgagtgtaaaagaggaagtagaatccgaacttgaaacaaaaacgcaaaaggaagttgaagcagtacctgaagaaccacatgtgaaaagtgaggctgttattggcaaatacctcccatttggggctgaaacgcccggaagggatgaaaaagcattggtggaagaggaggaaattgaacaaaaaggcacggaggaaattacgttaaaaggagctgaacggggtacttttgaatacaaaacaaaaagttttttgataaatatttttcatgtacacttttgtttttataggtttttaattattttatttttacatttttgaaattaaatatattttagcagagaaataacagaattccgtaaatgccgcactttttcgtaccgcaattttttttttttatagataaaacccagagaaatttggaattttattttttttaaaatggaaatcttattttttacgttttaaaaactaaaaaattaatttttattagagttgttaaaccaatccataaatagcaatttaacgtaatccgaaccctaatttttcctcctgatgatgcttattgacactcgaccaaaatcttttctctgatattttaaagaaaatttgtttaaaaatcaaaaaaaaatatttaatcttgaaaactaattgaggcctccgcttaacccttattagtgaataggattatcattccaatgattaaatgaattttgttgaaaatttagtgaattttttcaaaatttttaattgcaaattaatcattaaacaaacaaataaaaattgcagaaaaaccaaacaaatccaatctcgttgttggagcaaggaagcggaagaaacatatttcttcatcattaattccaataaaacagtggaagaagggcgacaaaaagttggcaaaaatgccaaaaatcgacgctgcttttaaaggagcaaaaaaatcctttattccaaagccaaaaaaagtggcaaaaattcaaaaacccaaagtgatgtcatgtcgcataaaactcgctgtaattaaaggtatttaaaagaataaaatgatgtgtgactgacccccttttatgcttcattttcgggctttccttctttatacattatgggaatttcgactcaccctaaatggatttcagttttttcgggttatggaattttcagcagcgattaatttcattctttttaacgggaattaatttaaaattttttatttttttcaatttattattatttcttccacttttccttttaagttttttcaaaatataatttattttaattacctattatcttcacttccatttgaatttttattttttttataaataatatcaatattaaacaattattttttataaaactttcattagcgatttttaattttggaatttttcagctcgaataatttgaatcttttttaaatttttttccttttggataaattaacagtataattttctcaatttattatttgtttttcttcaacttttcttttattttttatttaaaatatatttattttttaattaatatcttctttaatattaagttgattttcatattggatttttatttagtttttataaataatatcaatattaaacaatttattttttataaacctttctttagcaatttttaattttttttttctaatttcaattctttattttgtttcttcaaattcctttgggattttcgtttttttcaattcaaatctttaaacaacttttttctctttggactttcgtttatatttcttctccaaattagttcaattccaaaaattgcagaagagtcgtcacttggaacagacgttgtgaagaaatgattcaagtccgaaaaatttcaatggacactgagcccaaaagccaacaggtccaatttaa

SEQ ID NO: 2078 - DNA, 1594 bp, Heterodera glycines
agcccaaaagccaacaggtccaatttaattaaatttacaatttaaattgtatgtgttaatcaatttaagcttctcaaagaagcgctaaccaaggatgaacatccggaaatgtttgtcacaacagcattggagcgatttgacagcgaaattgtggtaaatattccgtggttaaatttcaaaaaaatatattttaaataaattaaaacatattggaaaataatatttataaataaatttaaatatatatttcaaaaacctaatttctgaataaatttaaataaatttttgaaaaaaatatatataaataaatttaaatgcataatgaaagggtcgtcaaactttgcccatgactccggtggaacagcagattgagcaagaaatgccatcagttgttgagccatcgacaattgaacagcttcaacaaattcagggtcagcagcggttggatgaaacggaaaggtaggcataaatttagaattttattaattattattaaattgtttgtcgtttaaaattagaaaattttccagcaggacattattaggggaatttgttccaaaaatattcataatttttcattgttcgccaaaatatattcttataaataatgttaaaatgctttttttctccaatagtttataattttgaaaaaaattgattattttttttcaatttcatttagtccaatcactgaaattgctgaaaagaaggaagaagaagcaccgatgattcatgtgctgcatcaatcccaaactgaacataagccaattgtttggcttgaagaaacgccactggagcaggtgatagcattataaaaacgattttatattattctttttgaataaattttcattcgaatttcatgggttacttaatattaattagaaaaactggactaattttcagaaatttgctaaattttcgaaacacattttttttgggttaatcactcagttttccaaaaaacctaagatttccaacattaccacttgccaaatgtaattaaataaaaaaatgttctcttcaatttttgcattaaatacactatttaaatatctttaaattaaatatttattcggtttcaggcaccttatgaagctgaagatgttgcaaagctgcaagccctgcatggcgttcagagtgagtcagcagcacaacagccaaaggaggcgccagacgcaagcagttcaaccaaaccatggttttccgccgtaatcggcggaattgcgggcgctgtagctgcagtcggaatagcaaccgacaaagcaaaattgaatgaaaatggggaagaagaacaaattgaagcagtacaggaacggaatttggagttggaagacagtttggcatttgaggaccaacatcatccgactgaagaggaggtgaaatttccagaacacgtgaaaacggatgaggttccggaagacctgaggacagttgaggagtatccggaagacgtgagaactgaagaaataattccggaagagcatctggaaaacgtcgtttctattgcaaaccacccggaagaggagacaactccgaaacatgtgacagcagtgaaaagtttccggaagacgtgagaattgttgaatttccg

SEQ ID NO: 2079 - DNA, 9056 bp, Heterodera glycines
acaaatggcttagtgcagttatcttaattttattatacaacattcccgtgtcaaatctataatttagcacttgttctcggaattcatttatctttgaaaaagaaaggtccgataaattctctgcttcttgacatttaaatatatttatttctttgagtccaatttctattttttgcatagctaatgcttggtttctatactcatgcataataagtttaggtagtttttgaattttttcgagcatttctaagaatgaaaaatataaattttccattccaggtgcactaaatgctgttatgtagaaatttttcacccgtttaaaaagcatatttgcaaaaatttcgagattaattgatcgtttaagtatttttccagaaattttccaatttctcgtaattttgttttttataaaattaatttcttggtctattgtcgacatctgggattatagttacttctagtgttatgacatcatccaaaggatagaaaagcgaatataattcttcttttaataggacatgttggaacaaagcctcggctgtgttttcactagggcatctaagagggcaataaaatgattcaaaaccaaaagaaatcttcagaatgcttttgaattttccttgttcatttttataaatttttacgattattgatgcgaggatatttttaaaattttcctccgcattaattaggaaaggatttttaaaataaaatttggttttatattttttaaagccaaattttaagtcctcatgacataatgactcaattatggcacaattttccattttggtatatcgttatttttttgttcttatataccaacgtgctcccaaacaattgttttgagcctattttcataatttaacatttggctctgaacccttcgggactcgaaatgtaatctccgggcttccattaacgaattttgcgcttgttcctcgaattttgttgcctggtcaaaagttttgcatctctcgaactcgcgccatgcagattcagcctttacagactccaaattgatttggtcctcgattttgaaaatttcccaaattgaatcggacattttaagatataattctcgaacaccgttagcataaggagctttttctctagattttattgcctgattaagtgtttcccgagaagacttggcaaaatcgccaacttcttctgctaacgccgctacatccctccatgctctctctgtctctttttttgcagcttccaccaaaatggtattagctttttctgatttttcagaattcatttttttatttttcatttattaaatttttcttttatattttatatgcaataaattcgtctctaaattctgtttgaggtctcggcctttccaaatctatttgcttttctcgcattgtttcttttaatttattggccaagtctccaatgcctaaatcgggctgcgagtaagcagtccgatatgtttgcccaatttcctgtctatagttttttgctaattctattgatttctttgcctcatccgctagttcttggcacatttcagcatcttttctgtcaaggcatttttccatacctttttttatatttttaatgttattctcttcattttttattttatcaaatagaacatggatttttctcaccccatttaaaagcttttcatgccaaaattttaccccatgagcactaggatttttgtcttttattttttgagcttcaaccatggtattatgtgccgataaagaaaaatctttggcctcttttgttaatctaattatatcttcaagtacggcctcaattgttcgtcggttattgcctaattactctttttcttcttttgaaatgcagcagcaactttctgccgcgttcactatgataaagaggaaaaataattttaagaaaaacattttatttaaaaaaattaacaagtttatttatagatttaaaggctgacaatatcgatcaaagagtaataaatccccttcttccctccgaattctttcacccttgccccaattttcatagtgcacacggcgcccgacaaactttccacctcttcctaaattaaaatgtatatgcgaattttaaaaattcgttaccatcccattctgctttccacgcatcccaaaaaatgccacagtttccaaaattcctgtatcatcagccacagacatcttcaaataagatgtcatcgtcttctcattaggattgaatcaatagtttggtttgcagaaaccaatttttaaaaaaaacatttccaattaatatttattataaaaaatcatgcgaaaaaatgatggtaattttaaaaattcttccattgccttctcagcaaccacccgccgtgaagtgttaaaaagtgaaggtggaagtctatagagtagcgcccatgttccaaccaactctctaaaatattttttgaaaatttgttttttctatgttctgacctatctatacggtggtagaagatgtcaattaagacctcaacaggggtcaaaagtagctctctgccccaggctttgcccatcactctcaacgcggaaacgcaatataaaaaaaaacggctcctgaaggatgcgttggttgtttggcttctgccttcccaatagaaccaaaagtaaaacgctggtgccatgtacccctctcccgtataattcgcctgcaccgtaacatttagcacagttgtaaaccttccgataggcgtccctcttcccgagtcatgaaaatatctcacatttctctcaaccatggtgaaacaaaaaattgaggtgcgattatacatagttatataatctgaataagcgctgtcgtagtctctgtgtattgctattttataatctgatgagtcaaataacaatgcctcaacttcctctctgttttttggccaaaaaaacgcttctttttcgagagcctcctcaaaatatttttgaaacgagtacatctttaactgaaaaattaataacgaaaaaaactctaatagataacgattgtaatcaacaaaaaataaagaaatttaaaaaatttaaaaattatttaacaggaaaggaataagtggcaataattatcgaaattctctggtccaacaaattcacttccccaaatgattgctgtctgtgcatgaactcattgaaaacaatgtctgggttcgaatgttggaaggggcgggcagggatgatcactgggtccgacagggcactgcaatacagatcgactgaaattttctcaattttccagtccggctcagcttcacggttcatcgcatccgtcattaattttttcaggatttttttaaacatttgttcggggtcttcgttttctgggcacttaaaatagaaagtagtcacatgttcttttatcccaaattttttattttcgtttgtgtgactttccacttcttcaaaacattttcccaaattagcactgttcttgaaataattttttgtatttttcgagcggcgaatttcttttgaagtttcttggaaatttttctttgacattctaaaaataggaaacaagtttgattaatttaaaatattaaatgttataaacatgagacaaaattatccaaaaacaaaaattaataatatccaaatggtaaaacattaaaatgatcatcaataattccttttttctgcactggcgaatattctttttgcacatcttttgagagaacccggaagtcgtttgtcggcccgatcttctccgggtagtgaaaaacttttttgacccctttcttgtagtccagcaccatctctttgaacaaatcgtatttaaaatcgtttcgtttatccaatgtcatccctctgatctttgttttgtgccaaactaccccatccttctttcttctgagttttaatgcatactgcttcggacccgcagacacatactccaaaatttcgctgtcggaatattctcgagtcatctcccttaaaaccacaattaaatgtgtttcaaaaattatcctttaccccaaaaatttcccctccttcaatgggcaccgaccctttggatgtgcaagcgccagagagtctaaatttaaaatgttatggaaatttttattcctgccgacctgtatcacaatacagcagcttagacccctcctccctgtagacttgctccatgtactcgtacagctttatccttgctgcactagtggtccacaaggacaaaacaatatttgacactttatgctctttgatgaacgcctcctttttccggtaaaccacccgggatagctcttcgcttatttttactgggcgcccaaattcaattgtattatctcttcccaattccatccaacgttccatactccccacaatttccgtatttgaaagggtattacgcattgaaaatttgccccacaaactgtttaatccctaaaattgaacaatttttcgatatttttgataatttctcaccaatttcgcaatcattcttaacccaggattgagtccaattttatcgtaatccaaattaatgtcatattttgccttatacatctcgaggaatgctctcttttcctcctcactcttcacctccgtcggccaccccgacgcttccacctttatcttcaaaaacatccgcacatatcctttgaacagttggcggtcaaactgctcaaaatgataggcccgatagaagcctgtgaccctatatcccagctctaaagccttccgcaactcaattgatgtgaacgttcccaaaaatgctctctgcgctggccggtggttgcatttctttacatcttttgccatcacaaactcattcttggccctttttgcacaagcccaacaattggggaagaggagcatgtcatcgatgtgcattgggaggagggggtacaaaagatttttcggtgggatgacttttactttcaaaaggccatcatagggaacatcgtcgggcaccgtccaattcacattgaaattcctgctgactacaattttcgggaccccgacggggtatggggtgtcttaagcgaggaaattttttttaattaatcagatttttttaccgtaattaacaaaggggtataaactgatgatgtcgaacattgatatttccatttcttccgtagcctttgcgtacaaacaaaacggcatcgttctccccccggcgtaagcatcccttggattgatcggtcccttgtctggcacactttcaaagaattttttcatctccttatttttcttcaattcctcactcacgtcacactcctataaacaaaaaaataaataaaatatttctagatatttattttacccaaacttctccgattgaaaaatttttgcatttttccctcaaattttccatgcgaatttccgttctactgcggttctcttccattgtccgtccgtttggcgctatcgtccagggcaaaaaacatctcgaacatccgtgaaacgcacaccccttaagaattgttaaaaagaaaaaattctttttctttcacctgaaactcaataatctttttctctgccccaatcacacagtccactttcagccccccaaattccacttctcctccgttacacgcatgccgcacttttactccttttctttgtgccagccactcaaaatatttcactgcaattttgctctgattctcagctctctcgtaccctccctcgggcataatcggaatgtgcctgtccttcaagaattttgccctgaagatcttcataaagacacccgcgattgtgacactgtccttcatgacatccaaatctcctgttatccccaaaaacaactgccggaacttcaaaatagccgccatgagaatttccacgtcgttttcgcaatacaccctaagctgctcccctaaaacctatttaaattaaaaatcccatatttttagttttacctaattcaaattctgtttgaaaattctcattgtgccatgcttccaattttgccgcttcctcctctttcatgctgtcggggcaatagtctccaagtggcggcaggtgtgacaatctcttcccaaagttctcatttttgttgtatttgtgaggaaaatacaacttggccgcgatgttcagtcccaaggtctttgggagatcccccaacttgttctgactaagcatccagaaatcccggaaatacacttttccagccttgatttgataaatcttcaaatctgccatcatcagctccgtcgcaatttccttctttgttagctcggacaaaacaaagtgggaatcgaacctcccagcataatgcgcaaaagcaaccgtttcaaatcgttgaaaacccattatccaggcaacaaactcgctcattgggtcaaaaccatccgctactgaccatgtgattttcttggggccttcgcaaatctcacattcccgctcttctcccgcacaaatactacaagtatgtgaggcactaacaagattaggccggtgttctcccccatctactgtcgtttccaggtcgtatgccacaattctatatgctttctgcggccgcactttaatcggtttgatgaaacattgacgaccaggatggttaactttgcagattttacaaaatttttccccacagacgtgttttgaacgtgtttggtagacttctccacatttttcacatttcttgtactctttacaagccatcttcttgtgcgcttcaaagcattcccggttgtagaacttgagattacattcgccgcagtgaatctcatcacagacatccacgcatggaaagccaaaccccatccgacagcacttcttacagcggtccttgcattccatccggtgccgttcagttcgatcatatgtcacctcacaagccacacaaaaattgcgaacaccaaaaaaccaggaagccgatttgatcccatcccagtgattgccttctcttatcacacaaacttcatttcttcgaacaccttcccctttgaaaattggcttaagtcgggtcttctaaaaaagatgtaccggtatattttttcaagcgaatttatttaccatttcaaaagcaacgatgcgaaagttgtccgggtattgggcgtcccaaaacttttgtacagcctcaagttgttggataccaaatgttttgtcgcccatgctaatccctgccttttccatcaattctaaaaccatttgtcgttgttttttctccgtttccaataaataacggaaagccttccgagaaattacatgatcaattagttggtaattgcgagcaaattcaagggcataaaaaaggcctaaacacaagtaaaagatttcatttgtggaaaataacgattttgaactcactaaattttccctttggtgtgctaatccgacccgattccttgatttgggcaagagagcaaaagggcgacatttttttgaaaggagtaaaaaaccgcagttgctactgtgagaaaatttcttttggggaaaatacaattttgtttaattatcaaagatatcaattaaaattatcaaattaaaaagtaaaaaatttataatttatttaaattttatatcctggatgagttgtgtggggaataaaaacatcgaaaaataaataaattccagttcttcgggccattggcattaaaatatgatctgagcgaaacaatcttctcatcatggaataaaaccgacatttaacaaaggatgccaaaacaaaatttatgcacagcagtcgatgtgtttttggagggggaagagcatcaattatttccttgatcaattcggcggggagcggacagggcataatgttggtgaattttcaaaaaaggggttatagcaaattttaaatgattttcaaatgaagaattaaccgtgtcgacaacaccttattaatgcaaaaataaaacacaaaaagtaaagtccataaataacaaaaagaagcattccgaaaattttgtcatttcttttcatttgctcgtaatctttgtctaatgttaggttttgcatctaatttcttaaattttgttaattttcaaaaaaaaagttaggtaatgggattaaacccttatcattacaaaaaatttaaaaacaacaaattttatcagaattccattcattcattgaggcggacgtcttgggtcccttggtcttcctctccactctcccagccgtcggatcacttccagcactctcggagggttgggatgaattggcttaagaaaagatgttttggtgttaggtaaaagacagggtcggaaattaccggtccatttggcaacggttggacgaatagtggcacgtctctcagctgccgcggtcgttgccatggttgtactggttgaatgtcctgaagaaacatccggaaaatatgagaaacgcacgaaaacaagacccaacattaccggaacgttttcgggtggatgatacggcacgtttcgcggcggatgggcaaattgtggtacggcgtattcgcgttgaatttgccgaacatgaattgcctgaagaaacacccagagactgaggaaaagcaaccacaatttgatccaaattgatgtcacatttcgtggcggatggtgaattggcggaaagtctctcagcggctgtggttggacacgaacagcctgaaaaagcactcgggaatttgagaaaaagcaacaaaaaacgagtccctaattaccggcacgtttggcggagggatgccaaattgcggcaaagctctcagcggcagtggttgttgcattcccacccgaattgcctgaaaaaagcactcggaaatttgcgaaaaaagaaacaaaaccgagtcccaaattaccggcacgtttggtggagggaggtctaattgtggcaaagctctcagcggcagtggttgttgcattcccacccgaattgcctaaaaagcactcgcaaatttgcgaaaaagaaacaaaaccgagtcccaaattaccggcacgtttggtggagggtgatggatttgcggcaaagctctcagcggcactggttgatgtacttgttggacccgaattacctgcaaacactcgggaatttacgaaaagcaacaaaaaaaacgagaccaaaattaccggcacatttgggggagggtggtggatttgcggcaggtctctcagtggtatcggttgttggacccgaacagcctgaaaaaaagca

SEQ ID NO: 2080 - DNA, 2392 bp, Heterodera glycines
  misc_feature (53)..(55): n is a, c, g, or t
  misc_feature (66)..(66): n is a, c, g, or t
  misc_feature (165)..(165): n is a, c, g, or t
ggatgaattgctttaagaaaagatgttttgtgtttaggtaaaagacaggtcgnnnaattaccggtnccattgggcaacggttggacgaatagtggcacgtctctcagctgccgcggtcgttgccatggttgtactggttgaatgtcctgaagaaacatccggaanatatgagaaacgcacgaaaacaagacccaacattaccggaacgttttcgggtggattatacggcacgtttcgcggcggatgggcaaattgtggtacggcgtattcgcgttgaatttgccgaacatgaattgcctgaagaaacacccagagactgaggaaaagcaaccacaatttgatccaaattgatgttacatttcgtggcggatggtgaattggcggaaagtctctcagcggctgtggttggacacgaacagcctgaaaaagcactcgggaatttgagaaaaagcaacaaaaaacgagtccctaattaccggcacgtttggcggagggatgccaaattgcggcaaagctctcagcggcagtggttgttgcattcccacccgaattgcctaaaaagcactcgcaaatttgcgaaaaagaaacaaaaccgagtcccaaattaccggcacgtttggtggagggtgatggatttgcggcaaagctctcagcggcactggttgatgtacttgttggacccgaattacctgcaaacactcgggaatttacgaaaagaacaaaaaaaacgagaccaaaattaccggcacatttgggggagggtggtggatttgcggcaggtctctcagtggtatcggttgttggacccgaacagcctgaaaaaaagcactcagaaatttgagaaaaagcagctaaaatggacccaaaattaccggcacattttgcggatggtaatcgaattgtggcaagtctctcagaggcagacgctgctgcccaacatgtattggctgaacacgaacagcctgaaaaaagcactctgaaatttgagaaaaagcaacgaaaagcgaaccgaaattaccggcacatttggcggagggtggccaagttgcggggggatcggcggaggtggcaagagaatttcatcatcttccgattcgtacccatcgtcatcggggaacatctgccgccctaaaatggaaaaaatcagacaagatatttgtggaaaaccaaacaattttcatcctgtggacgatttcctgcaaacggaatatttgcaaaatccaaaaaaactgaaatttaaattaccaacgatgaccgggattgggaagctgggcgatggtgaacggggcgtggaaggaggacttggttgcttggatccgtatcggccatccagaaaatcttttctccatttcctacaaagaaaaaaatcaaagattggaaaaaataaatggcattacgaaagttgtgcaagtgaatttgggtcgtatgctctgtttgggtcaaaatgcccagccgaaaattccccatactcttttgaaagaaacgcgaaagtgccgggagcaataaaaggcatgacgagaaaatggaaaagtggatgaaaatggcaaatggcgaaaaaagtgaatttgggatgcagccccgctgatgacaaattgaaaagtgtggcgaaagtggcaaatgatgagaagtgaacttggggatgctgccgctgctgactcctcccactgccatgccgtgctgccgtgccgcggcggcagatcaaaatgattgatggaaaaaatttgaatatttgggggcatgcgccccgaggggcaaagtgtgcccccgactcagccgaatggaatggaatgaagtcgcttcggcgtccccttctttatatgattgacagttcccgtgtataaaaactgcggtttgtgtgatgcaactatttttgcataccgccgcactttaaattttctcgaccaagaactttgattgacaggtcgtgaacataaaaaactattttgaccttgctggttggatggcaccatttttgtgcaaacgccgcgcagcaaaatttcgcaacacgcaaaaatggaaaaaatacgaataatcttatctgatcaaaataggcgggtggcgaacggtggtagggggaagatgggttgaatgaaaggaaggggaagctgtcgatgaggagggaagggaagggggggggggattttggggccaaatttgggccggaatttttcaccttttttcacctgctatcgcatgctatgaccctttttcacctgttttcacctatttacaaagtttttcacctattttcaccacttaccacaggacatttcaatgtcacctattggttttcacctgatttcctaatgttttttcacctcttttgatcattttggtaagggaaggggggggggataggagaaaaggaaggaatcggagggatcattaagga

SEQ ID NO: 2081 - DNA, 1672 bp, Heterodera glycines
atacataaaaattgcttgccctgtcgacgattcgacctccgtccctttgacctccctcccttcccccctcttcccgaggatagggtcaaaatttccccaccattctcaaaagttggcctggattactgtggcccagtttacgttttgacaaattcggcaccacaggccaggaaaatttccaaaaaatattggattgtcatttgggtctgtttgcctacccgtgcaatttctttggatttggtagaggaccaatcagcaccaatttttaccctggcatttcgccgctttgtctcaaaattcagcctcccccaaaccatttactgtgacaatgctcccacttttgtcgcattttctaaatttattagccctcaatttccaacggaatggaatttccgtgtccctcatgccccatggcgcggtggtcattatgaaaggttaattgcgcttgtaaaacaccatctcagaagagcattcacttcattccgtccccgcgcaattcatttgacacagctaaccacttcactttccgaaatagagacggtcattaacacacggcccataacctttaattccgccaatccaatggaccccaaacccttaagaccgattgattttattcgtcccctcaatcctcctcaaaattttgtttccctcctcactaccgaaatcgatgggacccaatcaaaattaccggaaagtacccaaatttcattgcaaacattatgggaaacagcgagccttcacacagaaaggttttggaaccagtggattaacgactacttaccctccctgcgagagcgatacaaaaaattggggttttacaccggattttggaaaagcaaaaaaaaagaaaggatggggaagggtggaggggatggggccaaattttggggccggatattgggccttatactactcttattatttatttattttttcatattttaaattcaacaaataaaacacgtcatccaaagagcgaaaatttggagaatgctgggttattcatgtcgccaccaccatttttcattaataactttcctcttttataggacactaaatttgggtaattaaattattttcaaaatattcctattgttcgttgcacaggagcgcaaccgttctgccatatatgaattattaaaatgatttgaaagggttttagttaatttttattcaaatttttaatttattaaaagttttttgtctctttttttgttttaacaataaatttaatatcattatcttgttgttaatttaaaaaaaaagaaggaggcgcaacttgaattttaagaaattaaatcatccatcgatgtctatgcatttatttagagtcagaagactttataattttaatttaaatagataattgttttgatattgaatggtattttaaacatcattcatttttaatacaaaaaattatctcaaatcctttttgtatatattgatttttggatttaaggttaatttcatatagtaatcaatggatttcatgagcataaattaattaattgtagcaaagcggctgtttttttttgtgaaattgatctgactgatgtgatccatttgtcacactctaattgccaaatatataaattgaatatataatttgaaagttatttaaattttcaaaatttaatattttatattaattttttaaattgttagt

SEQ ID NO: 2082 - DNA, 2217 bp, Heterodera glycines
aaaatggaagaagggcatattgattcgggatttacctctcctatataaaatttctttcaattttaattccccttgaccccctgcccttttttgtgtgtttccttaaaccgatgtttctcccacgagacgcctttcgtcctcttagaaagtgcacgtcattctttcccactattctatcagtccacccaattttctgttcattttcatttgaccgatggttcggggacgagatcatctcaaaactttgcttttcctcttctctttttgtctatttcttttttttttgaatttaaaaaaaaataaatttaaatatggatttttcgctcgatacaaatgcattattttctcaatttccatttcattttccgctggtgatccctcgtcctccgatcgtccgaatgcctttttgtcactgtgttcctaactttgtttacttctgaccaaatcacattttaatgactgagcttttcctaaactaactgagtacttttaagttaccatttctccgccttttaccattaatcgcacgtttttaattttgtatttttgtcgacattttaagaaataattttattgtttgtacctatcattcgtccacacaaacaaagctctctttcattcactctttcagacttaatatccgatctgatcagtcccccccccaccattcgttctgatcactctcatcgttttgtcagtttattcgtcattcttttcgtatgtaatccgtcctcaatttgaaaaaaaagtgtaatcgccgttgttcgttctgtgcataaaggcgtccctctgctctttcgctcgttaatttgggggcggtgtgctctccgcgccactgctccgtccgtccccgccaccgtaactttgcctgaagcagttgcactccgtccagtgctcattgtgctgaagaagcaattgaaggtggcggatgtaagcgatggccagcctcaggctgtccactttgctcatgcgtcgatcgcttaatgttggagagcaaattggcgacagaagggcaaatcaattgcatttaattggttttgtatggcgattaaaaattaccgctcaattagcggtaattgttcgcgcaattggctgaatccgctgttgagattatgaacgcgttgcctttctctttcattgcgtctccaaactgtggttccttgggtactgaacaaaaatgttatagttgtgggtaatagtgtgctttgtccctccccccccccttttttggaataaatttttgttttcttctaaaaagtcgtgaaaacagttccaaggttggcggtactaatgcactttagcagacatacatttttttttggtcttaattcatgtaaaatagcttccgggggttttcagcatcgatgattcaattaattctgtacaccagaacccgaaatcgaactattggtcgaacatcgaaatcttcaaaatccttctattcaaaaaaagtccaacaatatttaataatgaaaaatcaacgaaaatcaatgcttgcattttcgatgttcgaccaaaagttcgatttcgggttttggtgtacggaattagttgattcaacgccagattcttaataatgatgctataaagcccggaagctagtttacatgaataaagacaaaaaaaaaaatttcatgtctgctaaagtgcattagtacccttttggctaataccgctcttcttctcttactgattatagacattcgtcgcattttaaatgatcgaaattcgggggccttcccatccgcaccaccttctgctgttggtgcaaaagtcactcgcctcatttccaactcgtggggcagtggactcttgacggtgtcttcgaagggactgatgaatcattgcactccgatctcccgcggagacggagccgtggaatttctataagtactaattcactgacgatgtcgtcacactggagaatgtcttagaaaggaaagagccatttaaatatttatgtttcttctgctaagagctaaataaaatctacatactaatattataggtgctgaagccaatttttgtagaaaataagtactcaactatgaaaagtaacctaagaacattgagcctgtattataattagtccctgtcgaaaatcactgacgatgatattaaccacggtcaaatcacttattttctttatatagatctctgtttttgaagtaatccaacgaaaatccgcctagaatgtcttataatcaacaaaaggat

SEQ ID NO: 2083 - DNA, 3664 bp, Heterodera glycines
aggcgtccctctgctctttcgctcgttaatttgggggcggtgtgctctccgcgccactgctccgtccgtccccgccaccgtaactttgcctgaagcagttgcactccgtccagtgctcattgtgttgaagaagcaattgaaggtggcggatgtaagcgatggccagcctcaggctgtccactttgctcatgcgtcgatcgcttaatgttggagagcaaattggcgacagaagggcaaatcaattgcctttaattggttttgtatggcgattaaaaattaccgatcaattagcggtaattgttcgcgcaattggctgaatccgctgttgagattatgaacgcgttgcctttctctttcattgcgtctccaaactgtggttccttgggtactgaacaaaaatgttatagttgtgggtaatagtgtgctttgtcccccccccctttttggaataaatttttgttttcttctaaaaagtcgtgaaaacagttccaaggttggcggtactaatgcactttagcatccggggcttttcagcatcgatgattcaattaattctgtacaccagaacccgaaatcgaactattggtcgaacatcgaaattttcaaaatccttctattcaaaaaaagtccaacaatatttaataatgaaaaatcaacgaaaatcaatgcttgcattttcgatgttcgaccaaaagttcgatttcgggttttggtgtacggaattagttgattcaacgccagattcttaataatgatgctaaaaagcccggaagctagtttacatgaattaagacaaaaaaaattttatgtctgctaaagtgcattagtacccttttggctaataccgccaaggcttctcttactgattatagacattcgtcgcattttaaatgatcgaaattcgggggccttcccatccgcaccaccttctgctgttggtgcaaaagtcactcgcctcatttccaactcgtggggcagtggaattttgacggtgtcttcgaagggactgatgaatcggcgcactccgatcgcccgcggtgacggtgccgtggtacgtgccgtcgtgccgcggtcgtccccctcgtccgcctcctcctcgctctgcgaccgctgctcctcctccgctccctcttctccgtcttccgccccctcccttcgctttctcttccgtccctttctcttccgttctctcttctccccattgtctctctccgtcccttccgccgttggcatttgatgcgtatgcacaattactgaatggtggtggtgctgcggatgattgtgctgctgataaagggctcctccatttggctgattttggtgaaaggcaccacaatttgcggtgccatcggcggacggcccgctgaacagaaaggagagagacggcgcattttgggagtgattttgttgttggagttgggcgacatcggccgcattggcacttatcattttagtccaatgaaagtgccacaaatttacttaaattgtattggattatcgatcatttctaatttttaataaaagtggtggatttaaaagcgaaaagcttaatttggccaattatttatgagaagcggctaattaattgcctcccatttttattttgtggatgcgactgattgttgtgagtgatgaattggtcgtcggctccctctttcatccctccccctctgcccctttggcaccaatcaccgctcgtcctcgccccggccgaccacagtatcgaattcgccctcctctccatccctttcccttccctttgcattggccaacagaatttggccgttggatttgtgcagctgacaattggtggatgagaagagattattattgaaatggtgagcagcacttccatacaccacaaaagcagcaatttatttgggtaattttttagatttttatttttcaaaaggatcaatcattttacaacgtgatcatttgtttttggctgtgttttcccgtccgttatgtttccgaatcgctgtgtgtctttctgagggagtgccattgtcgctgttctatcggtcgtctcgtcgtcgttgagtcgtcgcccgagggcacattgcgtttcgccactgcgtttggcgcttcgtcttcgccaaattcggcctcttcgtcccattggggttcgtcttcctcactctcttcttcttcctcctctttggcactcacttttgtgccatcttcggacggtgccaattccatcgtaggctgaggcaatggcgacgatttgtgtgaaaaagacggagaagaggaagaaggataagaacgcaaagggcaggtgatcagaaactttggcaaagtgtcgtcaagtgacagaatgcgttgcgtttcatcggtcaaaaataaattttgaagggtcctaaacagggctgggcgtaattacggaaattacggcctttttggacctcgtcatgacggattacggcttacggatttttgggatttttccgtaattttgatccgtaattgggtttttggattatttttcgagacgatttcctgcaagattatttttttataaaacaattgttttcttttaacttttaaaaaattcttaataatattgaaatactatataaaccaaccataatgattaatgatgcaattttattctctaaaaaaagacaaaaagggtaggttttatgtcctaaaaaaccaaaaatagtcactaaaaatggaaaattttcactaaaaccctaaaatttagggtataaaagcgtaaaattttacccacaaagcaacaaaatgaagccaaatcagtattgggacacatattttttaaactttgtcaattggaatatgaatgtcctttctcgacactctcgacgggatttgtcctctccctccctcctgatcaactaataatcacttggattggatgtactgacccatccgatgtttcttcgcctgtcactgtcgtgctttgtgtcaatgggccgctgagcgaagttggcgacatggctgtcctcagcggacttccgttcagattgtcgctgtttccttctacgccgctgttcgcgcggcttcgatcagttgaacagaggccaaagttcaagctgttcagccgaagtcgcgacatcgactgggcggtcggcaaagcgccgcgggtgtaaatgtgggcgagggctgcacggagctaagcgaaggggagaaaatgaagggaggggagagaggatgatcaaagaatgaatggttgatcagaaaggatcatgagaatgagagggaagacggaaggattaacaacgaaggactgatcagaaaagtaaaaaaagtgatcagtgggctaagaacggaaaaatcgatcggaaaaacaagctgattggagaaaaagacaaattgactgtgaatgcgtttcaaacatttcggtatccgtacctcgcgcaatgcgacgacgcctacgagacggcctctgttggtgacataagctgaacaaaaaggcgaaatgaaaaacagagagagaggggaggggggaaggggacatcggcacaaccgctgcggacaaagcgggaaatgggatgaaaaatgatggcattggcggtgaacatgagcaaaacacgacgcactcggagtttgactcgagaaccgaacaaggttttcacatttatcgtttaatgacataattttttgttgtttgggtcttgcattctgagccacgactgtc

SEQ ID NO: 2084 - DNA, 4239 bp, Heterodera glycines
gcttgcgcagttgggcggccctgtcgcgcacggacgtggaacgaccgagaaaagccttaaaaacgaacaaatggggaaaaggggggggggagagggagaatggttgaactgatcagtctgacaagaacttgaaatgatttgatcagaattaacgcggaagaaattccatgttatgaaaatgccatggggaaatgccctccccggggcccacctgctgttggttgatcgacttggcctccttttgatggcgcatcagcaaaggcaccaatcgcccgctctctgaaagtgtgccaccgatcattttggccagtcaatcactttgatcaaactttctgccatccaactcactgctttggtcgtcgtgcaacggactgatggacagcaaagtgttgccaaacaaattccgatcattgatcatcgacattttataatttgccggcaccgcagtcgtagccaatgtgttattcggcgtgggattgcgatggaaagtgccctcggagaagccgctcattgtccgacttttgcgccgtctgctcccgtgcaaaagaagtgccgggtcgggcccgaggtgactggtcagcagatagtgcagatatttgcgcgccacggagcccaacaaaatgcgctcctcttaattttaggcattcaaagtgagcaatgttaagttggacggttaagtgatcagaataatgaatctgatcagctcacaatcaattttaaatttggtcacacctaatcaattacccagcataaaagtcaatatattgatcaaacaatggtcagatcaggcatgatttgaattggattagtaacaattagtgttctgatgggactgatttggcattgccttcgtcggtgaccaatgggtaggagcggaggtgcggtgtgcaaatgagcaactcgcgcaactctttgtaagtggtcagtttggtgacgaacacaacgtcacggaccataatctaaaatggcaaaatgtcattacaattttccacagataagctgtttcaattgttgtccacctgttcaaccttcaaagtgtggacactgaaaaagggaaaaaagcaaattaaaagttgcaaaagcaatgccacggcacacctaatccgagaggggggcaattcggccaaatggggcaactttcggatgttgatgatggactcgtaaatgctcggctggagaaatgaactgaccgcatttgccaccttaactggggacattcggtgtagctttgccaccgccaccctttgatcaattttcctcaagcgatcggaacggaccattaaagcgacgaggacgggcagaagggcgcacaactgaccggtggtctcgcagacgatcaccgcaatggaaagcgaatgcgtcacggcgccggtgtacgcggcggcgcctgggaaaatgccagagcagagaattgttcattacaaagttgcattttgccttttagaactgaccgacgacggcgtaaaggccggggtaaatttgggggccgtccgaaccgcgaatgccctcgggaaacacaacgaccatctgaacaaaaagtgccaaaacataatcagtcgtcgcacgcattagtcgaccaattcgccaatgattcgtccgccgcacgcgccgatgacaaaagaggggacgaaaatgccggcgggaagtgccaaagttatgcaaatagcgacgaggaaaaactgacaaatggaagaacaaattagggagggggaaaggcaaaagagacgaacattgaccagcaaatagccgaacagaacagggaaagggttgggcctaaacttggaaaacattggcattaatttgggcgggggcggggtgggcaagaaaggcacacataaaagcggtggtgtcggtactttcgtcgatggagtccaaaacggattctgtaacggcaaagtatggtaaaggaaaaagaactaacgtaataggccaattatccaaatgattcccatgatacgctggtaaaatgttgcaattacttctgcggggaccctcctcctcccaaaggtcctcaatggtccaccgttggatgaccttcccaccgcagcccatcgacgtgacattgtacagagtcatggtacagttggagatgaaatcgcccaacgtttcgcggaaagtgtactgaaatggacggctaatttccaagcggtcaaaaggcactaataaaaattgcctttccggcaatgaaacggccaaaaccatccgggaaagtgacaataccaacaatcagtgccatgaaaatggtgaaggacatagagctaaatgccaaggatagtgggagatgggacaaagcggacccaaatggacagactttttgccaaaaatggcacgaaaagtgcgatttcgccgtttgaaataggcaatacgacgatggacgacgacaaacaaagcaccgaaaagaccgctgagaaggccaaccaaaactgcaagagaaggcatttccgtggggttgggagggaaaagcggacgaaagctaaccgaagacggggatttcctccaccagaaacacttcattggggaagctggtctggtagtaagcagtgatggtgccttaaaggaacggaaaagagagttatgaaacaactgatcaacggactgatcagtgactcagcctaaagtgatcaaaaaaccagaagccccattacgtgtgtgatccatgggacatcctaatcaatgtgaccgtagtgatccgttagatgattaagcaaaagccgaccggattgagtctggccaatgtgaataatctgatcactcatcctcaaaagttgcgatcggcagaccgtccaatgtgactggtcttatcacttgcccattccaaacaatcaatcaatcaaaatggtccaaattaaccgcatttgtcatggattgtccatccgttccttccccgcgtcacctgcgatgtgcggcggaatgatcaccgcgttggcgaagcggaagatcagcgcggcgcatgtggtggcgaagaaggcgcgccaataatttttcacagcaaaatatttgtgggtgcactcgataccgtaaaggacggctgccaattgacacggggtacggtaacgctttggcatcggccgattttggtggcactcaccgcccgccggactgctaaaggtgcacgcaatgcccacggaacagccggacgagagaatttcgaactcgcggccttcgttggagaagaaggcgctgctctgccaggcacgcgtcactttggacagcaaagtgccgacaatggcgcccatgtgaacgaagggaccctttggcattggcatttcattaccaagaaattgaagaatcaaagaccacccacttctttgccaacgggaagccctgagcccaaagtgagcgtcagagaaagcattttggcgaccaaagtgcggaaggagaggtaattctgcagcatgaacccattcatgatcactttgatctcggggatgccggaccctgaacaaaagcgggcgattgtaatgccaaaatggacggagcaaacgaccgatcgcttgggcggagacgtatttgcagaccaaagcggcggcaccgacaaaaacgacaagaaagccgacccaagagacgaatcccgacaaaggaaagcaaaaggcaattgggactaagggaatgccgaaagagacataccaacatcacatcgtaatcacgggcaaagtcgaacagaatggcacggtctgaaggtgaaaagggaaaaatgggggaagtgaaaatgggagggaacgatcagaaaattatggaagagaaagtgatcaaaaaagagagtgaaggagagagaaaaaacagtgaaaaacagagacactgacaaaaaaaagagagagtgaagaaaaaggatactttccagggatgggccgaggtttcgcttttcgcatttcgctttttggcgcgaaatgcgaaatttccaccctaagaaatgaatatatttgaaaatttaatttttaaaacgaatgcttcagtctaaaaaacccccaaaataggtgctaaaaatgggaaaataggagccaaaaagttccgaatttggggtgtaaaatcgaaaattttcttcaaaaagcaaaaatattatgccaaatcattaatgagatagataattttcaaaataaaaaattctcgccaagaaaataaacaaataaattttggaatgatttttgagaaatttttctttgttcataggtatatttttgaaattttcgagtcgattcttaagggtatattttttgaaaaaattttcggtcgattcttagg

SEQ ID NO: 2085 - DNA, 4265 bp, Heterodera glycines
tgcaataaaaacgaaatacaccaataagaatcggtcccaaaaatttaagaaaatatacccctgaaaattgaccaaaatttcagaaaataacccataagaaatgaaaaattttcccaaaaattcgtctccataatttatttattttcattttcttgacaaattgtaattgtgcgggcgaaattgataaaatgagaggcaatttatttatttttatgttaaaatgaagtaatcatttgcatttgcagaattgtgaacctaaatacattaatgaattcataatttagaaaggagaagaataaataaaattttataataataaatttataaaatgctatttttattatgatttaaaaatggaaggataaataaagtttataaattataatgaaagaatatttccataaaataaagtaaaaattgttctaaaataaacagaaatgtgtataaaattagttatcaatgagcacttatcacagccaaacaaaatcaaaaaagaacagccaaacaaagacactgatcagactgatcaaactgttgtagacgatgaacattgacatggaaaagacatcgtaacgtccaaaaacacataagtgaaaagcgaacagaatgccaaaataaagtgcaaaacattttgttgtgccaaatttgaagcatcgatgcatcaaacctttgcatttgcgcgttggcatttcgcgagttggtccgccactaagaattttaaattacccaattatccattaaataattaatatttaatttattaaaaatatttataataattaaaaataaaaatttacagcatttttgcatattgtttgatgaaataaacaattaaatattaatcatttttttcaattttaattttctttttaccattgctttaatggcattttgacacgcctcggcagtgaatttatcgcaattttggctttgtgccatctgttcgggcccgaaattcgataaacatatggcacatttgggccaaaaaacaaacggagtgcaaattttgggtcgtccataaaaagctgaatatattatttactttgaaatgaaatatgtaattattaattatgctctttttgattgagttttaattgcaaaaaaaatatattattcggaatttttaaataatcaaaaagaaattaatatttttaatggattatttgttttatcttccgcaggtttcaattttgcattttcaatgataaacccatttattattgcaaaaaaaaaaatattaataaattacctaaatttcaactttttttattcattaaattgtcccatggaatgtgtaattgtgccaaattcactcccaattataaagtgccaaccacctttgccaggttcggcttgcatcccacgagttcggccagttcgtccatgtaagggatgaacggcacttggacagtgtgtttggccgactcgaaatattgacgacgcatttgtgcccgcgtctgtgctatgtcctcacacattgtgccattgtcgggaagttgaagacgaccagcaaaaactgcggccgcccagcgggattgcatctcggcaatgggtgcctgagaataaaataaaaattataaattcttttaaaaaatcaaataagccgatgcttgaggcgaatttttcggcaaaaatgccaaaaataaaaggcacaaaaacacaaaagagagcaattatatgcccaatcatacagaaaataatccataagtaaggttaaaaaaaagaaaaacaaaaaaagaaacactctgaagcttcaaacaaagttatttttgatgaatttaaaaaaattaaaaaacaaattatgggattttacctcaaaaactttcaattttttttttgcttaccacactcccaattggctgcaccaaaccaataaccgccagacgttttgccacataatttgagggcgggaaaacatatttgtacaagtcaatttcattttgtttctgaaatggagcgtttaagaacattaaaatttagcttaatattgatcaggtggtacccaagagccaaaaaacacaaaacgattttttataattttcttaaaggttaaaaaaaacgaaagaaaaaccaaaaaatgtaagttcaaaaactgtttaaacgcttttttaattttgcaagctaatttagaatatttagtgctattgaatgatatcaaattgcattcaatttggacaaataggcgtagttatacccgaagccccggagcaatattattcatattttcagcattaaaactctattaaaatgtttactctgatgggaattaattctgccggcctaatgaatggaaatccgaaagtgtatccggtgcacaaaatgatcacatctgcactgaattcacgtccatcttttacacaaattgagtgttcgccaatggtggaaatgtcgtcctattaaatatttctatttttattattattaataataatattataattaatttcatacggtaattgtaatacggccactggccaacagattggccaaacagtcgttcactgctgggtgctgttggaagaagcgatgtgctggacgaagcccgtatatgtcatggtccctggatttcgatgttattatgttttctcgaaatcttattctggaaaattattaaataccaatttttttttctcatcttcttatttatttgaattcaaaaaagaatttttcacaaatagaataaaaaaataaaattatttttcttcaaaatttatttaaaaaaatccattaaaatatggtaattggtaagaaaataatattttttattggatcatttgaaaaacttattattgtaatatctatttttgcttttaggctgaaagttctgattttgaaggttctagactttttgccttaataaaaatctctaaaataactcaatttaacatctttattttcaaactattatcaattttatcattttttaaaataatttctttattgaataaaatttttgaattttcttattgctgtcactactgtttttaaattattattcttatgcattaacattctctgttgcattcgatgctcatgaaaatcgttggcaattgtccatggcaaagtgcgcatcagccaatcgtaaaaccgactctgataaacaacatcgtacggtagcccattttggatgacccgattgaacacccaagtgccgcgtcgggtggaaatggtgacctatttttaaagacattacatattttacggctaattatgataattttttttattaaattattattcgaatttttcaatttcagtttctaaatttaaaaaattcaaaattcccacatttttcgcgatttttgccaattcgacgccaatgtccaacgcggaattgccaatgccaacaatgaatacatttttgtcttcaaatcccttatagtcgcggtactgtttggcatgcaaaatttggcctttgaaattctcaaggcctaaattaaatttgagatttttacgcaataattaggaaaaaatcaaaaaattgaataaaagcagtaaaaaaagcggaaaattttttgcaatttcaaggaaaattgtcgaaaattccatctgaaaggcgactttttttcttttttgcttcaattgtggacgaaaaaagtgaagaattggaaatattcgaaaaagtaaaaaacaagtttaaaaattagaagtttctgaaaaagaaaaagaggcatgaaaatgaaaaaataagcattaaaaatgttatcctggaagcaaagaattcacaaatatgctgatttaatgcgctgattttaaggtggccattctgacaagtcatttaacatgctaattaactcgacgaaatatctaacaaaaaagaagtaagccaaaataaaaataatatgaaatttcaaattaaattattattttttaacctgtaatttgcggcattaatggctcgcagtgatggcccgtacaaatcattgcagcatcaaattggcgtaattggccaaccgaaagttggactttccaaatgccattgttcagtgtcatctgaagaccattttattgtttaaatttgtttaaatatctacaactttaattgacacctctttaacttcggtgttaaattcaatgtattgcgcgagattgaaatggtccgcgtacatttcaacatatttttggacatacgaatggtgcataaaatttggaaattcaatgggcggaggcttaaaaaggcaattaattaattaaggtgcaataaggaatttaaaaaaataaaaaattctaataataaaaattgagttttacaaaatcggaatatg

SEQ ID NO: 2086 - DNA, 886 bp, Heterodera glycines
gaggattgaaatggaaagcaacaaaaaataaaatgtcggaatttttttgaattgaaaaaattaaaacaaataattcatttgttttgaaaatggaagacttacgaaaataaatgtgttccaattttgataatatttcttttttcgccgtgcaacataaaaatcaaaatcaaaagcacttgctgaaaaccgccgcttttttcatcatttcatttcgacaatgatatttgcaggggcctatttcaattcggtcatatcactgatatgacttcatatttgaccgattttgtcttttaacattggtgaattttcttcaaaatccaccaaatttcaaaatcttggtatcattcgatacccctaaatgtctacgatttgcatactaaaaatcaagaagttttatccagatacaaaaaagttatggccgtaaatgtttgccaagttggttttttgttctaatctggccataacttttttttttccaaaaatcaaaaaataacgaaattttgaaaaataaatttttaaaaaacggagattttttgaaaaattatcgtgacttcaatcccgcgggatcccgcgggattggtaaaatggtcgggagggatcccggttcgggatcccgatgaaatcccgatcccgatcaatcccaatgaatttaaaaaatcgctcgggacggatcccgaggtcgggattccgaatttaatcccgcgggatcccgatcccgtccggtctctatttcacacacctaatttgttttttccatttttaagttaatttaaatccgccgggaacagtcttaattatctcaacaaaatgtctgacaaccgaaaacaaggagaggaaaagatggccaaagcaatgtaaaattaaaatgccaatttccatttttatt

SEQ ID NO: 2087 - DNA, 3189 bp, Heterodera glycines
  misc_feature (57)..(57): n is a, c, g, or t
  misc_feature (119)..(119): n is a, c, g, or t
  misc_feature (168)..(168): n is a, c, g, or t
gtatgtaatgtatgagaaggtcggcggtgccgagagatatcggcggataaattttgnaaaaactaagcttcaatttgttaatatcttcaaagaaatataggcattgaccaactaagaanaaaattatggccgaagaaactgaggatacattcatggaacgcttaaaanccgactagattctaagattttaaagattttttgaaagctatttctcttactaatttaaaaaatggtaactataaatatgctgtagcacatgcgaaaaagtgccaattgtttattttgttttcagttcatgcagttgaatcggttttgttgcataattttttaattttgttgaaaattcaatttttggttttagttcgaatccgaattcagggttataaacaagcgaaagaaaatacctaggtgtcgaaatcggattctacgaccccgaaaaagaaaggcatcaagatttgttaactccaaatcaatgggaagatacaatactaattgaacacataatattccatttattgctcctcctttaatacatacataaaaataaataaaattattttgactgttttatatacaatacaatacaattgggcatggcatttatttgaattcaatatcacactgttggcacttcattctttaaatactgggctgattattattctcggccgcctcctccgtcgttgtctcagtcgtcggcggtgtgtccacgccgctgtcattggccactttgcgctcctcctccgcggacaccgcctgctgttgttccgcttccacaaggggggccacctcgtccaatttggcctgaattagggcacagtgtttagacggtgaaaaattgcaatttcttaaaattttcggcgaaaataaaaaaacattaataaaaggtggggaaattaagaaaaaatattttttattttttgaaaacatgttagtgtgaaaacaatttttccaaaattgttaaaggcgccccaaatggccatccaatatgcccacgaccccaattcacctgcggaatgtccgtcccttccaccacaaaagccgcgtatttctccgccaccaaacgacgcaaacggtccaacgcggaggcattgctgtaaatttggggaaaatttgacaaaatgcatggatttcccatattattggtcaaattgtatcaaaaattgttagttttggattcaaactccccctccaccttacaaattagggagagcagagctcgtttcccgcccgaaaatttttttctaataaaatttcaaaaaaacgaaaatttttcagtgatttttttacttttatgatgcattactaaattttttcaagaaatcgctggaaattttttttttgtttttttccgaaaaattctcttaagtttgaaaatttgttgattttttcggggggtggggaggaaacataatgaactccaaattaaaggtaatgccgtttttcaccttctcgccacttcgtcctgctccccttgctcagtccgcacatcgctttgccctcctcctccctctcttttgactccttctctccttcctcttccttttcttcctcttccgactcgtcttcttctccttcttcatcttccgtgtcctcctcgtcctccttctgttgttgctggtgcagaaattgcgactccaagaactgcagaaccatctcgaatacggctgtgccggtcaacagcgggtccaagtcgctctgaacgccgatgtaacgggcgacacggccaggcaccaggaagccaaagtcgctgaacgattggtgcacaatgcccctgcaaaggaaacaaatgttcaaataaatatgagcaagcaattcggggaatgccaaaaagagtgggtgaattctttgtttttacacggaccaatttgcaaagaacagggtagcaaaaaaattaaaaataacagaaaattttttgtttctaaccaagaaaatatgtatatttttgcttttcccaccgcttcttcgaccactcactttatcgtgaacatcattcggctgtccgtgttggtgacactcggctgtgcagttgctgctgtcgttgcggcgccgtcctgcgactgttgctgcggtgccgtcgttgttgtcgtctccgttgctgttttgtcgtcattggtggcagtggtcgccttcgctaacagtcgctgcattcgtcgcacattgtgtggccattgccatttgctggcgttgagcatcagcacgggctaaaaaagtggggaaaggtgatgagcaaaaaaaaaaaacccgaaattttctggaaacgggccaaatttattttttgcacaaaaatgggttttattggcgcgggttcgaatcccattgggtgtgtgtgccgatgaaggggggaaagaagacaaattttgaatttgaacaaatttaacaaaattaaaaatttccagtggcgcctatcggcacccttccgccgttcctcaaaatttttttccaaaaaatcgcatttcacacacctgcacagtcgccggatacattcgtcgttccaccgggtacagccaggcgtcgagcagcacacaggcgttgaacagcgacggatattcggcacatgcggacagcgacgaggcggcgccaaaactgtggcccatgcacacgcagcgatccaacgcgagacgattctgacaaaacggggagggaattttctattttttacaaatttttcaaaaaaatgagcgattttctggatgaattttaagaagaaattttaatatttaaaattttgacacagcagtgaagaattttggttggacgacaaaatttttaattttttactgcgcttttccaaatcgagcaaaaatttccagatcgcaaacccgttttcgaaaaatgtttcattttcatttatttcccccaattttccactcactttgaattgtgcccaatcgaatgtttggccgagaagaatttgctgttgtccaatttggcgttcgttgttgttgtccgtcgtcagcttctcaccaattggcaccggtccgttttgctgctgcggcgtcccttcaacggctgttggtagcggtggcgagggcggcggtgttggtgatagcacctgctcaagcgtatacgtccaatagcaggagccgtccctggaaagcggagagggggaggaggtatagtttgaattttcaaaagcgccatgccatggccgactcactcaccggtgttccaacgctgccactacgt

SEQ ID NO: 2088 - DNA, 2719 bp, Heterodera glycines
  misc_feature (48)..(48): n is a, c, g, or t
tgccgggtggagcgcgcgccgaggcgaagcaggcgacgatcaacatcnggggagattctgacgtacgccggctcgtccttcaagcacggtgagtgagcaaaagtcggatcacatcatccatcatcagtgaattcccgccccttttcagttatcaactgcaacatcatggtgaccaacatgagcgacttccaggacgtcaacgaaacgttcaagaacttcttcaccccggacacgtaccctgcgcgcagcttcttccaggtggtcaagttgccgaagaatgcactcgtcatgatcgatgcggtggcggttgttgcgggccagtgagccgaagtgcagaagagcgcacagatgaacaacagatgtacattcgtgtattgtatattgatgtgatcatgtattcgatcctattgtattattgcgtgtaataactgtcctcgttctgatcacgattgtatgtatatattatgttgcgccaatcagataaatgcctattgtatgtattctggtcctcgttaaattttacagaagtccgctaaaatcctttacagcaagtcaaaatttttcgaaaccgagaaagacggcaattgtccggaaaaaccgttcaccgcttggtcaaagagtttttggggctttgaaattcgttttgaatggggcctctagcaaaactaagaatctgactacgattaggtatctagcaacaaaattgagattaaaatgaaaagccacctactcttctcatttaccatcactttgctgatttcaagacagcaatgatgatttttcttgagatgctaattttcaaagagtgtaatttaactaaaaattgccaatttcgaataaaaatctgtttaaaatttccaagtcgaagtggccgcgccgaaatggccgcgccgaagtgaccccgacccatttttttagccctcgggccagcggtttgcaattaaccggtaagaaaacgtttaatcgggcacgtttgtttttcaaaatttaccggaccgggcgcatctgcaaaagcccgccggcgggcgcccaggctttactaattatgtcgtcaaaaatgaacggaataaatattttcgtcggaaaaaatcatcaaaattacagacgagaaaaatgagcatcaaaaaaggaccaacagatcaatttgtccattcaataatctccaaaatatccaatcatttctcaattatatttcacttccgcacaattcgacgtcctattctttgtttgacacgccgctgatggggacaatggcataaattcattttgttcaaagattggatatacggaaaagttgaaaatttgtattattttcttaaaattcttttttcattgctcacccaatccaatttttgacgagacacaaacgaattttgacattgttcaaattgtccgtcaaattttcgtcctcccactgaacaatttgtccaatttggcatcgcttcaaccccatttatgatttggtccttcctccaatgtcagtttttctcgagttcgttcattgaccaattcacatggcacaatttgcggattccgagcagggagcagcaggacaaaacgtcgccgggacatatcaaatttctttattacctagcctggtttggaaaaaattctagaaaaattcgaaaaaaagttattaagaaaattcaaggaagtacgttttccgttattttgaaaatcagcagatttagttttttattaacacttaggctttcaaaaaagttaagttttaaattttcttaaatttaagttgttttttcaaacgcaaattggtgccagttttgtcccaaatttgctgattggcacggagaaaagcgaggacggaatcgtcgtacctgaaaagggaatacatttgtcgtcaacaaaatgtttgaatttcaattaccaaatctgaaggtccttaaagcgaattttgtcgggcagcggaaaatcaattgaattggcatggtcaataaacacagacagttttggcatttccgcgtcagtgtcttttcgaattttgattggtctccaaattaccaatttgcttttgccatcgaaatgtttgtccactaaaacatcaaaacgtggcgaaagcaatgccaatttgaggccgagttcggcatggtcaaaaaagggaacatatccatccaaacacccgtaaaatccaactgaaatgcggggaaaataactagggcaccgatttatagtgaaaaaactctggcccacaaaaaaggaatttaccagtgtaaattttaaattagtgcgcaaaaaattacgtcagttatgctatttggcgaaatgataattttgtctaacactgcactggacttgacccatagtgaaaacggaaataatgtatataaaaggagcgcatttgcagtgttccatcacataattcattgcccacatattattgttattatatattgctcatcgtctgcaactttaatcccacgaagcgacgtgcccggcgcaacaatggcaagagaggaatactgcttcgatgcaacggcggcggcagcggcggagcagtctcggccttcggcaacgacttcaacacttgtgcaaggagatggcctgtcaagcagcttcgtggacgcgatcatcaggaaggtcaggcagtcgcctgtccaacgcttcacggatgaggtgggatttttttgacatgacatttcaacaattaaaaaatttcattttttccacagatcaccgacgaggagctcaaacaactctgcaa

SEQ ID NO: 2089 - DNA, 6599 bp, Heterodera glycines
ttttatccattgttgttttttattcgtttttgaatgtattggttggtttacgagaaagcataaaatgtgtcaaaatattaagccaaaaaacaattaaaactaaatgggcattacttaatatgttttctaactgattgtcctaaatccaccgttttatcgccgcttctgatcggactttgatcgatcatttctgctcttttctttgatcactcaacaaacgaacgcaaaaaacattctgcgaagaagccgaaagatgggtgccatatgttttgtttcatggccaaatcacatcgatctttagaacgcatttgagtgatttttgttggcggatccttccgctccgtttatccaatcaatctcgcccctgctgataagatcaacagcaggagttttcgtcatgccttttcaattaaaaatttttaaatttaatcattcttaggtatttaatttaattttcttttacaattaccgaaagaattgaaaaatggaaaaaatcgaagtaaaagaaacaggtttattataattcattactttttggacatgcgaactttttcagatatgaagtcaaatctgatcgaccaaaccattgaaattgtgcgcgatggcctgcaaaaatatggccaagataaattaagagaattattttatttaaaaatttgaaaatgaaaaaattttgaaaaataaaaatctaatattacaaattgaataataagtcgcatttgtattttccctaaattaaccatttgacagataagaatatatctgaatgattgaatgattattaattttttcataaaaaattacccaaatattttttagcaatgtttttgcccaaaattgcttttttacatcctttcatgcggaacaaaatgctaaaattcttttttttaaattcattaaaaagatttattgtaaattaattggattaccaaattgcccccccccccccgccctgcaggacattgccagcttcgtcaaagacacaatggagcagcgcttcgccggcacttggcattgtgtcgtggggcgcagtttcggctcacgcgtgtcctatgaattggagtcattcgcgcttttcaaggtcaaccaacacaccgtgctgattttcaagtgcggataatgggagaggaaaacaaattatatcaaatgctaatacaaatattcattttgtatatttgtaaaatacatttaaaaatagctgtttcaaaatcagaaaataattttgggtttttaagaaaaagggtaaaaaaattgtcaaattttcttctgtcgacattttcttaaaaaaatgacatataaccgcgaaatttgatcatttcagacaaatctttcaacaaattctattcaaattttcctcggcggcgcccaatggcactgtcggccccctatcatccataattaaggaatatcataaaaatttcaaattgggtttaattaaattccttaataaaaaagagtgatcttcaaagtttgagcattgattattggggtgcgttttttataaaaaattttctaagggatttaaaaaagtgccgaaaaaagtcggaaaaggcataaaagtgcaaaaagtggcaattaaccgcagaaagtgggaaagggaaaaaaggtgcactaataaaggtgctcaagaagcttcatgctaaattaaaattacaaattatcgcactccattaggccatccaaattttaagacattcacatttggtttatccaattctaaattccatatacaattccgatatctgcggataagacaattaaatttgtccaatttcctttttatttgtttttcacttttgatgaacaagaaataataaattattggcaatttaatagattattgtgaagctgcaagtcgacccaaaatataaaatattcttattctccaaccactaaaattaaaaacaaaaacaaaaagtgcagcattaaaaaaaaagaattcttattttttcggaaatataaaaataaacagagccatcaagcggatgttgtaaacccacgcaccaagtcataagctcttaatggcacgtaagggattaatcagtgattaagcaaccgaatgtccacgccgccaaaatgtataaaacaacacacactgtcattacgataacggctgtcatcattttaatcattttagtcgattcaattaaaaggcatgaaaatccaatgggattaccaaaaacgacttaattcctttgggaaatcggaagcattctttaccattcatgttaagcaattaattgtacaacacacagtgtcattacgatatcggctaattataattttaattcaatttgcctattcaattaaaacgcgtgaaaatccgatggaatttccaaaaacgacttaattttaattcctttggaaatttgtccaaagttaaaaaatcggaagtattcttttccattcatattaagtagttaattattgtctcattttttaaaaaatgtagcaatatattttaaagggagccggaaaatgtcacaaaaaattagaattttaaaaacaatgcaattgattttgtttctataaatcgtccggaaatgagcatctgtacctaaaaaaattttcatgtgcttaagtggatttggtaggatagtaaagggaaagcggatgtagaactaacaaataagtccgctccacgacaccatatttttatttacttattttcttcctgaaaaataaaattggctgttttttcaaattgttttgaaggttttgccaaccaattggataattaatgttggtatcattcaaaagcactttttctaagcaaatgtgaagcatttcgaaacaccacaaaaatgttgcgagtctttgaaagtttgtatttgcttagtaaatttcttcttatcaaaagcatttgaatgataccaaagattatccaattggtaggcaaaatcttcaaaacaaattttcaaatagccagtttcaatttatggaagaaaataaaaatgaataaaaacattgtgtcgtggagcaggttcgaaacacacccattattgtttttaaaaatctagtttgatgtcggattttcagggagccatttaaaagaatacaaattatcaaagaaagatcagtcaactttgtattgcaattaacacaaagataagccagactttgtagtcatccaccgtattatcgttgctttgtaatgggccattaatgctaatgattttcccattaagctgaattacgcaattggtcttttttttgctcattaattggttcccatgcgagttttattttgacgcttcagatagaagaaaaataatattctaaccacaaaaaaaactgcgaaatgtcaaacggaaagtttgcacaaattttgcttcttctgctgatcattgctgaaatattcgtcgcgataaaaacaaagaaaattgtaattttaaattagagtacatagagcgggaccgggaccaaaacacggacaactgagtacaactgagtaccgaggtcccggttttgaccgggacgggaccagtcccgggttttttcccgcttttcccagccaaaaattcccggtttttcaacccgaaaaggtcccggtcccggttaagcccaaaattcccggtcccgctctactctattttaaataattaaaaaggcagaatttcattttcagttttttgttataaggaaaaattattgggtattatgcatttttactcaaaaatctccaaattagaaaaataaatgtatcttaaagatgaatttaatttattttcattttcctcaaaaaagaaaaatcaaaatcgatatatttattttgtaccatcgtcctcataaaatgggttgtatttttaattaacttgtcataattataaaagataattattgtttggttatgtaagcattgcaacatttaggagaagaagcatattcaccgccactctaagcgcgaggtcatcccaatttgcgtcgacttcactcgaagtccagtggagtgcccgaagaagttcaagaagctgaagttggaccggttggtgatgcagcagctgaacacgccgagcagacggatcagtttgaggtgctacctgaacatgttgccgagcccatactgtttccggcgaaactcaaaactgttctgatcgatcacaactaatttcgtaacagcagaggaagagagagaagagagcgagagagaattacaagaaaagtgaaacgaacaaaagaagttaagttcatattgaaccgaattgatacttatgtattttagctgggtaaaaaaattttcagggaacgtgagtccagtttccgtaaaaatgcatttactttcaatgagaatcccgtcgggaatgcgggaaaaataaagtgaaaaataataatttgaacatttaaaaaaaaaatttgtttttcgtcgttaaaattgtctattattttataatccaaaggattcaatgcctaaaaaatgctaagataacaacgactaaaaaaacctctttttcatgcatttcagaccatagagagcaaaggaaaaaataggtaaaaacctaaaaatattagcactaaataacctacctaattattttgataattataaaactcaaattgaatttggagcgggcggtgccgccacaagccatgaatccatatttatattacattcagttatttgaatcggttttgggcaataaatttggactttggtgaaaaatgcatgttcgacttttgtctgaatttgggtccagggttcgaaattgtccaaaatgggtgtcatattcgtgaccaccccgaaaaatcaaaactcacgttatttggactttttaattacttttatacaaaggaagtgcggtatataccttacagaaagataatattatttgtacaagaaagcgatgcatttaacaattaggattattcaaggcgcttgtcaaatcgttcgcccatgccccgctggttctgaaattgtctttctgaacaccgctcatcaggtcgaacttttgctccaccgcttcaaatttggtcgtggtcacttgcttgtgcagcatcgttttcgtaacatttcccgtgtactgtccccatggttgtacgttcggtcacgggcaaaagcattcgtaacactggtgctcttcatggccacaggatttacaaattgtaacggcaaagcactgatgcagaaatatgtatgtttaaaattgagattaaaagcatgagaaggcaataaaaaagatattgttgattttttacagaagtgaataaaaattatagataaacattcgcaatttataaaatttgcgtcagccatttttgctgaaaggaaatttgaagcaaaaggaattgacggaccttcaaaaacaaaaacaaagtccgcttcaattttttgtaaaagcacagaaatatatttgctggattcgaataccgtaaaacccgggaacattttccctggtatgattgtctcttgtacggttttatgtaatttgggtttgggtcttcatccaactcgtaattcgcattggtgaggctattttaagagacagaaatttcaacgggtaggaaagagagggttgagaaatgtttataattcttcaaaacattacagcaaaagaaaaatgatgaacgaatgagtgaaagaggagaagcataaagacttttatatgaatgatgttctgaaagtgatggaaaaattacctaatgcatattctacaaccaaaagtttttacctcaacagtctgggtggtatataaataggcaaaatgttaaggcaccttccatttgacttttttccaacggcagaatttgcctcgtcgctcatcactccgtcccatttccctttgcaataatgcagcggaagcaacccaataatgtaataatcattattcaaaattgtttgttttttaaatttggtcttgttacaggatttgctgaacgtcagagacaaccattggagtgccggtggagaaggaacgcgccacacacagaaccacgggagtgccggcggagaaggaacgcgccacacacagaaccaggggagtgccggcggagaaggaacgcggcgccacacacagaaccacgggagtgccggcggagaaggaacgcgccacacacagaaccatgggagtgccggcggagaaggaacgcgccacacacagaaccatgggagtgccggtcgagaaggaacgcgccacacacagaaccaggggagtgccggtggagaaggaacgcgccacacacagaaccaggggagtgccggcggagaaggaacgcggcgccacacacagaaccacgggagtgccggcggagaaggaacgcgccacacacagaaccatgggagtgccggcggagaaggaacgcgccacacacagaaccatgggagtgccggtcgagaaggaacgcgccacacacagaaccaggggagtgccggtggagaaggaacgcgccacacacagaaccatgggagtgccggtcgagaaggaacgcgccacacacagaaccaggggagtgccggtggagaaggaacgcgccacacacagaaccaggggagtgccggtggagaaggaacgcgccacacacagaaccatgggagtgccggcggagaaggaacgcgccatacacagaaccaggggaatgccggtggagaaggacgcgccatacac

SEQ ID NO: 2090 - DNA, 1448 bp, Heterodera glycines
tccaccgtattatcgttgctttgtgatgggcccttaatgctaatgattttcccattaagctgaattacgcaattggtctatttttgctcattaattggttcccatgcgagttttattttgacgcttcagatagaagaaaaataatattctaaccacaaaaaaaactgcgaaatgtcaaacggaaagtttgcacaaattttgcttcttctgctgatcattgctgaaatattcgtcgcgataaaaacaaagaaaattgtaattttaaataattaaaaaggcagaatttcattttcggttttttgttataaggaaaaattattaggtattatgcatttttactcaaaaatctcaaaattagaaaaataaatgtatcttaaagatgaatttaatttattttcattttcctcaaaaaagaaaaatcaaaatcgatatatttattttgtaccatcgtcctcatcaaatgggttgtatttttaattaacttgtcataattataaaagataattattgtttggttatgtaagcattgcaacatttaggagaagaagcatattcaccgccactctaagcgcgaggtcatcccaatttgcgtcgacttcactcgaagtccagtggagtgcccgaagaagttcaagaagctgaagttggaccggttggtgatgcagcagctgaacacgccgagcagacggatcagtttgaggtgctacctgaacatgttgccgagcccatactgtttccggcgaaactcaaaactgttctgatcgatcacaactaatttcgtaacagcagaggaagagagagaagagagcgagagaggattacaagaaaagtgaaacgaacaaagagaagttaagttcatattgaaccgaattgatacttatgtattttagctgggtaaaaaaattttcagggaacgtgagtccagtttccgtaaaaatgcatttattttcaatgagaatcccgccgggaatgcggaaaaaataaagtgaaaaataataatttgaacatttaaaaaaaatttgtttttcgtcgttaaaattgtctattattttataatccaaaggattcaatgcctaaaaaatgctaagataacaacaactaaaaaacctattttcatgcatttcagaccatagagagcaaaggaaaaaataggtaaaaacctaaaaatattagcactaaataacctacctaattattttgataattataaaactcaaattgaatttggagcgggcagtgacgccacaagccatgaatccatatttatattacattcagttatttgaatcggttttgggcaataaatttggactttggtgaaaaatgcatgttcaacttttgtctgaatttgggtccagggttcgaaattgtccaaaatgggtgtcatattcgtgagaagccaccccgaaaaatcaaaactcacgttatttggacttttaattactttt

SEQ ID NO: 2091 - DNA, 2214 bp, Heterodera glycines
  misc_feature (2138)..(2138): n is a, c, g, or t
aaaaatgatggacggaatgagggaaaagaggagaagcataaaggcttttatatgaatgatgttctaaaagtgatggaaaaattacctaatgcatatttacaaccaaaagttttccctcaacagtctgggtggtatataaataggcaaaatgttaaggcatcttccatttgactttttcaaacggcagaatttgcctcgtcgctcatcactccgtcacatttcctttgcaataatgcagcggaagcaaaccaataatgtaataatcattattcaaaattgtttgttttttaaatttggtcttgttacaagatttgctgaacgtcagagacaaccatgggagtgccggcggagaaggaacgcgccacacacagaaccaggggagtgccggagaaggaacgcgccgcgaacaattgcaagagcgtggcattttcgggacgccaaaagaggaggtaggaggaaaagtgtaatttacttttaaaaggctttcttcatctttcaggcgatggcattggcaatcaaggacctgacgttggcgacgaatcaactcacgatgacgatgcagacgttttcgttggatgtgcgccaaatgaaggagacgacttaaatcgacatccaaacgaagcggcaactgatccgttcggtggacactctggcccgtgacctgaacaactacaacacacgtggtggagaagcacaaggagttgcgcttggccttctgaaccgaatcgacccgcagacgttgttgcttgagttgcttcgtattttgcttcgtcagtgatctgtcgcaatttcaccccgtcctatatattgtcatgtgttctcttttgtggatcaaatgttccctttatattgtaacaacgattacccaccatatatgttgtgtgtgtgtgtattgtatatactaatgttgataaaggaatcgaagctttttaccccagaaaaattcagaaactgattttagccccaaaaataggggtaatagttcagtttgtgtttttgacttttgaaaacataaaaaaattttcgaaaaaggggggggcgacaaactgaactattaccaaaatagggaccacaattctttatcattactgcaatattaaaaatacctaattttgatttgcttaatttatgcttcctgttcttcagccgaccaattgcttacaaattagcattccctcccacccaaacattccacgccaacatgtgcgcaacaattatttaataaatttggtttttaatagagcatcaaaacgaaaatctcacccaaatttttaaaaaccagaaaagaaccaattttttccaaaaaccactaagaattttttaatgtaaatctgctaaaaatagggccaaaattctcaatttacccctggcggcgcctatcctctaagcgtgttttgaataaattttgtaaaaataaggctttttgactgggcttttttgcctgcaaaataatgcttttgaaaattttatttgctagccctggcagtcggcaattcaaaatgtttttgtttgcaaaatccacacacatttttcagttcctcctcagctcctcacgcagcaaagctgaatttccggaaaaaagaaatcggtttttaatcaaaaaaatcattttaagagacgaaatccaaatccaatcagtctaaaccatagataagctcacagaagtggagacagccgatcaaagtgacggcgtcggaaaggaaatcgccgtaaaagggcagctgatgtgttcggaaagtccaagcaaatggaactcgtcactttggagctgttgttggtgctgctcatcacggtcagcagcatcagcgagctaattgtcagtgatcagttgctgatcaacagaaaagcgaagtgacaacgaagccataatcaaacaaattaatatgccaaaatcagtcaaaataataagccaaaatcagacaaatcaatgcatatgccataattggccgaattaaaatgccataatcaatcattgataccaaaattaaatgtgccataataatgcatttgtcataattaattaagtcttgagttaaattaatgcatgtgccgtaactgaatatgccatatttagaatagggattcgatttataaactgccaaaataattagtttttagtttctaaaaacaccccaaantagtgctaaaagtccgaaattaggggtgtaaaatcgaaaattttcttcataaagcaaaatattatgccaaatcatt

SEQ ID NO: 2092 - DNA, 1842 bp, Heterodera glycines
atgtgcgcacaaattatttaataaatttgtttttaatagagcatcaaaacgaaaatcttcacccaatttttaaaaaccagaaaagaaccaatttttttccaacttcactaagaattttttaatgaaaatctgctaaaaatagggccaaaattctcaatttacccctggcggcgcctatcttctaagcgtgttttgaataaattttgtaaaaataaggctttttgactgggcttttttgcctgcaaaatgatgcttttgaaaattttatctgctagccctggcagtcggcaattcaaaatgtttttgtttgcaaaatccacacacatttttcagttcctcctcagctcctcacgcagcaaagctgaatttccggaaaaaatcaaaaaagaaatcggtttttaatcaaaaaaatcattttaagagacgaaatccaaatccaatcagtctaaaccatagataagctcacagaagtggagacagccgatcaaagtgacggcgtcggaaaggaaatcgccgtaaaagggcagctgatgtgttcggaaagtccaagcaaatggaactcgtcactttggagctgttgttggtgctgctcatcacggtcagcagcatcagcgagctaattgtcagtgatcagttgctgatcaacagaaaagcgaagtgacaacgaagccataatcaaacaaattaatatgccaaaatcagtcaaaataataagccaaaatcagacaaatcaatgcatatgccataattggccgaattaatatgccataatcaatcattgataccaaaattaaatgtgccataataatgcatttgtcataattaattaagtcttgagttaaattaatgcatgtgccgtaactgaatatgccatatttagaatagggattcgatttatgccaaaataattagtttttagtttctaaaaaacacccaaatagttgctaaaaagttccgaatttaggggtgtaaaatcgaaaattttcttcataaagcaaaaatattatgccaaatcattaatgagatacataattttcaaaatcacaaattcttgacaataaataaataaattttggagattgatttttgagaaacttttcattgcttaggggtgcattttcgaaaatttttgggtagatttttaggggttttttgggtcgcttcttaggggtgtatttttctttttgttaacaaattttgggcaaaacaccaaaatagttgaaaatattttttttttcaaaaattataaatcgcatccctaatttagacaaattagtatatcgaaatcggaaaaattgaagattaccgccaactttgattttgtatacaaatgatatcattcttctttatggagagagaagtcgaatagtactatttttagggtgccgcgacaaccctgagctgagttacacacccgggactggagtgtccattaaccactgggactgaatcgtccaactcagaaaaaaaggccggacgggctcgctttcgcgtggccgttttcgcgtggttgcatataagcgaattttttacttttttatatgtcaaaaaattttttcactcccgttctacttcaggtccttaactcaatctatatttaagtgaattttataatctaaattaagaatgacaaattattatacagtctaataattttttcacggtctaatgctttggtggtattagtgtagactcaccatcccaaatgcaatttggtataaaattgttttctgtctttctggcaggcttatttatcataaaaaaaatttccaatccctattttctatataaaattgagctatttgtgcgtaaaatgtttggggcatacttttgtacggcaaa

SEQ ID NO: 2093 - DNA, 1214 bp, Heterodera glycines
ggtgtcaaggcagttcgtacaatggcgtttcgtacaatttcaaatgggaatggccataacttttttttcgtcagttaatttcttcaaaattggaatcattcgaaagctctacgtgtttagacgacgtttgggttaaggttgttcattttttgtttttctttgttatacagaaaaataatttgccaatattttaggcctagattaacaatgtaaatttagtatcagaaaataaaaattaaaaaacatttactaagatatttattttcattataggataattttcatcaaaaattgatttgacatacttttattttttattacgtttattttttgtatttaacaccaaaatatcaatattagttaaattttgaaaattttaagtattcgggtcctagttatttttaaaatttcaaactctaattttgttaaattaattatttattatgagttttcttattgaaatttcctgttacaaaacttatttgcgttaatttctttggtaagttattgtacttcaatgtcaagaatagttttattaattgataaatgtttcaataaacataaatcaataaaaatatattcagttattattgaaaattttgattgagacaagaatttcagttttctgttaaaaaaataaattaatatattttattcgaaattttattttatgaatacattttatattaagattcgcatcattttcttaaaatttataaatagtttatattttttttaatcgtatgaattatgtattattcttttgtttttggtcttaataataaggcaaatgaaatactattatgctttacacacggcatcaagctgaacaaataatatctcgcattattggattttaaacgaacaaataaaattcttagtacgcgaatgtcgatgaaaattatattatttccatgagtattttctatttctgtctattctctgaattttattttttattttttttttaaagaattttcacaccctaatcaaatgtaaataataaaatccaaggtaagaatttttttttatctctagttctcttggttttcactcttgattttctgccatcatttttaagtttcttcatggatgctgtgacattttggtaaaacattgaaagattggtatttgattcgttcattagtaaaaaaaagcaaagtaaccggacatccataaatttaattaaaactattcaactatatgaatgtttt

SEQ ID NO: 2094 - DNA, 2195 bp, Heterodera glycines
agagcattgcttaatgtatcctcctcggttggcaaaagtttttcaaaaattgttcgcgtatgagcacctaagtgtaatttaagtcgatttattttgtctgcttccgaccaatttgatccaaagacatccacataatccagaaatttaatttgccactcaaaaatgccgaagcagtttcaccatcaaatatttgaggtaaaggatttgaagaacctatagcagtaagcgtattcagataaaatattttactaagctccgcatttttttgcattatcttgtgcctttgtatcgccgaagcgttttaaaatgtcaaccaaaggcgtcacactgaaacttcagtaaattctttgcctttgtgctgccgaagcaattcctaattttaattgttttcttttcccttttcggtcttatttattatttgttccgtgttttggttttgtttgtttcaattaatttaaaatcactttgtcccgatctgcactcaaaagtgccaagtcctcgatgtaaatgtccgtagttgtacagtccgcagtcagtcgttgcctttgtcctttcactgtctcgtaaagtgatcgctgagtaacgggtccaattgcactctccacgtagtcgaacagcacacaaaatccgttgaatcgccgaagcagggagacgcgcaccgtagctcgacgtacctaagaatttatagaatttttttaatgtgtcattcattcaaccaagcccactgaaatatgatcagtttatttaaataaaaattctaaattatcactcaattttaggctacagaattatcaagcttaggctgatcacagcataccgtaaacgtctaaaaaaaggaatacccaggccaaaaacagtgcatggagtgcattgataggaaaaaactcaaaatccggtccccagagttccaaaaacacagctttttgggctttggaaggatttaatttttcaaatcccccagccattaaattcgaaccaaccgaaatacctattcaaattgtcggccctcagtcggacttccttcacaattttagtccgccgaagcactgtgccgttgcttgaagccaaaaaagtgccgaaggactgacgatgctgctggtgggtctgttgaatgtccaccaaagcaattccgtctgatgtttgactgttcgctgctgatgtccctttttttttgttggtgatgaattgaagaaagatcactaattaaatgcttttcgctaaaaagaaattaagaattaaaagtaataaaataattaaatttaaaaccaattaaaaattgttgggtggatgggaaggaatggggcggaaggagaatcgtatacggacaagccaagcgctaatgcagcggtgattccgtcagaccggcagatttcaatcgccgttctcatcgccggggggtgagaacaaatagcggtgagaaaggcagggacacagcagagggacgaaagcaaagagagagtggcaagggcaggggaaagggcagcgttctctccgttccgttaagcatccgtcaattttacacctatgacggactttgaccaaaaacagtttgctaatacattttcctaccgtagtcaatggaatactgtattcagccgtttttcttaggattgtcaaagatttcgaatttgcttgatttttttgactttaaaactgccgaagcatattccaaattttctaaataatttttccggataattgagtcacaaaattataccttttgttttgactaatcccaaattttatttgaattcatatacggtcgaagccaaattcctctacttttttttgagcccttctcattttccctcatttaattcacctcccatcgatagacttcggtcgaaatcaaatcaaacacttagttttaccgttcactgttccttaatttttgctttcgtatctccgaagagttatgcacctcaattaaatttccaaagatttttttttgttttgcttattcattttgctcattttctccacattttttcacttttactcatatactgccgaagcatttaacctctctccgtttttggatcatttcaatccccattttctttcataaaaattttggtccctttgaggttgttttttttgtattcgttgtcttccctattttcggggcatcccattttaggggttttgtttccttcccttttttcggggcatcccatgaaaagtctacaaattgc

SEQ ID NO: 2095 - DNA, 3055 bp, Heterodera glycines
agccctttttcttaggattgccaaaaatttcgcctctctcttgactgtaaaactgccgaagcatatttcgtaacttttctaagtcattttacatgataattgagtcacaaaattcgaccttttattttgctagtcccaaattttatttgaattcatataacggtcgaagccaaattcctctacttttttttgagcccttctcattttccctcatttaattcacctcccatcgatagacttcggtcgaaatcaaatcaaacacttagttttaccgttccctgttccttaatttttgctttcgtatctcagaagagttatgcacctcaattaaatttccaaagattttttttttttttgcttattcattttgctcattttctccacatttttcacttttactcatatactgccgaagcatttaacctctctccgtttttggatcatttcaatccccattttctttcataaaaattttggtccctttgagggtgttttttttttgtattcgttgtcttccctattttcggggcatcccatttttggggtatttatttccttccctattttcggggcatcccttttttggggtatttatttccttccctattttcggggcatcccatttttggggtattttttgagtcctccccgggggccttttataccgccgaagcgctttttcctctgtcagcaggcgcatcctcagtctccctctttgactcacctccgttctactgctcctttgtccgcccaggccgatgaaaagtctacaaattgcagaaccatccggtgctaccagtagcgcggccgtgcgcggtggacgtgctggcgttgggactgggcaatttgggagggcagatggggaacattgggaaggaacttataaactcccgaaggaagggccccatgggatgatcaagcccagagatcccatcccgcctttgatggacacactgggataagtggctttattccggagagactgaagatacttcgcttgaaatggcgaacattaaatacacgtgaaaaatgaaatgtgatcgatcaattatcgtcgggaaaggggcgacaataagcaaaagggaaattaaatgcgaaatgaaataaatgtgagaatgtgaaattcatagggcttcggccggcaaacaagaaaacccggatctaacttacaatatgaacaatatttttccgaaagaaagatttttcattaataaatgaggtactcatttaaaattatttattatttacgaattttttttttgatataagtcataatgcgcgaaacattgtttatttttaagcgaaatttatattcttgcacattgtttgtgtaattttttgcagcattgcttttatcgaattatttttatcatatttatttaaccatcaagtgaacgtcaattaatttagtatttgagtgtttacattgggttaattaaagttgcattattttaacaaataattcgagtctccgatggttgaaaatggttggataatctattagttacatatattttatttaatttttaagaacactataaattgttatttatttcgtagcagaaattttattttgtctatacaatatattgtttttaggtttatgtcgtgcagatgcggatgactttgaatttttaattgagttagttgttttaccttgtttttcttttttgtttcttttcccaaaactttttattttccttcgaaaaaattcgtctattaaattgattttaatatttagtatgttctgtttatactattattttcatgcaaaaacccataaaatgtatttttcatttctgattaagatatttgttttacttatgtagttatacagaattttttattatttattggttaaaaaaaaggttagcttatttgcatcttttctcaatatatatatttggataattttaggtgtttcatcctcttttatttgaatttgtattaaaacaaaggacgaatctcatttgatttttttgagatgatgatttgagtcggaagagtcagcctttaaaaatcattattttcttaaaaatttgctcaaaatcggaaaatttggcaatttttgtgtacaaatctgttaacaaatcgcattaaaaattacaaaattttcccggcggcgcctatcagcaccgtccgccccccttgttcatcaaaagttttttggaaaacgccgcaaaaaaatcaacttcgatttttcatgcttagaatttcacaaaaaatgctacctaacaataaattgaaattacatataacatttgaacattttaaatgttttttaaaaagtttgtaaaaatgaggctttttgcatgccaatgaggcttttcaaaattttaatctgtgagtcctgcttttattatggtagtgagtgatcagctccttcgaattttttgaagcaatattttattcaaatttttttttcattaattatttattcaacatttccttttgaacatttaacgaccatataaaaatattgtttaaaggcaaataatataaatatattttaaatatttttaaaatcccttaatgcattatttgatcatgtaactaatgcatcagcttaatgtttaattaattattcttaaattaattctgatctgcatttatttttaaaattttacttatattttttatattgtaaaaataagaaataaaaggaaaattcaaatgcattaaattaaaattgttttcctcagttttttcaatctcggggttgcgttcaccaagcaatgattattaatgcgttatttataaaaaaaattaaaagcataattatttcgatttataatgcacaaacgatttttttcgattttattataaaaatagggcttttgtaaattttggtaaaaatcttattgattggttttatttaggttaaaaggcttaaaaaattactccatgattatgtgatttttattatttacatacgagtatttcattagcataaagcgttgctgcattcattattttaaataatgaattactaatagaattgatgcaattaaatatataatttttttgtacatgagcagtaacgtgatcccggggt

SEQ ID NO: 2096 - DNA, 6513 bp, Heterodera glycines
  misc_feature (6499)..(6499): n is a, c, g, or t
ctgttcgggcaggcacattttgcccccgatttatttatttcctttcttcatttgcatcactgttttggcagtgtctgctctcttcgtgctagagacagacacacgcatgcctattgattgacctttgcccttcccaattatttctccccattgacggctgaattcattctgtttttttttccccaatttatctggtccgctcccccgtctttgcatttatttgtaatttattatttgcgtaataaatttatttgttgtttggacttgtggtcttaacattggcgacgcccgtcaaaattcatcggactattcattatttcgaactgttcgaccatttattcacttcgaacaaatttttcgacgccaattcaactcgcgtcttgaatttattctcgtgttgaataaattcatttttgggaagttcagaaagctcgtgttgatttctgacttcgctgatccatcaaaaaacttaattcctcgtgttggaattggttctgctatgtgcagtttttaattcatcaatcaaatggcaaacgcaaaccccccgacattggaccagctcatcacggtccttcaacagcagcagcaattggtccaacaacttttggccaatcaattaccgcaaaatgctgcacctgctgctgctccaccgacaattacaattccgtcactgccagatgttcatccatttgaaccgacggatgacaaaagcaggatttcggaatggttggcccgcttcaaattcgcacttgactgcgcggcaccgaatgccattgacgcaacaaaagtcaaatgcctcatgaacaaattgagtgaggccgcattcagcgaatacagccgctccgtcctcccatccgctgtcaccgatttcaattatgacgacacaattttgaaaatggaaaaattatttgcaaggccccaatcggtgttcattgaccgatacgagtgcctcaaggcagctcgccatgatggtgaagattttcgacagttcattaaccgacaccggaagctgctgaaagacttcgattttgactccatcacgaaagagcaatttcaatgccttatgttgctgacagcattgcgatcatctgatgatgcatcgcttcggcaacgcattttgataaagctcgcagcggacaaaaacggcatcacctacgattcaatggtggaagatctgatcaattttcagacgacaattgccgaggccaaattgattgagcagccatccgcatttaaaaatgtgagcgcattgaaaagggggaaggagagggaacaacaaaaaatgccatcaaattcgcgttttgccaacaattcacaaaacgcttcaacggcacaacggaaatgctggcgttgtgcaggcgatcaccgggccgacgattgtcgtcacaaattggaaaaatgccccaagtgcaaatttcccggccacatcgcttcacgatgcgaaagcgttcagcaatggcgacgcaaatttgccaaaaagccaattcaacgaaagcaaatcgggagtctcagcgtcggtatggcaacaaagaacatcaatgccacttcactgctgaaagtcggagttttcgtcaacaaaaagaaaacaaaatttgttgccgacagcggcacggaagtgaacataatcgacgaagaggcctatgacaaaattggccgtccaaaaattcaggaatgcgaagaaaaagggaaactcttcgacggaacaaaggtcgcattcatcggcaaaggaattgccacattccaatttggcgacattgccatcgaccaggagttttacgtcgcaaaaagagggtctttaaatttgctgagcatttcaacgatggacgcatttggcctgctggacgatttaaaaaggaaaatcagcaattccgcgattaatttgtgtgcaaacattaattcaagtgcaacatttacgaccgaggccgccgataaatttattcgggaattaaaggcaactttctccaccacttttgaggaaggactcggactctgcaccaaggaattggcacaccttcaattaaaggatggtgccactccaatttacagaaaggcacgaccaatgccacatcattcaaaggaaatcgtcgaaatggaattggaccgattggaacagctgggaattatccgtaaagccgaacatttgacttgggctgccccgattttggtggtcaagaaaggagacggatcagcacgattgtgcatcgattattccacgggattaaatgatgcactgctggattttcaacacccgctgccaattcctgacgacatctttgcgactttgaacggaggaaaattgttctcccaaattgacctcaaggacgcatatttccaaattcaattggatgacgattcaaagaaaatttgcggcatctccacccacaagggcaattatttaatggagcgcctgcctttcggagtcaaatcagcgcccggcattttccaatcaatcatggacaaaatgctcgcctacaagccatcatagttgacatgcccgcgccgaccaacatttcgtcattgcgctcatttttgggtatggtcaaccattaccagcaattcgtcaggaacatgcgcttcattcgcaagccgctggacgatctgctcaagcacgaagcaaaatggaattggtgcgacaattgtcgcaaatcatttcaaaagttgaaaaacattttgacttcggatttattattgacacattatgatccaaaattggaaataattgtgtccgccgatgcttcggagcttggaatcggcgccgtcatttcccatcgattcgcaaatgggacaattaaggccatcgcacacgcgtcaaagtcactcgcgcccgccgaaaagaattactctcaaattgagaaggaagggctggccttgatcttcgctgtgcagaaattccacaaaatgatttatggtcggaaatttattctccaaaccgatcataagccgttgctctccattttcggaaataaaaagggcattcggcagtgcagcgtcaaccgattgttacgctggtcactcattttgttggcatatgacttcaaaattgaatatgtcaaaaccacggattttggacaggcagacgcactctcccgtctcattgcaaaaggcggagaagaggaaaacgaacgagtcattgccttgatcaccgccgaaccaattttggaagaaattctccattcagcctcgaaaaatttgccgatcaaattcgaagatttggtcatcgccagcaaaaatgactacaacattcagaaagtcatcaaattcattcgccaaggctggccaaatgaaaagaaaattgagaaagaatcggataccatcaaactcttccatcggcgcaaaagtgatctgacaattttgaaaggctgcctcatgtatggcgaaagagtggtcattccgaggatttttcaggccaaaattctccgactttttcacaagggccatccaggaatgaaacggatgaagcagctcgcccgacaatacatattttggccaaaattggacaaagaaattgaggattatgtccaaaactgtgagccgtgccaattggctgcaaaggcaccgataaaaaccgatctccattcatggccaaaaccaactggcccgtggcaacgaattcacatcgactttgctgggccattcttcggcaaaacatttttaattgtcgttgattcattttccaaatacccggaagtatttgagatggcaaattcaacagcatcggccacaatcgaaaaattgcgttatttatttacgcgccatggcatcccagaaacaattgtttctgacaatggcacgcaattttccagttcggaatatgccaaattcgttgcggccaacggcatcacacacttattttcggccccatataatccaatgtcaaatggacaagtggagagatttgtcgacacattaagagaacattcagaaaattaaaaggggaggggaagcctaacaaggagatcatcgacacttttctgatcacctaccggacgaccccaaacgattcacttccggacttgaagtgccccgctgaactgctgctctgtcgaaggccaaggacaacaattgatctgcttcggccaccaccacaccaaccatttgaaattgatttggagatggaaaggcaattcaacaagaaatttggcaccaaaaatcgaagatttattttgaatgagaaagtcttcgctcgccatcgctcctcgcaacattggaagacaggagtgatcagcggcacatctggagtgatttttgaagtcaaatttcccgacggatcattcggccgttttcacgccaatcaattgcgcaacaggaaaacagccgacaattttgatcagtccttggccatattaaatgaggcatttgagttgccattgcctccggccctgcccaatcaaccacccgacgcagaaaatgccaatttagggcccaatcacttggaagatgaggctgcgattcccattcaggaaaatttggctgctccgattgaggacgtcccaaatcaacgacgatatccccaacgccaacgtcgtaagccgaaccgattctcgcccggccataactgatcagcctaaaaggggaggtgttcgggcaggcacattttgcccccgatttatttatttccctctcttcattttccttcactgtttgcagtgtctgttctctccgtgttagagacagacacacacatgcatattgattgacctttgcccttcccaattattcctccccattcatgggataattcattctgttgttttccccaatttatctgctccgctcccccgtctttgcatttatttgtaatttattattttgcgtaataaatttatttgttgtttggacttgtggtcctaacagttataaaaatcttttaacgcttttaagtgattattttttaatcaatttcattatttcaaatgtttctccaatattgtaactgtttaaattaattttgctgacaaaatttttcttttttgtattttgtactaattgattcacttatattaatgtttatatagcgaataacaaaataatttgaattatattcatttgataagggattatataacttataaattaataattgttacttaattaaattttatttttaaattggaacaaaattgtttgctagaaattaataattattttatttatttttattggcgcgttcgttcattgcattgatttttaaaatttaaatttatttgttatgccgtggtgactggcatttgctaaggaagggaggaatggactcttttcgaataaataaatttagtttttctgaagctaattttatgtaagataagaactttaattcatattaaacttgaatttttcatcttttattcgatatctttacgcgcatatttattttttaaatacctttaaaatatattaaatcataatgaattttttacatttattaaaattttctctttttcagtattagttgctattattaaggatgcgatttcttatgaaaaactttttttgctgaattgttttgaagaatggagctcaccaaacgcatttatgcgttaaaattttttgatttggacgtcattttttgtcactagaaatctctattttggcgttttgtcacttcaaatagtgaaatttgactattttggcgttttgtcactattttttcattaaatttttttggaaaattttttcaaaatttcatccacaaaattttttttgacaaaatttttgatttaaaaaatgtcaatatttgctaagaaaatattagaaaggaaatgcacctcatttgcaactgcaatcatttaataaaaattatttttgctcaatttttgcctgaaaattatacatatcactaagacgtcaatatttcggactttttaatcccggtcccggttaagtccaaaattcccggtcccgctcaactctaaattaaagttacaaaatgtaatttttattcgagtttaaaatgtttatgcttattttttcgaacttatctttaattatctgtttaacgcacaattcatttttaaattatttactgtttgaggtaatttttatttaacatcgtttttattattttgtttaattgttatttataattaagacaaattgtttaaatatataaatttactatctatatatttgaaaaaaagtttattataaaaattattgtttccgatataactctttattttttatcagttatagaattcttacaatcgtagtttgattagcggaaaactcaatttttaagaatttaatatgaaaaattaatgttaatttaaattaaggtttaaatttaataaatcatataaaaaatttaataaaaataaacaaaaacggtaataaaaagaaaattggactttaataattttattttcttcacttatattatttaatattatttattcgttgaattttttttgatttaatattgccaaattactatatattcattaatatacctaaatacatttaatttggctctttacgagtatattattttatttcgctnatttatactacaat

SEQ ID NO: 2097 - DNA, 914 bp, Heterodera glycines
cctaccattgttcttccgcttgcccaaccccagcagtttcaattgtgctgattcgatcaagcattggcccaatcttctgatgctgctgcagcagaaaaagcattattacttacttcgttcgccgccattcattcgtccattgtttgtccgatggtattcttcgattacacacacatcgccaacccaacccaacacaaaacattcacccccccccctcccccgtatatgtccaatcatttggcatttcttaattcatatcaattgaacaaattttgaattcaaaattctaaatggcacatgatcttgaatgattgggtctttttaaatctgttcggtataataattatttaaatttaatttttttaatccttttttttcatcacgattggcgttggattttctcaattaaattgtattaataatgcatattcatcgaatccattcggctctctctctttttttgccgttttcccatttatcgggcgattcttctcttattaactcattcctttctttgtaatgcttttttgatctcttttggtcctttgtcgagatttttcccctccgatcactttgttcccgcccaatttgacccttcgttgttttgttttgttcgtttgttttgtttatttgtttcatttgcacattccgtcccgcccattaaaacaatttcataatgaagcggcactgatcagcacacactctctccccttttttttatcaattttatcttagcaatcggatcaatttggggctgttgcttttgctgctaatgtgctaatccatgcacaaataaataaatgaacattcattccatccgtccgttgtgttcattaaaaggtgggtggtgctgttttgtctcccttttgctgctgctgctgctgctgatggccttcgcattcccataattttcc

SEQ ID NO: 2098 - DNA, 4776 bp, Heterodera glycines
ccaaatccgaataattaattcaaaagttgcattttaggcctcaagcgccccttcttccgtgatgcactcgtcctcatttacgctgccgttgcgcagcaacaatagcaacagcggcggcggaagcataatgaatttgcaccagacatcgggcagcgaggacttcggcacgcgacggagtgccatcaccgccggctccgcggggggaggcggcggaagcagacagataagcgttggcagtgccgggggcccaacaatcagcggcacgtcgacaatcagtgccggaagcggaatgaccaccatcggacggaagggcattttctttgcgcgggtaaaaaggacaaaaaaaaattaatgatttaattgagtcactccttttgctttggctattaaccaattaattaattatttgtttaatttcaggaaaaattgactttcgcccatttggaaaaaatttatgcgcaagcgatcgcaaatcgcagcaacgatttgagcattttggagttggaagcacattggacaaattttgtgcacatcaacaaactgttgaacaaaagacagagcgatcagcaagaagcaatttgggagattattgtaattaatgcaaaatgaatgaaaaacgaaaataataattaaaaaataatttttaatcgaatttaatttaattccagacaaccgaacgccgttacattttgcagctgcaaagtttggaggacatggagtggtgctttgtggagctgcaaaagcaaggctttatgcgtgatgtgaatcggcagtgtgtgttcctgaattattcacagcttttgcgttgcaacttggcattttggcaatgtgccattgtgccaatgctggagcgatcgcggtgtgcatttaggaggagggaaaattaaagaaattattaaagacgggaaaagtgtttaataactcttcattttattacctaaaatcggtgatactgtctgctgggctttagccaataggaaaagcataaaaagctgtgcccataaaacgaaatcacaaaattggcaaattcaggcaaagccatgagccgctgaacgcgctgctgatgcagcccgggttcgactccatcccggactggtccttctgctacatcgacttcaacattggtcacgcggacagtcacgcgtatgtgcagaagcggcagaaggacaacgaagtgttcgcggagtttgttaaatgggcggagcagcacacgatgctgaaccggcagaagctagtggacgtgctcagctcgccgatgcaacggatgacgcgctattcgctgctgctgaaggcggtccaacgctgcgcggcggacacggaggagaaaatcggcattcaggtacggtttgtacttctttggcacaactttgcccatttcatcccctcagggcatgatagaatgcgcggagacggccacaattcggttgaattacgagctgaacaacaacgacttgcgcctccaattgtccgagatcatgaagaccatcgagagttacgacgtggtggacagcgacgagttcgaacggcttttccctttgcccacggcgccggcgcccgtccaacagttggcccagcagagcaaccagcaccaacaattgctggccgctatgagccgtccgccgccccacttcaacctgatgctgccaatgccgttcatcggcgggcagccccggttcaggcggatgtacacgcggggcgacctgaaaatgcgcgagggccgacagagtcccaaggtgggacagcgccgtagggcagccattaggggcaattaattaataagtccattggtacaaagccatttgcccagcatttgaacgcgctgaatttcatggaaaaatatttttccattacagcaagaagtgcattgcattttgttcacggacatgctgctcatttgtcgaatggtctcccgaagaaatgaccgactccgtgtcaccaaacccccaatgcacatctccaacctccgtttccaccacttcagcgaaggaagtgggcatttatcatttatccactcacttaaatgctccttaattagcttccacttggtttaattgcctaattatctctccccgttttctttattaatcctaattaatcttaatttacttgtctcatttcccaaaaaaggcggcttctacttgatttgcatgaacgagttcgaatcgccgtcccaatttctgttgatgttcaccgcaagtgttgaggaaacgaggcgctggttggaaatgatggtgatggcacaggaggaatttcgctccctgcgcacagccaatgcgcagaacaacagctattattatggtaagcccaagtgattaacattaattcattattggttaagcctcgagaaaagcctctagggcttttgagtcagtctcgactcattcattcccgagtttcggataatttccattttttattggcatattattatatattctcgagtctcgagataactttctcatgcatcgtttgtaaaagcaatcaatggcattcagcagaaggctgtttcggaagcgttgaacggctcgtggcgcaaccgccgagttgcaacaaatgctgtggtggtggtggtcacaatgctacacaccgaaatgccaccagcgtcgacatttgtgcatcgcatttgcgacggggcgaaacgctgcgcacaatgcccgtccatcagaaacaattggcacaaaaaaatacagcattggcacagtgcaaagggtgtgccgaagcggggccgaacaacggcgattttgagggggtggtccatcggaagagcagaagcatggactcacaggtggccatttggggtgctgtatagtcaattgataggaaatattatcctaaggatttggcttttcatataccataattagcgtatggctttttaaaaatgaatttctcatgtttcgttatctcagtccgccagaggggtttaagattttccaattttaagcctaatggttgttcttgactctcggcacaaattcatttgtttattcatttcaaattggtgccgtctcgtcaggtgatggctgccgccgcgtccggctccgccctctgttccgcgtcccagcatagttccggttgctgtgcccttccccagccacgctcctccgccaccgtcagcagtgcgattcgcgcttccgctgaccaactgctgtttgacaagcataaatgctgcaacaactgcaaaagcgtggaggcacagcggagagaggacgaaaggcacggcgcggggggaggggcggacgaatgttacggcacgactcgctcaatggacgaacatctcctgtccagggttggcggatgtgccaaattcacgcgcaaaagtgccggtcgagagcgccaggaacgcctggaacgacagcagcgattggcatgctttacagagccgtcctcggatagcggcgttgtcgtcgctgacgctgccggccgagagtcggacagggactcaaaggcggcgacggaacccgtaaggaaaggctcaatggcggtggcatccggtaattaaggggcaattaatttatcactgtaatttatattttaaattttgcccgctttaatcttcattttccacttatgacagcagaacggaaagaaagcagcatcagccaatgctgcggtgtcttctcctcttccgctgaatcggcttcaaacaatgcaaacggcgcgggctccggtggctcaaacggcgactccgcttccgcttcagcagcgccggcgacggccgactcaccgcagcacattgggcacgcattgggccaagcagcgagcaccgccgcattgattctgacgaacccgggcagcacaacggcacacagcgccaacatcagacataaattgtcactgaatggcaccggtaaaaaatgaggggtcattaatttcattaatttaaaaacacaattttttccagccgatggcccccctcaaattgatggcattgtagcttcttctgctgctacttcttgtgccccttcaacaacgatcagtcagcggcgtttcgagcggcgatatcacaccgttggcgaaattgagacggttcggcagccgagtcagcaccaaaaaggttggcactgccagcgaattggccaattaaaagtttggatggccctgtcattagtgactgattccttatttacattattttcagtgtgtttatccgctggtgtcggaacgggcaacaacacttgcggcggtggcgttgccggaacattgcacgaaaaccaatcaaattgtgccggcggagcgtcaacgccgggctcgtccggaattctcaagcgcttttcatggaatgtttccagcgccatgggcggatcgtccaggaaaatctcttcaaaacttaacgaattggttggtattgtactatataataacaaagttattttaattgatggtaatgaaaagtgccaaaaattgatttgaacggaataaacgaaatttaaattcgttttaatttacattttcctttttcgtagtttcctaattagcattaatataaacccataatgatggttgtataatttcagaacggtcgtcgcttcagttctcagtcgacgatgagttcgctgtcttcggagtcgtttggctcttccacttccggcatttcgtccatttcgtcgctgcactcctcccactgttcggcctcgtccgcctccacccgtccgagtcacagccaacaatggcaccagccgtgccatgacgaagtcagcacgcctaccaccgaccgatcgacggcaacaaattccgacacacgcggctcggccaaagccacttcatcctcgctga

SEQ ID NO: 2099 - DNA, 4591 bp, Heterodera glycines
gcataaagttatcgaacagcaccaagaatgcttaatttgtttgataatgaacaaagtgatggtccaaaaagtcttccgttgacgttttggtcggcagcgttttggggtgcaaccagcggcggggggggggggggggggtctaagtgatacagatggattcttatattcttcaagatcagttctcctttccagtcaacctctacagtttttatcactttaagagagctgaaaatgccaatgccaaaagcgtcctcaccgatgaagcggcgaccaccgccatgcattgtcaggcgcactcattctgctgcaatgagggcgcgtcggttgcgcacaaattggtgatcggagtgagcgcaaattcatttgaggatgagaaaaaaatggcgcacaaaaaattggaggaggaaaacaacgaaaatcgaacaaatggaaaaggagtggtggggacagcaaaagcggaggaaacggcaaaagaggaaaagggggaggaaaagcagtgccaaacggaggaagcagcaaagtgccaacaaacgcagcagcagcggcagcagccattttgcataagattgaacagttcgccaatgtcgccaaaattggaggcaaagaacggtcagagattcaagaaagcaatcagtgatttttagggtccgaagttgtatgcactaaaaaatgctaaatatgcgcataaaaatatgcactaaaaatcccacaaatacgcactaaaaaccgaaaacgccgcaaatatgcagcaaaatatacttaaaaaattgccaaaatgacttttaactaaaaaaatgccaaaaattgtttaaaatttagcttctaaccctagtgataaatagaaagtccgaggcaatagcgggtcctaagccccctctattgtaatatatgaattgaaaagcttaaaatattggagatatcaatttattgctttgtatttctccagactcttcttccccctcaccgccgcccctccccaaaacgcaaccgcccgcttcgacgccgtccagcgctggcacagaggaagaagcggaaacggaggaggaggacgggcacaaagtgcgccgggaacggcacggctcaaacggcaaaaatgccaaaatcggcggcaaaggaagcgccagtcggaggacggcaacagcacgtgcgtttttaaaccaaatattgccaaattataattgaatttaattgggttttagtcaaaaacccccgaaaattcaatcgaatcaattaatattaaggcctcttgcaaatgcctcccattcctccacaaccgacgcatcactttgctcaccatcagcagccacaggcaacaattaccgtaagccaattgagagagagggggatacgcaatactataatagggaataaaccaccgtacacaattaccgtaagccattgagacagagagggagacatgcaatactgtaatataataaccaaccatacatttgcatttgcgtcattcgatcataatattattgataaaatttttcaaatgatgaattgcttttaagaaaacaatgaatgccaaaaatggaagcggcggcggaagcaccgaattaatgcgattcattttggacgacaaattggagacatcgtaagaaaaagaaataaaaatgggaaaaagagattttgaatttgaaatttagtgaaatttgaacggatttccaccactaaaaacattcgaacaaaatgaattgagcaacaggagaagctaacggaaggaaaagcggcgccaattcattctcttcacattgaaatcgatttttaaggaaatcccttctaattactactaattgccactaattgttagagaaattgtgtattattttattattgttcatttaatttttcattccaatgtttgacagaatcagttcacattctcaaaacacatttaccccactcactcactaatctttattaacttacaaatccattcatgcatttttcgctgtgtgtaaaatgcgatttgttgcgcaaaatgttgaataaatttatttatatcattaattaattactcttccatttacgaccaaattttttcggctctattgtagtcactgaccataaatcaatttaacgactgtagtgaaccataactttttctacaagcatccaaattagacattcacggtatcattcgaaagcccaagatgtcctctattaatcggttctagtcggttttacgcgtcccatgatcttttactcgtcccaaaacatttttgttttcgaagcgttaatcgaaaactatacctttccgaatcgttatagaaatacaaaaaaaaaataaagcctcaacttaggcctagccccaagcaagcctaagtcttcagcctaggtttaagcttaagcctagcctctaagtcattgtacgagttgcctttgtacgagttgtcttgacactgactgtaagtttaacaatcaaaaaatttaataaagctactgaacactcttagttattggaaaggctaaaatatcatgaacacatcatgggacgcgtaaaatgttatgggacgataaaatgtttcggcgccagctcgtttttccacgatagattttttctttggcatccaaatcaaacggctctaggaaaatccgacactggaaaatccgacaccggaaaatccgacactggaaaatccgacacaagcagaaaatccgacaccgctggaaaatccgacacgagaccaacttaaatttaaaaaatatttttgattgtttgagttaatatctggctaagtttatcaagttttcgatttggatttaaaaaaattaattgattctgccattcgatgggatattgatggcaaataataaaagggttgtcgattgttgcgagtcgcataaatctctgtgagattcatgtcttgcaccacgtacactttcttatgcttcatgccctttcatctgattcgatttgccgcattttttacaatttttttgagatgatcaaaaagaacattgaaataatatgattattatatgcctaccttaaatatattttatagcaataaaatatttattttaaataacttaagtatttaacttttattatatgtattttaaatatttactaactcaaacaatcaaaaattatttttaaaatttagttggggtcggtttttccaatgtcggattttccggtgtcggattttccgcttgtgtcggattttccagtgtcggtttttccaatgtcggattttccggtgtcggattttccaccggtgtcggattttccgcttgtgtcggattttccaatgtcggattttccagtgtcggattttccggtgtcggattttccagtgtcggattttccagtgtcggattttccggctcccaatcaaacgatcttgttttcatcgaatgctcgtagcatgctctgttagccttgccaaaacgaaaagattttcaagcctagaaaaaattttattaaaaaaaacttggaattttcgactttttgaaattttcatgtataaattttttggtaatgtcaaatcgcgaagcaatagcttagaaaaagcttctaaacacattaagctttcgaatgatatcaacaatgtttgatttggatgccaaagaaaaaagttacagaaagttatagtggaaaaacatgatggcgccgaaacgcagtggacccgtattttagacattagacgattcagtcccagtggtaaatggacacttcagtcccgggtctgtagctcggctcagagttctcgccgcgctctaaaaatgatacataccattcgacttctctcagcataaggaatcgaatgatatatcatttgtatacaaaatcaaaattggcggtaatcttcaattttacctaattttttgcccttcgctgtttcgtcgaactataaaaattgcgccctcttttcctccctttcattcactcatttttcttttatgcatgatttactctgtttttctgattcttcttcaattttcaatgtgaatttcataaacttcactgtttcaaaaagacatatttcttttcttaacacaccatcccagaaatgagctcctgtaccagaaaagatttgcatgtgtggctcagtggtttttgtaagatagtaaagggacaaagggtggtggttcgagtccgttgtgcaacatgaatatttttatttatttttgtccaaaatattaaaaaatcacgatatttgggaattatttttgaaggtttttgccaaccaaattggataatcttggtatcattcgaaagcccttgatgaggagaagctttttctaagcaaaagttaagcaatttgacatcccagaaacgagttgtgagattttcaaattttcatagttgtctcatgaaaaaatgggatgtataacctaaaaaaatatttgatacgttcgatgcagaatttttttctctatcgatatgcaaaatttggagtggatctaacgtatagaaaaaaaattaaacgtagcgaagtaaatccggtttttctctattaacagagataaaaaaatagtacgccaaaaagagagatgtttttttctctgcactctctctttattgacacacatctcgttttttgaaacggtgtgttaacccggtaaataacctaat

SEQ ID NO: 2100 - DNA, 2220 bp, Heterodera glycines
agagaatgaattgacgcttttccctccgttcgcttctcctgttgctcaattcattttgttcgaatgtttttagtggtggaaatccgttcaaatttcactaaatttcaaatgtcaaaatctctttttcccatttcatttctttttaatacgatgtcttcaatttgtcgtccaaaatgaatcgcattaattcggtgcttccgccgccgcttccatttcgaaacttaataagtgccgaaatgtaggacgaaacgaaaacgaaacgttttcgtcaatccctgggtctgacaaaggaaggtccccaggtgtccgtgggatttccaaatgaaatttggtgggtggatagagcacccatggtttcttaagaaaaatatttttattttctgcgaaatgagcacgagtgccgagttatgacgtgccaaagttttttaatgaataaacaaattaaaaaattgtttggacacctctgcagagttcagtggtgcagcggtagtgcgctattcagtgttttctggacccaggttcggatctcccacatacattttcattttttaatttttgctttttatgccaaagtcaattatcattatcacaaaaaaaaatttttttgatttaaaatcttatttttttaatccattttgacaaataaattactcataaagttttacacaaaaattaatttgtttttaagtaaaaattgtaaaatgtattagaacgcagaggattcgaacctgggacacaaaaaaattttacctaacacactacctctgcaccatcagatgcttttaagtgaacaaaataattgttccttttctttaattagaaaaaataaaaactttggcacgtcataactcggcactcgtgctcatttcgcagaaaataaaaatatttttcttaagaaaccatgggtgctctatccacccaccaaatttcatttggaaatcccacggacacctggggaccttcctttgtgagtgaaaaattagtgatgaaaattgaagttaaagaaaaaatttaaaaaaataataaatattctttaaacaaatggcctagtggctaatcagcactaattgtaaaaatagtgaccattaattttggaaagcggtaaacttaaatttatatcgatgcagtttagaattgtaacgaaaaacaagtgaaccctaattttatttttctctgtccgtggaatttcagtaccaaataatatgagtagggaatggatttttaggtactaaaaatcctgaaataggtactaaataggtgccaaaaagtgcaaaatagaagccaaaaagctaaaatagatgcgaaataggtattaaaaattgaaaaaccaatgtctttatgcacaaaaatgccaaaagtgactaatttattatcaatttcgacaacacaagtgcaactggtcaagaaaataaataaataaatttttgagacgaatttttgagaatttttcattccttagtgaatatttctgaagtttggtcaatttttaggagtatatattttttattttttgggattgattcattagctttttagtccatataatttagactctacagattaataattaaaatcagtaattaaatgataaaaaaatcagtaaaataatgtgcgggaatgtgggatcgaaattaatgcacagcacacacaaactcgcagttttcacactaaaataaattcttcaataagattacttttttttcttaccaaaaacgtcattcttaagggtgtaaatattttcgtattttttgtccaattttgctttgacaaaaacgaaacaggaaacaaaaaatcaaaattttgtaaaccgaaaacgaaacaaaaactttagtggacaaaaacgacacaagaaaacgaaccatttcgacctatttcggacccagaacccgaactcgaacaaaagtcgaaatttaatttttcacaaaattctcttgtattgtccgaaatcgattaaaatgcactaaatggccgtgatatttattttctattatattcagtccatttgaatagatttgggacaataatgtaaaatttggagaaaaatttatccaaaagcttactttttgcctcatttatttttttttcttctaaattttcaaattattcctttatcgacaatttttttctgtgctgacaaattgcttagcattcgcatagaaaagattctccttttcaaatactttttttagatattaaatttgttcggttcagttgagaata

SEQ ID NO: 2101 - DNA, 7447 bp, Heterodera glycines
  misc_feature (1508)..(1508): n is a, c, g, or t
  misc_feature (1536)..(1536): n is a, c, g, or t
cgaacgacgccactcgccgatggtgggcgattgaggggggggggggtgaattgtagtacattaattatctaatatttggagcattcctaagcgataaaggccggcgataatttaatttagagacagacacaagggaatattgggaggaaatggtcaatcatcattaagacaacacgtgggcaagattcggtgaaatttgagaatgattcatcgagataagaaaaatgagtaattaggtaattaggaataatcgccccaaaaatggacagcgtttcaatcaattattaccgatcgcctgtcgtctcatgccgaatttgggcaagttttgcgcgcattcgtctcgtcaaattgagcgaaaggtgccagacgagaacacaaccgctgtaagagacgagcagaagacgcctgacaacgagagacgaagatttgcaattttaaattgcgaattttgagtgaaggacttgcaatcggacgagaaactgatgccggtcacactgtccgactgaccgttgagcaccgccacacattcgccattagacaagtccatgatgtaaacgaagcggtcggagcaaatggtggcagcgaacgactcggacgggtcaagacataacttaatgtgaaagtgcgtctccaattccgtctccgaatattctccgattaggtgtttacctttgtgattgtgccctcctcgcagacggtgcctctcaccgtcgtcagcaatttgctcgcctcgttgtacacgcgcaactgtctgtcttggcatccgaccagcacattgccatccctggtcactgtcatacagttgggtccgttgttcgacacaatttgcgagaggcgacgcgagttcaattgggtcgctggcgacgattgagaagaaacggcggcggaagtggcagttggttttgcgttgtcagtgaacatcatttgacggacgacgaccaatttgtcggtgccaaaggtaactagttggaacagattttgattctaaaaaccgaaaattcaacaaaaaattggcctttttaaaggttgtgtgtcgtgaaggtctcatttaaagaaaaaaaaacttcttgaaattaaaatcttatgttagtccaactgtccgaaattaatgaccgaaatgcagaatcggagtgccgaaatgctgctggaatggtcggaaatggtcagcaagtgggcgtacaattggtcgacgtcgaacagatgaataagccgatctctgctccccgatgctaacaaatggagtccgcctgttgctgtaaaaatgaaacttatgttaatgacaaatggacatcgaaacgtttaaaagtaaccatcggacggtacgcaatactccaagcaaagcacttctccgtcgtgggcttccaattcgaccaatttggccatttcccggtcgttaagatcgaacacacttcaaagagtaaggatttgcgagagtagaagaaaaccaattaccaaatgtttccatttcgtgttccgcacgacaaatgaacgccgaccgtactttagtntaatgcaacgcactcccgtagtggagtncgagggtgtccgacataatgccgccaaaattttctgtaaatgagtcacggaataattatgttaattagattaaataaactcactgtccggctgttcgctgagcgtgtcagtgcccggattaaggtataaaattttgcgcaattccaatgagaaatgattgggcggcccaatgtccaaaatgggaggcgaaggcgacccgttgctgtccgttaccgtcgtcactgaatgtgccgtggcggtgtcactgttgttcatgcaccaaatgcggacagtttcgtcggctccggcggtgaaaaacagttggggctgtgatttagagacctaaaatgggaattttagagaaattcgtaaaaatctatttgatattcacctcaatatcgaacacagggccaacatggaaaagttgggaactgaacagaaaaaagaaaatgaaggaaaactcattgcgaaaagacaaatgaccaactttattttgaagaccttcgttttggaagacgcgttttggacagaccaatggtaaatggaacgatcactgaacacgatcaatttgttgtattgtgataaataatttacaagatcaatcgcaaattgcaaagcagatttttatggaatttttgagaatacctgtagagagcagtgagtgttttggaatgagaatggaagacaattgaatggacatccgggaatctgaaaaatgcaacaattgatataatcaaaaaaagtatttattaataaactaagcaagcccgtatccaaaaaaatctgagagctggaaccgaaggtcttttttttttttgctttttcaaaaaatgaatttttggggaatgcactctaagccctgtcaacaaaatcactcccactttttcgcttggttttcttccgtccccgtgccatcgcccatcgcacaaatgtcacaatgtaaggcatgaggacggcacaactcaagttcgggctccattcgttccaaattcatggcacggattgcaccatttccgaaacccatgaacaattggtgagaggcgccaattgacaatgagaaaggcacctaaaaataaacaaaaaaaattttttttaaagttttaagattaaaaataaaagtgtatattttatacctcaccgccgagctcataaatattcgtaagcttcttatcaacaaattcaaccagtaactttgagatctgcaattgaataaaattgccatgtttttttatttcgtccgctcaccgtaattgagaaggttcgattgttcgaggcacagcaaacgtccacgaaagtgttgttgcgttggtcggcgaggatggcggaccgaccgtgcaaaacaacaccggcgctgccgttttcaccgttggaattgcttcccaaataccaaaatttgacgtgccgcacaccgacggtgacgaacatccgccccgattcactcacatccatcgcattaacctggcaaaggaggtgatgtttgttggtacattttgtaaacaaaaggtgaatgttccccacctgacaagtcagtctggtttcggccaatttttttctcgtccgccaatcccacacgcaaacggacttgtcgtgctgattgccaatagagatgacctggtcggaatcctttgtgaagctctgaaacattaaattagtgacgaatccgtagaatgcacgatttttattataaaatttcttttaaactgaccacgcaactgatgccaagccgatggccttccaattcaactcgttgctccccgtgcgtgtgcttctcgtgccgtaattcccacacacgcacttttgggtcaccaccaaattctccggtgacaatgtaacgcccattgggcgaaaaggccaaactggtcagctgaaagtaattgcttgaattaaaaaccatacaatttaaagcattttttgctacaaaaagaaaaaacacaaggaaccatgataaataaaagaaaccatgaaaacattttcatcaattttaaattcgaatttatttttgaatatttattttcaagggacggtcctaggatttcggcatgcggggtattttttgcttttcacgcctttttattacggcttttcaaaaaaaaaaaaaaaattaggaaaaaggagtccggagatgccgatatgcgccgctggatttttttgaagattttccctctttttttgagattttcgagaaaaaatttgtgcttaaattacaataattcaaccacctgatttttgctggcacagaccaaatgcgcttgagaaagtgttcgcgggttgagcaccacaacaatggaaccggcagggtaagcgacgaggccggaaatggggtcgaccgacaaggagctggagcatgcgggggtgccgaacacgcgctcgagtttggcctggaaagggagcgaaaaacgcattaaaaacagtccaaatattgcgaacaatcccttgttgctttgattttccattcctttcacttttccgtttaagtttctttgttgtttttaattttatttttatacacattccttttacaaatattgatacattccaagtcaccaaattcccccccattttatgacattccccagttgtaataaccatttgtacgatgaatacgagggcaaaagtttgggggatggattaattggagaccaaaacccccccgcggaaaatgggaaaggtggggctgattatggggggaggggggggggggggggacggaaggccggagaaagcccgcctattttcagttggaggagttcaaggacagtgaaagaagaagggatgggatggagagaacaacaacaacaaacagtgaaaagatccattagccaaattcagagagtccatttcattaatttaaggagcaaggaaaaaaatcccaacaaaaggaattataaaaataaaaaaaagtataatttgcctttttcataataaacgaattctgttttgcactcgccattttgaggatgtccgtccgtccgcaatggaagaggcgccttcacgatgttctcttttggatggagtgtccccgttgggtttttgccttcgccaccatcacagggggaggaggaggagggggaaatgcgtcgtcaagcggaatgaagagatgggtgggggaaaaagttgtgtgatcagcggagatgagagccacggaaaggagggagggttttgtccgattaggcctgactcttctgacagcgggacaaaaagtgaggcgttagtggtggtggtgcaattctgggcacaattaggggaagacaaaaacaaaatgagagggggggggggggagaacactgactgcgtttgttgtttgacgacttccgtgaaagagtgggcggagagcggaataaatgggaagagacaaattgatttgatggaggcggcgggcggaaaagggacccgaacagaaagcaaaagcccaccaccgccaccaccaactttgatggacattatccaatttggtggtggacattatggcggaggattgataagtcatggaaaagcattgactgatcaaacggtttatggaggggggggggggaaaagcaaattacggagttatattaaggaaacctccaacaggaagaaaaataaataaatgaaaacaataatctaatggaaattgacaaagaaagtacataacattgatatgtatgatttggctccaaaaaattattagcaaataggagggttataaatggtgaaactattaaattttctcttctctttacgggataagtaatgcaaaaacgcgatgacaaaatggcaataaatttgttgctggagatgaattacggattatatggagaggaagggaaagcgatgtcagtgatgcgcaatggacaaaacgattgcggaaatgaatggagaactgggggtaacagtgagaagagaggcaatgcaaccaaccgcacggagcagtcacctccgactgctgtggcggggaaggaggaaaggttcagccccgcccctccgtccggcccggcttcctcattcggtcgccaaatcccccctcttcagcaacaacacattgtgtgttgtttttggcctttgcttccgccgttttgcgcacgcggccgaggggagagggcatgaggaaaagaaaagatttgttgcttgatgagaaagtaccaccataagcaccattcaacattttctatctcttcctctgctggtgatggcccgtccagtttttgcatcgtcaatcgatcgaatggggcagagaaaataatggaaatggataggggctctccccgcctacccccccccccccctcccattctttctcggctctgatgtttgtccaccaaagggaagaggggcatgggaatggatgaggggaagaagcggaggaatggaaaagcgggggataactatgatgaatgggaagaggaagctgataaagggagggacgcccttcctcttatcatttgttaacttctcactttcgtcaaatctctttattccagacagtgaactctcataataaaacagccaaaatattgaaacccggcctttgctgctccttctaaattagaggaatgaaaatgaaaatgtcatttttcgttcaaatgccccatcttgtcatccctaccaacctttttgtggttctcgacattcattcatccaacccagaaactcatctccccaatgtatccctttcagtcaaattcctttcacaaaaattgtgaaggccttcgtcgattagggcggggttcggctgagtgatagccgtggtgccccctggagaaatggtacgcagaaagagggaaccggaacctctacacaatccaaccctccccctctccagcacccattcatttattcattcattttttgaatactttttgaaaaaagtgaatttttcggaggtcgacactgtccagcggtaaatgctctttgataattgttttgttcagtaaaaaaatagggggggggggggaagctgtagaaagaacaacaatgtctgatgagagaatgaaagaggatttttgggtggaaaattttgggagggaaataattgcgaaaagaccctctcaaaacgtacaacaaatccaactgctgctgattgaataaagtgattaaaaacgaattaatttttttctgcaggattttatcggttgggtcaaaagaacgtgcggaagtgctgagaaagaacggatgcaaaggggaagacgaattattaggatccccagtgatccgattgacggattggggaggaaatttcacatttcgagggtcgtacaacataatttttgtgatggatttgtgcgctgtgtgagttgagtgttttgggatgagtgcggggcattgggcggggcgccagggacgaaatttgacggtgaagaaaatcgatacattttcatttcattgtgtttgcttctcaggtcacacagcaggtgggccaattggtgaggagaaaaagaaaattaggtgggattttgagaagaaaatcggaacagaaaattgcggtaaatgccaaatgaacacccaacaattataaatttttaaattggacttaaaccagatttgagcctcgccacttttgttatattaaaaaaagtaaagaaaaatttgttcaagtttcatagttttcgaaatcttatttgtaaaacaaatatgaattgaaaaaaacgaaatcccatttcgtaaaaaaaaattacaaggaatcttacgaaaacttatctagtcgttatttcattaatttgaaaatattaatttttttaaaattcttttcgtctttacgaagtcgccctctctcataccctttcatctccaccgacattcacgatttccgaaaaatttttagggcctcggaatgccatccctggtatggtgacaagtaagttcgacctggacctggatccaggcctggatttttcctggatccaggtccaggtcatttttcgacaacctggatttttcctggacctggattttc

SEQ ID NO: 2102 - DNA, 3189 bp, Heterodera glycines
  misc_feature (1678)..(1678): n is a, c, g, or t
  misc_feature (1688)..(1688): n is a, c, g, or t
  misc_feature (3150)..(3150): n is a, c, g, or t
attaccgataaaagtgcacctcataacggcatcctcttctgcaatttgattttatgaagagggctttgtttttgaatttagatttaaccatgccgcgaattatctaaatatactttaaagtttaataaatgatttaaaaattgtgagaatattattttataacaattgaaaatctttagctttataaaaaattttcgggggtggggggggggggtagcaaaacgttggccggttccatcgcattgcacaaaatgtttattttttgaattaacgcgtaaattatatttggctatatgaaataaaaacgatattggattggtggtattcttgatgaatgagtatatatttagaaaaaatttgctcatcgtccacttattttttcttccttctgcacattttgtgcaatatggtcgttttcatttccacccctctttattcgtggtgtgtcgctattgcgctcgtcttaatgatcatctctcaatgttgcggctgttctaaaaagaaagtagtactttctttcatttcttcaatattaaaacctaatttagcaaaagaaagctaaagagccgctgaaagcaatgcctactcagaaagcggaagaggcatctacaggtggaacgaattgaatggacaagaaatatttattgagcaattttaagggagcgagaaaacgggtcaaagcgttgtttctgttaggccacccaatgtgccgacaactgctccaggtggactactgttataatgttattttatatctaacctttttagtcgcttcaaacccacccatcagcgcggaacagaatattgcttctattacacttacaccttcagatgtgaagacacctgcaccaggtaaattaaatcaacaagaaattatttattaagcaattttaagtgggcgggaaaacgggtcaaagcgttgtttctgatacgccaccaaatgtgccgacaactggtccatgtctactgattattttttgtttttttagtttatacaacctttttagtgacttcaaaaacgccgatcaaagcaggacagaatgctgcttctgttaggccaccagtgcctgcaaacacatcaagtagaacaatttttgaatgccgtcaaataatactcgttttagcaagttcaaagcatgtcaaagctcagggcactgtttctaaaaaaccttcgaaagcatcgtcatcacatacctcacgtattgatttctcagatttagcaaaataaaccttttggtttttagtgaaggtacccgacgacctggtttctgcaataaaatcgcatgtgccctcgtttctccatgatctagcatcacaaattactggaaggatggaccaaagcagtgcttctgccatgtcaagtgattcggaatcctcaacagaagagtcgtcgtcttcaggtggagcgaaattgtattatcggttggcctcgtcttttcaatttagcatcagaaatgactgaaaggactgatcggagtgctatttccgtgaggcattcgagtgtgaagaaatctgtaccgggtaatttattttttttgagtaccggtttaataaattattttttgttttagtgcctccaagacctccggtcaaagcaggacagaatgctgtttctgttaggcccccgaatgtgaagacaactacgccaggtcgactgaatcaacaagaaattatttantaagcaattntaagtgagcgggaaaacgggtcaaggcactgtttctgttaggccaccaaatgtgcgcacaaccacaccaggtaggataatttttgaatgccaccaaaaaaggaccattcagtagttcaaaagcctgtcaaaacggatcaaagcgttgcttatcgttctacaactgcatcgagtttaataatatttttgcgcgaaagaaatagaatcatttcagcagttcaaaaggccggcccttcggacctcagcgcggtttttattcagaattctctgcaggtgtcggattcggacggctcgcgtagagagaaaggtataaatagaggttggacttacgttcatagccggcgccgaaaacctgtatttttgcttctgggtccggtgttattgtaagtcgggtgactaaaaatatgtcaaaaaaacaaccttaaaaacaaagatttttagtttttttcactattaatttattccttttgatttatagtaaacgaccctaactatgagacacttgaactaattgaccatggcatttttatgggggagaatacgaatgataccgaccttaaggcagttggaggtatgtgactagaaattgtggatgttctaaccaattaattttcattttaagcacaaaatccaaactacgcaactcttagaaacttggatctgaacatttttgtgcgtggaccgactccgagtaaaccgaaatgagggaaagactaaaatgtgaagaatatcagggacatttatatattgatgctaatactcattctttgttgttgtatttaatacactaaagtgcaataaatatatatatgcccatcttttgttgaataaagtgaagcaaaaattctctaaacttaagtagcgtggtgaatcttataaatgtggtgcctggtttaagactcgaataacctaatcttttgcttttagcaatcttcacaaatcataattgcacagatccatcaaaattctgagattgttatttaccctaactcatttccggtcatggtttaacgcatttaactctcggaaacatgttttcacggtacttgtttggtttaggggcagattttacataaattttgctgcctatacgcggcgagtcaattttgtgctcccagttaatcaagtttattttttgttcagtaatatgtatgtaagaacgccaaaacttttaaaatttgaaaaatatacccttataaaaatgcaagagccgatctcgaattaaaaaagttaagtttcataaaataaacttggaatcgctagaggaggtcaaaatatagacttcagaattttcccctcaaaaagagcacaaaagggtttgatctattacaaaaattttgccacccaaaactcaacacataaaattgatatattttctgctttcaaaatggaaaaaaattgaaaaatgcttatgggtcgtaaactgtatacacggcgagtcaattttgggctccccagtgcanaataagtttatttttaatttattaatcagaacgccaaaa

SEQ ID NO: 2103 - DNA, 3135 bp, Heterodera glycines
  misc_feature (2953)..(2953): n is a, c, g, or t
  misc_feature (3067)..(3067): n is a, c, g, or t
  misc_feature (3097)..(3097): n is a, c, g, or t
  misc_feature (3105)..(3105): n is a, c, g, or t
atctcgaattaaaaactagacagctaaaaaatccattgtgtattcgatagagggggtcaaaatatgggcctatgcaaaattttaagaaaattggtcaataggaaaaatttttttacaagggcaaagttttttctttttctctcattttgacgtactatttcccagtctctaacatataaaatagcacgtcattcatttttttgctaataaactattttttaaatttttttttaactttgaaatattcttcagaattttcccttcaaaatgagcacaaaatggccaaaacttttcaaaacttaaaatttattggggattttcccttgtaaaaatggaagagtcgatctcgagttaaaaacttaagttccataaaataaacttggaatcgctagaggaggtcaaaatattggcctatacaaaatttcaagaaaatctgacccgaggaaaatttttttgaccctagtgaaaatttcaataaattttttagccaagtgcgcaatgcctgtggtttgctcaataaatatataaagtaaaaatggaagagtcgatctcgagttaaaaacttaagttccataaaataaacttggaatcgctagaggaggtcaaaatattggcctatacaaaatttcaagaaaatctgacccgaggaaaatttttttgaccctagtgaaaatttcaataaattttttagccaagtgcgcaatttaaagccaaatcaaataaaacttacaatattctccagaattttctctttaaaatgaatataaaattattatatttggcctattattgcccgagttatgtctggaaaatttcataaaattatcgatgatgtacctaaccaacgctttttgaatatgattttttattgacacgaaaactttattaatggaaaataattcttcctttattctttaaacgaagaaattgaaattaacacacaacatgaggaggatttgaacctgagaccacccttttggtgactaactcacagaccactaagacgaaaaaactaacttaattgcacttggagcccaaaattgactcgccgtgtataagaaagagccttcgtttttattaaaccgatcgttttgactttattaaatcgtcttttttcgttatcatagcgattcacattccgtattcaatcgatatacctttcaatttgcctttactatgcttcttgctttgacttctgtggacactcgcaacgcacttttgtgcgccgccgttccttccattggcgccttcgtgggctcgacgatggccatcaaagatcaggaattggttcaattcctcaaggtttgctgacaccagagatggggaatttaactccattcagcttttagaaacaaaattttccttctttcgcacgttgttgcaaatacaattatttgctggccaacactgccgtcaccattccgttcggttacgcttcttatttggtctacaaaattggaggaggtgtcaggttttttgacagttaatggatggaaaggaatgattcaggattcagttgcaccgactcaaaaatcgcattgggactgtacggtgcgacgctgctcagcggctgttttttggtgcccactctcaaaaagcatgacattaaggcggtaggcaacctacaagttcatcttcctcaggtccaagtccaaccctttaagctgactgccaacgctgttgtccttgccggactttccgtcgctacttcagtggctttctacaacatcgataagatttccgcttattggacgtgagtttatttgagagtcgtgccggttatatttgccaattcagcatgcccttcactctttgggccattttttgcgctggacttacggtgaaggcgaactgctgcgccgggacgaactcaaagcttatgaccaatgaggcggcttcgtgtgcttctgaaaaagggacgaactcaaagcttacgaactatgaggcggcttcgtgtgcttctgaaaaatctgagaataagaatgagggctcctgctatgtttagatacgatgatgatcaatatttctctttttgatcgattgtttttgctaaatcatcgcttgtttgattaggaataatgttaatggtaaaaatccaactcttactagggtaagtactgccccaactcgtatttttcgacaaaaaattcgtcataacttttgttgaaggcgaccaaattaaatattcttgttatcattcaatagcccttaagattcgtacgagttgggtttcatccgtatttgatagcaagaaaaattgtcttgtcatctgtttatttcgttgtaatgtaataaatataaaataatgctttagttaaaaagacttttactggtcccataaaaaaaggaacaaaaatgcagttttttgcgatcctgcgttactctcagggcgttttcggggccgttgatcacgaatatgacatcagatttgtcacatgacaacacctaatattgatcaaagatgttttcgaatgtcgcaagcgtcttttttccttgtaaataaatagtgactaaaaaggataaacgcttgattttttgtatttttgctgcgtaaaaataagtgaagacagttccattcactgaatccgcaaaaaaaaaatgaaaaatacttgatgaaaattatgaaaatcatagacttgaaaaaaatcatagattagatgatgtcatatgacaattttggtgtcacgttcgtgatcagcggcccgataacgcccaagtagaacgaataatcgtaaacacaccgtttcaaaaaacgagagatgaaccaataaagagagagcgcagagaaaaaaacatctctctttttggcgtactatttttttatctctgtcaatagagaaaaactgaattcacttcatcctgtttaactttttttctgcttgttaaatccacaccaaattttgcatatcgatagagaaaaacattctgcatcgaacgtatcaaatgtttttanaggttgtacatcccattttttcatgagacaactatgaaaatttgaaaatctcacaacctcgttttctgggatgtcaaattgcttaacttttgcttagaaaaagctctcctcatncagagctttcgaatgatatcaagttttccnaatttggntgggaaaacccttcaaaaataattcccaaa

SEQ ID NO: 2104 - DNA, 2056 bp, Heterodera glycines
gtaatcatgaaatttggaaccaaattctgatttatttatgtgaatctcgggtcccaccactgctaatgaagccataataccaatattcgtttcaatgtctatagcaccatttcacattgttactttattttgttgctttttcgagttcattttacagtctctgttttagttttgccaaaaatttttttatccgaagaaaatgaaccccaaagcaccgcagcagcagcaggccacaaccgtccctgtgactcccgccgctgttcttgaggtttggaattttttttattattattatcattgatagcgctaatataacattgaattggacccacgcttaacaaaaactgaagtttggctagccgaattttggcccaaaaaatacaaatcctgcaacctctgctggtatgcatgcaagtcttcctctctccccaaactcttgtcccctctgggtctgaagaagtgcgctacgttctccaatcccaccgccgccaacctgtctcggttggtcgcgcttagttggcggcaccagatgccttctaaccatcttcattcataacgccatccattgttgtcggtagtccggcagcgttgcactggcaaacctcccttcccccccccccacccaccctcgcccccaccttttgcacaggaatgttcatttgcgtttcaaatttgaaattgtttggatttgatgagtcttatttttgcatggctccgttttcccattctctgtgtactttgacaaagacggggcgtgggttaaagacgtgtaaattgctgccctgacaatgaatgacaactaaccacataaaagacaatctcattctgattcagtccattaaataccttccatttttctatggagggcactctcaaaatttatgtgttttttaccagcagagatggtttttcttaaaaaggcaaaatgccttccaaccgaacttctttttgagttggtcaatgcattccgttttgaccaccgttgggccaaaattcgagtttgcgcggcctttgattattttgtaaaaaaaagacaactcatgtttagcgagggagagaaacagagacaaaaagttaattctatatgtttttgtatgtttttatgatgagcttacttttttaaaataaacagggacctgctttttgtttacataaattcaaaaatcgaaagctccggaatataattaaataaataacaaaacatgaaaaacttctttaaacatactaaactgcatatttactttagtaccagaggagtattgaccaggccaagacttttgtcagccgcgagataaatctgttccgacccaacgctaccttcaccagtgagttttatcaacatttggcatcagtcgattcgtttatgtttcaaaaattctattcaataataaaagttatggccagaatttcaaaaaaaaaaaaattttcaaatatttttggccataactttttttaaacacaaggaaattttataaaatttaacaaatttgtagaagacacttagggctatcaaataatatcaaaaatatctaatttggatggttctaaaaaaagttaaggtgcatcagagtttaatttaatccgcttaagatctgttgagtgcatgttctgaagtgagcgaggttggagtggcagcacaaaaagcacaccacaaaagcaagttttgaacaaaaagcaacaaattctattatttattgccagagtttgtaattgtgttgtttttttagctttttattataaaaaaagttagataacttttggaaagtcaaatgcaacatattccattaaattcacaaaaaacttgctcatatttatcgaatagtcttttgataaactggtcctaaaatgcttaagtgatccaaaaattaattattgtgctgaattcgctaaaaataaattgttttcctgtattacattgtgtattaatgcctttttcagtcctcaatcatcttgccagcactttcgcacacatcagcaaagaacacgcagacaaacttcaaactttgcagaatgaatgcaaccgtttgaaggaagcgaaccaaaaacagaaggaaga

SEQ ID NO: 2105 - DNA, 5505 bp, Heterodera glycines
ctaaattaaagatttaagacaatacaatccgttttttctttaatagtattttcttttagtccactgaccctaattctgtgccggacaatgctgaaacagtgataatgtccgacttcggcttcgccatttcagccattttcggtacaaaatttattaatctttttcattgattacatccatttgattataattattcatttaagtgattatgactgtgaatttgctcactaatgctgcgtaatgaagtcgaaactgaatttagatgaaaaagaaagaaaagaatttttgttttgatcaacaaaaacaatacttatggttagagttgagcgggaccgggaatttgggcaaaaccgggacctcggaggaccgggaatttgggcaaaaccgagacctcggaggaccgggaatttgggcaaaaccgagacctcggaggaccgggaatttgggcaaaaccgggacctcggaggaccgggaatttgggcaaaaccgggacctcggaggaccgggaatttgggcaaaaccgagacctcggaggaccgggaatttgggcaaaaccgagacctcggaggaccgggaatttgggcaaaaccgggacctcggaggaccgggaatttgggcaaaaccgggacctcggaggaccgggaatttgggcaaaaccgggacctcggaggaccgggaatttgggcaaaaccgggacctcggaggaccgggaatttgggcaaaaccgggacctcggaggaccgggaatttgggcaaaaccgggacctcggaggaccgggaatttgggcaaaaccgggacctcggaggaccgggaatttgggcaaaaccgggacctcggaggaccgggaatttgggcaaaaccgggacctcggaggaccgggaatttgggcaaaaccgggacctcggaggaccgggaattcccgtcccggtcccgctcaactctacttatggtgataaaaactgtttataaaaatacaataataataattttgtaaaatataatgatttttatttttttaattaaaatgtctaattccttgcaattcaaattcaaattcataaacttaatgaaaataaagcgaaaaatgtaaaaaagtaagcaatttttgtaaaatttatgctgtagatttgtcaatatgacatagatgctgaaagttgtaataaatttaaaattccaattagaattaaaagctcaaagattttaattttaatttttaggaattctaaatttagttatccccgtaaaatatacaaaaaagagaatgattttgtattaagggttggttggcatgttaacaaacaaaaccgcaatcaaatgtccttaaaaataaggacaaaaactaactttcacccgccaaatccaacaatcttggtatcactttggtagccctaagtgtcctttattagaatgcaaaattccgttaagctaaaacttgtgctcttacgaaaaagcccgactacagatgtttcaattaaattttgtctagtttcttttcatacaaaatttacatttagccaaaattattatttttttaatggcaccgcccgtcagaaaaagaacaaattttcctccgacaaccgccgactcatttcttctaccgcaattggtgatgaacatgaacaacagcaaccgatgggttcacttatgacatcaaaaaaatttttattaacgctttttaggtaacaaaacacgtagaaattaatcaaaaaacttattttgcttttcaattgttttaaaattgttttcgataaaaataaatttttaaaccaaaaatttttatttaaaaaaataattgaattttgaggatcaatttttgtgaaaattttttttcaattcttaggagtgtattttctgcaattttttcaggttgattcttaggggtgtatttttcatttttattgcatttttgttaacgaattttccggaaatcctgaaaaaggcatcaaaaatggcgaaattggcacaaaaataggcattaagcacaaacattccaaaataggcaaagttaggcattataaaagtaatcgtagacacgccaaaccaagtggaaaatgcatttttttgtgcttaactgtacgtattaaatgcgcaaaaatcttaggcatttgcctaaaaatcgcatccctagtaatgagtggttcgtactatgcgattcgcgaaatcattttgcgctcaaatttgtagtggaagctgcgagccacacaagtgactaaaaaatgccgggaacgggaagcgagagtcccgagccacgcgacaaagagcccgttttgcccgcttcgtttttgccgaacaatttaaaataaacaactttggcacaaaaaaatcacattatgtgtggcaaaaaagaatggcaggcacacgacaatggtcgttgttgcagttgttatcttcgtaattattttggttgaagggagagggttgagtcatccatcaaccgattgtcgtgttggcctattggctgctgtgccgtggccgtggtacgcaaagtcgggcacgcaaaaggtcgtcacgggcaccgaacacaaccacaaacgggggatcatcaacggcatcgttatgttgccttgttgttgatgatgcattatcacagcagttgtcgtggcgtaacagcaacgggtgcccaaaggtttccagctgctgttggtccatggtgaacacgcagtccaacaacaacgacaccggcggcggtggccgtgtcacaacagtaccaccagcagcagcaggagacggtagagcactgtcatctttgttgttaccagcaggatggggatacggtagtagtgatgatggtgacggtaatgagagtagcaattcgtcatccaaccaaaggcggaacaaagtgcctgtaggttgaaaatgtgaacgcgcagcaattgtatatatacgctttcgaatcgggatacagtgcatacaaaatacagtattgtaaaaaatgcattactatagctttagttgcgtttactgtaattatcgtgtgaaaatgacttccaccaaccataacaccacactgtcttctgtaacattagtttgaaaatttttctgttgacacttattgaaatattcggaacattcttatacagtatgcctgggtacagtaaatttaccggtaaataactgtaacaatgcctcacctttgaatttctgagagtttttctatgtttttttaaaagttttcttgaaatgagctgttctcccacctttgttggtcaacagaaaagcaaaacggcgctgctgatggtgttgctcaaacagaatgggacggcgtacaatgcattcgccggcggcactttggcacggcaccaaaaaacggcgcagcacagagaagccaccggcggcggctgcggtgggacaacggccactattactgtagtctgcggccttacagtaatcggactgtgttgtcggcccattacggtaattgtaggaaagcaagagcaacgagttggcaccggcagaaatgagcaacaattgttgctgctgtttggcggcatcaatttgattgccgtctccgatcagtggagtgggcgagtcaaaaaattggtgcccataattggacagagcagagaaggcactgatctgagagagatgacattttgaatgaattaaatccggacgggggggatatctcatcccccccccccctcccccgaaaccgaaatatttttaaaaattttaaacttagaaattttccaaaaaaaaaaatctttgaaaatttttttggaaaattttcgaaaaacatagtaattgttcataaaatttcaaaaaaattgaatgaatttaaaaataaaaaatttaaaagtttattaaaaattttcaaggagaaaaaaaatattattatttttacacagaattagcaaaaaaaaaaaattcattttagatttgaaaaaaatttaagaaattttttcatttttttttctatgtaaaaatgacaatttttgggcaaattctcaataatttggataaataaattttctttcgtaaatactaaaatttaaaagagggagggataaaccacttagggtggtcttgagtttggcaaaacactcacaatgtgcccgttctcgggttcaaccagcagaatttggcccttgacagaaagggaaagacaatggccaatgaaagtgattggcgcggcaaaaatgggcgaatccatgcgcacagaccacaaaatcgaattgaactcctgtgaaattgtgaaaaaatttgataattagcctacccttagaaaaaattttgagcgaaaattgatttaaaaatttcgccacattaccccactctcttcactcgaaatttttaatgggaaactagtattttgtcttgaacattttgattttaattattggtaccccctccaagacttcgtagaaaatattttgagaaaaatgacaatttatgaaaattttgcaaaatttttgggtaaatcaccgtagagtttcaatttaaaaaatattggttcggcgctgcttacaggcaacatggtagggaatttttgtaaatttttaactttatccaaaaatgaaattgtggatttatgcgattacggcacagacccaaaatatgccaaaaacaaatatgtcatataaaaatggcattttggcaagctttaacggcgccaatgaacacacaccttacaactgacggcaaaaagcgtgccgttcagcgtgccaaatatggcaagcaatggcggcgacggcggaatttgattgtttgggctgatcagcaacaacggattggtgcgcaaaaagccgtgccgagaggcgtcaaatttggccataacaacagtacagcttctttgtgccaaattggtattgttggtggtgatgtccaacttccaaatatgcccgtcataactgccccaaaacagtcgggtggttttggtgccgtcctcgtcatcattgttggcaccatcaaaagcgggtgccattcgaatttcagcaccacaattgacggtggcaattggctgcggatggaattcttcccgttgctttagatcaaaaatgcgcattatgccggcaaagccacctttaaaattgaggcaaaatgacaaaattacggaaaaatcgctaaactgccggctcttacaaaaaatctaatttgttaggaaacttttctaagaaaattacaaaaaaaaaaaaaaattaaaaaagtgaacaaccaaatgccagcaaatttgtgccattcgccgaaacagaacagcctgcttcaaaacggtcgcccgggtaatgcaacgaaatggacggaatgcctatggccagatggacaccctgcaaagtgccggaatgggaggcggcataaacaatgctgaaacaatgtttagatgtgacaataaaaattttttattggtattggaaattaatttttatttcaaaattaaatatttataaataaacttttacttattttttgtaaaataaaattaaatttccttgtataaaattgaacgaattcatcagagaatttgatatataacgatggcagaaactaagccaatccaccaaaaaata

SEQ ID NO: 2106 - DNA, 4001 bp, Heterodera glycines
tatttttttttcaccccgtcatggcaaatcggcgttccgtcaatgcatttgccaaatgttgggcccatttctcatcaatgtcgaattttgttgacgaaatttgcaactgcaaatcatcatgaccaccgcctccatcattaacggcattttgaccatctccgcctccgtttgcggcatttcatcgatcattagtgaaaattggcacaaaaattggtccaatgtatgccgttcgtccaacaagaaacgaaacgttgcaaccgcataattatcgtcatcatcatcctcattatgatcatcattaggggcaattagtgtggtgcggcggcgtttgttgtgttgcaacaaaaaggcgagctcggcagcttcaagtgacttaaataacttgtacattttaaaatgcgttttcaaatatagtgaaaaagtatatggaaaagcttgagattgtgacgtcattatgcaaaaaaaaaataatttttttaatactaagaaagtaatcagattttatttttaaatttgatttacacccccctgaattagagcccccttgaaaaaagcccttcttctgaggggggttgaaaataaacaccctcgggtgcattatttcaaaatacggtattttcatgacaatttttcatttttttgtttatttttttaaacttaagtttctaaacttgatggtataatggcattgacttcctaccgtaacctgactgaaactgaccccaatgcccaacgagcgcaatgtgctgtgccggatttcgtccgaatcggccacaatgccgaaacgtttctcgagaaatttttgcaacgaaatttgaccacgatattccgagaggacaaattggcgcaaaaaatgctcgtcaattttgcctgaatgtgttgtgcaaaacatagaaatgaagtaattcaaatattcggcatttgctgttcgattttcaactgagaacggcgcttttccgtcttacaaattagcgtttattgtcggggccaaacaatcattgggttgctcagtactgtcttgtcttggtgacaagtctcgaaaaatttgtcggaacctctcctggccaagtcttaatctatatatatagtaccaagactggaaaaactttaattttttgaggcctcaatcatgcactaagtcccggtgtcaagagactcagtaaacttttttgggtatcttgtctcgggtcaggtcttggtctcgagcctagactcgagaaatctcgaattttttaggcatcgttccccaatttttggagtccccgtctcgagtgccaagtctcggcctcgagaaattttcggtttttactcaaaatgccctaaaatttcgctctctcacaccattttcagtgagtcgtctctggcggtcaatgttccaaaatgtgcgggtgggccattgaattttggccaattttgtgcgcaattgcgcctcgggcagtgccgaaacgccgtccaaatggtcggcaaaaaggaaacggcaattgtccacatagagcagcttggcaaacacaatttgcgggcacgcggccagcacttcgttctccgtgtcagccgccatcggcagcatgctgttcggcttgtgctaaaaaaatgccaaacaaatttttgtaaccaaaaaatgccaaacaaatttttgtaaccaaaaaatgccaaacaaatttttgtaaccaaaaaatgccaaacaaattttgtaaccaaaaaatgccaaacaaattttgttttatctttttttgtttgactttttggatcagaaagtgtcaacatttattttattgatataaaaaatatatatacaattaaaataaatgggatcagtttgttatcccccaccaacctgaatttttttaatctcgaagttagaaaatttttcaaaaaaaaaaacataggtaaaatttttataagaaaatttttgaaaaatctagtgatttttcaaaatttaatgtttttcaaaaaattttcccaaaaatgcttaaatttttcataattttttttccttctaattttcttataaaaaatttatttgttgaaaattttttaatattttacgggtggtgggaggacttagtgcacccaaaataataaatggactaaaattattataaaatatattttaaaatgtgaatgaaattcattatttaaaattattaatttatacccgtccccgcacaaaaatgtgacacttcttctgcagtttcatcccaccataatttgcaccattgtcattttcatcagcaaaaggtgcttcaaaggcaatgtccccggttggcgttgccgccgtgccatcattattgtactgctcgaaattgatggcacaacgccggccatggaccaacagaatgccgtcggcgccaatttcgagccgagtgcccatcaacggctggccaatgggcaccaaattgtgcgggtatttacttgaaaaacaaaaaatattttatttgaaattgcccataattattaggcatgagaatttaggcaaaaatctcaaaagatcgccactcaaaaacgtagcctaaacatggttaaaccttagtaaatccgctgtttatcaaaataattttaaataaattacaaacattttgttttatttttcaacaaaaaactttcagattccgttacggtcttgatgttgtaactttaaaagacaagaaatttgaaaatgaacattaaacaattaaatttttaaaaataatttaactaaatttttacgagtgtcatttatgtaaaatgaatttagaattggttttgaccgggaatttacggtattttttggcaaaaagtttacaaaaaatccccatttttgtttggtttttgaaaaaaaatgagggttgaaaaataaagcacctcccccctaaattagaacccccccccccctctaaaataaagcccctcttttgagggaggttgaaaaatagagccaccggaggctctattttaggaaatacgataatatttaggtcctcaaatatttgttcacactttatgtcggcgcgttcaaagcgatgaacggatgcccagcagctgacttcggtcagtccgtacacattgaacaccgccatgggacacgtcttcgtcaagtgatttttgaccaaattcaacgggaaattgtcgccgccgatcagcagcgattggatgggcgaatttggcccgaaaatgtgccgtaaaatgtccgtggaaaggcattggagcaccgcgggggtcaactgtgatgggtgttgtgaaattgtatggaggattaaatgcaaatttttaaaataatttttaccaaaaaagcatggcccaaagaaagtaaaaatttcaattaaaaaaatattattttatttatttacgatttatgtttggaaattttttaaaaaagtcggacagaagagagtgggagggggtgaaagttaattcaaaaaaatttatattaaaatagcaataaaaaatagggaaaatgaaaaatgaaaccctgccctataaaaaatttttatttaaaaaaatgatgaaacccatgcaaaaaaacaaaacctgcacaaatgagaggcgaaaatcgccatgaaaaagtgtggtggcgcagtgcccactaaacagccaatttgaaggcggaatgaccaactcggcaccggcacacatcgccacgaacagttcgaccattgacgggtcaaaatttgtttgtgtgccgaacagaacggtggacgaagtgccaatggaaaaacgggcactgcaaaatatgcattttaaaactcgcattcaagccaatttataataatcatttggtgtaattatttctcaaacctttaaaattaaaaaaaattttttttttgaataaaataatttattttttattttcattataaaatttcgcaaaagttgaaaagtttcgcgattttttgggaaatgtaaataaattcaaaaaatctataaaaaattttccctaactaaaatattaaattttctcataaatgtttttgggtgaaaaactaacagaattcaaaaaatatttgcattattttgaaaacgaa

SEQ ID NO: 2107 - DNA, 2674 bp, Heterodera glycines
  misc_feature (76)..(76): n is a, c, g, or t
  misc_feature (230)..(230): n is a, c, g, or t
  misc_feature (1374)..(1374): n is a, c, g, or t
  misc_feature (2540)..(2540): n is a, c, g, or t
  misc_feature (2575)..(2575): n is a, c, g, or t
tggcaaactagtccaaaaatgcaaaaaacgcaccacaaattcaagtgcagaagaatccggcacaacacccaccacncagaaatgccggatttcccggccaaatcgtgaattcctggcacaacccataaaaaacaattctccaaaaagacccacccgatgaccatcgatgccaaaaaggcgctttcgggcgccacaatggcaacaagctgattgtgagaacaacaatcatntaaatgcgcaattctttgctgttgtttttgctgtctctgaatggcattggcaatttgctgggcttgatcaaaaattgtgccggatttgtgagtgatggaagaagctgaggaagaggacgaagaagacaacaattcattgacacggaacgattggtgcacatggaaagaatcgcgggaaaacggcataattttggtggcgaatgggcagaccaaataaaatcttttaaaatttctaaaataaaatttaaaactttaaatttagataatcattgaaatatgtatttggcacaattccaatataaaacataaaatgaaaaattggcacaggaaaattggagaaaatttgcactgaaaactcggcaccaaccaacttttttggggcaccatgacacctttcctagttgaccaattttcaaaaccttagaatcagtttaaagcttttcaacaattagaagctgatattaatttgtaagccattgctaagctattatacaactcgccaaaaaaaagttcggacaaaaaaaaacgaacaaaattggcccgattttcgagtttttgtgaattgttcaactgcttagctattgcttaaaatttaataaattgtttgaattggtctatttccaatcttacggtatccactctcaaaacgagggaacaagcatactgtaattgggcaaaatatacggtactgactgatacatttacagtaatttccacaaaaaaagaatgtacaatattttacaacaaaaacaataaaagttaacaattttataaaactatcctttcaacaatgcgaaacacgtcaaaatggtgatttatgtggggcgattcttgcagccgccacttggaacagagggcgccaaatttggcattcaaagtgccgaagaacacacgctttgcccgcacatggaccaacgccatggcacctgtgtccggaaaaatttttgaatagttttttaaatttctttgagaaaaaaacaaaggattttttgatttctaaatttttcatttttgagaaatcaaatttgttacgaataatgttagcaatgtcatattttatttcaaatagcgagattctctccaaaattattttagttggatttgctattgtattttcggtttttttcgtggcctccaagcatcnccgccagcatcaaaagtgatcagagagggtttttccgagaaattggtcagacaggttgattccgaaaattggtaaaacagttagtatcaaaaattaaaagagaattaaataaataaaaagatgccatcaataagttgaatagcacttgtgaaagaaaaaccaaaataattcagcatcagccgagcggatccgaacctatgacataatgcgcaatttggtcggtttttctgatcatttagaagaagttggcaccaaaaacccaaaatttacaataggaaatttgattatgctctacagataaaagtgatttgggcggtgaccagttcgggatgttgctttgtaagcctgtttttcaaaaatttctttccccggtacacctccgccgcaaaaaacaaacaataaactcacacattgtgcacggttccatcgccaaaatggcataaaatcctggcaaaacaaaaagaggagggttaaattttaaaaatttttcgttttttttcaccggttgccaaatattgtgccgaaaattctgccccgggcacttcgtcctcgccttcctcttctcgtccatctgtccgtgccgttgtctgccgttggttggcggacaaatgctcaatggcatttagcacagggtgtgccgccaaagggttttgccgtgggttcgctgccgccgcaggcgcctcaaattgtgccgtcgtcgtgccgtcggccacaatttggtcggttgccggatcgtaaaacagcgcacctatggcacgggaagatgagggcatgtattcataaaggtttgaaaaggcgacttttgagtcatttttgaaaaaaaaatttaagaaaatttgtggccctaaaaaatggaattttagcgaaagaaaaaaaaccgctttttgaatgggtttttgcatcaaattttgacgaaaaaataataaattttaaggaatttgggcatcgtcggaaaaaattttccatttttttaattttagaaatgttcattttttcattttggagagatgagggaatttcctcaaattcctcttccccctcactcaagtttttttcaaaaagttacgaagatttaaccgaaattttggacaaatttctgcgcaaaattggaagtacattttttgcctgtcccagtgaaattgaataaaaattaattagaaaaaaanaatccgttttttcccggtttttgtgtccataactnttttcggaattttcacgaattttttgcaaattttgcacgaaaaaaagtagaacatttagtgctatccgatggtgtcaaattcgttcatcctttttctca

SEQ ID NO: 2108 - DNA, 5463 bp, Heterodera glycines
gaaattttaaatatatgcggggtaaccaaagcgcgccccacatttagaaccaaatgtaaccaaacctagccggaggcgcggattatccaattaatagggataatgcctggaaaaaaaccaaatggaagggtgcgaatttggaatccaaaaaaaaaaccagtaccgggatttagtttaaaatgatagagctactcagatatccgagtttgaaactcgcgacccgagaaattactcgagattttttgtggtggtctcgactctcggggggtcaatccaatcacgcaaatcgactttcgtgaaattccaaacaaaaaaaaacaaattttcggaatcggtaatgcatttttttgaaattgctatttactgtaaatggaataaaacactagatactgtacctgagaaaccattttgtaaatgacattaattaatttgctttccataattggccaaaccgtggaataaaaatcactgattaaacaactttggtaatttgtaagaattgggcagaaattactttccaacatccatccattcactaatttgtttccaaaaataagcatcaattaatttgctttcgcgcaaattgttgccgccgagaataaacttaaaaaaaatggaaaaattagtcgtatgattttttgtgccacaaatttgggaacggtccaaagattgaacaatttttgtctgcaattagtagggattataattatataaatgcggaccaaagatcatgttgatctaaatttgacaattatttatatcacttgatggatgccggattagtgatcagcgaccccgaaaacttatcggattatgtttttttaacttttgaaaagaaaaaattattttttttcgaaaaatgtggcaccagccttagttatggcatttttaatatgagcctgcaaatttcaaaaaaatttgaactttcaaaatagataatgtcaaaaatgtttgaaattttaagtctctttgaccataatttttttgacttacctcgactttttttttaatctttttttgtttgggatgatctgagccaaaaaaaatgagtaaaaaaaattcaccgaaagtttttttcaggtggccccggcagtatgaagggcattttgacgcaagaattggcacaggaatttgactttgtcaccattagcatcggttggtcattgtggcacagaaaaaaatttggcaaaaaaaaaagcactcaatgtttcttaagaggatctgatcttcagcagtttgccaagaaaggtggcggatactgtaaaaaatacggtggaactgcaagaattgatgaaggcatttcaaatttcaaaattttgatttttttttaaatttaaaatttgaattttcagagggatcctgctgtgatcaatttgaaatgggtgcttcagatgatcagcgcggtatatttgaaaatattatattaataaaagtgtaaaaacaaattcagagattggctgccacatctgcacaggtgagagaaagagacttggttctattttggcatttttagtgaaatttttaaatttgaaatgggccaagaaaattcgaaaatccgaggtctaaaaacggcggacctagccgaaaatcggattttcggggctaaaaagcgaaaaccaacagcagacaggtgttagaaaaggcaccgaaatgagacgggtacctagatttttgcttggaaaagcacctactggagtttcttaattagaggtactaacagtgaaatttcaattttccggttacggtatggttacggtacaaataaacagtatgaaaaacggacccacggattttttaattttcagccgcttaagcctcaacacctgccgaaaaatatttatttattttaatttaaaatttgtataaatttttcttttcgctcgcagcgctttatggtggacattgtgccagaattgtctttcattttcaaatcgaatgccttcaaagcgggtgatcattgtcaacgattggaggaatttgatcggaaggtgaagcccaaaaaaaaaatattaaattggcacaaattaaattaaaattgaaacaataaaaatgcatttagcacaatgttttattcgccttagaactgttcatttctcaggaacatcagctgctcggtgaacccttctcaaatttatattcaaaaaattatataaattaaaaaaaataataattttgaattaaattttactaccgaagccctccctgaattttcaaagccaccctcttttgaagggcttgttgaaaaactaggcccccaacaggaattttttaaggaaatacgaatttttttttttttttgaaaatcaggtccataacatggacgcattggatgccgatttccgaaatttttgaaaactctaatttatgatttccaaaattttttgggccgttggaaaaatttcgtagaattttaaaaatttcacataacgatacctttaaaaagaatttctaataaaaattttgtttgcgattgaaatggggtggtcaaaaggggggcttaaaaattttgctaaaatatatttttgtttaatattttaatttaaaaaaggaaaaaatattttccatttttcagaaggcagttcctccggtagctcattttcttcaccctcatcttcttcttcctcaaaagccaaggaaaaggaagaagcgaacaacatttcacgcggatttgtacgaaaataaatgaaataattcaaattcaaattttcaatgaatttttaaattttccgttatttttttttgcatggattttcggggccaggccgttttcgtacgaacacatgttttttgactataacttttttctttgtcaaccaaattcaaaattgttggtatcattcgaaagctctttcagatgctctattagcctgcaaaattccaaaaaatttcgtcaatttaaaaaaaagttcaagccaaaaaaagctggaaaatttggttttttgaactcttctgaccataatttttttggaccttaacgaaatttttccaaattttacaggctaatagagaacacttagggctatcgaatgataccaacaatgttggatttggttgacaaagaaaaaagttatagccaaaaacttgggctcctacgaaaacggcccgtacgaaaacgaccccgacccgctgaaacactatacaatggcaaaaacaaccgccttaccttcacgcagcacgtgaaattgtagtgctcagcacaacatggagttgacgattggcccgggtgcgggatgcagctgtaccagccacagtcacaacttttcgcggctttttcgcaatcatcaatttggatgagttgcgctggtttcacctttaagtaaatgcgtttacagtacatatatgccaaacgtttcatactgtcgacgcaccggtggaggctaaaaaatgataatgtttcaacgaaaatttccaatgctaaatttataatatatataattagcagggctgcaaaaaatataatcaaataggttgtttgaaatgatacgtataaaaaatttgaatgtataaaatcctttgaaatttggcatgcagaaagcccttatagtaagctattttcctgcaaaaattcaactaattctgacactacggagcgaacacaaaaatcagatttttaaattcagtgaaacctatttgcatattttttgcagccctgataattagagcagaaattaaagactaaaatttttaaatgacaaaaaatcatagacaacatctcagctttttatccttttgtggcatttctttaagcaccgcaaaaatactcttgaaaaatgtatttgattgatggaaagaagaccctaattatttaggagggccggcataagagaaaaagttcaaataaaatatccattttactttttcgcaacacttgaaagcgtagtgctgggcgcaacatgggcttggcgaacggccttgcgccgggacgcactcgccccaaccgcatggtttgcaacttttgtttgccatattgcactcgttatcatgcacgatttgcggctatatttgcaaaatcgcaaaatttttaaatgaaataatccataccaatgattcaatcgtgatctaaaaaattacaattaacaaaattcaaaaaagaattctgaatttatggattttataatttccctttatgttgaaaaatctctcatattattattattattaattattttttaatttttgttttacatttttacaacacgtgaattccgtattttctgcacagcatgcggttgcaccatttccttgtttgcgcacacaagcgaaccatccacagctacacttagctttggctgctttttggcactcctccatttgtaccaattgtgccggttccggctgacaacattgacaatgttatattacaccaaaccaacatccattttgcacatacctccggaggctaaattttaatgaacacatcaaaattttattatttcaaaatccatgaaaatattcagtgacaaatttctgtgatgtcgtttagcccatggatttgcacgaaatatttttgaaaaaatgctttggaagtttacagtctaaagaccaaaattatgaagtgaggtgcttttatccacacgtgtccttatctccacctacatccttgcagcagatgaacacaaagccatctgcacagcaagtgcttgccgttttgccagcgcttggatggcattttccccaatcacagccatggtctgctttgcacattggcccagcaagtttgtctttgtcattctcatcaccactgtgtggcatttgtggtagtgcagcgctgactacaaaatcaaaagcagtgccaataaaaggtgcattctcaaatggtccaagaagcatgctcttgcccttggacaaatgataattgcacatagtatcgccaagctttccgtccggcaaaaagacgctggcatcacctgtgtatgagatggtgtattcgtgttaagtgatacccgagaacaaagactttatagattcgaaactcagaataaaaaagcttatagccttgaagaaataaaaaattttgaatctaatttttattaccaagtgaaaaagatgctccatctccaccctttccttttcccgcttttttcggattcttccctccctttccatccgttttctttccgtctccgccagtgtttcctccaggttctccctgacgcttatcccgtgagttgggccctccttaataaaaaaataaataaagaaaaaaaagtattatgtcttccacatccagtcattgtcatatgtctatttttttgggttttcaaatggcaccattcgttgggcaaattaaataaaaaaccatcaaatggaaattttcaacaaaaaactgtccataacttttgtcaaagtcaaccaaattaaccattcttggtatctttagatagccataagaatggaaattttattttatataattataaaaaaagccttccccaagggggggggggagcgagtgttcaaaaa

SEQ ID NO: 2109 - DNA, 2395 bp, Heterodera glycines
ccccctcttccaaaaagtttttttggaaaaagcgcgcctcaaatgcgttttattgatttttaaatttggaataaaattttaaaaaatgatttttgctttatgattttaactattaaaaagttgtagaaaaaatttcgctttcgctttcgcattttcgcatattttagcttttcgcatttcgctttttttttaatttcgcatttttcagtttcgcaaatttcgcttttcgcatttcgctttttatttttcaatttggcccatccctgctcagtgggtataatcgtatggaattgtggtcatttgcatattgtagagcattttgtgcattttctaataggcccactcaaaatttccagatttttgatcagcatccaaaacatttgctgaccgtttgccagtgcatccgtgtcgggcttcaatagtggcagatttgagccttccggtgccggttcttccacatcctgtgtctcctgtttctcttgcccttgcggcttcgcttccgactgttccacttcggagttttccagcttgtttggctctgtcagactcgattttttcggttccgcttcctcctaattcagaatttttgggttttcgggatcatttcctgtatcttccacctcctggctttcctgcttgtttggatcctccggatctggtccatcctcttccacttcctggctttcctttggcttcttcggatctggtccatcctcttccacttcctggctttcctttggcttttcggggtccttttcttccgtgtccgctccctggcttttgtccggctttgctttgtccgagtcgacagttcctaaatcaaattattaaattaatttaattgtttaataaagtcttttagtttacctggcttttcgttgttcggttccggtttcgatgcggcagcgtcggcggcgcgctgttgtcgcacaacagcgctgtccagcgcgctgatcagggcgatcaacagactgaaagtggacagcgagttaattttggccatggttcaagccccacccctccctccaattaacttacacaagtgcagaccacttgttcatgttagacggtcgagagtgggacgggttgctttgaagaatgggatttgggatcagaaatagaggaaaaaatcacttcctaaaaaacaatgaaatcaaaatattggcttttaaaccaaaaatttttttgatttctaaatttaagtgaaatacaaaaaattgaaacggttttcgaaaaaaattatttaaaattttttaatcgttgactgattttcaaaaatgtttttgtttggcttttcctatttccttccaccagcttatttgtcagttgaatgctttttggttaggagcagaatgaaattttggaaatgactgatttttcactgattggacagcgcttaaatgcggtggccgacagtgcccaaatgggcggtccctgcggcagaagcagcgcggctgatgggcggacccggcaaaatttcccctcgtcccccgtccccaacacaccccatgggcgggatgggcgggcggtgggtggcgctgtgacacgtcgcgtaaattgtccaaccccccccccccccccccccatgaaagccgagcaaaaagaaattcgaatcaacaattagctaaagggtaggggggtaaaaactgatcgctaatagcgataacagccaaattcattggatcggattggggatgaatcacttttgttgctccatcaatggcggtggttggtgcgaaatgatggtcggaaattgaatttgtaatgaattttttgcgatgagatcaaaaaaagcaaaaattaattttattaaaataaattattattattttcaaataataagaagtattttatattaaaggcattctaattaaaagaaattgaagaggtactgtaaaagaccgaggaaaatacagtatgattcaaatgattaagcgaattattgtaaaagactacaataattacaaaatttgtgtgcctttgtggctttgaaaatctattgaataggtctactgtaaattattcgataagaaatcaatacgaacaattcctctgctcagctcgtatttgaacggctttccggcattttaaaattcgattattgtcggtgcgctttgcagtgaggccgtaattcaaaattttctaccggcgaaaagtcacgacattttgtgtgatttttgggctttattctcgtggttcgttaacgggtaggggacggttcggtgccagcccaagttttggactacaacttttttcattgttgaccaaatctaaaatcttgaatatcattcgaaagctttatatgtttagaatctttttctaacctatttcttagcgattagacaattaccagaatggttataacatgaaataacaaaaaaagcaagattttgga

SEQ ID NO: 2110 - DNA, 2777 bp, Heterodera glycines
  misc_feature (2766)..(2767): n is a, c, g, or t
  misc_feature (2769)..(2769): n is a, c, g, or t
ttcatgtttaaattgcgtcaattagcaactgttggatgaattaaattgtacttaaaattgcaaatatttaaaattttatttttcagaaattgtcaataagattttgccagtaattaatggctttttttaattattttgatgatttgtactacatatttacaccagcagcagtaaaaaaatatataaagaaatttcactttgtttttcgcaagcgatctgaaacaacaatacgaccactgttgggtataccatcggatgtagttcgttgatccaaatgaccaaagattgcataccagggatgacatccgagcagggattcacgcaactggatttcaattacggaaatccgtcatccataaaattggttaagagtaatttatgatcagaataaaagctttgaatgattttttgaggcgtaaaacctcaatatattggccgaaatcaagagaaaaatagcaaaaatagggcaaaaaatgagcagattcagagttgcggtcgaaaagttcaatttttttaaaattaattttcaataatctcaaacttttagaagcccttttaaaataaaattaaaaagattgtcctggtttggcggtgccgaaaggcaaataaattataatgtgtgacgtaaaaattctttctttttgagtttttagggctcattttgggaatgatttgtgaaggggtcccggctatgtaaattgacgaccttttttaagtttttgattttgcctcaaaatgactaagatttggagctaatatttaaaaataagtatgagtttttggaacgggcagtgccaataagcgctgccgaaaaaatttttcagaatttttaacgaattttgttaaaaaaatagccaaattttttaagcatttcctaatttcccctttgctagcaacccgccctctttttttgtatgttaatagtactacaaattgccaagaatatcgaaatatgggtagccttttaataaaactagttttataaaaaaataatttaacaagaaatcgtctcgaaaaataatccacaagtcccagttacggaacaaaattacggaaaaatcccaaaaatcagtaacccgtaatccgttactcaaaaaaccccgtaatttccgtaatccggaacccgtaatccgtaattgcgtgcagacctgattccgaggctcctaaaattgtcggaatttcatgccatccctggtgcatacactaaaaatagctgatatggagggcacttaaaaatgatttacgacatttgcactgaactaactctgacatgttagactgcaattttatgtcaattatttttgttgttttttagattatttttatcgcttttttgggactttatatatttacaattaatatctaaactttttgtaggtctccggaatgtttgtccattgcgcgctagaaaatctttgaaaattttaaataaatgcagaaactggaaatatcaaataggtaacacttttactttttttccttttattctttcaattttattttttaaaattcttttcattttgtacgattttctattaatgattattatttttgttcgtttattttttataaaattaatttattcattcgcttttttatctctttttctatcagtggaatttgcacagtttttccaatttgtcatcaccaccatttttccgctgttatcaaaaaaccatccggcaaaaatcgactctgattttgctaatgaatcatttttcatccattataatgaataaaattgtggatgcaaaaaaattatgttaattcatactaaattatcgaaaataaaaatgataaaataataaatggaaaattaaaaagatatacaatatacaaagaaatggtgtaattcgttctcggcctcgagaatcggtaaataggcgaaatgcccatgcagcttaaaagttacaaacccaattttaatcttagtcaaataacttcctaatttttgtttgccattacatagttttttccgtcttttggcacaaaatgccaatgcaagaaattctcattccacaaaacccaaacactaattttttgttattatttttcttttctcctaattttgcaaatggattcaattaaaatgcattaatgagcctaaacgcataaaataaccttttttaaatttgatttattgattgcttcgtgtgcacaatgggctttatgattgctaatgttttcatttttgttctaacgtcgtcgttctatgaccattctgtcaacgccgaacggtaaattgtttttgaagaattgcttttttaaaaagtgatttaaagtttctatctgacaaatggcacagacggaatgaagctaattcaatttcgagcttttgaaaaatgtagtgcaaaaaattgtacggatgaagccacggaagagcactttaaattaattaaaaataattatgatttttattttaaatgcatttgtttgacttgaatttgagttatttagtgatttgaaattggttgaaatggatgttacattcgtaattagtgacccccacgaccctcgtgaataattttcacgacttatggcaaaatttttcggtcgccatacagcaaaagtcaaattacttatattttaataatttttggcagtcggaatggaacagtattgaaaaaggatgttaaaaaataatactccaaaaccgacctcattaattatttcaaatctttctctaattaatgagtctgtctgatggtgccgatgtggaaaattaggaaaaattttgttacaatttataaagattccaagacctgnncnaggcatgc

SEQ ID NO: 2111 - DNA, 1268 bp, Heterodera glycines
gcaaatttttgatgtttgtcgcagtgtcacttcatcaagtaacggaaaagagagaagcggacgaaacggcagcggagagggaattccttttttggcattttaccgcaatggcatttcggccatttgccctctaatttgggttcattaacactctttaatcgttcctcttttacactttcaattttattttcttttcattcatttcatttacctaatacattttctattaatgaatattatttttgttcgtttatttttataaaattaatttattcattcgcttttttatctctttttccatcagtggaatttgcacagtttttacaatttgtcatcgctaacacttttccgcttctatcaaaaaaccatccggcaaaaatcggctctgattttgctaatgagtcatttttcgtccattataatgaacaaaataatggatgcaaaaaaataattatgctaattcaatactaaattatcgaaaatattgataaataaataaataatattggaattgaaaaatgaagaatttaaaaaatatacagtaatcacgataaatgcagatagtttggattacggtatgaattttccgtaatttaatccatcactccaatttaagttgatttccattaatcattggaaaagttaattacggacggagtgagaaattgattttgcaggtcgaggccatgactattaaagcatgtaaatgaaggaaattaattgttaattcgtgacatttgtaacacagttttcagagagtctctgcctttttatgccaaacatttgacagtaaaatattccgataaaatttttcacagttcaataaaaaattttcgcgaaaatcgaaccatgtgaacgaaattaaacttgagtagaaaaaacaaaactgatcgagaagtgattaccacatcattttttttactcaagattcgcgtatgaactttgacttaatcaaaccaaaattgaacttagtttaacttaataatttcactaagtactgtttttttttatacttaagaaaattaaattcataatatttctctttcatcccaaatgtgaggctttatcctcattttgtggtttttgtgaagcaatggggctaaattctcaaaagaaggcttgaagccattttggatttttttttaatgccttaaaaatagtaatcttgatcaaaattttgaataaatcgcattaaaaagttggatatttttccgggtggtgcctgtcggtaccaccggcccatgaatcaccagtgtttttttattttt

SEQ ID NO: 2112 - DNA, 1906 bp, Heterodera glycines
  misc_feature (923)..(923): n is a, c, g, or t
tcgccgaccgatacacgaacggcgcaatcactcaaatcgtccaatcactcaccgatcaacgaaaacctcatcaccgatcaatcgtccaatcactaaccgatcaatgaataacctcatcaccgatcaattgtccaatcactaaccgatcaacgaataacctcatcaccgatcaatcgtccaatcactaaccgatcaacgaataacctcatcaccgatcaatcgtccaatcactaaccgatcaatgaataacctcatcaccgatcaatcgtccaatcactaaccgatcaatgaataacctcatcaccgatcaattgtccaatcactaaccgatcagtgaatgacgacccaatcattggtcactgtccctaaatcactgacaagctttgagtcgggagtacacttgcgtcggcaaccattgttttatgtttgcgtctctttccatctgtttgcattttgccagttgctgcactaaaatgccaaagaattcgttcgcttttcccctttctttccgatcgttctttttgttcttcccccccccccccccctcaattttcttaccaatttccgcattttgcaattccaattcgaatacaattacttctgccgcaccaaatgcttctttgacccgcggagagacttaaatttaatattttaatcatttcttttttatttttaaatttattttattcgtatttcgttttttgttttgttttttcatttatttttccatttttctctttccaaaattatttttcctcccaaattcctttttcatttcccatatggcatatgtatggggaaggtcattttcgctaattatttcccatttccctgaacaaacacaacatattcctttgttttcattttgccttccattttttttatcccaaaattgggccatttaatttattttttgccattanatgggctaccgtattgccaaactttgtcgtacggtacgtgaattgtcccctaaaaggggtaacaaattaggtatttgaattcgttgagttaaaagaaaattcgaattaccgaacaaaaaactgcgaatatttcgcgacggcgaatcgatggaccacagaaaagttgacttggcctgagaaagaaaggaaaactgaacaaatcaaatgcaaaagcagaagaaataatctttgaccttttgggctttttcattttgcgcgaaaaaaacggcgaaagcgaaagaaaaagcgaaaaaacggaggcaaaaagaaacgggacgaagcaaaggcattttcattttggcactttgggaggagagaaagcggcagacgaacgaagcgacggcacgccgtttgacttgggcactttctgcaaaatttgtcgaaattgggaaattgtcgcgggaggggcggcaattatttgcagcgaaaaggtggcgaaaattgggcggtgggccggaaaattgggccacacctttcgcatttgttttgtgaaaataggcaaatttgaaagagattttggcaaaatggcaacggaaaaatgagtaaaatgaaataaaacgaatgacaaacaaaagaaaagtaaaaatggaggaaaacgggcggaaaagggagcgatacggtggaaaaagaacaaagagggatactgtacagggaagaacaaagaggaatactgtacagaggaagaggaggaggagggaggggtacggtagaggagggacttacaacaggacaaggacaggggaggacactgttggagagtacggtaaagaaaaagagcgaatagcggcctacggtaagtggcacgacgaattggtggcaaaataaaacggaaatcgctgatgaagcagcggcggaagaagcagcagaagtgtgtgtccgtccgccctctttccttcacattcgccgcgcatcccgtgcggagtgtcttcatctcgtccaacgca

SEQ ID NO: 2113 - DNA, 3233 bp, Heterodera glycines
  misc_feature (3204)..(3204): n is a, c, g, or t
ctgaatgaattggcccccttttcgtcggtcggcggtttcttcaaaggcactttctttcgacagatgcggcgacatcaaagagagttcgcttcacttcgaaaaagccgtcaaatgcgggagaacaaaggtcaaaaaacgaagccgaatttggacaaatggaagtgaaaagtgagaaagtgaagaaagccatgaaaaggcaaagaatggagaaaagaaattggcaagagatatgctcaaatggagaaaattaattaaaaaataataattaaaacaaataaataaataaacatttctcatttccctttttgggccttttatccgcccaatttaatgagacaataaaagcgctttgttcgttctgctaattcggacaataatccttccgcactaaattagcgattcatcgtattttgtcatttcattgaagccgaaattgccaaaatgccattaaaatttgccaaaattttctgctgtgccgtttccttttttcctttttaccttcaaattttattggggcaaagaatcgccgaaagaattcgcattgaattcgcatggaatgaaaaggactcaaaaagacaagtccctaattcaaatttgaagtttgccctgccattcccttatgtctgttgtcctttttaggctcgtgatgactttgcccgtgccgtggacggtccgctgggaatggcacaaatgcgccaagtgcgtgccgacctcgccgaactccgccgacgattgatggccaattgggagcgaaatgaacagctcggaccgagcgcattgcttgccgaagcgatggtccaaattgggaagcgaataatcggcaaattaattaattggccttaggcaatggcacggcgaagggaagcgaacggagcggagagaatggggaaagggcgcgaaagcatcgcaaagcttaatggggcaattgacgactatttatttcaggtggagacgaacgaaaatagggaaaagcatatgggaaaagaaagaggagaaaatggaaaagcatagggaaaaagaaaaagaggaaaaagaaacaaacggggagagggaaaaaaggaggaaaagggaaaaaatattgaaaaaaggaaaaagaaaaccatatggagaaaaagaaaagggataaaagaaaggaaaaagcatagggaaaaagaaaaataaaaaggagggaaaaaacattgtagaaaagaatttcatttcaaagagtgacattttactgagtgccaatcaaacgagcgaaatgctcagagagatggaagaggagcgcgaagaggacgaagcgcaagagattgtgctggtggaggagggcacggctcggagacggaggcgccgcaggcaggcacagacggggcacgactttccgcacaaccaatgggatccggcacgaccggtgtcattcgtattcgatgccaaaatcggtgggtaaaccgatgaaaaatgcaaaacggaaacaaattaagaaaaatgaatcaattaattttaattgggggaaatactttaaaatgtttaatgtgccaaaatgaaagggaattcggcacgaaaagccgtgagacaagctgttcgcttttggactgaccacacttgcctaactttcgtcgaaaacggcggcggttttccgcgcgtgcgcattttttccggcggcggatgcttcaggcggagaaactaattaatttcaaaaaattttttttataaattttatcaaatggaattattaaaattcttttcaatttcagtcaagtgggaaaagtttttcaccaaagagagcaagtaagtgagcacaaaaagtatttattgtttaaagttttaattcgcttgaaaggttatttcgctgggccgtggctgtgagcaggtgattttgtggaagaaacgaaacacaatttgctgctgatcagagcagtgatcaagcccttgtgcctgattctgagctgatcaaaggattgatcaatgctttatctctgaattttatttttctcacgcgcatttctgatcagcgatcaattcacctgtctcatttctttggtcactttcattgtcttttagtttggaattgcggctcatgagcttggccatacgcttggctttttccatggccaagcccgtgccgaccgtgaccaatttgtgaacattgtctattccaacttaaggcaaatttggctgaaaattcctcggtcactttttcacatttaaagcccacaaatggcgggacaattcgtcaaacaaagcaacgaaaacaacgacaattttggcgtaaaatatgactacggaagtgtaagagggaaaagcgaattcaaagcgaatttaattgatcagataatgcattattcggacacggactcggccacgagtcgagtgacaatgttggccaaggaagtgagtgaaagaggcggacattttcataatggatgagtcatgcccatttgtcactcgcctttccctaattaccctaattaccctcattaattattaattaattacctcccgccttccaattttggccgcctaccaacacacaatgggcaacaatgtgtcgccctcttttctcgacgttttggaggtttggcagagtggccaaatgtgcaaaatgaccaattttcagatgaatctctactacaagtgcacggacaaatgcaaactaagcggggcccagtgccaaaatggcggatatcggtgggaaaagtgccaaattaatgccgaaatacccctctcctcgcccgttccgcttgacagtcatccgcgcaactgttccaagtgcttgtgcccctccggcttcggtgcctttgactgttccggccgcggaccacctgaaaatggcgcaccagcggactgcggagagaccgtacaggtgaaggagaaaccatcggcaaaaggcaagggggtggctgggcaacatttaggcccatgaaggcgaactgcaggaattgagtggcaatgtcagtgccacgttggccagcggactgtccgaacggcacgccatttgccattggcacatcaaagtcggccttctctctttcatccgtttatgcactttgtcttccgcaggcacctcccggcaaaagagttcaaattcggctcaagtcgctgttcggtgcctgctccgacggctgtttttacggcgggacggagttgaaaacgcaagatttgctgcgcgtgggcgcaaggcaaattggcgcgaaattcaaaaggcaatcgaatgcctttgccttnccctttttaggatttgctgtcgctcggac

SEQ ID NO: 2114 - DNA, 651 bp, Heterodera glycines
  misc_feature (86)..(86): n is a, c, g, or t
ttcactgatttgacaatgcttaaaaggatttcttgtcttctttgatccataaatgggattgattatcattttatcactctttttgncattttcgcaggttttcctcatcctttttttaatattttatatttttttgcttcttttccttcttttcctccaatcctttttcgttcatttttctgatcgatcgttccttttcatcgcccgtccaacaacagatcagatccggatctgactgactgacctttgcttaaggaaatgccctggagcaattaatgcctttcgaattcggctgaaatttcccctcaattggtcactcaaagagcgcgtggttggagaggagaaaaagcagaaaaaagcgaaccaaaataagcgaaatggaaaagggaaaagcgaccaaagaaaagccggggggggggagggccatttgctgctggtgacccccccccccgccgcccccgtctcttttgacaattaaatttttcatttgaaatattttattttgatcatttattttattttttacattgtagatgctaattactatttatagaaggccaaaaggggcggctttgattcatttgatcgcccccccccttcgaattgggtgggctttgtttggatttgcgtgttgtcttggatgaacgtgga

SEQ ID NO: 2115 - DNA, 1292 bp, Heterodera glycines
gtcataaaatgttaggtgcagaacaacactcctcctccccccccccctctctcgtcgtttatgcgcagttccgggagtgaatgcctctgcggggatcaaagtgtccccaaaaagtgctcttcgcattgtttcgctagcgatttccccgcgtcattttctgctttttctgcaaagcattgcgaggcgtttgtcccgtcgagtgtttctcatcagctaatttttgttgaatatcggcaaaagcaaagcaaaagacgcaccattcatttggcgaggacttttcaccgctaattgaatcatccgccaaatcccgcgcattaattagcatgccacgggcactgcccattttactcattttgctcagccaaacaaagcgatcattcattcatccatcaaagggaaataaagcgaataatttatgtacatacctttccaatgcaaaacaattgttcaaatccgtcccccgcccctccatttttaaattaaatttttgttaattgttttgtcagggcctccaattaattaatgcggacattgccacgccctccgctccgccgttttctcccgccctccccgctttttgtgctgctgctccatttgctacttgctgctgttgttcggtcccaggacagctgctacgtgaccgattcggggcacacgtgctgtgacaaggcactcggtgagtcatccattgccattggcacggaaagtgacgacaaatcactctttggcggcacactatcctaaacaatcgcagaatcggccatgaaatcggcgatgagcggcaaagatttgttgtcctcggccgatcggatccaaaagtcggcggagggagcaatcggcggaaaattcgaaaccgtaagaaaaaacgaaacaaaacattgaaacaaaggcatcaaaacgatactttccatgcatccgccaaaaaaggtagtggcatttgacgactttgcgcacaaatcgcacttcaaagacggcaaatcgtgcaaagtggagaaggacggacaagtggcattggcatggcaaccgtaagaaaacaaatggcgaggcatacggtagaaaaaggcaattggactgaccaatcactacagtacctttactaatcattaaccgctctgaacaccgttcatgtccttttgttaagtcccaagcgcttttcaaggtaatagtttgctttccccccccattttttgaaaaaaataaaaaaaattaaaagtcgtcgaaaaggcctttcctgaggttttccgggtctctgatcacgaatccgacagttttgaaaaaatgggggggggggg

SEQ ID NO: 2116 - DNA, 6562 bp, Heterodera glycines
  misc_feature (6443)..(6443): n is a, c, g, or t
  misc_feature (6491)..(6491): n is a, c, g, or t
gggggggaagcacactgtacccttcaaaatcgttttgtaaaagtcagtcatggacaaacattaggaaaggaggcctcaaattattattatataattttcactagttgaatttcgttctaatttgaattttgtaaacgagcaataaaaactgttttcgttcttcgcataaactgcctttcatatgcactttaaattttatgtaaaatttccatttttcaattgacatttatttccttttccagtaaagtgcaaaaataatggaagatttgtaaatgaaaagaattttattgtgtcactaaaaccaaaacacagaaaatgcaatttgttcaaagtatttttgggttccaaaagaattcttttttaaataggtaattggaccttccgctgttagttgtattaattgtaaataacatacaaaagcatattaattacagaataaaatcacaaagaataaagaaacaatattaaatttttcgtttgtacggagatcgcaaaaaaagaaaagaaaatgttttgacaatgccaaaatccgagattcctttcaaccggacacgaccacaaataaatggaaaatgcatgttcaggcacttcgatagttaaattgggaagaggtggacaaaaaggagttctcgacatctccaagatacgatcattcgaacgaaatcacaagaaaatgggtgaaagaaaggagagaccgaaaggatggaaataaacagtcggtcgtccgtccgccttcagtcacccgtccgattgctcggcccattctccgcttctcctctcctctgctccttttccggcgaacccttcgcattgtcctctctgctgggcccattttcagattcttcttcttcgtcatcgctaaattaaaaaaataataattataaaattctgtttcctctgtgtaattaattatttgacctgtcgtcgtagtccaccaaaggtcgtttcaccaatggtccatccgccacagcagaagcattttcggacgatcggccgacggacgtggaaggaagctgaagaaagaagtcacaacaaaatgccaaaattattgaagccaaacattttggtcatttgtatgtgctgcgcttggactgccgccatcgccgtttaccaatgggacagcggcggacgatggctctttgctgctcattcgaatcactattttggatatcctgctgacggacactgcgccgcccgctggcggagtgatattcccaccgaaaacactggcaattccgtcctcatcattagctgaaacacaatgtaaaagtacgaggggaagagtgccattcagagatgacctttccgctttctgagaagagacgggaagagggggtcgacgcccgactttcgacactgagcggtcggctaaacagagtaaaaaaatgaaatgccagggccaactcgacacaccatttcgtcatcatcgtccttgctgaagaacaattcctcgtcgtcatgttctctctctttgcgccattgggcattcggcggagtcatggccaatggcgtcgtctggccattttctttcactttttcgccctcgtcagatttgttggccaaatgagcctcccaaatgtcgtgcattttgacaaaagtttgcacatagtccactttgctgaatgtgttctcccaatggttgttgattaggtactcaatgagcggataaatccgttccttaaaaggaattatttaaacaattaaaaaatcaacaatatgccgatgaccctttttataaattcgaaaagttcaatgagagacgaattgagtaaattgtaacgctgcccattggcgacgaaacactgcacaatttggtccaaagtgcccttgtcacaaatgtgtcgaatgtacgtgtcgtccttcaaaccgatgatccgtcttatcaatcgcaacgcacctcaaagagaaacgccaatgtttttcaagaaacttgacccaagcaaaaaaaataaaatacataatgccaagaagtgatgcttgctttgcaaattcataagcacagaatggagcaaattcttctggatggtacaagttcgcatattgaagccatgatgttccacaaaaaagcaaagcaaatcgatgatttgactggtcctattcgctatataataagtgtctgaaaattgaaaatgaattaaattccattggatttccattcaaataaaagaaaatcaccgcaaatcagtcgcccgtccttcacattgtcaacaatcggcgcataaatcgtttgaattgcgcgtttgtaaaacatttgaagaaattcgcctttctctttctaatttgaatggattaattttgcgctccaaattcattacaaaccgccaaaacgccctcggggtccaacagaacgcgcagaacttgagacatttggctgccagcagtgaactcggcatcgcggtcactgagcatgtgtttgacgagtttgttgatgagcagagaatcctttgggaaaatggaaaagcataagcattaacccacaattcaaaagcactggtacatttctcccctcctgtcgcgactgtttcatgagaaaatcacggaacaattgcgggttgaagtcgacgacgatggtcagcaattcgacagtggctgtccgagtggagggcaacgggctgctaatgcacgggtcgatcgttccgagaacattgttatcgattagtgtctaaacaaagaattcaaatttttgaagatttatttatcgcactttaaagaattggtccttcccctgcggcccactcggctgaagcgaatgggcaaaggaacaaaactccttcagaaagttagtgaggtctctctgcctttcggggttaattgacgagttgcgcaattcctcaaaaagttgctgcagcaaatccttgtcattcttaaaaatgtgctttgcaattcagaaatttagaaggcatcccaaataaacaattcactgaccaaaagtgagttgacaatttcggctctaatgaaaaacaaatggctgtttaacaccgtcagaagattctcctcaaaaattgaaggggccggcaaacaaacatcctaattaaaatgggaaaattaagaaatcttatcaaagatgagaagaaagaatgcacctggacgtattggagtcgaaaagtttgatggattttggcttttagttcttcagaactgatgggcagaacttctctgaactttgaacgttcccaaaggaattcacgatgtttttttggctcatcgaatgatgcgtcatattcgagcattccgacaatgcccctgaaattgaataaatgtgacgacgaaagcaaagagtttagaaatgaaaggccacccacttgaaatatttgtcttcaataagttcattcaaaatggaattgttattcagaagaaacaaattcttagcgatggaagccaattggttgagcatttttgtgttctccaaatcttcacagagttcgaacaattcgcaaagtttgttaatgtaactgttgaacaaccaaatttaaaaaaattgtaattcattcatttcgcttgcccattctgcagaattgcggtggccatcttctcgcgcaaactgttcgcgaacatgttgttcgacaaggcctgctccaaatcgcccaagttttgcaaggtgcacggcggtatgctgacgcttgacgtagagcacgcatttgaaatgcccgaagtgctaattgtaagacctcaaactgataacctgccaaattctcgaatttacctgctgtcgctcggctcattctcctcgctctcattctcttcctaaaaaatcagaaatacccaaattggcattaagcattcattacccacctcagcgtcggtctcggggtctttgccctgtattctgcatatttctcccacagctcagtgcagccggccttttcttggaagctgagtgccaagtcgcaagtgtccgactccgaccacacaatcaaagtgccttgctgcttttggtacactgtgtccagttgtatttttgactccaacacattcttttctaaataaactcaaatgcaatattacgttttttccgaattgtctataaaaagcataccatttgtttccaaacggacaattatgcaccaagtgttgttgttttccaacgattgcaaacacgcgacgtgtccagtccctcggtcatcccacgacctttggtcgcaaagcacgtaaagtttcactcggttgtgcgacccctataccaggctcagttattaagcattgcatttaaatgatttgagaattacccgctcaaattccactttctccaatgttgagcttggccgtgcttcgggtggtattaaattgtaccctcgcatttcctcctcttcgtcgttgcttggcactgttgagtctgctctccccacttgttcttccgagtcttcgctgactgagtcggcacttgcattggcaatggtctcacgttttgtgctgttttttaagtgctgctgatcaagcaataaatttgctgaggtcgtcgttgtaactgctgattctgatgccatttccatagcagtttttcgaatatctgtaatttgtttttcatatattatgggttatttggaaatagtttaattatcaaaaaactatcataaaaagttatggtccaaaaaatcccggcgactcttcgacaagcgaccttttggggtgcatcgcaagaaccgaccttcgatatttaaaaaaaaatttttaatttagttttttgtcattttgttgacttgtagtagaattgaatgaagtaagacactaacgctaataaaaaaaacaaactttttatgtgcatagattatttctagttgaaattgacccggtgcgggattggatcccgcaagggattttgcgggattccagtccgcagattgcgggatttatccctgctggatccctattttgctggtttttttgaaattgaaaatgaacccacaaaaataagcacttcgaattcatatttcagggaggcgaattaaatttgtgctaataatgcagcggatttttggatcttcaaaaccaaaagctccgccacccaatctcgctgatgcgattacaactattgatgctcgtggcgaatctgtcgaaaagaaaatagagaaattggacggtgaattggtgaaattgcgtgttcaactcaaaaagatgagagatggaccagcaaagaatatggtcacgcaaaaggcattcaggtaaaatctgagcaaaagtttatgagagtcattttcattttagaattatgaagcagaaaaggatctttgagaatcaacgcgaccaactcgccgcacaatcgtttaatatggagcagagcaatttcgcaattcagggcatgaaagacaaccaagtaagttacctagatgcaatttcaaaactccgttttgaaaactaggactacctattaaaaaaaagggaaaacatcggtaccttttcaatgcaacatttagtatttttattctttttttatttcaccggtttttaggtgaccgtcgccgcaatgaaagagggtctcaaatcgatgaaacaggaatacaaaaagctggacattgacaagatcgatactcttcaggatgaaatggaagaaatgctcgagatgaattctgagattcaggatgcactttctcgccaatatgacactcccgacgtgagtttttttaaaatttataaatggagaaaaatatttctaaaagatttttcttggctttaattttttataaattataaaacaaaaaataacaaaagacatgtgaggaggggcttggcaggaatacttgacagtttcaacaggcatcggaaaaattgacaaaattttggtctctttccctcttaaacacacacattcaatacggacgggggtaaacgtcggttgtactccttgcaaagtagggataattctaaagtttttatattgaagatcgatgaagctgaacttgaggctgagcttgaggcattgggcgacgacctgcaattcgatgcggacacaagttatcttgacgaagcaatcagtgcccccagcgtgccgactcgtgacccggccagcgcttctgtgactatctttatttatttattttcatttgcttttttctcttcaattttcagactgtcactgatcagggagttgccgttgatgaatttggtcttccgaaaattccagcgcagtgaatggaggaaatttatcttcctgtctataattttaattgaataattttggttttattataaaaattcctcttgactttgtataacttgacttggactttttgtattagatataattcaattttatttttggaatttctcgcaaaatttaaattatttgagccttaagagtgaagtcttaagagaaggttgtcttgttaacatttgttttttgctgatggccccaaaaattggtttatgtgctgatgggtttggcatcacagaagcgcttgccattcatatgctacgttcaacttgtttctttgataacagtcatattngaattgtgagtttagcatttgcatttcttccattgttttttattatgngaatttaagaattccgaccaagaggagccaattgttgcgatgccaccgtcgggatttgaaagtgccgactt

SEQ ID NO: 2117 - DNA, 5891 bp, Heterodera glycines
gcgtggtggctacatgcgactggtccacggcaaggacctgacccccgacgttcattatctgcacgagaaggatgattatcactttgtgaatgctgtgcacaagtacattgtgcgacatccggaacttccgtgggactcgccggagtttaacccatcagcaaacattcaacaaaacatcgcagaattccgggaaatctttgagcgcgaagttttcgacgaaaattatgagctaaagacaagagaggagaagaatgagctgatagagctggtcaagggatttcgattctatttcgcggacgagcttggacgttttatgctaaggattttcagcgacaaaatatcacacatcactttgacggatcagctggcctacgtgttgggctacgaacagcagcaagaaattcataacgaagaccaagccaagtacgctgttgacttggccggtggtgtcagtcacctgtgcatctacttaaacagcggaataatcgagagcatgatttttggcaactccttcgccaatctcctccaagtgattgcggtcgagggtacgtcgggcagtgtggtcgagaaggactttaagtcaccgttgttccacaaaattgtggctagagaggtggacgtactggacgttgagattcgtacgctcacaggacggtagtgttgtgattttcaaaatattttccctacttttttttttggtttaagagaggtgccttttgaatttggccaagttgtgctgactcttcagtttaaaaaagtcgtaactttctgatacaatggtccgagttatattcaacgggtcgaacttgcggttggagaattatcatcagcagggtggaagcatttcgtactttgagggagctccgaccttccagcgtggctatggctacttccttggaattccacggcagaagggagcgggggtgggagccgtactgcggaacctttggcgttatctccgccctatgatcgctgcggcgaagccctacgcaaccaacatagcagctgaagttggcaaagaggggcttgagcggggcgcgcgagtgcttgctgaggcagccaaaggcggcgacgtaaaggaagcgctactcgcagagggaagagaaggcatgaaaaccttgctggacaaggcgtccgcatcgctacagaagggcagagggagaagaaggaggaagagagggacgaaagccgagatcattttaaaacccacagacattgttggacaaactgttccccagagagctctgttgaaaaagaaaagatttgattcccttggctattattaatcctcatgttgtataaaaaagttgatgttgcgagtgcagaggtggtcaatagcggattggacttcttcagtacgccgccaacaaactgtgcggtgtccaactccagctatcgggagtacttgacgctgaacccgatcagctcaaggcctttccattttaaggcaaatattgggcaatgtataactcttatcagtgtttgttcagattcatccgatcaccagctacatagacctcagcaaagtgtttgtgtgcacggaattcaagctcaagaaaatcgcagaagacggagtggtagttgacgtaccagccaacgcggctgttggccttatacaaatgcccggtgcaactttcatccgcaatctgaaggtgcacatcaaccagcgtgaggtgtacgactccaaccagctgtacagctacaaggtgtacctggacaccgagctcagttaccctgcggcggcaaaggatgcctactttggcgtggcgggctattttcgagacagtgatccgacaaaagtgaacgaaaaacggaaaaaagcggtggaggagagcaagagcttccaaacgataagcaagctgagtgccgacatattcaaccaggacttgtacatgatcagcaacgtcgagattgacattgagctcgcactgcagtcggacgactttatggtccaccaggacgctgcgaataaggacaagtacacgcttgaaattgtcgactgtaggctgatcgtgaagactgtcgatttgatggacgggctgagtcttgacattgccaggaagttggacactgaacccgccagatacggtatccggaagtcgttcatgaaatcgctctttgtcactggcggtcgctatgacttctctgccaacctattcacggaggaggtgccacgaagagttgtcattggactggtgtccaatcagaattacattggccataatcagaagaatcccttctattttaatcaccacaacgtgagtggcaaatggcaactgcttgtgaatcagattattcaggtgcgggacattgagcttacggcctctggcaggacatatccccagtacccgtacaacctggactacaagaacaacaggtacgcaagggcatatcacgatgcccaagagcacctcggcatggcgtgcacaacggagagcaacggaatcagctacagcatgttcaagactgcctattgcctctatgtcttccaaatgaccaacgcgcaggaggactcgccaggatttgagctgatcaaagagggctgtactgcagtgaacatccgattcactgaagcagtacccaacgagggagttacattgattgcgtacggagaggcagacgggctcattcttattgatcgtaaccgttcgatcactagtgacctcacagtatgagtcagaattattcctctgaaaacattctgatggacacgcctccgagggacgggatagtgatgtgcttccccgatgttattgagaagtcgccaatgaactttctcttctgtcttgtgtatctgttcggtgcggcaggggcggcaaccgtaggcacctatttattcctgcgagagagaagaattcgtaatggacaacagattcatcgacagacttctctttgagaatcctgcgacgaaaaggtacttcagcggcacatatcccgcagatgggttgccaaggtgttcaagatttccgtgcagtctgattgttaacctggtacgcttattttttgcttcattcgctcatcgtatttccattcaggaccctgcaggtatgccgggaactcattggtgtgcgatatgggcacagtctcctgctgttgcctacttctttgactcttatggagagatgcctatcagcttgatcaaaaaatatttatccgataattttaaaaagatttactataataagaggcggtttcaatcggtgttgtccaatgtttgtggtcactatgtaattactttcgtttattttatgtccgtcggattgggtttcgaaaatattatgcaaattttgaatcgttcaaataaccctgatggatttgtttatcggtttgtaacaaagagcatagaataaatattaacgaaattagtcttcatcagatgtgtcatcatcatcaaaggcatggaaacagaaaaaagtaaaggcccaattccgaataaattcagcaaatccgtttagtccatcatatttttcataatattcgttgaccactttttagctcgtgccgtcctcttaccttaaaaacccttcacctaaaatagcaataaaatatgaaacatattttccattaacctcaatacagtcttcagcatcgaaaatgtagagtcgattcaacgatgtcagcgtgcgaatcatcatacatccgcttacacgatagtcacgatggctactgtatgctggagttagtgttgtaaaacgaaagaaacatacccaaggtttggtagtggcgtaatacagccaaattcacgagcaacttcctcaaggattggcacacattcgatgagtcggaattcggtgttggatgtgacggtcatttttttcaataaaaatcgtaaaataagattgaggaaaattaaagtatgaaatatttgtacagtaaacagtacgcgaaataattgaacatttcaaagcactttatgaatcaacactgaagaaacacatgacattgttacggaggaagttatagaattcatcaattcccttttctttgtcgaagtagatagtctcaacgcttaggacgtatccaaactgcttgacaattcccttgaactcaatttggtctccttcttcgctgatgtagatgaaacgcggcttgtcctggtgctcgaaaacgtaacgcttctgctcctccgtttgatggttcatccaaagacaggctttcaatcattgtttgttcatcaatcggcgtagtcaaattgttgaaattcatagttgatttggctaaacagcattgtaaaagacagaaacagaaaatattcatgttaataaataatgaaagaagataagaatgattttgaaaaaagggtaggattaaggatagaaacaaaaaaaacgacgccaagccacttttcccgccaaattttgaatttgaatctaatgcgaaaggttttcgtctcaataaattatggctttatgtatatattgtggcgttttgtcttgttttgcgtattttcaaagttttttcaccagactacagtacccctcgcagtgatgacgtcatcatctttgcagcatatagtggacatttatcctttttctggcaactggtctcatggcagagtggtagtgtgttgggtttggtggcagaccaaaagttcgagtccactagcctgcggattatttattgcgaattttcaccggactaccgtacccctcgcagtgatgacgtcatcatctttgctgcatatagttgataattatcctttttctggcaagtggtttcgtggcagagtggtagtgtgttgggttggtggcagaccaaaagttcgagtccacttgcctgcggctaatttattgcgaattttcaccggactaccgtacccctcgcagtggtgacgttatcatctttgcagcatatagtggacaattatccttattctggcaactggtcttgtggcagagtggtagtgtgttgggtggcaaagcaaaagttcgaggccgcttgactgtggcagaatttttcgaataaaaattttaaaaaattcaaaattaaaaattataaattataaataattttcagaaaaaattttacaaaaaaagtcgcgcacccctgcaataggtttaggcttgcagaaaaaaagtcgcgcacccctgcaataggtttgggtttgcaaaaaaagtcgcgcaataggttttggcttcagtactgaaaattttggcgctcagatggcccgcgctcacccggcggcgctcaaatggctggcgctcagttggccgtgcacccctcccataggtatgggaggctaccgtaatccggtggaatttactgccctaactactcgttgtctaaatgactatggtagattaatgttatacggtagatgcgtgcctacacaatactccaggaatgcgatacttacggtagatgcatcttacgcagaaccctatgaacaactacggtatgcgtacgatgcctacggcagatgcatcgtacgcagaatcccattacggtatcatacatgcgtacgatgcctacggcagatgcatcgtacgcagaatcccattacggtagcatacatgcgtacaaagcctacggccgatgcatcgtacgcagaatcccattacggtatcatacatgcgaacgatgcctacggcagatgaatcttacgcagaatcccattacggtatatacatgcctacaatgcttacggcagatgaatcttacgcagaatccagatattcaacgctccagaaatgcgtacgtccatcaacacatacgtattcttgatgcctacgttgtctacatgactatggtagattaatgttatacggtagatgtgtgcgtacgcatccacatactcacgatatgcaatgctccagaaatgcgtacgtccatcaacacatacgtattcatgatgcctacgttgtctacatgactatggtagattaatgtta

SEQ ID NO: 2118 - DNA, 910 bp, Heterodera glycines
cgatttttacttgaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgctcataatgggatgtataaaggcgattgtagaaggaattggaagcgttaaaattgtttgagaagctttttgagcgtaattacgatttttacttgaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgctcataatgggatgtataaaggcgattgtagaaggaattggaagcgttaaaattgtttgagaagctttttgagcgtaattacgatttttacttacaccattttttgctaggcttagatcacatgcgattttcggcactctgataattttagcgttcataatgggatgtataaaggcgattgtagaaggaattggatgcgctaaaattgttgagaagcatttgagcgta

SEQ ID NO: 2119 - DNA, 1951 bp, Heterodera glycines
agttctttttaaatgcagccttccacccattccataccaacaaagattagaataccttcaactgccaacacttgaaagcaggcgaaagctttctgatctgttcatggctcataaaataatttatggccgaacagatcttaatccctttgaaatattcaaaccttctgaacgctttaacattcccttttatagacttaactcgaaatataaattaggcaaaaaatttataccttttgcggggcgggtaacaaaaatttggaaccaactcgataaaaagcttattgacataaactcattaaatcaatttaaaaataaaattaaaactatttcatttctataagattgaccggaaaaatagaagtcgaattattaattcattaaacaaaaagtgatttggtcattatttttatttatttttttttattgatttcacattatattttattttttggcggcgatctcgtttttaattgtttatgcgctatcttgaggacattttaattaatgttttgtcctcaatgtaagcggatttttcccttttgaggactttttctttattgacaataaattaaaaaaaaaaataaagcaactttttttagcattttttgttttcaaccccacatttttattacccacccaaaaaagaatttttctaaaagaatttttgtaaaaattatgattaccgcaacaggcgcctgcgactccacgtcgtcaggccccgtccgcgaccggcgataccgacaccacaaacccactgaaaagttaaattttaccataaaatatttaaccaaaatagtaaattttcttaccaccaagtgcggcggcggcgatcaccaccgtcaccaacagcaccaatacgggccattgccatgtccatggctcttctggggcgggggtggtgggcgtggcgacggtggtggaggccgtggcgacggtggtggaggccgtggcgacggtggtggagggcgtggcgacggtggtggagggcgtagcggtggatgtgcggcacggcggcgggcacgtacgcccgaagatctcattcttaattcaaaatcactgtttacccaaagctttaaagaaaaaatataactgatattttctgttttgcctatgttaccccttcaagaagggtgcactacgtccccccccccccgcatcgttccccccccccgagaaatttctttaaaaaatactaaattagaaatttttgaataaaaatcttagaaagttttttcataggaaaattctaaacaaaaatttttgtggttaaactaagatttttaaaaaattttccaaaaaagcgctgaattttctcaaaaaatttttttttcatagaatttccttattaaaaactttctaagcttttttcttgaaaattttctaagttaataaaaaaaattttttaaaatttctcggggaggtaaccggcggggaggaaaagagctgctcccttcaagaattccttcacttgaatttgaaaaaatgaatttcaaaaaacccaaaacacacgagattttttttttgttgcatttttatgcgttttgttaacccagcaaatgatcagatgcgcctattgactttttttaatgtggacaaaagagatttttttttcaaacaaaatccattaattaccgcctctgcatcatccaccgccgcatatgacacgtcgaacgcactaaacccagcaaacattgacaaaatgattatgatgattttctgaaaatacgataaaactatgcaattactgtatcgcagaattggttatttcatttatctaaatttttaaaaatgtaacaccaatgatgacaaaaattagggttctagtcagttttatgcgtcccatgccatattatgcgtcccatcaaatattatgcgtcccatgaatgaatccttagtttcttatgccataacttttttcttacttggtatcaatcgatatcttaattactat

SEQ ID NO: 2120 - DNA, 4226 bp, Heterodera glycines
cccctgccccccgctaaaaaatcatacatttcacccatttttttaaacaacgaatgtgatccatgggcaggggtccaaccaccatccgttcaatccccattgttttttgtcccgggcggcacgtgatcaaaaccagaccctggaagaccattaaattaatttaattcgcccgaaggcaagcggacccgaaacgaggggccgtagtaaaccataaagtactaccaaccggccattgatacagttgtcagaaaaacgataattgtcacctatgcaccattcttaattggatccattgagtgctatggtttgaacttttctacgagtcaaccttgctcgctatcacttggctatgtgctacgactatttagtgagttagccaactaagagtttaatcaaaaattaaaattaactttttaaaaagaaaaaatattttctataccccaccaaaccaaagcacaatctatctttttaatttccaacatatgaatttgaaatctccaaaaaaatcataattcgagaatgatagctgtaatcattcttcatattcattgcgatcagtctcgtgctcgacgtaaaaacctccaggataataatccggaattggccagcttccatcagaattcagttcagaaatgccgctggaagaacttgaacaaccaaagccgctgctactattcgttgattgcccattttgatcgacggccaaattgacagacggacttgtgatgttccaataggatgattttccattgtaagtcacggtaaatcgcccttcccggatcgcttgacgtagagtccgacaatcctgtcgaaggcggcacagcgcacgctgccgacattcatttgcgcttctgcggttctcacgcagcatttttcgcctctgcctttcttcttcttgagcaacttttttggcctgttgttgaagttttccttttcggcaatgtgtgcagcttttacacggcatttcgctggtcaacggcacttaagatgtttagggtttcaattaacggagagcgcttaaattgattaaaatttacaaactacaaaacataattctattcctaatttcgttatatccttaaataacctaaaggaaatcgatgccctttgccaaaaatcttgggatgttgcgttgtttcgatccgccgccctcccctagcatcgtgcactctgagatacagttgccgcaacttgctcagctcggatgattttttgatttggtttgatcggcagaggtgctccgaaatgatcgaggaaaggagggcggcgtaaatgactgggttaccattaaaaattgtttaattggactgataaaaactgatcagaaaatgcaattttgatgcttaatttgactgaaattattagaccattttatactcattacaatgttgtagtcgtctggctaattgccacatttttctaaatccaatttttcatttgcatatttattcgctatttttcgctgtcacaccttagcaatcgcaacaagttaattcctaagatggtaatcggcatggccagttggcaccggcaaactcgcaacattcatttaattatgtgtctgcctgacataattaattacttaattcaaatatttaaccggctcaaatgagtaagggagcagaacccttagctggaagcagaattccataattggcgatagccgaagcaggaggaggggggggggaggtggcagggtgttaagaaatggagaaggaaaaggaaaaatgaacatgaagatagcgatcagtctgacttatcgacgcgcagattcaacttcacaaattctccggcggctaatcggctgactcgcatgaatttgaattcaattacaaatccagctagcttacagcatttgcctagttcattttctaattttgcccggggcatctgacagttttagaggagggtaatgagagaaacggagtgatcgctatcattcttgttactaatgtgcaatttaaggccgacatgtaatcatatgctgactatagacgtgtacaatagggtatttaaggagaggccattcctgactaatttttgatttgctttatgctagattttgaccagaattaatcgtaaacttaaataatttaattccaactatgtattttgaaataatattttttaatttaattacagcgaatcccgactttcaaatgtctttaagcccttaccaaatgaaatctgcaaaacgaaaaaatcttaaaaatgatcaaagtttgcccgtttttgttcaagtcgacgacatttcatcatcggttgatcttggaaatgacgggataaatcctgaacaggtgggaaatgcgtgaatcgaatgcatgagaaaaagctgcttttctttacaataagctaaaaataattaattctgatttcctcagcattctaacacgaactcaatggagagtaactcgaaggaaatggaaatgcgtgaacatttggaggaaattgaaagccaaacgacaactcaaaataaatccgtttttgtgagccgttttcggcaggaattgaaaggtaattgacctatgaatcctttctgaaattacgtcagtttatagtttttgacatatttatatatttgagttttgattaagacgaagagtctacacttggaaccaaaagcatgaatttttaaaattattttagaataagaaaataataaaattctaaacagtataatttttaatacgcctttcaaaacaattgtcatttaggcattaattcattttaaccaaaataatttacctatcaatagttttttttgtatgtttttgaagtgtaaaacttttccgtttttagtattagaagaaacacatacaatttgaatggatacataagaagtaaaaatttgttactttatttctaggctattactgatcaaatatatttcccacagaatggcacatttacaagcagttttgtatttacggcacaataacatttgtgcgaaccttcccaacagcatttcgggttgattttgctcataaaagaatggcggcaattgcaatccgtgcaatgaacggtcaagattatggcaaggatggaaaagtttttatttgtgattggtggtcatggaaaaaggccaaaaagggaaaaggaaaaagtagagcaacaccgaaaggaattgtaaaattgaggattcggttaggggagggtgaagtgtttggttctcaaacaaaacccatgtaagaatatttaacattgaattcagagaaaattaaaaaagcgacctttgaatgctgatttatatttcggttcaaacacatttggcaattctatgctaatacatttgaagaatacgcattagttttaggcaataataatgttgaaaaaatataaaaacaattattttattttttttttgcaatttgtgatatattaaaatttttgcaaatcatctccctcataacgaattattatggcttcggttaaatgttttgctgttttttttaaagaaatattgtacggaaagacaaattcaaagcataattctgccatcagctccagagctgttatgaaaagaatggcattttaaacaaattaaaatttaactaattgttttagaaatttatttagctggtatgacaaaatcggatcaccgctgttttgaacccgttaatttcttctgtatataattttcattatttttatatttaccgttcaccaacagcagcgcctaattgttcttcttgtagaggatcttctacaccgcgttttaagcacatttggcaataatttgctgtagtttttgaaatatacaaaaaaagataattcgaaacagtgacatcctctgttacaaccccgcccatatactctttaacaaaatacacgtttaatattaattgtttagagattaattagctgatttaacaaaatctgagcaccgctgtcttgaacgcgttaatttcttttgtttacaatttcattattattttcatttattgttcaaacagcggcgtattcttagagtagaggagcttctagaccgttttaatgacatttggcaataatttactgtagtttttgaaatatacaaaaaaagataattcggaatatcagcgccatccttgctccaaccccccccccaaaaaaaaatccttcattaattcatttggctttatttcgttgctctttcgtcagtcgagattttatgaattgcctataagatgaaggtgcactgataaacaatcccttcaatgctaaacataaatttatccaaaaatttg

SEQ ID NO: 2121 - DNA, 1627 bp, Heterodera glycines
tgactatgatttacttacggtcatttaatttttctataaatgtagattaattattctataatgaatgctgccagatccgtagtttctgctctaatcggtcgaaaattttctgagattgattttgacaaaactggtatgatcacctcattgaagcttcaaagagctttgtcaaacggtactctacgaccgttcaacattgacgcatgccgtctgatcattttccaatttgatccaatgagacacggcttcgttggcattgagagatttgaatcgctttggaacgtatgtgttttttattgtttggcatataaaactattttctagtatattaacgactggaaatttgagtttgtggagttatcagagaatatgggctttctgacaatgcgtcaattacaaagtgccctgacaaaatatggtatatttattttaattcttttcggtattttcattaaggatttactttcaccacgcctttttttcacatactaatacatcgattcgaccggtcgcagactggtactattttaaattattaaagagactcactttttcttttcaggatgcttatattttgacgactttatatatttatgtattatgctccagcggattacaccgccgtttcgttatttagatagaaatgcgaacggtcgtattaatattcgtaaggttgaatagtttaactacactatatattttctattaatttcagattttgaagaatttgtaataatgatattatcagcgcaaatttagttgtttttttgctttaccagttttttcagaagtgatcgctcgcactcttactgttataaataggccctcgatatgccaaatcttcatttaattacttgaataaataaaattatttaatttattcatgaataataaactgttatttaatttgaatttattattattgtttaagcttggtgtacctatgtttttaattcatcatttagcataattcatattacagaattagaaatgagtggccttaatcggttccaaattgccgcatcaccgaagaagcgtttcgccgatgaatttccgccgtcgtgcaaagatttgcacgacgtaaaaaaattcaatgcgccgggaattttttacgtgcgcgcgaaagtgacggatttacagttcgctttgtataaggtatatttggaaaatatttacttcggctgattctcgaaattagttaattaatagtttaggcgtgccccaataaaatcaaggggttgccctgtaaaaaaaagcttgacgcagaaaaccattgcgttaattgcgggcaacgtgccaacttgtcgctccgcggcatgtatatgcgcttggacctccaggactgcaatgatcctgaaattaatcagcaagcgaccttgtttgctttttgtgccgagagttatctggatataaaggtagagcaattcgccgcaatggtgaacaacgatctgaaaagctcgaggctctgcttcaatcgaaaattggcccaaacgtttccgtcaaactaagccctaaaggttaggtttgcatttatcgatcacttagcactagctatatgacgatttaaatctttagggaaaaggggggcatggattgctcgactgggtcatttcggttataattgaag

SEQ ID NO: 2122 - DNA, 2015 bp, Heterodera glycines
  misc_feature (40)..(40): n is a, c, g, or t
aaatgaaaaggatagaagaaccaagatcagcggctgtaanccaagggcagcacaaacttgaggcggagacgaatgctcaggatggtggaggcggcgaagctactatcaaacgggcgcgccgtaaaagttgggacttcaagacgatggcgcactttgataggggagaaacggaccatcaacagcaccaaaaagcaccactgtttgagcagaaacaacattatgtgcaccgggtggaacgttttgctctgcaacgccatgtaaccgaatttgtgttgaatgggcagcatgatgagccggaggaggcgctcttcctcgcctttaagcacatcatagatcgtgcaatacggaacgcagaaaactcgccgagtcatcagcagcagaagcagactagcggtggtgcagaattctaagtgaaggtcttttctttccacaacaggactaactgatccgattgtactccccattcgcccgcctgagcaaaacaccgccgaagtgttgatggctgagctggataagcttggtcaatcggacggtgatgaagacgtgcacggtggcggaatcagcaaacgcgcgctattgctcagcgagccgattgaagttgttgtcacatgcattgcacctccggttggtgcagcgccacgtttccatcattaccagcattggggctatgatgagcgccatatgattcgcgtaatgaatatggacgacaatttttgcctctttcatgcgctgattgccactcgagcctacacggaccatgagtttttgaagttgtcttcgcgacgggtggctgatgttgacgcggatgatggcacactggctgacgtgccagctgaaatttctcgacgagtgattaccagggcagatttttgtgcaggccacgaggcgctgaaccgacttttgtcaagtcgggaacgcatgaaagcagctgtgacggagctgatgcgcgatgcaggtattccaacaaatgaggacgcttatggtatggagcatatcgagcaaatccagcagctttgggtgggttttataacgcgaacagttatttactccatatgaaaaaacaggaccaaacttacgccggtttgtatcgaattgttctgttcgaggaccgctccgagaaattgctgcgcccaatttggaagggtccgatggggcgtcgcctctgtgtgtcgctgtttgtgtcagaaggacactattatggtatcaaaagaataaactgcttcttcaaacttggcagaaaatattgcctggactgcgaatgtgcctacaaccgtgacactaaacatacaatatcatgcaaaagtcgttgtcctcaatgtgctaaaggtcgtttgtaaattactttaatgcatttaatgattgttatcacatttttgtttcggttaagttggtccccagtatccttgcaatagggtacaaggtgtacaccttcactgccagcaatgtaaccgattctttttctcccaatcatgctttgacggtcatcggcgcagccagacctgcaatttgcttaaacgttgccctaaatgtagccgtaccttccagcaggatccgaaatgtccgcataaatgctacagtactttttgtgcacgctgcagggtatttttttgtcaatattagactgccagaaataaactaactgtcaattaggtataccatgagaaggacgccggttgttacattaagaagattgctgtgccaaaagagaaacaacagtatcgaatagtaatctgggacacggagaccagacttgaacaactcgaagaaatagatcatcaacgccacaaagtgaatcacctttctgcgagggtaacatgcactgaatgttgtgattctgtaaatcgggctcgtgtcaattgccaaatttgcacgaccgtgtatggaaccgtggatcggttaaaaaattggtcagtggtttgttaaattttccgcacaatactattcgaatgtccatcgtcatcattaataggagtgaagcagaaggacatgaaccaatcacagagttttggaatgga

SEQ ID NO: 2123 - DNA, 1706 bp, Heterodera glycines
gaaaaaaaaaatttgcgaaccctgtctatatattttgacacttactcttcgacacattttcgttctgatcagtctcatccttctgctaacagcttatttttatttgcgaataaataaataaataaaatatatttttaaatatttcgtccttctagtggcttagtattatttatctaattgtttctatctgtttttgtcgcctaattaaacctcaaagatataatttaaaattttggcattattatgctatatttcaacagttcataaaatctttaaaattaaaattaaagtcacattcttaaatttaacttctcattcatttataaattttggctttaactatatttaatccgatgatggaaatgaacctcaaattaaataatttatttaaaattaaaataagcatctctttttcaataatcaattatccgcttctgtcatctcgctgcccattttgatgaatgataaggctgcactgtaattaagacattgtttttgtccaatggaacaacaacattttgtgccctcgttgacggcaaaaggcattttggcaaaaaagtgccaattaattggtgccgaaatttgtcgcttgtgcacaacagcagccaactggacaacaccaaagtgcaaagatcggtgacccatgggtattggatgtaaatgatggcactgtactggggataaaatggccagacgaattcgctgacggaaagctgaaattggaataagtttattttgtagttaataaaaatttaaattaaaaatattttaaaatttaaatttacatacaaaaaacaccgccaaaagggcgtggccagcaaaagtaagcagcgagtaaattaacagtttccgctcaatgttatcagtttgttgtgacgtgacagtcgcttttcggtgccgtttataagcaattagtgtcaacaaattgactaagaaacataaaatcagaaaaatgatcgacgtcagagatttcaattgattagaataatccaaaaatgtccttgactgaaattaaatgtcatattcatttttactgggttaaatttttaaaaaagatatttattaaaagggcgcggatttttaagtttttacttattttttctgcggctttaactcgacgagaaatgcacgaaaaccacatttttttttcgaaattttgccttttaacgcccctattcgacccttaaaatccctattttgagtgttcgcccctagggggggcggaagtttgggcaccgggaagtttgggcaccagaaatttgggcaccgggaagtttgggcaccaacttaaagagttaaaaaataaaaatatttttaattgtctatgaattgcaaccatctaatttaaaagcatagaaaatttaatcaagttaggaaatagaaagttctttaacgaatattcattcgattaagcatgcttattttgctaaactcattacaattaattcaatatcaatgccatacatatgtattatttatagcttataacattacaaggctcgatctgtgcaaacacttaaaattttatgagcttaaacagaattagacgggactcttgatatttcggaccccactaagccggtattcaggtataagtccaaacagaaactagcacacgtgtaattatacgtttaaacaaccgtaacaattcgattacataataaaattgccaggttcccctacataaatgttttgattttgaagaa

SEQ ID NO: 2124 - DNA, 5632 bp, Heterodera glycines
attaaagaatacctattttagatactaaatgcataattaaacacccattcaaaaagaaaagttgaactaattaaaaggcaatttctgttaatttgtgcctaaagccagctaatgataaactgtccgaaaaagatttcatttattttacatattcatcacgcacgccccaccacagctggtgatgagtgtgctaaaaataaaaaatagtgtcaaggcaaaaggcaactaaagctcgaaatagagaaaaatgaaatgccaaacttaaccaaaaataagtttttgtgcttcatcacaccgacaaatggtaacacgccttacggacatttgcggatggacatttgcggacaatttcgggaaaaaataaaaaaaatttcgtaaattttttttttatttctgaaatattgaatggagaattgcaaaactaaataaaactttgttttttggggtttaaggcctaatatttagtttcactggtcaaaaagtgcaatgctggtcttccaagtgattaaagtagagttggtcccaatgatcgggggcaaatgtgaatgtcgcctctgttgcactcaaaaattttaaatttttttagggttaaaattttttttgtaattctttatttttttaacatttttatggcagtagaattcgggtgagagtgctatttttatctttagaaaaaattctgagaaatgcttaattgcgaacagaatttgcttgcaatttcaaaatgaacaggctattttataaatgctgaacgccagctgcactaaaatccgattcccgacatttttgggcatcagatttccgatttccttttctgaaaatttttgggcctcgaaatgctttccctgctggtgaacagtaaagcaaggattatcttggcttcttctccaaatcgaacaaataaggaaaagaaaattcagggctcgggtagcaaataccctagtaaaaaaatattaggccttaaaactagagatcggacctgtcgctttttttcggtttttttcggtttcggttttttaaccgaaaccgaccgaccgaaaattttttgagtttttcggtttttttcggtttcggtttttttcggttttataccgaaaccgaccgaccgaccctcttgtccggtctctacttaaaacccaaaaacaaagttttatttagttttgcagtctccattccatattttcagaaagtttttaaaaattttttacgaatttttatttttcccgaaattgtccgcaaatgtccgtccgcaaaatgtcccactgcgggtaacagataaattctagatgagcgttccaaatcagaactataatgatcagagaccggatttttaggcacgaaaatctttcaaatatacacgaaaaagtgaaaaaaggcaaaaaaaaaaaggcaccaaaaagttcaagctagaagcttcaaatcaagttaaaaacacgtttttcgtgcgaaagttagcaaagaaaaaaaggcataagcctcaaagcccggccctctaataatgatagtgatgaaataaggaaaaacttttaaaaatttttgcactttttaagaaggaatttttttaagtgccattcgttctcatataattaattaggcaggctttaacaaacaatggagaaaatgataatagtgccaatggggtgggaaaatctgtgtaacaatgaaaattgactttataaaataatattaaaagaaaaaaaaattatattacaactatcaatgtgacaataaattgctctttccggacaagaaatgcccaggcactccaatccccgaccccgccttttcaccccgaatgttttggtcagtcttccccaaccaatccccttaggggtcccagacattttgtcacattgggataatcggtgttgggacgttactcaaaatcaacaaaatggacgttagtcaaaaaaccatcaaatggaaaatttttgacagaaaattattcataacttcactcaaaataaccaaatttaacatcttgatataagtagatagccctccctatatgttcgctatagctacaattttcaaaaaaatttgttacctttcacaagtatggccagaggaactccaaaaaaccaagtttttttgaacatgtttggtcataatttcttaaaacttcacgaaactttttgatattttgcatgctaatagaaaataataggtctatcgaacgataaaaagaattaaaaatttgtttgcttcagagaaaagttatagcaaaaaaaaacaataacaacaacaacaacaacattcaattgatcgtttttgactaacgtcatactgtaacatcgacaaaccgacctacactaatcatcagggaacggatttatatgtgccaaaaaacacccaaatatgtgctaaaaacgcaacaaaaaaaaggcaaaaatatgtgtcagtaaattaataggaatttatccctttccaaattccggaattacagtatatttcataaaaatgtgcactaaattcttattttagggatatcaattaaaaatgtaatttacgctaatttgtaaggaaaattacttatcaaattcacaagaagccatgtaattggccatgtttccggcgcctttgtaacacctcaattaagtgtcctaatgagttcgtcaaatattacaaaaatgaaaattttcgtgcttaaaaatgtttaaaaaaaaaaagttagggacgaataaaagacaaaacaaaagacacaaaaaagtggtcaaatgataatgaagtcaattaattactaaagaaatgttaatttgaataaagtacaaatgtttagcaattggttaaaagtgaataaaaaaagaaagaaaatacaaaaatttacgaatgaaaagagaaaatgacaaatgaactcttttagaaataaacaaattatgcaaaaaaaaaatcattttgtttagcccaaaataatataataaaattaacaaaagtgggacaatatgaaaaacaaaaacaattagggagaaaataacacaatttaacgaaaaggtcactctcgaaaacgagcaaattggagaaggaattgaatgggaagcagaacagaagcagagaataacggaacacaataagataaagtgaacatttagaaacgaaaaaagcaattagggacaagtaaaatgattaacaaaagttaatgatttaccattaaaagcatttcaattaataataaatttacataagttaccaacatgttcttgtactaatcattactcaaaacgttcacttttagccttaataaatcgtgatcaaaatcaacgaattttgttgtctgtatctaatataactcatcaatcctttaataaagattggattttgtgaatagcattaggggacaaaattaaggtattaaatgaaattaaaaaagttatgactaatttttgttgaacaaaaggacgaataatattgggtaagcctggacctgtgttttctggacaaaaaccatgggaaatataggccccgggaaaaccaggtttccagaaactccaggcctagatcagagaaaatccaagcctggatccaggtacaagccgaattctaatcattcaaaatttttcaaaaaaattttaataccaatttttctgtcttttaaaacagattaatttttaattgatttgcatttttgaactaaataaatcgtttaaaaaagtgaaagaaataaatgctgaagctgtccgtcgtattcgcatcaaaaatatttgaaacaaaaaaattccatgtgggaaaaagtgcatattgtgagaaaaaaattaaattttaaattttaaattaaaatataaatatttaatttaaaaattattattcatttctcatttctttctaataacaaaaacatattattaaattgaaaatttacgattttattaaaattattagaaataataattaatatccattttttttttgcaattaaaatttccaaatagtaggaaattccggtgtccgattttttttgtatgcatttaataaagtgacgggtcagaggccgacgggggggggggggggagacggactcattaggaagaaactcacatcaattagcaatgtaaacatggccaaataagcaaacaaattaccaacacctcagtcaatccattccattccattcattcgttttattagtgtccaatttccaatttttaggcctccgtttgcccatttatttatttaccttcgaattggtgcgcaattattccttaacactcaatttgtcgtcatttcttttatttatggccaagcagtcaatcgatgctcttcacagcataaaattcataaataagtccgtctcatatttttaaaagttggcaaaaaactaaaaaattcctaattttaaacgacattttacaaaacctttttattttaggcataaaacaaaatgatattttcatggatttacacattttatctcatacataaatatcctataaagaaagttgtgtacatatttctgcgttaaaaagtgcaaagttcacatttcagagtggtaaaaaaagatcaaataaatttttaaaatttctatgcccaaaatcaatttacacctttttctcgaaaatgtaagttggattgaaaaaaatgaaatatattttttgcagtgaataaaattacgcaggaaatttttttaatgctttttatccacttttcgaaattttttttcttttccctatttttaaaagctggcaaaaaaaatttagaaaattcttatttgaacaactttttacaaaatcttttatttttaagcataaaacaacgtcagcatttacatttttttgttttccatatttggttctttcatggccatatttttgattttcgtccatgttttatgtccaaatttggtgatttttcgtccataaatattgcttatccaaatcatcaggctaaaaagatgaatttattaaaacatttttggttgtaaattggtaaattatgtaaacgtattttctgcgcagttcaaaaacattctgaaaatcacaaaaaatcttctgctattgatttctacaaatttttagtccacccaaattcttcccttacaaattatagtgatcgctcaagcatgaagctcgtcatattttatttaatctgtcttaattatctgttacttttttgtaaattggagccaattatttgtttcatgcaattctttgctaactgttttctgctggtcacaaaacaactctgattatatcgccacataaatatacaattccaatgacacaaaaatttttctaaaattattgcttttaaatttgcatatttcataagccgaaatttcattggtgtctttggacaattttgcaatacctgaagaagtgcatatattgcaaggcttcttccagggtttctatcggtaaaacccaaaactgggcatacgaattcaaattcaggtaaaaatttaaaaaaaagcaaaagaccgggcgtaaaattcaaaaaatgggcaaaaatcaggcactacgcccaaaactgggataaatttccgatttctcaaaccttaaagaagcccgaattttccccaaatgtttgtgtcccctgctcctcggatgattgggggggggggggggagggcacgaacattgagcactctcctctgacctccttggcgatgccattgcattctgacaacaacttcactcaa

SEQ ID NO: 2125 - DNA, 1911 bp, Heterodera glycines
cccccccccctcgcaccagtacataattgagccacaattgttttgtatgtgtatatatatcaaacaacgaacaaatgaggagggcgggcgggggggggggggggaagcaaaaagaatggagaaagaagcgaagtcagaaaaacgacgaacgaagcgcaaaaacagaaacagccatttgggatcaaaaggaggagatgcttttgcttttatttcgattctttttttgaactcgacgaaacgccaaattgattttgttggatggaattaacgcgcaaaattagtaaattacaaaaaatgttatatacctaaattaattttatttccttttttatacatatttatttgcgtttccgtttttttttcattttattgcggcggtaattccaataattaaagagaaaatcttcatgtttttttctcatttgcgcaaatcttcggctcatttgtttgtgctatgttccaatttaaattgggtctttctcacagctcccacagtcatttcgtgccatccaatcaaaaatatcgctataatcattcaaaacaaattgatggttttatttcgaagagaaaattcatgaaaattcaatattaaattaaatgaaatatttaaatgttttcatattagaatatttgtccacttatttaaaattacgaattttcaaaatgacgccattcaatcgttggagttgcgagatttatttcaattgaaatgccatcggtagtcagccgactttcgtattgccaaaatggcatcaccgagaggagaagacagtcgaatgacagcgacctgacgacgatgatggcacaaaccgggtgccgtcaggtgaacagaaaacgggttaattaattgattaacaataatgtaagatcaaacaatgactaattagttagcaagaagctgagattaatgcttcttctttctccattgttcagctgcatgcgtgggatgtgctgctgtctctgctcggtgccattgacgttggcctcgccggcactcagtttcagccgcgcattggcattgacaaatatcggcaaaaagatttgcgtctatccgcctcgctgctgtgcacactcaccgtaacgggtgggacggagggaatgggtaaataattaattatgtgatggttgcccaaatgatgttgaaatttaaactgactacaatagctgagactatataaattcagcagcaatccgaacccacactcaaccccatggtttccatgttaaccgtccaaataaactcttcgaattattttcagtttagcaaattaaaacatataaatgcttcaaaaatctataacttgcataatatgttatcaacaaattaattaaaaatatttatattttcattattatttaatcggctttttctgcgtcggttgctcgtcgggaaacgtaattagggaagtccagtaggtgccttttatttcaggtctttcaagtgccatgatcggtcttttgctgttcatcggcatcgtcggactgttcgcattggcacttttggacagtctttctgttgtagaaaccccttgtactcagctcaacgggaggaccaactgaggtcaaacttcaaaaactgttggcatgcacagcgctgatcaaaatggccagtcgaattggcagcagttgagctgctcgcgcttatcggtgtcgagtagtgagaaaatcgctggacttttccgtttcgagcagttcaagaattttcaatcactataattccggtgagtattgctttgtccaccgtcgccgcagtttggtcattcaaatcggtcgacaacaacacgtttccatattacaaaatggacatcaaccaataccgaatggccgtcacacatccggtgacattctgttgactagattttttaaaaattgtaattaaaatggctgtaattcaaaatttaaacagagact

SEQ ID NO: 2126 - DNA, 3064 bp, Heterodera glycines
caaggacaagcgctgattttgtgcccaaaaccgtaaaataacaaatctaaaatgcatttacataaatactggtgccatttaactcaggtaatttcaagtgccatgatcggtctttcgctgttcattggcatcgtcggactgttcgccttggcactgttggaccgtctttctgttgttgaacacccctggtactcagctcaacgggaggaccaactgaggtcaaagttcaacaagaaattgttggcatgcacagcgctgatcaaaatggtcagttagagtggccagcagttgagctgcttgagcttatcagtgtcgagttgagaaattgctggaactttccgtttcgagcagttcaggaattttaaatcccaataatagtgtcataatcaatcccctaattgatcctgttaggatacataaaatcaaccgtttacccctggcattgtccatacattttgctcattgtcagctcaccggcattgcctctctcgcacttgcggcttttctcgagttcgagaacgcgcaattggcactccgtcaagagtactatcgcatcgttcttgaccaactcagtgccgtgttggccattggcagcgcaattgccgatttgtacgccggttacaacaaagtgcacggcacattaaatcttaaggtaaacggggtccggacaatgcgtcagtggacgctccgtcaatagacaatccgtcagtaaaagaacaatcagtcagtaatggacaacttgtcagcaaattttattctgtgattgttcattgacggattgacaataactgacggattgtcccggagcctaagagccttcggctcccggacaatccgtcagtaagtggacaatccgtaagcaaatttgttttttaaaacacccaaatttatttaaaatcatgtgaaaattaatttaaatcgctaaaaaagtgaattaatttattttataaaaattatgaaacaataatttttaaaagaattaaatgataatttttcgagatggtcaattaattgaagtataaagtaactagaaatattaagaatgtatgaaattatatttattaaattgaacaatcattttcgcatgatttttgatcattgctcaaaaaaaatttgctgacgaattgtccactgacggattgtccggaccccggagcattccatcttcaaattttttcatctcaatgtttcactgtatatttgcattttatatcacaaataaaatttagaaaattaaaaattaaattgtaaaattcgctttttcaggtgagcattgctttgtccaccctcgccgccgtttggtcattcaaatcagtagacaacaacgcgtttccgttttacaaaatggacatcaaccaataccgagtggccgttcacacatcccgtaaacattttgttgattggtttttgacaaaaaaaaatatattttaaaattggcatttgcatagccgataattcaaattttaaacagagactacttttgctaccatttcgcccccacaatatgccgtggtgatcattcacggcattctgatcggtctgctcgcccttctcgcgttgctatccgcttgcactgcgattcttgcggcaaacgcgctcagagaatgcatcgccaaaagggaagagctgaccgagctggccatgcagaacaggcaagaaaattgccgaatataaacaacgattgccacatttttcaaaaaaaaaatgacggcactggtaaaagcaattctaaactaggcaataattgatagagatttgtccatgagctcttctaattaaccaaaagaacttcttcggtttttaaaggattccccccccccctaccacaatgcccgtagccagaaaattgggcagggcacccgaaattttttttttctccgttgttatttttcaaaattttgagcgctgagcgcgaaaaactggaatttatagcggttttgtgccagaaaaggacccatttttgccattttgggttggggtcaaattttcaataaataatgggttcatttgagttgggcgccgaagggaaatttttgaaaattttaatgatatgtgcctgccctcccccactttaaaatgttgcaaatggcaacactggcttaagtacatttaattcaaatttttcgttaaattttaaagttttgagtgatttaagctaacaatttctttcaagatttctcgccctgctccactccttctgggccatttgtctgctcgttctcgcgctgctcggactcgccgaattgccgtggaatggcgacttcattggtgccgatctcctttggcttgcggtgctcgtgttcggcacgggactgctcggctccgccaacaaacggtcagaacgaatgatcatttttaaaaagcataagtcatgaaataaaaaaattaataaaatgattttaaaaaatctctttttacatagcagctaattcgattccgccagagcatgtggcgatgaaacttagttttcgtctttggtttaaataacaaaatttttttttggcaaatttaataaaaacaattttcctttagttcacattttggttagctgatctaatgaatgtaaatgctttaattattttgggtaaattttttaattagcttctttacttctcttctcctctgtgatcagttgacaccagcaggggtgtgtaaaattcattgttgtccccttttcggcactttttaagttcgttttcgtcagtcaaaaatttttgttttaaaaaaatttcgttttcttttttctatacgaagacgattattatttttagttttcgtttacgtctatcaaaaaatttttgtttggttttatttttcgattttcaaattttattaccgtatcatttttatttttgaatttttttttttttacatttcgggcactctattggcattttactcattcgatgtttttttttttggtttaggatttcaacacttgtcaaattcgtgatgaattgcattacgctatccgtctgtgccgagaaatgcttcctcagcattaatttggtgttccaatctgtcacccattccgacttttttaaccccgccgtgttggacaacc

SEQ ID NO: 2127 - DNA, 927 bp, Heterodera glycines
tcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaaaggggttttaaaaaaccccccccccccccccctctatttcatgatggataagtggtgattaacacaatagaattttatttgaacattcaattagatctattattattttatgaaaaatattaattcaattgttttaaattcaacaatcaaaaatatcaataggcaaataaatactttttaattaaattttaaaaatatatttattcatttatttttttaatctatctttatgcaattaaattctttttatttgattttaaaaatatatttattcatttccaaaagtgctccactgctgttgcgctctgagtgccctgttctacgcgttcgcgctgctctccagtgaggtgttcttcgagattgacaaatggcgatggtcggaggtgccgttggaacagacggcgcaccaccgaattgggaacggactgctcggagtcaccgttttcattgttcaggtccaaaaatatattttgggaatttctaatccattgccaggagcttatgtataaaaaatattgatgctatagcatctctgtctcgagaaaagtctaggcttttttgatcttcattttcattttcgagaccgagacttttttacaccccttcatgattggattttggtaaacctaaaaaataatgttcattatttgaagatttaatattttcggtaaagaatttcgtgggggagatacatttttaagccagattttgtaccaaaa

SEQ ID NO: 2128 - DNA, 6438 bp, Heterodera glycines
  misc_feature (16)..(16): n is a, c, g, or t
accaaatccgcttccncctcaaaggacagcgccagttgaagcaaatcctcgccacactgaaagagctttgcgcgagccatggggcaacagtggtgacgattaaccatttggtggattggcgcggatatccgaccccggcactgggaaacgcatggatcaaaggcatttcgcatcggatatttttgcaccgacaaaacaatgataatgccgaaacgaacggacgaaccgaattcagtgcattaattttgagcgaaaaggtcgaaaaatgagtcggcagtttatgcatttcaacaaaattagctggacttttaaggttccaagtggaaaatttcgcttctcattgacgaatcgtggatttgattcgaatctttgaataccaaccaacaaaactttatcccccgaaatgatcacaattatgcccaatgccaatttgaatgccgaaagcattactaattttcttgctggtattttcgaaactatgaaacgcgatcttattttattttgaaattttctattttattaattttgattaaaaaatttaattaattttcctattcgaagcacatccggcttgtttaaatgctaaaaacaagcatttgcgcgaaaaggtcttctggcccgcaatatgcactgcatacatatgtatttgggaatgtccaattttattgttcggatttaacatttaactatcgcgctagcatcggaacggataaataatataaagattaaatgaatgtggttctattgcattttatgagtccaaaaactaacaaaaaactaatttgcttaattagtcatcatttcttacgattgccaaaacgcatagcttttgtatattatagctttttagattttgtgttttcaagtgataccaaaaatgtacggttttagttcggatattaaaaaaagttatggtcatagaaactcaggattgatagatgattgggacccataaacttttcattggactcataaattttgattgtactcattaacacggtgtgtgcctaatcaatcaatagtcaatgatatcatcaagcgcctcctgcagcttttcacgcaaatccttgtgatcactgatcggactgttgaatgtgaatggcacttcgatcagccaaagtgccgcgtaaccaacgaggccaaagccggtgatgagcccgctcaggcagccttcgttcggcttaaatttgcttgggcatccgcaacagatgttggcacatgattggaccaggccggccagggagcagatgagggacagcacaaggccggccgcgcctccagtaaaaagggcttaattttttggcaaaattaaaaatggtaaaaacacattaccgtattccttcaaatatgcccccgtcgcccacgaaattactgtaggcccaaaattgagcccctcaagctttggaaaaaaattggaaaaacactcgcccatggctttagaaaatatgtatactaagtgtagcattagagtatttggaattttttggcaaatgctaccgtattccttaaaatagggccttcccccaccgcccgctaaattactgtaagcccaaaaaatgagcccttcttttgaggggctaaaaaatggaaaaatctttgcctatggcttttttgaaaatgtggtatctaagtacagttgttagagggataaatggaaaattcaggctgaagagactgctcgaaaacatggaatgttttttttaaatttaacaatttttaaaaagtgccaaaaacggaatttttcaattttccaacttaatttttaatcctaaactattaatctgttgattttttgtgctgatgataatgatctcttgtccctattttaataataattataaaaattgattttgtaaaagtaattacaaaaattatgcctattaaaacggcaaaaacatgaactgtcagcttgtacatttcgcccgtcttttgaagcataattaatgcgtagcttttcgtttcgccgtcacgccgtgaacgccgccgcggccgacattgttttgcgcaactaataaatttttttgtttgttttctctattggtgtgcaaaatttcaaaaaaaaaattgttactatcaaaaattatggccaaaacatttaatatttattttaattattttggccctaacttaattatttttaatttgcatgctaatcgagagaacacttaggattatccaatgaagaggtcttttttgtctccattttccaaaaatatggtaaaataggggtccggcggtgccactaggcgcctttttggatttcgggaggggggggggggttagccccctcagcccccccctggctacgcctttgaacgatcccggcatcggtaatgatgacatttaatgtaaatttgtgccaatttgaatcacccggcacttttgagcattttgctgaacacttgtgccacttcagcccgatcattctgatcaattttggccgcttcaaagccccgcggggcgcttctcacaatgcctttgtccgccaccaaattttccgccaaatttgtcgccacttccagcgcttccgactcatttttatacgcttttgtcacatattttgccaaaaggtgcactttttctgccggcacatcgatggacgattcgaaaaaaaataattaaaaatttttattaatttttttaaaaaataaaaataaataaatgtaaatactaaaaatatttaaaaaaactctcaacaacaaattaaaaattaaacaaaataaaaatattttaataaaaatttaacaaaaacaaaaatctattaaaatattaaatttaattgaaaaattgaaattttttgcagaaaaaacttaaaaacacaaaattctttttatattttttaattaaagtttttaatatttgtctaaaaaaatattattagaataaattttgttttgactaaaaccttcatgcgtcggtgagctcgtcaccaaattaacggaagcaaataaaaatatttttaaaaatataaacattttggaatgaattttatgaagtaggaaaagtgattttataatgcaaatttataaaacaaatcgatttgaaaatgaaaaaaataaactgcaaataaacagttatacatatgcacatttaatttaatggtcggaaatgaattgaaagattttagaggtcacgcaagcctaaaaaaatgcattttccgatttttaataacaaatatatttaatttattggccggaaatgaatgaaatgcttaaaggtcacgtgagccaaaaaaatgctttttccggtttttaattcaaattatttttgtgaaaaaaattctgaatgctaaatttttgatgctgatcaaaaaagtcgtttacacctacttgatcagacagtaggcctgtcagaaagaggacaaaattctctgccgattgccttttgaatgataggtctacaacttatatacacagagcaagagatggttgaattttgttgattgtaaatatcactaatttctaccgtatttcaagaggaaatgatcaaaaattggtcgttttactgtactcaattttgacaccctcactaactcagcgggtatttgtcgtagacccatcagccaaaaggcaattaagaagagaaatttgtcctctttctaatgggcttttaatgtttcccaaaaacaaattttttccggccctgaggattttttttttgaaattttccggtttcagaccatttaggccattaaataaggattattttagtgatcagtctattttttcttatttaataaaaaaagcattttatttccctcaaataataataaacctcttacaaatttgtgtgacacttgttaattgttttggttacagttgagacacttcgttttttaatttgaatattggcattttgtttatttacgccaaataccaatttttaccgaccatgcctatggctgtactttttctggggccaccaactggaattgtccccaaaattgtgtttatatgagcaccaaatgttaatggagtccaaaaaatgttttttttttcacgttcattcgtttagaattgagcttttactgctaatttgctcaatgtctgccgaatcgttgttggaatttattgccaaattaacgacattgtcaatgacactgacagaggaagaaagcaagaaattggttgaattgacgaagaaatggacagaacaattagacaacatcattgggtaaattaattcaaatgtttgtaattttatggcaatggcaaagttttgtggtttctccgaaaaataaatttaagaagcacatttcctatgctaaaaaatgcgctgatcgcgaatctgagctcggatttcccaatttcggacccgaattcggaccctaacaaaaagaattggattttttccaaaatatgcattaaaaatcaatcaattttgacgaaaattgttcattttttggccttccgctgcctcaactgtaacaccgaccatggcaaataatcggcagtcctcgccgccgcccttctcgtccgccccggtgccgtcgtcgtcaaattctgtccaatcattgccatgtgccaccaccactgccacaaaaaatgccgacccaattgttctgacaccgaagacgacgatgccgacgacgacggcattccctgctgttctgccgatggtcccgcaaaacggattgccaggttttttaaaatatgcacggtctaggctcacattggcaaaaatttacgccgaaaatagacagatttaggcattttgaagggaagggtcccgcaaaacggattgccaggtttattttaataaatgtccatagtctccaaaatgtaatccaaaatttgcatagggatgccgccattgcctgccatgggattgccaaatgtggtgccaaagaatgtggcgaagacgccgaccaacggaattatcgccgtgccgcccattcccgccactgtgccggcggcaaatgtgatggcatttggaatgcgaaattccatcgctcgggtattccatttttttatttgtgaattaaatttcgcaatttcgttaactgaaatttcgtttatgccttggaattcaattcctaacatttttaggccttaaaattccttttcttgaaactttttggagttttgtgttttcccaatttttttgagcctctggtttgaatttcctgatttttaaaaattttttaggccttcaaatttcctttcctggaaatttttgagtttcatgtgattccgatttcccatcgaaaaccccatttttttcttattgttgtttatattgtctggcgtaatcaaggcgtgccgatggctcagttggtttgaacaaaaatactcgtcggtatggaagagcgccatgggttcgagtcccatcggatgaatttcattttccacacaccaaaatgttttgtataccattcacgttggcatccaatgagaattctgatcagttttgcatttgattgcactgcactgatcagatggttacggatgcgcaaattgtacggctgtacttttaccgacgggattttccatgaaattctgttaaaatagcacagaacaattttttaaatattagtgagaccgtcaaaaaaaattttttttgcaatatttcaatgctttcatcaaagcaaaaaatttcaggaattttttttaaccgatttttagaaaaatttttgagaaaaacttgttaataactcatccttgacttatgaaaaaagcattgaaaattttttcaaaatttttttttcttgcaattttcgtataagaaatttcctaaaatgcaccccaaatttgaactctaaagaatttttttattaaaaaaaatttcgggcattgaaccactgcaagtttaaaaaaacgcattttttcttgttgcctcaccctctaatttgaccatcacagaaaggcacaacggcggtgcccggaatggcacagcgccgcggcgcactcaccaaatccgccgcggctgctgcgtgcgcacacggcgtgtgcggcatcaacgtggcccgcgctggcggcggcgccgctgcgcggccggccaacaacggggcggcagccaagacgtggcagatgatgcaccagcggcgtgagcagcggcaggcgttgtcaatgcgtcgtgcggcggcgatccccccaagtgccgcttacttatccgccggttccaagctgtaccagcaacaacagcagcagcagacggtatgatttccccccccccccccctttccgtcaattttcagacataaatttttcaaaaaaagtcagtgaaaattttttcgaaaaaaattttttcttcaatgttttttctaaaaaattccatttgtaaaaaaaaaaataatttttgggggtgaggaatgtagtgtacaccctccagaaagcagctcgtttccctcccacccccgactcttttttttcattgggaccacaattttcttgacaattgccaaaaaataggggcctaccgtagcggaggggggggggg

SEQ ID NO: 2129 - DNA, 2991 bp, Heterodera glycines
atctctttctccccaaattttatattttttattataaattttcttaaatctcccccccccccctctcccccacataaggcccctcaaccgacggcgtgttgttcttccgctgcagacacaaccaacatgatggagacggacacggcggacaaacagtagagacgaagtggggacgacgtccaagctgtacacccaactgaatgaagagtcaaatgtcatgttctgacggaatctcgacgaaaattttcctttttaattttttttatgtataccattttcattgaattctcgacgagcatatattaccccatatacatacttcatgtgcattatctgattatcaaaatctcctattttcctttttccgaataaattttttcccattttttcaataccaattgtgatttgctgatgcgagtcaagttaaagtggtatgcaattcactaaacaattttttttaagtttggcgaattgtttaaattttgagcaaaaattaccccatattttgctcatccaacacaaatgtaatcttttgcgaaacacggatttacacttgcaaatccccggaataaatgaatactaatctccatgtttaattccacgagatcttgttggtccatcttttaggaattttactcgattttttcaaaatttacagccttttatttattgacactcccccggcgcatcacttccaattttaggcccatcatatattttttgataattttccaccaccaccgctgctgctgtttgctgtggtctcctcttcgtgttgtactttcattttgtgccggtgccttcgttgaaatttcattaaaaaaaagacatgaaaaaatcggtgcaacagtcgtgccccgagctgcgcaaggcgcactccgtcacccactcgtccaactactcgctggacaaagtcaagtcgctgcatgagcgctccgcgcgtgcaatgctccactctcacgaggttttttgatgcgttcccattccaaaaaaaggcgcgcatttttcacacattttgcacccctcgtctccgtttgattttctatgtcaattgttttttacgaaatttttaaatttctttcggtttgcagcgggtcgttgatcatgacgaatctgattatttatttgggttaattcaccttattcctaacccgaatccaaataaaatgttaaagtccaagaggggaatcggaattggtcgaaatgagtgtcagattcgagaccagagcgaccccgaaatccaaattttcataaattttcatgacaataaattgcaagctaaagggctcatctctctttggcgtatttaacaaattcaaaaaagacagtttgtaaaacaattttattctgaaattcggaattggcaaaatggatgccatattgtataccggcaaattgttattataactcgaatatatatatatatatatatatatatatatatgtatatatatgtatatagatatatatatgtcgatgcctggagcttgacgacaatcagttgcgcgaaattatggccaggatggagctggacttcaagaaaggccttgacccgttgacaggtggtcgtcgtactcaaaatgttaaaaaattgtcacggtttttgttgggataatttgttttttggagggggggggggaggaaaattttttgaaaatttatttggttttgacataatttgtttttatttggatatacattatcagagatggtcccagtggtgggcaaaatacgcagggtatacccctttaattatttttcctaggaaaatattaaattttttttcagaaatttttggttactgtttttttccgaattcaaatcctgttttttccgtacttctgctgtttgtttcgggtgggtggccgcaaatttttccatttattcccctataaaaattccaaaaaatttcggtaattgtaagtttcaaaaataataattatgagcaataatgctcgaaaaacaagtttttccggtttttttggccgtaactttttttaaatgcacaaaaatttttgtaattttaagactaataaaaaaaaacaattaggggctctcaaaaatgtatagcaaagattgagaaaaattttgtccatttgtatttacttctttttccatttttcagcgccgaccgcttccgtcaaaatgttgcccacttacatccgtgccattgcggtcggtgaggagcacggcgaattcttggcactggacctgggcggcaccaactttcgcgtgctgctcatcacgctggagggcgactgccggtcgacgatgcaaagcaaaatttaccgtgtgcccgaccacatccaaaagggcaccggcacggcggtgagtggggagcggttttgtacaaatttcattaaaattttcaaaaaaaaaattgccgtcgttgcattacggcggggccagcaaaaatctcgccgccgaatttttttttttattttctaacagaaatttttgaagaaaaaaattgaaattttttagcgattttttattaaaatttttgaaaaataagtgagtcaccacaaatctcaaagaaaaaaacgctagataaattttacaaatttcctttttcttgaaaaatttctgttaaattttttttaagtttcgcctgcgagaagtttgccccctcccctatcatcccgaaattaaaaaaaaatttggacacttttctcagtgccttggttcatacgtctgacaaaacgaagtttctgattggagtgcgttgacttttttgggtcttacaattggcaaatccttcccccaccgaaaatttttttttggcacttatccgattttttggaatgcccattttaaatgcagtacgaatgccgtcagcattaattcactcattcattgttttgtcccagctgttcgaccacatagccgcctgcctggccaagtttatggaggagcacaaactgacgggacggccgaagttgccgctcggcttcaccttctccttcccgtgccagcagcacgggctgacca

SEQ ID NO: 2130 - DNA, 2973 bp, Heterodera glycines
aatgagaaatttaacaacatagctttaaatttttttactatttaataaattaatatcaatttttgtatttcgcctcagatgatcatttttaataattttgagaaacgaaatcaaaaaatcagattttaagattattttttgctgcaaattttttcaaaaactttaggggaaccgaggggggggggaggtcggcgctgccgataggcgccgccgggaaaattttgaaaatttgaaatgtaatttgttaacagaatttatacaaaaactgcccatattttgtgattttgaactaatttataagaaaataatgggttcatgggtctggtgatgtccgattggcaccgaaggaaaaatgcgtagacaacaattttattctgattattggacagaattcttagaaatcgttgtgccataaaactacctaataagatttagaataatgttttagaaattaaaaaaaaataattatttttatgaagaaataaaagtcacaaaatgccaacttttgagtcaaattttgaaaattttagtggaattttggagacctgtaaattttttgggatttttaagggattttttaagaaaaattagcaaatgacaatattttttaatttataattcaagatcttaatttaaaaaatggagattttttgaaaaattatcgtgacttcaatcccgcgggattggtaaaatggtcgggagggatcccggttcgggatcccgatgaaatcccgatcccgatcaatccagatgaatttaaaaaatcgctcgggacggatcccgaggtcgggatcccgaatttaatcccgcgggatcccgaagaaatcccgcgggatcccgatccagtccggtctctattttgcagacggaacagctgtggcttcctccataaattgctttacaagcacagcaaaaagactccattgctaaatatatggaatttttcaaatttttcatgtaaaatacagaaattctgtaacaaaaatggattaaaaataattattttttgccgagctgacatttttggcgacatgttcaaaaaaaattcaaaaatttttcactaaacaaatcagtcaaaaataatcccacagtctctattaatcacgcagtctctaattatcccctgtattctgaggaggttgaaaaataatcccccatgggctataattagagcatatacggtatgcagttcaattgtttgcatttagttggtcaggaaagaaagattggggcgtgggagaggcgtcaaaaattcctttccatctctactttcttacttagtcaattattgattgattgtaatatgacaacaaaaatgagaaccaacaaacaacaacgatttattcagcacataaatacacacaccatcccagaaatgagctccaataccaaaaaagattcaaatacagtacctgtctcagtggtctgtgagaaggtcaccaaaatgggggtgtcaggttcgattcccagtgcatgctattgatgtatttcgatgattttaatgtataaataaaaggaaaagtaaccaaaatgatttaaaaattgtttacaaatttttaacattttttatttgtcacgtgtaatgaaaatgaaaaccatcaatcctcgatcagtcaacgacatcgacgtcagcttcttgatcactttcttcattcgttttgtcttcctccgcttgctcccgttgttcctcctcccgcttaattagttggacaaggttttaaagccccttccatcaactcaccagcttcaattcgtcgagtctgccggtgtccagcagccaattcgagacgaaatgatgctccagctgttggcgcatttgttcatcgtccggcatcgtcttccacagttgctcaagtcgccgccacacggagtgcagtgcctcatctcctgaaaatcacaacatttaaaattgaacccccaaaatgttatggcccaaccctgctcatccaaaagccccaaaaattggtgttggcgcgcaaattgaacaaaatggtgcagcagcaaatgggcctttgtcttttttgaaagaaggttttgcaccattggttgttggttgataaatgccttgaactgatcaaccgccgtctccaatccgtccaaatcacctggagacaatggctgggccttaaatttaaaaaaatatttccacaaacaatacaaaaatgaaaccaattactttggtgaaaatttggattttccccaaatgtgccattgtttggcaaattgttttggcccattccgtctcgaaaagggcctccatttgatcggcatggacgaggattttccggatgctgttccccgtcatgtctcgctttctgaacgcttccctccttgcccctatccgtctgaagaattgctgggcgatttcggcattttctccagtttccaactccttgatcaacgcatttccgaggccctggaagacatggaatggggccaacagcatctgctcaaaattgatggacggcagaagaggtgcacaaacaatgcccatcgtcagagcccgagcctctgccgttgctttgtcgccgccttgtgtcagctgctggaactgatctgcctgtctctccaattcttgcacagagcgaagttggcattttgctgaactgatcagatgttctctgcgacagtcacacactggggatgggaacgctgtcattgccgaaccgcaatggccaatgatcgcccacagaaaacacaggtcaccgccaagaaacctggaaatttttcacaaaataaaaaacaaaaattttttcaccatttcactttgcgcccgtcaattgcatcgattcgcccaatttgttcccacaacgatccgcagaaattcttcaaattttttcgagaatcctttgcagggaaaacagccgcaacaaaattgttggaaggcgaatttgggcgcaatgcatgggccaacgaaatggtaactttttaagacaacatttaagcgatgataataaacatagaaatcgatgc

SEQ ID NO: 2131 - DNA, 1912 bp, Heterodera glycines
aacgacaataacacaatggtaattatcctagctcgctttgcatcgaaattaaatatgcccggggcacactttttgttgtttttaatgactaatcactgccccgctgatcagtcaaagtcagaaggggcgctttgttttggtaagcccccgccccccgcttctgctggtcgtatcccattattctttctttgggttttaagctgcaggtttttacacatccaatttaaaacaaaattattattttttacacgatttagcaaataaaataaaataattatttcttttgttctgtgtttttattttattttggatattagtaaagtaaacaaaaaaagataaatgatttgtaatcactttatcattgcaagatttttagtgctgataaccaagaatgtcaacaacggatggaataggtacttacaaatgttaaaaaggcattattaaagaagacaccaataaataaaaattacctattatacctctaaattaaatactttaatattttgaaagaaatattcttaatcgaatccgagagtaattatcagaaatagatgactaattaacctttaaaaatttagcagaaatttattaaataatatattaaatttaaaaaaatctgttgaattggggcgatatgtaattttgatgattttaaattaccaaatatttttttagttaattatgatagaaaataggcgaaaattttttcagcaaaattcatttaatggttaaaagttttctctgtttatcagattgagttaattaattaattaattataaaatatgcttctaattttattatttttgtgtgtaaggattagcaaagtttactatttcaacaagaaaatgaaaaatttacttttgaaagccatgaaaaacattttttaaattcttcgtatttcatgattttttcaatatgaatgctgaaaaaattttgagcaataaaatatggaaaatgataaagatggacctaatgactatgttcttttggaggaagttggagcagcaaacaaaaaacttgacctctgtgaaacgccatcttttttacgttattttcaattcaaaagaggtgatgctagtgccagatgccgaatttgcaaagcccaaatagcgcgaaaagatggaaacacgtcagggatggaccgtcacttgaaacggcacattgagttaattttaatttcgtttctttttatatttttttagaatttacaaggaatttgttttggcaaagtacggcaaaatgcgttcaaaagcgcacttctttttttgatgaatcaacatcacaaaagccaacgaaacaattatgtttagagaatttccgtgagaaagaaaaatggacaaatgcgcatcgtaaatctcagaaaattgattcacttaaattacgctttatctgtttgtctgttgaaccaatccaattgacggaaaagaaaggattttttgagactttataagaagcatgtccaaggtaaaaacaataaagaattaactcttcaaaatcttataatttagctaccaaaacaaagaccgccgctttatgacaaaattgttggaaacaaaatatcaacaaagatagaaacggacactccaataatcaatgcctctaaaaaagtcatttcaaatggtttaaaaattagaatggaaaagtacgagaataaaaggtggtttattctctcacttttatacacaccatcccagaaatgagctccaataccaaaaaagattcaaatacctatctcagtggtctgtgagaaggtcaccaaaaagggggtctcaggttcgattcccagtgcatgctattgatgtatttcgatgattttaatgaataaataaaagtgaaaagtgaccaaaatgatttaaaaattgtttacaaatttaagcattttttatttgtcacgtgtaatgaaaatgaaaa

SEQ ID NO: 2132 - DNA, 5004 bp, Heterodera glycines
gttgaaatgacatcatatttcaaagctgagcaaattcttcgttttatttcgacgacccaaaaaaagttggtaaaacaaaaaaatcaatgaaaaactgcacctttctcagtggtggaaaagtgtcaaagcgcctgtcgatcagccttagagtcgccttcatccgttgtaagccatctgcgtcccgagctgggcaagcagcagaagtccatcctccgcttccattccctcctgcagcttttggccctttggcgtgtagtgcgagaatttgtggcggatttctcggtagattcggtccaaagatgcgcggctcgcggaacgcgagcgatcacgatcgatgacgcccacaatttggtcgacgatgtcgcgcctggcgctgcgctgcagttgatccagtcttttcttcggtcttcctctgtttggtggtgctaaaattgaaaaaatgatcagattttatgaaattaaaaaaggaaaaagttcactcacttttgctggtcgttggtggtgccatcggtggtaccatgtgctcgtccagctgccgacggagatcactgatcagcgcttctcgattgcgcacctgctcgcggagaaatttgatggtgtcgtcccggtccttgaactgcttctccagttgttcgatgcgctctgatcgctcgtcaatggccagcggtggcggggtcgtctctccggtgtccattggcgcagttggtgttgtcgaaaacagcaccaaatcgccgattggtgtgacagatgtcgatggcagcgaaaagccaaattccaaaatttactcgtccatctccggcgttggcactggtcctggagttggtggcggaggctccatcgcttcttccgttgatgcagcagatgttgacggccctgcttcgtcctgcagtgctatttcggcattgggatttggttgtgtagcggctggaatacaaaaaaatgatttttttgagataaaattgatgaaaaaactcacttttcttggcccatcggccttgtctcgccctctgcgtctgcgcttttctctcctcccgcttattctcacgcgtatggcgtgcatttttggtctgtcgcttccgtaataaagttcttttagccattaaatctttaaaaagaataataatttaacttttttatcttataactttttaagacaacatttaagcgatgataataaacatagaaatcgatgcagaatttttttctctatcgatttgcaaaatttggtgtggatctaacatatagaaaagaagctaaacatagcgaagtgaatgttgtttttcctaataatgaaaatattagatagtacgccaaaaggagacaaaaaaattagagaaaaaaagatattgtttttctctggcactctctatttattggtacacttctcgtttttcgggatggtgtgtataacacaattcttttttcaggtttcttatcattgctactttggtcaatccccggtataaaaatcatataaatgtgttcaacttcgaagaccgaattcaaaataaagttttgttggaaacctaaatagaattaaacatcaatccacagcgccgtttttccgaaactgatttggatgatatgaaccaaggaacgcttcaaaccatttctgaaaatcttttatcagattttcttttttctggaacttaaacaggacaaatggcaaactcacaaacctgatattgtaataaaaaatgaaattgattcatattttaaggtagaatttttaacgaatcaaaaattataaaataatattttaagagtccaactctgaacccggatgacgatcctttaaagttttggcaacaatgcacaacgtacccgaacattaaattaattgttccaaattttttgtcaccaccgccgggcactgtcgaatcagaaagaacatttagcaagctgtcagaaattgataatcctaagagatcaaacctttcggaggagcatgcaaaataacaactctttttacatttcaattttgacgagtgatttggttatttttttgattaaaaaactgatttcaattaattccattaagatttctcggttcccgagtcgagaaatttctcgggctttttgggtctcggttctcgtatcggttcccggggtcatttctcggttctcgtatcgtttctcggggtcatttcccggtctcggttcccggcaaaaatcaattctcgcacatccctaataaatggagatatgtgaagaaacattttccaaaatagataaaaggaattttcaagcaataactaactaataaatcgactgtgtttttttttggtttgctaccaaaaaatgctaatgaaaagggtgtttatgctgaatttggttccgaacggtgatgcaatttcgggacgagaagcatccctttcgctttaattgttgcaatttcccgaacagttctcgctgatcaatgctttcccgaactgataagcgccactaatcatctccttttcctgtttgaagatttcctcaatgctcaaaatgatttgattaaccatttacacattgttaattttgcccaactcgttcttctttttttcgagatatttgattgtctgattaatttcgtcgtgtcgaatgccaatgatttgcatttcggtcaacaaattttgaaatgtttttatctgatgatcatcatctaaacaaagagattgatggaattccatgaagatcattcctgctgcacaatttttttatggcccattggacaccgaaaattaggcataataggacaaaaaagattttcacatttaattggaataatatgaataaattttaaattctcgccatataaagttttagcatttaatatgagctatttctcgttatttggcatcactagactgctaatgagtattaataaataaacttatatttgcttattaatagggtgtgaattttttttacgaaatacttaattttaaaaaatggtgcattttgtaattcataaactcgaatgccttacagcatgcatgcttacatagtgtaaactccaaattagtatttttttttgcaaaattttaaccccttctgaaaggttggaatgagttacaaaatccatttaggccttgctgagctcttgtttttcaaaaaattcgacctaatttataaattttcattgatagataatttcataacccaatccaaatttcattttaaagtttctaacctgactcaatttctctttttcctcctattggtttgctttatatcggtcttttaattgctctaagtcatgttttgttttctccaaaatttcatccaatttttgttcaatttttttctgcagcggcacagactgttcccgtgccaaacggacaaaattcaacaactgttatcggatattcatttttgttgttgcatttttccattctttgcacattggcaatttgctccgaaagtttggcaaatgcttcgccgtaaatgcacgggtcagcaaaagcggctattttgtgctgaaattctgcctctaaaatgcccaatttcaaccccgcaacaaattcctccgtggcttctccaatcattgcaattctctcatagttttgtcccagtcagtccttttcaatttgttcggcaaacgaaaggagacgttctcttgcagtttggaaacggtcaatgctacagtatgctgtgctcaccaatgaatgttcaatgttggcacagtgtttcttcagcgatgccaaactttgcggcattgccaacatgtctttagcctccaactgcacacgcaatgtgccaagttctgcaggcagttcactaatagttaactttatccgcaccaattggatgtccaacagttcgtccgttgcttttcgcttaaaatggtcatttccgttcagcaaactgctcacagtaacgcatcgccattttgatcagtttgaccagtcgttggtacaccattgagttgccgatgctcatttcaaacagccagttctctgccaattctttcaaatatgccaattttttcgctaatttggcaagtgtttgttgcgtttgctgttctgcccggtcttcaactaaattaattgaaaaatgctattatagagttcgaaaattaaaaaaaatagcctggtctcatgttttactttaatatttgaccttggcctgtttgtttttgaaaattttgaaacggacaaaaaagccaaactctaaatctttaatcaatgcaaaatccaggcctagctagatccagaccctgattgagacctattaaaatagtaaataatcaattttcgagtttaatcttgaaaaatatgagaatgtgtggaaggcggtgccgaaacaaattactggacttgattttcggatttgctcaagttcggcaaccttttccacaatttcattcaaattcaatggagcggaaactgtgtaaacggaatgccattgaacttgcaaaattaaaaatgcgaaaataatattcatttaatctgaaatacaaataaaaattatgaaaataatgcattttattaaaacattttcaatttttattatacatgcaaagaacaatcaatgcaattccattcagatgattatgctttctgtttcttttatttcatttttaggggctctattatttattcgttggcaggaaaaaattgatcagtgaaaatgagaaaattatccattatttagagaaatgagattctgtaatttgttgagggaaaaattgtaaaataaagggccaattatttgctattaaaaatgagaatagagggaggcactttgcttcaccaacactaaaaatattacaaaggccatgaaatgcgctcaaaaattaattactacaagaatatttagggatccgaaaatattgttgagttttaacaaaaatattttcagttttttttttttttgcatttttgaattaaatattaatatttcggcggttgatgctttaatttctgacttatttgttagtgaagggactggcgaaaaatttggagaaattttaagccaatggaaaaaatccaaaattaaaagagcatatgacacaaa

SEQ ID NO: 2133 - DNA, 1732 bp, Heterodera glycines
ccggcaggcgccgccgggaaaatttttgaaaatttgattaaaatttgcgcggcggtgccgataggcgccgccggggaaaaaattggaaattttgatcgtttataaacaggttttcactgaaaattagccaatttataggtaaaatttttaaaaatttttgggaatttaatccaattcttaggggtgcaaaagtcgcttttcgggccaaaaagcgaaatgcgaaacgccaaaaaatgcgaataatgcgaaaggcgaaatgcgaaacctaggcacatccctgctggacaccctgttcccaaattttttttggaaaattttaccacaaaaaagacagtgtaaaaacaaaaaattcgccgacagggaaaatttaactaaaaaaattcacggtcacggtcacgaaaaccgtgaatttcacgggttttttcagtcacggctcacctctagtatttaatttaaattggaaaaattggcaatgtgacgatagaaccgattataaattttattaaaaattccaaaaatatttacatattttgtacgaatattttttaccactttatgttgaagttcatcagatttttgtcttttcatgagctcccattggcctgaagcgcacgaaaaagctgttggttgataagctattttcgagttattagggcctatgctaggcgtgtccgggttattgctgggcaaagctcggcttagcacaatgctcaacagtaatttctatcagataatattatgtgataaaataatatagttaaaaaaaagatgctgaatggaataatacttagggaaaaaagtcaaataattcaccatctgtcgggcggacacgaacccataaaccgccattttaacataagtaaaaaaagctcatttttaaattatctgctccacatttttaacatattcacaccagaggatttatacaaataatacaaaaggtggcaagcatttggtgaaaacataataccgaaattgtttggaacaaattacgccttaaatgggtcacagttttaatttcaatttggcatttaaaattcattttgattttcaaccggtccaattgttatgtcttgtcacggcattcaatgcaattggttttatgtgctgttgttgttgcgcattgctggcggattttttgatgccaatgctcaccaaaagggcgttaatttcggcacggtataagtggctaaaacaagaaaaataagtatttatgaagcaaataatttattagaaaaataattaaaattataaaaaaaatattattttacaaaatattagtagacaaaaagcaaattaaacgaataaatgtattttaaatcgtaaaatgattattaataaatcattttttagctttacttaaaatagtaaagcgttggcgcatttgccgacgccgtaacgcaggagcaaacggtgctgaacccggcactgatataagtggtcgtaatcggcgaaaattgggcaaattttaaaaattgaggaagataaattgtcggaaaccatccaattgtctccaaaaagacgaggaaaagcaaagagcggaaaatgctttttgagaaatgttgattttctaaaaaacattaaatactggcaattaaagcacctaaaatttggttctgttcggttttaagcgtcccataaccattttcagcattccaatatttaataatataaaaaaaattctttaaagtgttgatttaatatgttgattgtgtggaccccagccaacccg

SEQ ID NO: 2134 - DNA, 1447 bp, Heterodera glycines
tttcaacaatttctctttttcggctccaacaattcgtttcatcttcgaagctcaattcccatcttttatcttctttcttccatctcattaatcaccgccgatattcgtcgcccaaacgtttcgctattcgtttttcggcatttttctctctttttccctccaattttcatttaatttcatcttttaattagtcatcatcaatcgatcaaatcgctttaatatctttaacgctctttcctcatcccgaatatctcgttttcgattaatccaaattctctttctccatcttcgtaaattttcttttcgatttatacccaatttttcgagcaattttcgtttcaattttatttccattcttttcgttgaataattttcttttcccatttgcttaacttttctccttaattttgtgaaactcgtccaccattttctctttttcttttttattcaattcggcatttcgaaaaatcatcagaaagtccattatttggttggaaaactaattatttgtctgggtttttacaaccactgatgttcaagagtctcggtttcacgactcgactcgagaaaagtctcgggtttttttggtctcggtctcgattttcctaactcgagaccgagatcgagacattcacaaaagttcaacgaactataatttgataaatggtgcttattcgtaaaaagaaatttaaatagtaaaatttttgtgagaaaaaaacattttaaaataattgaaaaacaattgcctacaataaaatttacatcggaatatttaatttttttaaatttttaactatataaattttataaaaacttttattactaacaacttttttcatgacaaagtttaaaaaatgaaggcatttttaatgactttcaaccaaatttttttcaaaaatcacaaatttacaattttataaatttaatgagttcctggtaatattttattaaaatatttttccagccttttttttgattcttctttcaaattacaaaaatttatcaaacataacaacacattgactaaaccctgaaaattgaaataaattctcaatcattccgtattcagaacgccttcactttttctcttgaattccgctttatatctttctaaagatctttttgtaatatttaaaatttccgcaattttgcgatcggtaagctttggattttgatttttcaattcaaaatattgtttcatcttctccattttttcgacaattgtataatgcttccgccctttaatatttaaataattaaattaaaaattcttttaaaaaatttcaccttttgaaatattttgtttaatgccgaatttcttgtcccattttttcattgttctataataaatccaaatatttgcttaatgtttgctctaaatctttccattcttttcgtgaatgtttctcattttgcataaattcattttttaatttaaaatattttt

SEQ ID NO: 2135 - DNA, 1515 bp, Heterodera glycines
  misc_feature (1504)..(1504): n is a, c, g, or t
cattttgcataaattcattttttaatttaaaatatttttcaataatttctcttttttcatcatcaatttgttgatttttcaaaggttttccattttttaattgtttcttccatttataaatactgctgatatttatgcccaaatgttttgctattatttttttgcattttttcttttttccttccaattttccatttaatttcatttttaatttagaatatatttgatcaaattgctttaacattttacgtctttcctcatccgaatgtctgtttttgattaatccaaattctctcttccatttgtaaattttctcttgactgacgcccaatttttttgcaatttttctttcaatttttttccattctttctttgaatatttctttcccatttgcttaactttctcttttattttatggaatttttcaacaatttctctcttctgtttgtcatttaaaattcgaatttgatcataaatttgtccattatttgttggcattggcaattggccgcccaattcatcacaatctgtggacatttcatcactctcttcttctttcacttccaaactttcatcaaatttttgattaatttgtagatcatttggccctgcttgaatattctgatcaacattttgtccttgcattatttcatcaatttgacaaatgttttcttctgttctttcgtcccatttttggccaaatatttcatcaaaacttttttcttgatttattttgccagcctcaatttggtcaattgcattttctaatattaaaacccgtaagaatataaatattaataagattttcattattttttttgtaaaaataaaatgaaaagatttataacaataatattttataaatgaattttgtaattattcattttttcatatggctagattattcgatcaattattaaccacatttagtcatttatatcataatatgatgcatcaattacatatattaatataattaaattatattatatctaatacagctatcaaatatgtcaaattttggaagataaattttttatattttggttcccgtttttgacctagggtaccacaacgaccccccaatatttttgaatttatgattatttcgaattttaataacagtttggcaaagtgtaatgaacataaacccaaaaatattcgcataaaataaggttacgcgggtccggatacccaaccgggtccagacccggatacccggctttttcaagacccggactcggtacccggacccgactttttgattctgttacttctttctcaggttcaattcttccacatgtcggcctcttttaaaaaaattataaggcttttgttgaaaactcttattttatggattcaaacccaggtttaaaaaaaatgaaaatgggcctaaacctacgtaaaaaaagctcaaaattttttaaagaaaaaactttatttttaataaataaaaatgtacaaaaaaaaatttcttatatttttttatagtatccaaataantgcttttgaag

SEQ ID NO: 2136 - DNA, 3497 bp, Heterodera glycines
  misc_feature (3456)..(3456): n is a, c, g, or t
aatgttttgctattattttttggcattttgtgctttttccttccaatttttcatttaatttcgtttttaatttgccatatatttgatcaaattgctttaacattattcttttttcttcaattgaatgattttttttcgtcatcattccaagttctctcttccatttgtaaattttttctctatttgtacccaatttttttgcaatttttatttcaatttttgtccattcttttcttgtgaatttctttcgcatttgcttaactttctccttaattttatgaaatttttccacagtttctcttttatttttatcaattgcttttgaaaaattatcataaatttgtccattatttgttggcattggcaattggccgcccaattcatcacaatctgtggacatttcatcactctcttcttctttcacttccaaactttcatcaaaattttgattaatttgtagatcatttggccctgcttgaatattctgatcaacattttgtccttgcattatttcatcaatttgacaaatgttttcttctgttctttcgtcccatttttggccaaatatttcatcaaaacttttttcttgatttattttgccagcctcaatttggtcaattgcattttctaatattaaaacccgtaagaatataaatattaataagattttcattattttttttttgtaaaaataaaatgaaaagatttataacaataatattttataaatgaattttgtaattattcattttttcatatggctagattattcgatcaattattaaccacatttagtcatttgtatcataatatgatgcatcaattacatatattaatataattaaattatattatatctaaaacagctatcaaatatgtcaaattttggaagataaattttttatattttggttcccgtttttgaactagggtaccacaacgaccccccaatatttttgaatttgtgattatttcgaattttaataacagtttggcaaagtgtaatgaacgtaaaccgaaaaatattcgcataaaataaggttacacgggtccggatacccgaccgggtccagacccggatacccggctttttcaagacccggactcggtacccggacccgactttttgattctgttacttctttctcaggttcaattcttccacatgtcggcctcttttaaaaaaattataaggcttttgttgaaaactcttattttatggattcaaacccaggtttaaaaaaaatgaaaaaaggggtctaaacctacgtaaaaaaagctcaaaattttttaaagaaaaaactttatttttaataaataaaaatgtacaaaaaaaaatttcttatatttttttatagtatccaaataatgcttttgaagaattgaaccttatgttccttttataaattgtatatttttggtattcaaattcaggtccggggttcggaattcagagcaatgttgttatggaatttctttttcttacaatactttatgccacagaaatttatttcaaaatattattcactgatgtggagaaccccacaaaaaattgcacaaggtagtgccaacggggccccagtcagggatggtcgggctcggtcgttgggtcggaggcaattggtcgaacacacaattcacacaacattataatgctttattgttccctctcaaacttgggtaattaaaccttatttaaatgtgtcataaaagaaatgccgttccggcgatcgattcacttctgcatcagcaagaaagacaagcggggctgctaacggcaaaggaattggaaaatgccgaaacatggattttgttggaaacccaacggcttcactcgcccacagaaacagccacaaacaatttaaaattgtccagctcgagctccatcgagccactgagatgccaagggcgattggaaaacaccgatctgcccaacgaaagcaagcacccgacctttttaccggcagaagcctggaccaccaagctcatcgttatccactacgatcgggcgctgaagcactgcggcccacggacgcttctctcaaaactccgagagaagtattggataccaaaaggccgacagacagtccagcacatcctcaactccaacaaattcggatgtttgaagtgcagacgggagagactcaagccatacgcttatccggacgctcctgacctgccagaggagcgagtcacggaaacacaacccttcaatcataccggagttgactacttcggatcgctgaaagtcaagcaaggaaacacgactgtgaaagtgtatgtggcacttttcacatgccttgtcatcagagcgattcatctcgaggtagtcggggactactcagctgaagcatttctgagagccttccggcgattttctgcacggcgcggcattcaagtttgatgatgtccgaccaagggacaaatgtcaccgccggcgccaaaacgatccaagaaaattggacagcgcaattgttcccaaatgaaatcagtggacaattggcacaccaaggagtcacatggctcttcaacacggcacacgcaccttggcgaggtggtgcctgggaacgacttgttggcataacaaagaatgccttacgacgaagcatcggttgaaatctcctcacgtgggaggaattctgcacactcaccgttttggcgaacaaacaattttttattgggggagaaaaatgggcggacaatttcgcacagttgcgattgcggaggaaaaaagtggggcaatttgcggcggagggaaatttggggaggaacaggatgtggaacgggcggggaagggatttaaaaaaacacgggagggaaatcgatcagtcataccatccccttatcacccacccccttttacatcattttaatgctaaaatcaaattttgattttacgataatttcgacactgacgcattttccactgacgcattttccggtcacgcaattttactaatataacatatatataataatgactgattatttatgatacccaatctttcccaattctccattggaaaattaaaattccaattaattgaattagattattaaaataaaacatgtgtatcatattgatgaggtttagtaactttttgttaaaaaccggaattgattgaatattagccatgttgaaaaataagtaattaattaaataattcattgcaatttacaatggaaataaaaggtgaataaattttaatttataatcgatctttttccatgtgaatatttttagatgaatttactattttaaatttatttactcgaattaaaaaaaacttgtgttgtgtagtgtgaattttttatatatttaaaatttacgccaaaatgatgatcatttattattatgctgtattgcccaagttgtgtgcatttaataggcaaaaaaccctcattttggatcaaaaagcctcatttttacaaaatttattcaaaaaacactcctanaatattcaaatgttatatttttgattgtccatcagtgatgt

SEQ ID NO: 2137 - DNA, 3788 bp, Heterodera glycines
tttttttgtaaaaatataatgaattatttttgtaaaaaaatatttttttcgtaataattttataattattaattttgtatcctggctaaattcttcaatcaataaccacatttagtcatctatcatcaatacgatacaacattttaataataattcaatttattattatattttttttctcagcgaatattggaagtaattaatatgagctaacaataattaagcggggttttaagtctcttatcacaaattaacaattttttctcatctgatgtaatctgatcaaagattcaaccaaatggaaatgaatttgaacagattttatgcaatttattgccataactgatacgtttaatgatttatattttattacgtttaatgatttatattttattttttagtttattttcaaaagcatgtaattatgtcaaatttatgatcaaataaaatcagtgtcaaaataaatgtcattatattagtgatcagcgaccatgaaaatactaattttaaaatttattaaagaaacgagtttttattaagagctttcccatcaatttttgcagaaaataaatgatttaaaattacacataattgtgtcattctgagaattatcaagaatcatgaggtctttctgagctgccgacaggcgccaccggattaaaatttggattttgcaaattttattaattaaattaaaaattaaaagaactaataataaaaaaaatccatattaaaatagagtattgaacttataggatgtgggaattgataaaaaagagttgtattttttttggcaatttcgacgaacacgacaaattgctacaaatgtttcgataaaaattagtcataatttgtagaagaaaaattactcaaaaattatttaattcattagggtaagtaagctaaactctcgaaatgactaaggaagaattgagaacttaagagtttaaaccttaattagatgccaatattgataattttaattccatctacaaaaagtttatttttcacgaccctcaaactgactaccaaataaatcagtattttccattttaattattttaaatttaactacccaaatggtttattgtatatcccgatttatctaatgttatactgtataccattttgcgctttgaattttggcatttatttatgttttgagaaataaaatttaaaacacatttttttctaaaatagtgttgaattttaattaaacaattcatttcctctcgaaaaattgtggtggttttattggccttctgtcgtattcaaaacatttccactttttccttaaattcggatttgtattttattaaggacattagctcaatgttcaacaattcggcgattttcacatcggaaaattttggagtttcctttttcataagataatattgcttcattatttccattttttcgacaattgtgaacctttttcgctctgtaatatatttaaattgaaaaatttattttaaatttaaaaataaaagtttaattgaatttaccttttaaattattttgtttaattcctaatttcttggcccatttttcaatcgtccaataactcacaccaaacatttgtttaatttttgcattaaatgccttccattccttctgcgaatgttttccattttgcataaatttaatttttacttttaaatatttttcaacaatttctcttttttcatcatcagttttttgatttttcaccatttttccaacttttatttctttcttccatctttgaatactgctgatatttgtgcccaaatgttttgctattattttttggcattttcttccttttccttccaattttccatttaatttcatttttaatttgccatatatttgatcaaattgctttaacattattcttttttcttcaactgaataattttttttcgtcatcattccaagttctcttttccatttgtaaattttcatttgatttgcacctaattttgtggcaatttttctttcaattttttgccattctttctttgaatatttctttcccatttgcttaactttctccttaattttatgaaatttttcaacaatttctcttttctttttattaattgcttttgaaaaattatcataaatttgtccattatttgttggcattggcaattggccgcccaattcatcacaatttctggatatttcttcactctgctcttctttcacttccaaatgatcaaattgttgatcatattggttctgatcaactgtttctccatgcattatttgataaatttggcagatgttttcttctgctccgtcgtcccatctttggccaaatatttcatcaaaacttttttcttgacttattttgccagcttcaatttgatcaattgcattttcgaaaattaatgcgcataataataaaaattttagtaacattttcatgatgttttgtaaaaaaataaagaataattttcataaaaaatgtttatttcccaatgaatttgtaattattaattttaagactggctaaattatatattcaatcaattatcaaccacgtttattcattatatcatcaatatgctacaacattttaataataattcaatttatttatattttgcttttctcaacgaattggggagtaattaatacgagataaacaataattaaggaattaagggggtttttcatttttgttctatttgatgtcatctgatcaaagattcaactaaatttaaatgaatttgatcggttttataaaattaattgcatttatgtccacctgcttactgattcgtttcattattttaattttatatatttttgaaatgcatggaattaagtcaaatttatgaacagatgaaatcagtgccaaaataaatgttataatagtgagcagcgaccctgaaaactctaatttgaaaatttattctagaaaacgttttatttgtgtttccattcattttttgcaaaaaaaaagacttaaaattacaaaatcttgtgtaattctaaaaattatcaagaatcataggtctgacggagctgccgacgacagaaaattggaaattttgctaattttgttaattaaattaaaaaaattaaaattaagtaacaataaaaaaccaatattcaaataggttgattgaaatgtcctttgtatgtcactaatttttccactaaaatcctcatggatcggattcggtgatcgcaaaattgtcggggatcgtgggcttggccccggtcggggaatggccaaaaaatatttttcaacaaatttttatatattttttaaaaattttctaggtatagagcagggcatgtccctgctcggcgtattgctttataacagccaggaaattaattacccaattttgccttctcattataaaaatgttaaaaagattttggaaaatttatcaaaaacattagaaaaagttcattgttcatgctaaacttttagagaaacaacaaacatttaaagcatttgttcatatgcataagtggtcaagtggctaaaaccttctgattttattatttctcgcttgggttcaattccccactgggatagaatattcttcatattttctttaccattattttaattgaaatattaattaaaaaaaatattccaactttttttctttcattttaagcatcctaaaaacctaaaaattaatcaattggtctttttttacaaattctgttaacaaatcgcattaaaaaatacaaaatttttcccggcggcgcctatcggcaccgccggccctccttgttccccaaaagtcttgagaaaaacgtgccgcgaaaaa

SEQ ID NO: 2138 - DNA, 2472 bp, Heterodera glycines
ttaaaaaatatagaaataaactaaaaacagtttgaattccctcttgaatggttaaaaatttaaaaatttagcctattaaacattttttaaaaaatttattatatttttttttgaaaaattccgacttccgagttccgacatttttggggtcggaattccgacttccgacttccgaaaatttttgggccatcggaattccgacttccgacttccgaaaatttttagtgcctcggaactccatccctggtaagtaccacgggtaccccctccccctggtattgtccctgcaatgtactaagtaatcaaatcggattaagaagttttaaatttacctaaaaattaataattaatagatcaaaattttccaagaacccttcatttttacggtaaatttaaaaatggcataaaaatacaaaaatttgctaaaatgccgcacatattctgaacaattagcgcagcttcggactgcagttgttgttgttgttgctgttgattttgttgttgcggatcatcaaaatgtacaacaacagcagcagttgaagcagcggcggcggcggtttcgatgacggtggtcgtcggtggtggcggcgaattgcaattattgacgaatggttcttcccccgggggcagcggcgacggcggtgatgggaaataatcctacaaaaaatttgggcgattaaatattttttattcgttgataagcgataagattatgaatgaatgaatgaatgaatgatgtgtatttggtattttataaatgttgctagtgaggaaaaataatgctttttcctattaagaaataatgggtggggcaatgggaaaatgattgaaatttttggaatttttaaaaattaaatcgaacataattcaaatttttggaatttcccaaaaaataatcgtagataatttaattttttggttattaaattaaacgtacatatcaagtagtgatttcacaggactgattgagtgatttctaaggacataattgtcaaaaaaatatttttagaattccttcaaaaattccactaatttctttaaattgtttaatttttcgccaaaatttaatagttttgtattttattgtttgcaagaagcaaatgttcgcgaaatgatcaaatttgttaaaaaaaattccattcacaattcaacatttacaaacacagcagacacagtgctctgcgcacagaagcatgagctatgcatggattttgagaaaagggattaaaatgttcgagactctcggatcaacgaacgcatcattaatgcaattagaaaaaaaatagttcgctgaaaatcaaatggctatggtgggggggggcagcattttaatttataaattcaaatattaatgggcacccttttattattgtaattaaaaaaatgcgacacaacaaaatgaaacaggttcccgtttttaaaggcacgccttttttaagggaaagacggagaaaacaacaagcaaaaaattttgctcacaaaatgtcccctctctcattaatcgcctaattattcaatttccaaccgttttgcgctggctgcaacattaattagtggacaaaatatcgttgacacattgatgagaaatgggggaacgcgaataaatgagaaaagggcggcacataaaaatttgtgcgcatttttgcagcataaaaaattaataaaatcacagcagtggccctctctcattagtgagaaaagaaaagtgaaatttttgagtgtcgttgcaaaaaacaactcgccgctaattgggcaatgtgtgaatggacaattagttttttattttttaaatttaatttaattagtgaacaatttcataaactggaatcaaatttggttgattgcttcggcccacaaaaaattgatgaacaggctttggttgcttaccacgtcaaataaaaataatggactttagtcgccaaaaattatgcgcgatggtaaattaatttggtcatttttaaaaaataattgtaattcaaggaaagggggaaaatctttgatcacaaaaaatggaaagcagcgtataattttgaaaacttacatttggaaaaaaattcaaaatttttgagagattgaagagcgaagtttatgcgttttaccacccaaaaattttcgggtttacgcgcatgggagtgtctaactgtggatagtggacaaccgaagttcgtggtcagtatgttagggcataggatagatatggaccgcgataagccccgaaaaaaagtcgtgtcgggcactccgtctataaattgactaattatttcactgatcggaattcatgatcaatgctctgaccctatgtgcctaaaccatctttaataggatgtgagaattctgagaaagaaatatggtttgtttgcatttcaatgcgaaaccgatgaggaaggcgagggggtgggagaatgggattggatatttgattctgggttgtgctgcgcgtgccgtggcaccccgctgggagatttgtgccct

SEQ ID NO: 2139 - DNA, 1915 bp, Heterodera glycines
tgaggaatgggaggggaaaagggaaggagatgtacatgcacacaaatacaataaaaagacgaaacgatgaaacgatgatgatgctggtgatgatcgggatggagatggatacctatgtgtgtacacactgtacacatacacaaaaggttagagtgtatgacaatgtgtgtgaagaacaacaagaaaaaggaaacgatgtgtgtgtgatcgatcatcattcgtagtttcggaatgggaaaaaatttttgaaaataaaaaattcaagccaaacatttgtgccaaaaccgttaagccccggaattttaaaatgttgggttcaaggtttgagaattgggtcaaaaacgggtatacatatgggatgaaaatgatgattttaagcattcttgggaatcaataaattaatttaagacggatttcttaattgacccgggtgatcaaattgtgaaagtgaaatcaaaatttttttaaaatgaaaaaaaattattagacggtggggacgattctttgaccaattgatttgcataaaatgcaaaaaaataaataaatgacggagatttgaatatggaaaggaaaaaggacagaaaaaaccactgctgaacaacaaaaattgtattaaaaataattatttcatttatttatccacttaattggcatatttttatctcggcagtttattccattgtatgaaagcgccatgggttcgagtctcaccggccgcaaatattttctacgtttaaatacaaaacaaggattttgtaatatgtataagcatcaaatttaaaatccgagttttccaaaaggaaaagcatgaggaataaagcggcgagggaaaacaacatacaattatatattcattcaatttaattggaggacgcgaaaacatcgaggagggggagaaaacaagcaatttgagaaaattagtgtagggaaaaattccaacatccccctcccccaccccggtgcttaaccttagaaaaacaaactcatccccccgcggagtaaagaagaaaattgctgcttatttttgtagcaaaagccgcttcattgccccctctccccccaacttgaagacgctccccccgtcctcccccatatcctataatcgccgccccccccccccggtccgagtgaaaagttttgtgtcacgcgtccacggcgaagcagcattttcggattaaaaaaacatatatgtagaggaggaggggagacttatgttttgtacacggaatttttaaaagccggtctttattaaaattgggcagaaaaatgggataattcgggatcagaattcgggaattttcacccgcagaaaccggattatatgacaaaaattctgttttccggattttttgatccgggtgcttgtttcagaagacaccccgctgatcagtaatcaagacccttggaatagatttcgagctccatttgacagagtcgggacaaggcgggatttttacctgggttagaggtaaaaaaagattttgtaaactggcaaaaatgaacaataaaatatgtaaaaaaaaaatagtaagtaaacagcttgaacttgaatggattgaaaattggagcatcacgatttggcaaaatgccaacatttacaaaaatgtgccaaatcaatatgggagcagtgaaagctgtttccacacattatgtgtgcgtgtgcgtgcacacatatgcacttaaagaagcgcttgatttgatcggacagtgcaaaggcagcaatgaatgaatgaataagaattgaggatggacaacttcgccctttcactctcactgtgtgttgagcgagcattttagagcattttgttggttgacgggcgggcgggataggggggagtggaatggttgttgatcgaggagcaaaatgagtgagtgcgatttgattgggggtaggggaggggggtgaggggggaaa

SEQ ID NO: 2140 - DNA, 5431 bp, Heterodera glycines
aatttttccaacgaaaaaccgcttaaataccatttttttaaataaaaaatcgagccgttttaccgtagtggcaaaaaattccacaccattttcatcttcttggaattgttgttgcattgagtgatggaaatgggaagtgttggcgccatctttgtcaaaaatgttgccgtgattttgctgctgcttttcggacggacgatgatggccccgttggcgatagcgtgccataatgtgtgtaagccaaaaataagacaaaatagggactgtaaaaaagaaaagaaacgggatttactgcttgtaatggctgatcgaaaatagctgtgggagctcaaattgctgtgggagcaaaaagacaggggccaaaatgaaggaaagatggccccataacaacagtcatccctccagtggtggatgtggtctagtggctaagacaacggatccacgtaaggggccccgagcggcggttcaaatccggccttccaccccaatttttcgcctaaataatactgctccgttttagtgtttaggattctcgaccaaaagaatttaaatttaggcccggaattttgaaatgaacgagaccgaaaccaggagtttagaaatggaccgggacgggggtttatcgagacaaaaaaaaacccatttgttagcggcctagtccaggatggtttgcttgcgcgccgggcccccggacccatccaggctgaggtttgttgtaattcaaactttttagaatgaaaatacctaataatagacagtatgttgaacaagagaagaccaaagaaagcgagaagaatagaacgccaaaatgttttcaatttaaatataatttgattgaattttttcattcacaattttttgttttgtgaagacactgtcgccaatctttttatttccgccgcgcgcttggggttgggtgggccaagctgaggcgggatggttcccgctcctcttcaccgctctcgtcccttctctttctgctcactccgctcgctgtgccgtaaagggaatggcgccctttttgccgttcgttttgatgggtctgatgctgctgaccgatccgatcagcgccaaagggggacgagaatgggaggggggaggggtgacaaagttggactggtgcttgagagaattgtgcagcaaatcgctgcttgcttaacggcaccaccgacaaggtttggggaagggcttgtcggccccctataactagacgagcaagagtctcggctagagattcatgcggcggtcactccgcttggcgggagttactctgccgaactacccagtcctgattatgggagggggggggggggggggaagaacatgcttttatgaccccgctgtgctacactgatcatttgtgatcgttgagaattgacgaggtgatccaaaatccgggttcatccataaagtagtaagtggagtccatttgatgaaatatttagtacttaaaggggaagcgtagaggaaaatgctctcgatggtcggagaagtcgagaaattcaaagaaaaatttaaagacaattttggggtcggcgcaataacataagcagtagataaaaattcatggatttaaaaatgtactgtatatacttttggggtactgtagtaagaaagtaaattctcgcttaaaatagaaaataaataaatttattaatttgaaaaaagagtgtactgtagaaaattctcattaaaaaaagaaaaaatggataaatttgtttatttgaaaaagggcactgtatgtactatggggatacagcagtgagatagtaattagaaaacaaaagcaattctcgactcaaaactcccgaacacccctgctggtgaaacctcaccttctgctgctgttgctgctgcatgtgctggctgttgaagaacctgtagcagtacacaccaccgatgcgcagttgaaccccgttttgcagcacgcactccgcatggattgaggcgccgtcaagttcgaccagtgcacttttgtccaacaacgaaatgccgaccaaaccaagctgtttttgttggtgttgtacatcgacagccccttgttgtactgcttcatcttctccttcgtattcttctgctggtgatgagttttgttgtttttgttgtgccgcaggcggaatataacggagcgcacaatggcgtggcaaaacactgggcgcacgcaactgaacgtaacgagtgagggataagtgagcatataaaagagggcacaaaatattgtctgtattttttatgctcgctaatgaccccacgaaattttttttacagtctagaaattttcgtaatttatttaaaaattacctaatttgatttttttgaaaagactagaggggcgatatattgtaaattaatatttcgggaatataaaactggagatcgaatatgggccggacccgtatatgggtttctattggcatgtagccctttttttttactgatacgggtttttacggaccgattgtgtgaacgatcacctccaaaaaagcggcatttattggtgcgcttttcctttgcaataaattagctacaatccttactccaatattagtaattgtctttgtccaagatttccggcatttgttcagaatgaaactcccaaggacatgataagtcgtccagcatttttacctgaatggtacaggaggatgatgagccaatctcggtgacaccgggctgaattgcgacagcacctggtcaagaacagcgaattattattttttgctattaaaattgcatttcattttaaaaaagttttcgccattacagtaattagaaggactgtcttaatatggagcatttcacttttggaaactctatgccgagaccgaggcattatcccgaggccgaaaccaaagaaatgaaagcggagcaggtcatttccccacaaaattttaaaaaaaattgaaattttttaaaaaattttccgtggagaaccggccggagggaatgaaatgcactcggatgaatgaatgacctgcgccaaaattggctgtgctagcgaacgcattgatcggcaccagacatggcaacagcagcagttgttgcaacgatgatgccaacgacggaggagaagaagaggaagcagtacatgaaaacaatgctgagggggagtaggactttgctgctgatggttttggtgttgccgatgccatcgtcgccatggcttttcctccccgctgttcggcatcacaaaattcgactgcttctgttacgagagatgaaacggcgccggtagaagcaacacgatcaacatgcttaatctcctcatccctaatgttgttaacatcattttctgccactgtacggctgttgtgccgttgatgatgatgatgatgcggtggtggcaatggtggcatcagttgtgggcgttgaaatgttgccggagggcgacaccgcaaaaagaacacctgcggagcaaaatttaaacaattaaattttgttttgcaaaaactgtaagtaatctaaacaaaatgacaaaatgtgtgtttggatgggtgagaaattttaaaaaaaattcttggaaatttataagaaatttcaatttcaagaaaaaaattgttgaaaaaattttcaaacgatttttttcaaattttttataataaattattattttttgaaaaaaataaaattttttaattaaattttcaaataaaattttttctaatttgtaagattttttattgagtctattactatagaattaatataatgatgtaaaattcaataaaaatttgttcgtccggaccacgttgttgttggtgttggcggtggtgttggccatgtgctgctccaacagttggagtggtcgttccaccgcgttcagcaaccgctcccgctgcttttcaatgctgcgcaaatcgctgaagctgcgcgacatggcatcggactcccgcaaaaacacctttttggagaattaataaaaattaaattcaattaaaaattaaattgcgttatataaatgggtgcagttttcgtttccactccgtaccgtttacccaccaaaaattaaattaaaaaattgctaaaaaattttcaaatatttttatttaaacttttttttgtacaaatttttttaaagttcaaattgaaaaattacaagtttgagaatttaaaaaatttcttattttttttccttcagtgttcttcttctaaatcgccgtcgggaaaaaactttttttgtaaatttttaattttcagttgccattaaaattttttatttggatagaaaagtgcgcagggcggaagaaatgtatttaaaaatgtaaaaaaatatttatttaattcaactaaaattcaaaaagattggaagaggggtaattgaagcttgcttgcttgtttcccaaaaaataaaaataaaataaaattccattttctaattatttaaatttggaaacgcacttcagcaaggccaaagttggccgtgcccgcctcctccagcccgtacttgtccagcgtggcgcgcacaacctgctccgcggtgtcggtggcgttcaccaacagagtcacatagggccgatgcgggaacagttcgactccgtaaatttgcaaactcccacctgttcagcagggtaaacaaattaattcaattaaaaatgggtaattaaaatttaaaaaaaaaattaatcagtgcccaactacaataattaattattgtaatttacaaatccgttaaagattttaatatatttttaaatcctttctaacattaaaaatttttgaaaaagtataaaaaaaatttaaaaccatttttttgaatagttaaagcaaaacagcgaaaagaacttgaactcacaaataaaccaaaactcactatttgtatttcaaaaaattttattgttagaaaaaaaaatttacaagaaaattcaagaaaaaaaaacttagtaattcataataaaatttaaaaaatcgctaggaaattgtttaaattttttttcttgaaattttcttatatttaaatgtttttattttaatttctcggcgggggggggggggacgagcggcgtcagcagggagggtgcaagccgattccgaattgattccgatttccggctttttttaaaggcttgcggtttcccgatttaggatttggaaacactctttttttctctctctccctctctctctattactctctacccctcctctatctctattactctctctctctctccctttcctctcactctttctctctctattactccctccccctcctctatctctattactctctctctccccctttcctctcactctttctctctctattactctctccccctcctctatctctattactctctctctccccctttcctctcactctttctctctctattactctctccccctcctctatctctattactctctctctccccctttcctctcactctctctattactctctcttccactgaccgctgttcat

SEQ ID NO: 2141 - DNA, 2523 bp, Heterodera glycines
ttttgatgggattgatcaagatacattgattttgtcatgatcaatctatcaggtatgtatcggcatgccatttccgacatttttaggctcagtattaacgactgccgtaatttttgggccgtaggaattttgtttttggaattttttgaggggcatcggcacatatcccctgctggtctagagctgtgttcagaaatccaaaaatttctcgattagagacctaaatatccgagaaatttctcgaatcgtggaacgaacaccgaacaacttaaaaaggcacacatcacgaacacaaacagattcacacacacctttattctgcaacagttgcgctctctttttccctcccccaacactcttcacactgccgcccaatggcggtgccgtcgttggtgtcactgttgctgcttgtcgccgcttggagaagcgtcgcggaacgctgcgcgtgaactcggcactcgccgccgcaggacgcaacacaaagcgaccgttacgcatcggtgacggcggcggcacacagcgctcgctgccgtcgctcctctccttgtcgccgccgttgtaacaacaccagcccagctggaccaacaacggtcgctcgtccgcgtccatgtgccgctcgctaacgccgtcacagttgctgccgcccgtgccatcgtcgtcgtcgtgcacctcccacagcgagtaggaagcgctcgccggcgtcgtcatgtgcatgtcgtccgcctctgcgtggaatttggcgaataacgcgtccaccacatgtgcgacggtgtgcatgctggacactcgcatgcattttgttgccgcggcacccgttgtcgtcgaagcaggggacgactgttgttgttgccgttggtgattttggagttgttcatgaagatggaagcggatcaccccgtggaactccgtgttctgcgagtgcgagcaataaacggttatttttttttagttaattcgatgatgaagccatcggagaagagcaatatgcttttcgtaaataaatcccgccccctcgaccccctcaagaaggggtgggcaaaaaatcacaaaaactcggtactgtaaacaaagaaaggccgaaaaacataatatgaaaatgtatcaatgactcttcagtcatttttttcgggtctcccataatttgccacaaaaagcggcaagttcaaagggtatttttggtttaataaccccccccccccctcccaacggcatgggaacacatgagcaccagcagaaaccacacctcgtcaggcaaactgatcgcgaacatgtccatcattgtggcgttccagcgctcaattgtctcacacagtttttgcctttgatgtgccgccgtcgccattttggacaaaacaaacaaacaattaattaaaagggttttacaggcaagaaaatgtgtcaaaaatttggaaggcaagaagagaattagtcaaaaattaaggcgatgatgatgaaggaagtcaaaaatatgcagaaaatattatgggagatcattgaacaataaggccactgaaaagttaaaaaaacaaataattaaaatacatacagtaacaattattataatagtacagtatctcgcgctgtcggagaattggacaacgaaacaccgcaatttcatggaacttttatatattttttatttcattttgtggaatatttttaatatatatatatatacacacataaaatatatgaattgggaaatgatggatttaaaaaaattgggtcccaattttggaattttttgggagaatttccgacgacgatagccccgcgattgcactactgctgctgtggtggatgatgaccgcataaacgattgtgctccatccacagcagccatgggctgctgctgcttgatgctgtcgatggggcggaatgatgcgcgtgaaatgcccaatttgcgcaatttgtgtctgtctgtacaagggaaaatctatttgaaaattcaaattttctttgtgtctatgcccagtaaaaaatggatgatttgccataaaaatagaggtacttttccgtttgggggccccacatttattttacttaaaaaatgtcaattaaatgcgcaatgaatattcaaaaacaacgcttcagcaatttgggagtcataaaagcaaaaatttaaaaggaaaattaggtgaaattaaaaaaaattgtttaatttctgtaataattttgctatacataattgcaatttccccgtggtgcaatatcaatttaattaacaattatttttgctttggccaacatatcccaactttttgctagccgtaaaaatgattattaaaagaggcgataaataaattgttttctcggggattgacttgttaaacaatgaaaaaattactctccctgaagaaaaaatggtccatcattaatttatttgttcattaaaacattttgtgcaaaataaaactaaataaacgcaaaaaaaaaacgaagattcaaaatgtaaatgaatgggatgggatgggatgacatggtttttaatcttcgctaaaaggaacaaagaaaggggggggg

SEQ ID NO: 2142 - DNA, 1833 bp, Heterodera glycines
aggggggggggggagaagaaataataaaaattcaaataaacaaaaaaaaagggggaggagagagaaagggatatgggtaaaaaagagatgaaaatttaaaaattgtggaggttttttggaacggggcgaagaaagaaaggggtgggcattcgagttcgaggccgacggacagccgatcgacgaaatggcgcactcatcatcattatcgtcatgatcattattatggatcggagagaagcagcaccactcaattaagcgtgcgggggggggggggggtagggaaaggcggcggatgaacgaaaatgagtgaacacggcgaatggagagggacggacggaatgatgggcaaatgtatgccgccctttacgctgaaaaagctgttgtatgccatgccaacaaaaaaaggctcgtcattagcatttgcagtctgtacccaatccaagccctcaaatcctgctgggaccgttcattgtggcaaggcaaaatttaaaacaatttgtattgtttttgtggcattggtagacatatttaattgccattcaatggccaaagaacaagcaaaaaaaagcattcaaaaaaggattaaagcaaaattatgccgaaatttttcagaaaatttggagcaatttgtgtgtagaacaacgatatgcaaatggggaagaaagaaaaaatggtgccatttgttagtttaggctcacaattttttttttaaatcttaggggatagaaaattttttttttttgcacaccaaaaaggacactctttggctattattagaaaaaagttttttaaaaaatgcaaaatccaaactaaaaactagcaaaatttggcatttagttattggtcaccaaaaagtgaaagtattaaatattgggaaaaaagcaggacccacatcaaaaaatggcataattaatggcaaaatttgtttacaatggctcaaaaaaatgcgaaatatcatttaatgaagtgagggcgcgagggaaaaaaacactttagcttgactctctgatccgaaaaattattcaaaaaaaaatcggggtaacttatgtaaatgaaaaaatagccaaatttgcatctattatataattcatcaaaatgtgaaagtgtgaatgggaacggaaagcaggattaagcatcaaaaaattgcctaattaatggcaagggaaattacttttatttgactctctgattcgaaaaactaattgaaaacatttttgtttttatgcaaaaaatttagtgtctgttttttatgttatcaattcctataattgtctattgttagaaaaaaacaccttctcccttctcaagcaatttcgaatgaatgccaaaaaagtgcgtcttattttggcagaaatacataaaaaagggttgactctccgacaaatgatcaaaaattagagcaaaagtttaaaatgttttaaattaaattaaaatgattaaaaattgaaaaaaacagcccaattaatgaaaggccagaggaaccaagcaagcaaggcacatgaagctataaaaaataattggccatcagcgaatttttactttacgctattgggacaaaaaactcaattatacaaaactcgaacgacgtaatatatttccgaatttttattgaaaaataaataaatgaattttaaaaagacattaattaactcacttatttaggtcggtgagaaaaaaattaataattttggaaagcgagaagggattcaggttaaattcaaaaataaataaataaattttcaataaatacctccggtattgcatgactcataatacaaaatacttcaaaatttgctcaaaaattgtcaaaaatgacgatttttagcacaaaaa

SEQ ID NO: 2143 - DNA, 1313 bp, Heterodera glycines
aacgtttttgctgagacttcttggtggttcgccaagagtttgccaaatgaaaagttcgaactttggaggcgaacagtgagcacataaatgatcctgtaacgagaaatacccgaattaaatggataatatttttaaattttactcaattctcaatcatttggctcaaattactaaaaaggcactgccagatccgaatttcttatatttttgccaaaatttggaacaaaatgcctaaatttggcgaaaatggctaaaatttccctttttgaaaatatgaaatttaatccaaaattgtaaattaatttattaaatattttaagattttttttcgaataaggacaattttgaaaataaattattaaaaaaataataataaattaattggaaaattgttccatttcttaggggtgtatttcatttttgttaaagaattttccgaaaattctgaaacaggcattaaaaatggcgaaataggcacaaaaataggcattataattccccgtagacagcccaaatagctaaaaacgcgcttttcgtgctcaattgtgcgtattaaatttaggaatttatcaaaaaaatgacgctctacaataattggccaaaaacgaaataattggccaaaaatgagccttctttttaccttttttgttaatcaaatttcatgtggcaattagagcggagagctcatttatcagcgatcagccaagggatatgaatggctggacgggcgccggacttttcgacagtggacttttcgacagaggacatttcgacagaaggacttttcgacagcaaaggacttttcgacagaaatattttaaatttaaggaggggacttttcgacagtggacttttcgacagtaaaatgtaattaaatttcaaatttaggggtgtaaaatcttaaaattttatccaaaagcaacaaattaagtcaaataattattgagatacataatttttaaattcaaaaattcttttcaagaatgtaaacaaactaccacgtagatgcagttgcttcaatattccatttactgacacgaatacttatgaatctattgatccacgtgtacgggtggggtactccaacaattatggcgagcgataatccaacgcataattaaagtacatgctatagggaagctattcccgaaggattctgtctccccataaatctgggcgcatcggatcggggggactgccccgaaaacaaaaataaatcgattttttcaagtgtccggttggggtactcaaacaattatggggagcaaaaatccaacgcacaattaaagtacaggctatagggaagctattcc

SEQ ID NO: 2144 - DNA, 958 bp, Heterodera glycines
  misc_feature (939)..(939): n is a, c, g, or t
  misc_feature (951)..(951): n is a, c, g, or t
atcgttaaagcccaagtggcgaatgttttcagaaaaaattggccaaatttcacgaacaaaaatgtcccaaatcagctgctggccatccgtgttgtgtggtgatgaaagccacaaatataaattggtgcctcttttgtcgaaaatttggtgatttgaacgaagaaaagcgatgacgaagtgatcgatgtaactgtgaaaatggaaggaatgcttttattgccataaagctttgatttttaattactaaatccgaaggtgattaaaacggattttgctggtcaacggataatcgggcaatggaaattccacaattttgtcatccatccacacagatagtttcggttctggtcctttgtccttgcgacgaattgcgattggtctccaaattgtcaattcgcttttgccattgaaatgtttgtccaccaacgcattgaaacgtggcgaaagaagtgccaatttgaggccgagttgaggacggtcaaaggatgggaaaatgtccatccaaacgtcgttgcaaatccaactgaaatggaaaaacagtttagtcaaataaacgacgaatttgtgacttttaatttaattaccgtcggttcatttttggcaattagcacaatttggccgagttccgaatgatgtcacacaaatagcagaagaattaattgcgttggaaactttatttttatataatgagaaaagcggaaaaccaaaaattctaacgaaaatcacattttattcaacaatttttgaattttgtttgccttaaattgttgcaaatgggcccgaggggttggacaatatgccaatggaaggcgaaaaatcattgacaaaaagcgagcagaaaaagggaatggcagtgctttggaatggaaggaacgcaacagaggagaatatattttgcaaatgatgacatttgcccgggcgttttagcccctacccccnaaatcatcatanaaaatca

SEQ ID NO: 2145 - DNA, 1664 bp, Heterodera glycines
  misc_feature (1606)..(1606): n is a, c, g, or t
  misc_feature (1628)..(1628): n is a, c, g, or t
ttatagttttttcactatttttttcctgagctcccagtagcctggaatgcacgaaaaacatgttttttcggctgttgttaatctacttttcgagttattagcaactattttctagtttttaatttttatcaactaaaaaactataaaagttttgaaaaaaactattttcagaatcgacttaaaaatttttttcaaaaaatgcacccttaagaacctacccgaaatttttcaaaaatgcacccctaagaaatgaaaaatttctcaaaaattcaactccaaatttattatttttttttgataaaaatttgtgattttaaaaattatttagctcaattttgatttggcttaattttgttacctttttgattggagtccgactttatgaattgtaaaaagcttttcatttttattcctaatagatttgacaaaaaataatgttctgcgcctctgtctctgtccccaatcggatggaattggccaggaaattggagtcaaggggtaattaatttggagttaaatagggtgcatacagtaattaaactaataaatttcaagggatactgtacgttcgtcaccatcagcagttgaaggatgctttgtgtgggcaaatgcattttgtccttttcagcaataaaccgaattccacgcccgacatttttaagcagtttttggtaaatttcatttcacaatcctatcgtatatcgtaattattttttcgtttgtttttcttttagttggctcttcactttttgttcgaattggccgaagcgcgcatgaactgtttgttcgtggatttggagctgttttcggacgggcacaaaaagatggaaatgccgaaagtgatcagcaattcgttggacgtttttccattgattggggtccaactgatcaaaatatgtggtgatcagctggttacagccgattgggtggccaaagaggctgaaacattgggcgtatgcattgcgcgggtgggtgaaaaatatttggacatttttgattttaaatgtttataacgggcatttttgttaattgctattttaaatgttttatacactcttccaggcctctgatgaccctaaaaggatcccttctcctgttgatcaacttttgtggccctgccatttgccgtgtccccgtgccaaaaaatttggcggcaaatgccgagacgacgacaatttttgggggtgtgaacaatgcggacagactttcaaatttgcgaaacagaatgagggcaaagaaccgaatgtgagaaagtgccatcaacgtataagtcaaatgaaccgaaaaaaccgaaacatttggccattttaattagtttatttaaacagttcctcgttacaatggcccattgaaatggccccacttctctcgtgtttaaatcactttaatgccattcaattccatttgatcatttgcttccctctcccaggctccgatcactcatttgttctgcgactgcggtggcactcgcgtcgatcgcttgactttccgttgtgccttttttgctgaccatggcgttcacttccacgcctttacgacgctcgatttgctgaacagagaattggagcggcagagcaaaaaggacatagtgaagaaccttttgctngtgggcaaaaagggcaacgtcnaatcgacactgatcaacgcgatgcattttatgccca

SEQ ID NO: 2146 - DNA, 5659 bp, Heterodera glycines
  misc_feature (13)..(13): n is a, c, g, or t
  misc_feature (28)..(28): n is a, c, g, or t
  misc_feature (37)..(37): n is a, c, g, or t
tttcagcaataanccgaattcccacgcncgacatttntaagcagtttttggtaaatttcatttcacaatcctatcgtatatcgtaattattttttcatttgtttttcttttagttggctcttcactttttgttcgaattggccgaagcgcgcatgaactgtttgttcgtggatttggagctgttttcggacgggcacaaaaagatggaaatgccgaaagtgatcagcaattcgttggacgtttttccattgattggggtccaactgatcaaaatatgtggtgatcagctggttacagccgattgggtggccaaagaggctgaaacattgggcgtttgcattgcgcgggtgggtgaaaaatatttggacatttttgattttaaatgtttataacgggcatttttgttaattgctattttaaatgttttatacactcttccaggcctctgatgaccctaaaaggatcccttctcctgttgatcaacttttgtggccctgccatttgccgtgtccccgtgccaaaaaatttggcggcaaatgccgagacgacgacaatttttgggggtgtgaacaatgcggacagactttcaaatttgcgaaacagaatgagggcaaagaaccgaatgtgagaaagtgccatcaacgtataagtcaaatgaaccgaaacatttggccattttaattagtttatttaaacagttcctggttacaatggcccattgaaatggccccacttctctcgtgtttaaatcactttaatgccattcaattccatttgatcatttgcttccctctcccaggctccgatcactcatttgttctgtgactgcggtggcactcgcgtcgatcacttgactttccgttgtgccttttttgctgtccatggcgttcacttccacgcctttacgacgctcgatttgctgaacagagaattggagcggcagagcaaaaaggacatagtgaagaaccttttgctgttgggcaaaaagggcaacgtcaaatcgacactgatcaacgcgatgcatttttatgcccaatttgagacatttgaagacgcattacaggtgagtagtgagtgatctgttgctgattatggcaatacaatgataccatacaataataccgtaatgtgagaatgggtggggccgagacggtctcgtgactgatcaaaaatgtgaagagaattacggaaaaataagctaaaatgccatcttaaagttatgctggggctatcaatttaatgtaaatacaatttttcatggcttctttatgctctaaataataggaaaatcattttcttttttgtatttactaacaaaaatcggcacttttatttacatattttgtgatttttacatattgttataaatttggtacatattttgtgcattatttttgagagccccatttatgtcttattcaatatctaatggaatataaaatatatttttgtgtaaaaccaataaattgcttggcaattatttttatttgcaaattaagctggccacacttgccgatttcaactccgactctcttgcccctgcctcatactccaaaagcatgctacaaaacggcaaacatgtgaaaattgaggcgaaattgggaggagataccagccgcaaaactggccaatcgcagacccaaatctccgcagcatacgttattcaaccagttgaaggtcgtggtttatgacaattttagctacagtaccctttttgactgtacggagaaacgagcaaaattttactatttgaattgttagcataattttgtttcctattttaagtgtttaggacatgccaaaaattccatctctgtacaattggatttaacagtcttaacagttttttagacggacaaacctgttgtgtcattgacacgcctggcatcgacatggacaaccaaaacatggccaacacgttcggcttcctctgtgagtttgatgtgttgcacggcgtcggcattatgatggaagaaaacgacaaccgtgccactaatccgtttaagtactgtatcaacgacggctttctgtgcaatctccacaaaaatggggcaccggtatgagtttggcacaaatacccaatgaaaaatgccatacaactagcccaccttctaattgcagaacatcgtttttctgatcacccattcgtcgggctcgggaaaggccatcgacgtggtgggcgagctgctggaagaggttgaggaaaagaacggcgtaagtgcagctgtttacagcatttgaacaattttactattcttttgaaaattaagtaatttttcttaaatataaaagaaaactcagaaaaatgctaggggtcttttcttacagattttttatgttttgatttaaaaaaattaaatctctcggcgggacagcgtgcaccccaatcacgccgccgaaatcacgccgctcaattttttaaaaatttttcaaacagaaaattttttatacgaaaatgtcaagaaaaaaaatttaaaaattttctgcgattttttttggaattttatgataaattactaaaatttttttcagaaaatttgccaatttttttttaaattttcgtataaaaaaatttctaagaattttttctagaaaaaattccaggttcgaaaatttttttaaacatttctagtgacgtgatttcggcggcgggattttgtcctgttcctgaaaaacatttgggggaaggaaattatctgttctgcttcataagcgcagcaggtcctcccccccccccctttcacgaaagaaaaaaataaatgtacagtaaatttcaagaaaaaatcgaattattttcagcgatttttagaaaaaattttttgaattttttctaaaaattatcttcttttttttttgaaattctgttatttacggcttcatcccttccgattttctcaaggtgaaaattccactggacgaaagcaacattttatgcttcaacaatgccccgtttgaagcactttgtctgatcaaaatgaagggtgtcacttctaatgaaaaggaaatgagaaaattctccgaagaatgggccgaatcagtgcagcaattcaaacggttgttgaagcatttggccactgtgaagccccatttgactcgggaaacgttgtcggtgtgtgccgcgcgaagtgccatcgtcaacattataccaatcattgcgtcaaacgggaagcaaattcaagtgaatcacacagacagcctagaattatttaaaatgccgaatttcaaatcattcagaaaagcatcgcaaagttggaaatcgaagaattggaaatcgcagaatggacaaaaaccattggcgaggataagaagaaagccgacattatgtttgacaatttcatgaagaaggaacttggtatactccgcatgcttttgcactccggtgagttttggggtgcaccccaaaatcacgccgccgaaatcacgccgctagaaattttaaaaaaattttcgaacctggaattttttctagaaaaaattcttagaaaattttttacaagaaaatttcaaagaaaaaaaaatttttttggaaaatttcaaaaaacttagtaatttatcataaaatttcaaaataaatcgctgaaaatttttcaaaatttttttttcttttaattttcttaaaaaaatttctaagaattttttttagaaaaattctaggtttgaaaattttttaaaaatttctagcggcgtgaatttgtcccggcgtgatttcggcggcgtgattttgtcctgttcccgagttttgtctaatggaaagagggggggggggatgcgatgaagcagccagcaggggtgaatttctactttttgttcaaattcatgttcgtgagccggaattgatacataggaatgggtgtctttggtgatcaacgataatttttctctcatacaacactaaaaagccaaaatttttaaaaacaaattctatattatataaaaattttggtgtttatgcactttatagaccgtaaaaataaaattgttttttaaatcatttacaaaatttctagagcgttttcggggttcttgatcatgaatctgacatccatttcaaccaaattcgaaccccgaacccgtatccgagttattttcacaccataaaatgattttttttatttgaattttcgagtttttgttcgaatacggctccgggttccaaattttgtcgaaatgaatgtcaggtttgtgatcagaaaccccgaaaatctcctaggaatttttaaatgattttttaaaaaattttttattttttatggtctgttaagtgtattagtaccaaaattttcgggtagaggggagggggatacggtaataaaatgaacggatattcattcaataacagacagcatgatgagacgcaatgttgtggaggacccgccattgttggagcgggtcacagaaatgcgcaaggaaatgatcaggaaagaggcagtcatcaaacagcagctgattgaggaactcaacttttgctgcaaagaggcgggtgttactaaaatggagcgaaaaagacaaataagccgatttgatgggattttgattaatgagacccatttttgtaatttttggaaaaccacaaattatcaatgctacacgaaaattcgaaaaaaaacaaaaacatttttttttaatatataccgtattttctcgaaaggccccggggggattatttttcaacctcttcagaaaggggggttaattggagacagggccataattagaaaaaatacggtatatttctcaagtactaaatgcggaaattaataaattcaccgtttaacaaaatgaattgcatgtttaagacagccaaatggatctcctgtttgaagtcaatggcagtgataacggatgatgaccaaatgctgagatacatcgaattgagcatccgagacgccgatggaaagatggccaaattgaagggacagtcgtcccgcgaggagcagcagaagagcatcgatgcactccgagtcagttcaactgcttacaaatagaggaaaaaaacttggaaatacctacgttgttattggatttttaaattcatctatggtcatgcttctccatttttctgtatcggattaactttatccgatggcttccatccacgcttcactttttgtcgattataaaaatcttgaaaattaggggcgtgcgttttcggagttgcagaacacatatgtatgacagggatggcatagaattccggcttcagatgtctggaaaattttttggtgctttggaatgccatccctggtatatgacacgatttcgaccaattcttaagcccaaacacgaattcaaacaaaaaatcgaaaattcaagcccattaaaaaactaatgaaaattcaaatccctttgacgaagtaacaatttatttatttatttacagaaattcaaggaatgttacatcaaagagcgcacactgttcgaaacagcttccggcaatggtggaggagttcaaatttccgaccgaaaatgttgaacaaatttttgacggacttttcgcattggaaaccggcgacaaaatgaaggacaattatgaagtggtaaagaaagcaaagcgagagcatcagaggcaattcactgccgaagaagagaggcgcgcagcgaaacaaaatttggtcaaagccgaaccgacaaaatgccaaagtggtgggttggcgagagt

SEQ ID NO: 2147 - DNA, 1478 bp, Heterodera glycines
aaatagttgttaaaagctttcatatttaggaggaagtaatattgtataattttaccaaaataggtaacaaaattaagtcaaaccagtatgacgataaataattattagagcccggacgggaccgggatcccgccgggatttttccgggactcccggtcccggcttttttggacaaaccaccgggaccgggagtcccggaaaaacggagtcccggtcccgggatcccgtcccggtccattttccaagtcccgatcccggtcccggccatttgggccgggactaaatttcatcagtgaaaataactcagatttgaaaatatttaataatatttaataattattttggcgaaatgtctttaattcgaaattttcagatagaactttggatttcttgaaaatttgggcaatttcaactgttaaaaagatccttgaaacttattaggaccgtgaaatggggtccacttcgtttcggcgccagctcgtttttccactaaacattttttctgagtcatctaaatccaacattgttgatatcattcgaaagcttaacaaaaattttgaagttttttcttaataaattttttcaaggcttgaaaattttgttgctttttgtaaggctaataaagcatgttacgagctttcgaatgacaccaagattgttggatttgggtgcaaagaaaaaacgttaaattgcaacagagtccacgtttttgccatttttatatatccgatttatttatataggatttgagaggtttttcttcataaaattgcatttgatcactgatttgaattatgatcgatcggtcattcttaattaattcatttcttcttcttctgcggctgatcactgtttttgttgttttgtccgtcactcatttggcccttttgtgatgcattgtccggcttcctcttccacttcttctgctggtggcggagacaatggccttaattatgcgcaattttaattatttaaacaaaatcaaatgcttttttaattgctcacccgatgcaattattggcactaaaaagccaaaagtacacattgttacaattgttgtcccaattttcatctttcttctgctgttgcttaaccgccgtggtctccccaattttgcatcgtttcattatccaacttttgtcaaattcatttgctttggccaatgtcagcttttcctttgtccattcgttcaccaattcgaatggcaccatttccattgacggcgcatgaacaggaaaatgaatttcgtaactaacggaagaaatggcattcgcacggagaaaatgctaaacaatttgattggaaaacaacaatcagtgatttgccaaaaatgttggaacacaccagggatggcactgaattccgatatttttgataaattcggaatttttcaaaaattttcgatttataacttttttggggtcgggtttcagaaaataactcagaatgccatccacagaccgggtacgccccaaaaa

SEQ ID NO: 2148 - DNA, 2141 bp, Heterodera glycines
tttatatttttacatatttttttgctgctaattatgccgaaagaagcagctacttttgtttggcgtatattttgacatttttgggtaaaaactataagaaaaataaaagagttccaaatcaatttaaaaatcattgggtttcaatgctgtgctatatttttttgtttttaaaattttttttgtgtcttactttttttttgcaaaagttaaatcatttttttatatatttaattacgaatttataaatatattttttattaaggaaaattggaaattggcacattcattgatttctctgagtgacagcgccaatcggtttaataccttcccctgacttgtgtttccattaatataattaacgcccaaaaaaagaaataggtgctaaaaattgaaaaaatttggagacgaatttatgtgaattattaatttcttaagggtatatttttctgaatttttggggccatttcttagtggtgtatctttcgttttattgcactttcaaaattatttataagaaatattaattaataaaaaagttataaattcctgcctttaataagaaaaatgcatccacaattttgtcacatttaattaactcacaaatggaattgcatttgaaaacggaattgaaaaatggttgaaaataaatattccaaaacaaatagcagaagaataaatcatttgcttcttcttcaaagtagtaatataagagtgctgacgcgtttcttaaaactgccaaatggggttgtgcgtttcttaaaactgccaaaatggggttgcgcgtttcttaaaactgccaaaatggggttgcgcgtttcttaaaactgccaaaatggggttgcgcgtttctaaaaactgcctatcggcgcgtttcttaaaactgccaaaatggggttgcgcgtttcttaaaaaaattgccaaaatggggttgcgcgtttctaaaaactgccaaaatggggttgcgcgtttctaaaaactgccaatcggcgcgtttcataaaactgccaaaatggggttgctcgtttctaaaaactgccaaaatggggttgcgcgtttctaaaaactgccaaaatggggttgcgcgtttctaaaaactgccaaaatggggttgcgcgtttctaaaaactgccaatcggcgcgtttcataaaactgccaaaatggggttgcgcatttcttaaaaactgccaaaatggggttgcgcgtttctaaaaactgccaatcggcgcgtttctaaaaactgccaaaatggggttgcgcgtttctaaaaactgccaaaatggggttgcgcgtttctaaaaactgccaaaatggggttgcgcgtttctaaaaactgccaaaatggggttgcgcgtttctaaaaactgcctatcggcgcgtttcttaaaactgccagtgcgcaaatattataatacaatttaatacatttcatttaatcaaatcaatgcttttattatttattgcacaataataaatttcaagtatattttttttgtttgtgccaacatgtattagctagccctgacgagttagtcaaaattatgaaaaatatttgccaacgttaatctatctattctaagtatttgacaaaattatttctaaataaatgagattaatttgttttagaatttgttatgcttgtcagttcatgtttttggtgaacactttaaagaatagtgaaataataaagaacaataaaaacagatgttgatcagtattggattaattaatgtcataccaagcaatactggcataaaattcgaggaatccatctatagttatatttagggatggtaattatatggaaatccatattttttttcctggaatgtgggaggcctgaaacgcacgaaaaacatgtttttagcttggtttgaagcttctaggaaggatttctatatccatattttccatatttttccatatttcgcgatttatgtccatatttccatatttttccatattttggcattttgtccatattttatgtccatattttggcatttttcaaaaaacctctattagaacggcccccagcagcttaattagcctttttgagcccaaaaaccgaaaaatttttcaaaaaaatcattttttcgccaaaagtctcgagaatattgaataaatttaaattttcttaaaa

SEQ ID NO: 2149 - DNA, 3576 bp, Heterodera glycines
  misc_feature (1115)..(1115): n is a, c, g, or t
tagagaccggcgcgggacgggatcccgcgcgggattttgcgggatcccagtccgcaatcccgcattttttggaaaatgcgggatttgcgggattgcgggatttgtgggattaatcccgcgggatcccgtcccgcaaagaattttgagttccaatcccgcagcgggatccgcaaatttgactttttgtgcgggattctgcgggatttcattgattttttgaaaattttaaagaatagaatgccaaataaagtgtttaatttgctttataaaatataattaaatattccagtaaaaaaataaagatatatattttttaaatgccataatttaagcaaatatgagccacccaatttggcaaattgggctttttaaacgaactacagaagattcggtcgagtgtttggagtgtaaaagtaaaaacgtcagtaattttactcttaaattgtcacagcggagtgtcaaagggctcaagacccatttgtttgccaagcacaaagacacgccatatgcagaaaaatacttaaaactggatgaaggcaagtcaaagaaggatggtccaaaaatcacagattatacaacacggagttcgggtccaagaataaaattgtgatttaaattaattaccattttaggcaaattaagtgtgatggacaaggacattatcaattttattgcttgttgcaatttgccgttccaaataatcaaccacaaaactttcaaaaaattgctccgaaatccttcggaaaatttacgcgacgaaagccattaccgaaaaaatgtcctgcctgaagtttacaaagttgtcaaacaccagatcaagggagaaattgctgagtttgagcaaatttgttgtacctctgacatttggacttcggatacaactaaggatgccttcataaggtttttattcgtttggtacaaatgaaaatattcaaaaatttagcttgactgctgttggtgttagctcaaaattttcgcgcaaaaatttactctagctattcaaaaatttcatggggcccacacttcggaacgcatctctgaaatcctaaaagctcttctcgaaagttggaatgtaaaagaatgccattgttttgtgacgatttcggcagcaaatntagttaaggttagtttattgaacattttatttcaaatacattttttggaggcattggatttaatgcacattgaaagaatcagctgtgccgctcatgacctcaatttatgtgtaaaggattgcttttcaaaagaaaaagacgaaatggctcaaattttcgaaaaatgtcgaaaaattgttggaactttaaaacattcggcaaaattgatggatgatttaaaagatgttcaaggcgaacttggtctaccgaaagctaaattgcttcaagttgctaattatcaaatactcatttaattttcatttcaaaggacgtaagcacgaggtggaattcgacattacgtatgatcgaacgtatgctggaacaatcggctgctattgatgaatttttggttagaaacaggaaattcgatctgcttctaagtcaagaagaatggtccattctcaagctaattaaggcaatttagtgttcaatattttcttatgttttaaaattttaaggaacttctaaagcccaccgaagaagtctctttacattattgtaaagaaatcctctccgcccgaattccgctcgctcgaactttggtctccactttggaacgagttgatctttcagtgacaattgatggcgaaatcaaaataattaacgaagttgagcaaatgcgtacaaggctgattgaggcggttaaaaagcgttttttacaaaaagaaaataggtatatacttaaaatactattatattttaaattaaacatttagactttgtatgttgagtacttttctcgaccctcgcttcaaggatcgtttttccgacgaaagtgacatattttttgcgcgcgttgcacgttttttgaaggatgaaggaacagaagaaaatgacattttggaaaatttggaggatgaagtgaattcgactcgcattttgccaccagccaagcgcgcttgttccattgtggagataattcagaacatagccagttgtaccaaaaaaggtggtaccaaaattgcaattttgatttaaaaaaattttagctacatcatctcaaaataagggcatgtcggaagaaattctcacatacaaagaggacatttgtgtttccatgaatgttgatccgttgcagtggtggaacagcaatgaaagaaaatttcctaaactttcaaagatttcgagtcgttatttgacaccaccatgcacaagcatttccagtgaacagctttttagtgtggcaagagacgtatatgactaccgtcggtcaaatatctctccagaaacggccgaaatgttgatctttttgcacaattctattcctgatgtgaatttctcatattaatttctatgttcatcagtttttggttttaaaacggcacattcatttattttttgaagaattttttattaatacaatattttttcgaaattcaaaaatcccgcaatcccgcgcgggatcccgcaaattttaaatgcgggatttgcaggattgcgggatttgcgggattaatcccgcgggatcccgtcccgcaaaaaattttgagttccagtcccgcagcgggatccgcaaattgaaaatttccagtctctagataaaattataatatcttcttatgcgattcactaaattcatgtgtaaaatcaataacactcaatattatataatttagcgctgcctcgtaaatgtaaaattaatattcatatgatgaatattttatatattttttgacaagaaaatattggatacctatataattataatattattataatctagaaaaatgaataaccgacggacaactctgtacaaaagttaaaagtttttttatgagaaatttaaaatagcaagttttgtcctgattttttacatttgtttggcaattttttaaatagggaatgtctgattgaattgaaatattctttacctgagaatttatgcttaaaactaaaatttgatttcgccacgtttcggagtttttcgcaaataatgcgagagggccgaaggagagaagccggaaatttcttccaaaattttctataatatttcaaaaatatcttcatttaaaaaattggaagattttgcactgtttttcactttttttctacaaaggctcagaatctttgtcattctttcttaatttttcagactttttcactgctttgtttttcgtcacttatattggtgcaagtgggtttcttaaaaactgccacccatacgcgattcttaaaactgccaaaatatgattaaaaatataactaggactggtaaaaatatggatataaaatcgctaaatatggccgtaaaatatggaccgaaaaatcgcgaaaatatggacgtaaatggcgaaaatgtcgaaatatggacgataaatttttcgaaattgaatgtaaaatttcttcaaatttattggttgaaattgcgtatgagagaagtttccgaaattttttgactacggtaagccgctttgacaaagac

SEQ ID NO: 2150 - DNA, 8102 bp, Heterodera glycines
tattaaattgtattataatatttgcgcactggcagtcttttgaaacgcgccgataggcagtttttagaaacgcgcaaccccattttggcagtttttagaaacgcgcaaccccattttggcagtttttagaaacgcgcaaccccattttggcagtttttagaaacgcgccgattggcagtttttagaaacgcgcaaccccattttggcagtttttaagaaatgcgcaaccccattttggcagttttaagaaacgcgccgattggcagttttaagaaacgcgcaaccccattttggcagttttaagaaacgcgcaaccccattttggcagtttttaagaaatgcgcaaccccattttggcagttttaagaaacgcgccgattggcagttttaagaaacgcgcaaccccattttggcagttttaagaaacgcgcaaccctattttggcagttttaagaaacgcgccgattggcagtttttagaaacgcgcaaccccattttggcagtttttaagaaatgcgcaaccccattttggcagttttaagaaacgcgccgattggcagttttaagaaacgcgcaaccccattttggcagttttaagaaacgcgcaaccccattttggcagttttaagaaacgcgcaaccccattttggcagttttaagaaacgcacaaccccattttggcagttttaagaaacgcgcaaccccattttggcagttttaagaaacgcgcaaccccattttggcagttttaagaaacgcgcaaccccattttggcagttttaagaaacgcgcaaccccattttggcagttttaagaaacgcgtcagcactcttatatttactattttgaagaagaagcaaatgatttattcttctgctatttgttttggaatatttattttcaaccatttttcaattccgttttcaaatgcaattccatttgtgagtcaattaattagggaacttaatttgtttaatcatttttgataggaagacgacaacatgtttaatgcgtttgttcgaaatggtcataaaatgcaaatcaatgaatattcaaagcaaaaatatgagggacattttggcattgtttattttacgagaaagaattggcaatgtgacaaaattgtggatgcatttgaagaatatgaaagggcagaatgccaaaaatatcgaaaatatttggacattttgtacgaatatttatatagagagtacgtcggaattcaaacagtgaagcccaaatttgtgtttaaagaacgaattgaaattgaagggtcaataatttatgcggtgatttgcttggccagaatttcgctattttattttaaattatcttggagtaatgactttaaatataaattaagtgaatttttcatttataattctgaaccaaaattgttgaatgagaagagattaaattttgaagttaaattggttaatgaaaatgaaatgccaattaatgaaatgattttgcaattggcaattgacagagcatatgaatatcaaacaattgaaagtttagacgcaataatccgacaaaaattcaagaaaatgttggaggaaatgttcaaaaaagcggaagaaatggcaaaaaaacataaatggcaaacctttttcgcgattttttatccatattttttaatgccctaatgattagagctcgacaaaacgacttttggggggttttaaatgcatttctttgaaagatttgttcagcttttattaaaaactgtttattaaaagcgcaaattgtgataattatttaaatatatgcaaattttgtaattttttttataaaataggtcttttgcgagtaaaaaataattggcatcatgtcaaaattggctcgcgctgttccaatgcctcccttctgctgtttaaatcatatgatgccaattttacaaatcaatttgccagcactgtttaaaggcatcatgccaaaatttaaaagaaaatgccccaaatcggaacaggacggttcggtgcccgccgtttcggtgccagcccaagttttggacgacaacttttgatgtagactttgattcctccttttattgtcagtgggccgaaataatcgacgccagtcttctcaaatggccttattgtctgtcgtaactcgttcctttggtatgtctagcatttgagggtaagcgtatggcttcagtctctctttgcgacagtttaaacacccatattgctttgactgtatcgtgttttgatgaatcttctgccttttggtatccaaaacttctctcttatttgtgccaacagtgtgttatgatttgggtgtctcattaacaaatgtgcctccatgacattgagttttgttgtccatgattccggtggcaaataaattggaaatttcgtttcctcatttattattgcttctccaattcgtcctctgcatctccagagctctttatcgttgaatagacgaaggtctctttgaagtttttccgatggaggaaattgcttttgtgcctcccaaattattaactgttcagatgcacgtaattctgacacagacagtatacagggacaaagaattgataggcttcctgtaccaataataccctcattgacaagatgcccatgagtataccatcaatacaattttcgaattttatgtttcctgtaccaaggttaccctcatgggtaagatgccaatgaggatatcatccatacaaattttttaattttatttttgttcgaattcgggaatgccggattcgtgatcagcgaccccaaaaaccccttaaaacctattttcattatcggttctggtcggttttatgcgcaatttcaaaccaggtacaagcagctgcatcaaaagcgatcagaatgttgcaggggccattcaatgagctaaattaatgatattttaatttttgatttcggcactttgtaaaataattgaaaaatattcggaaattccttaaaaaataaattttttctattttttcacaaaattaaaattaaaatagcggatttttaaaaaatttcgaattaaaaaaaattctaaaaaatgaaaaatgaaaaataattaattctaacaaataaaaatgatttaatttattttatcattttttattacttggttttgatggtgacgtatactagtgctaagttacatattatcccaattgtggagataaatgttcgtaccgctgttaaagcgataagtgcccatggcaaaccgtcttccgcataaagctcaaaaagctaaaccacaaaatttttattatttttatattatatatttattttaaataccgtttcgttttgattcattttaattgatataataagcaatgaataaatgattctaaaacttaatcaaaaagctaaaaaccaataatttattatttatataataattttttaaataccgttttattttggtccattttaaattgtatatttatgcagtaagtaagtaaaagattctaaaattttaaggaaagacacatttgtgaaagtgtaagtcattgcgaccgctacactcagcgcatttgtgcatcttcccagacgaacaacctgaagagcagccggtcccggacgagcacaatcagaacgaagtccgacggtcgaatcgcaaccgccgtccaccaaaactgctcgacatggacacatcaaaagcacgatatgattacacaaattgattgattcactcaccaacccattttttttctctcattacattccaacttaaagggggaggtgttgtgtatatcactcaatattcaaatgtacgccatttactgtactcaatttcgtgtcaatactcatctcgcagcatcgtccataaatacccatcactttgtcactcaattgcttcttcttccattcattcaacacatcattttattattcatttattcttcatccaccgacacaccaattttattatttattcttttgcctccgacaaataaactatttttattcttcgttgtgttcaccattgaacataacaataagcacaaaaaagagggcttttagcttggcttaaagcttcttggataagttttataatgcatatttttgcctatttttacattttttgtgtttgatgcctagccgcctttttttaaatgcctttttcggcatttttatgtgcctaattctcatcattttatgctaataactcaataagacctaatatttttctatgtatttattaaaatgagagcagtcttattttgtataacacaatataatttaatctccatccacccagttgccctcgggtgcgtaaaaataaagattataataagcggatacggaataaaaataaaactaaaaaatcgcattaaagaatttccaattttttatgaaaaaggcaagcatgaattatagagtgggtgattatttcttaatttgtcatttatttaatcaaattgttttaatatttcacgtttttcctcatccgaatattaatttatattcattccaaattatcttttccattagggtaaattttcagtcgatttgcacacaacttttttttttgcctttttcttttatctgaatacttatttgacatttgattaattatctctttaattttattaaatttttccataatttctcttttcattttatcaaatttatttggaaaatgatcataattttgttcattattttcatctaattgttccaattcataacaattactggacttttcttcactctcctcttctttcacttccataatttcaacaacaatttgataaaattgtcggttatttcgtccaagttgttcactctgatcaaaaatttctgcatgaattatttgatcaattgggcatgcatttcttattgtcgaaaaaggtggcgatcaatggaggggttatcgccggtttcctttgccctccttctcggctttgtcgacccctttccgaattgaatgcccaaggggggccgagaaaggagaatggggagggccgacaaaatggggatgatgtaacggcaccaccactcagttaaggagtgagtgaacctcccaattgcctgccgggatgagccccgactccgatcgctgaggagggaagggcgatgggagggagtgggcaaggatcaggagtgatccaatcccgcaggacaattgctgatcgctccgaatgcgattaggggcgccgaatgccccaaccgaatgaccgaatttggtgattgcccaaagggaagggcaattttcctctgtccaaaggaaaggacaaacacacaaatatttattgccaaagggaagggcacatatttggaggaaaatgtgataagggggagacgaagtgaagggaaggacgaaagaaaagggaaagatgaccgaaggaaataagagtgaacgccggagagattaccggcgggggttaaataggccgggcaataagaaatgcaaatcacgtgaatgggcatttcggacggggacaaagttgggaagaacatttgcccgatgacattggggcccaaggtacaaaatgaattgaattgaatggtgagaaaagacgggcaaaaaattgggacaaaagaagcgatttgagagcagatgccccgcggtggggcaacaaaggaaaacatttcgaaatgaaagtgagcggggggacaaaaatgcaaatgagaaatgctgagaagcaaaaggaagggaaatggtaaacaaattggataagacggaaaaagaggggggggggaggcaaattgttgaagtgaaaggaagggaaaaggaagcaaaaatggtgggggtgatcataaattaatcactgtttggcatcgggccccctgcttccttcagtccgccgggaacaatcccggccatccaaagcccatcctttttctctcgtcctttcgcgacacttatgttctttcgtcccatccttggccaaataactcatcaaaacttatttgttgtgttattttgtcagttattttttcgtctaatggaccaaaaaaaaattattactttatgatttttaattaatttgtatacgaaattatttgattatgtattttttcattatgtattttgtgaataaatctcggtaataatttcacataaattacaaattcattatttgaaaattcgaaaactttttgtctaatcaatataataacaattagctaatcacaaaaaatgcaatattatctcagagattggcaataatttttcttggtaatttttcataaaagcattcaaaatttcttcattcatcatcagcttggtgttaaaattatcagctttaatatttctaattaattaaaaaaatttaaacaatttttcgaaaaaaacgaatagagacgtgatggtttacgcagggcataccttcaaatttatattaattaggtaattagtcaaaaatttcaaaaagataaatttaattggagataatataaaaattattggggaaatataaaaaaataattttgttagacatttaaaatattaaataagacaccaaattgggaagcaaatgctgagaagccgatcaaaagcgatcaacaaagtggcggacattgaagcataaatgccagtaatgaatggtagcaacaggtaaacacagcacagacgtattggcacaaattgttggcccaccaaaatttggaacatgccaatccatgagccaatttcaaaccaggcacaagcagctgcatcaaaagcgatcagaatgttgcaggggccattcaatgagctaaattaatgatattttaatttttgatttcggcactttgtaaaataattgaaaaatattcggaaattccttaaaaaataaattttttctattttttcacaaaattaaaattaaaatagcggatttttaaaaaatttcgaattaaaaaaaattctaaaaaatgaaaaatgaaaaataattaattctaacaaataaaaatgatttaatttattttatcattttttattacttggttttgatggtgacgtatactagtgctaagttacatattatcccaattgtggagataaatgttcgtaccgctgttaaagcgataagtgcccatggcaaaccgtcttccgcataaagctcaaaaagctaaacaccaaaatttttattatttttatattatatatttattttaaataccgtttcgttttgattcattttaattgatataataagcaatgaataaatgattctaaaacttaatcaaaaagctaaaaaccaataatttattatttatataataattttttaaataccgttttattttggtccattttaaattgtatatttatgcagtaagtaagtaaaagattctaaaaattaataatttgaatttctgtaatttttattaatatataattgagattttcaaaaatttcaaataaataaccaaaaatttttgtgattttaataaaataattgactttgccaatataaatgatatggaaatgaaaatcaacaaatttgagacatttgtgttacatattttcacacactttgaaaaaaatttggtgagaaaatgaatgaatgcataagaaagtttttgaaaagaattaaataccaataataaaatttttaaattttttttttgtctttttcacgctttcgtgataatcagggctcccagatgtgaggttttagcctcattttgtggttttttgataggtcaatgaggctaaattttcaaaatgagactttgaggctttttgtggttttttgagaaattttgaggttttttgtggttttttgttaaatatttcataaaaactagaaaataaccaattcttttccgaaaattcacaaaattaagaatttttgcaatgaaaatcagctaaaaatatagtcaaaattcttaatttttccccggcggcgcctatcggaacaccccgagcttaaaaatcctttattttcttaaaaatttgctcaaaaccgtaaaatttggccatttttgtggataaatctgttaacaaatcgtattaaaaatcacaaaattcttcgcggcggcgcctatcggcaccgctggccccccttattcctcaagtttttcggaaaaagcgccgcaaaaaaatcaacttccgtttttcgtgcttagaatttcacaaaatgcttacctatttctaaaaaaaaattgctctaaattgatcatggccaatca

SEQ ID NO: 2151 - DNA, 4537 bp, Heterodera glycines
taaagagctttcgaatgataccaacaatcgttaggatttaggttggcaaagaaaattgttatagtccaaaaacatgtgttcgtacgaaaacggcctggccccagacaaacgtatggacattttccaatttgtagcctcacccaatgccaacccggacaacaacaccagcatcaactccgaagcagcttcagttgaccagaatttgccgcatttgatgcatcgtatggaagaattgcagccgaaattgatgtcattgaacatgaacttggccaatcgcaatcgcgacgaaattgtaaatgatggcaaggaaaaggaggaaccgaagaaaggggacaaggcggaggacgaggccaacaaggaggaggaaattgttgtccttaacccatacctttatctgaccaacgaagcaatggaaaagatggagaaggagcacaaagaaaaggattccgctgaagccaattcggatacggtgaaccatttttgtgattaaattcacggtgttaccatgtctagtaccactaatttgcacttttttaatttaactcatctttatccatataaatgaaaacattttttatgaatttaaatatttttcgattcactttcagaccaatgccaattcgttggacaaagaaaagcagccaacggcacccatccaattgggcaacaagcgcaaattgggagacggagtgaacaaagacaacggcgaagaagaccttatgaagttgagcacgcacaactcggaggaaccagttgacaatggaaatggtataattcacttataaaatcaaaattaaatatatagtaatatcttttgatttttcatgattttggtcgggatacgacggaaaattgtccgctttgccatccatccactcataactcaaaaatctatttatttttagtagcatacgtctcttcgttctcgtcccgctcctccacgactactatgtcttccgttgaggacgaggaggacagtggcaccaacgcgggtgacgacggttggatggtggtgaagaaggagtcgttcaagaagttgtgcgacttctacgagaagcgtcgtcgcgtggagtgcggcggtggcaccgtcgccgctgacccattcgcggaacaattggagcgcgaatttcgcgaggcaacgatggctgacaacaaccgcaccgatgaacgcgtggatgagaaattgacggcggagagtggtgagttgggggagggggataattttcgaagattttttaacttctaagttaggaaattttaaaaaattgcgggattgtgaaaagttcaatttggtctactaaaataactgaatttacggtttataataaatttattagtccaataattgagtctcttgtttaaaatttaaaagatattcacaattttagccgaatatgctcgaactttctacatgacaaagccatttagtgttttatttccctcaaatgcttcattttgattgctgtatttatttgtagaaccgaaaaaggcaggcgaattcgtgaaggaagttggacaagaaccggctgctgcggtttatgtggcacaaattgtggatttgaccaccgaaaaagatggaaagtcagaaaattcggagaaggtggtacataattcttcagtaaaagagggaaaaggaacattttttttagaccattccctgtgtccattcggttgtgatgcgcggcgtatgtgccggatgtggacaggattttcgtcaggtaaatgcaaatacggcaaaccatttattaaaacaattatttgtttttattgttagccaaatgaatttgtcgggaactcggctgccattttcaactttgaacagcaacagcaaaagatgaaccagaccgtgcccatttctggttcctttggtttgccacgatgttttcgcacatttctttttaatcattcatgtaacaggtgttgatgcccaccagaaaactgcaaaaaacatctatccgtctttggaactattggttagtacgatggatttaagggggggggggggtcaaaaagttaaaatcagacacacattttaaaccattctgtgtaaaatacaatcagattttggacgagaaagttttataggttcaaataatggattttttaggaaaaagaaccacgcggagggacactgatgggctgcgtggatggagaggaggtgtgcaccgccggactgccctacccgggctatcagaagccaaagggtcagaagcacagtcgtcactgcgagtggaagcacaaaagtgagcaaacgcaaataataatttttgatataatttttcatattccaattcgtactttgttcattttgccttccgctattccctgataattgccaatataaacagaaaaaaagccctcacgacaatgggttttttctagtaaaaagcgcattttagacttggtcatccagagtttggttgaacagttggtcgggatgggcttcgacaactgcaacggttggctgttccgtgtggcggagaaggaaggcgccgagttggaccgcatttttgtcgcgattgacgaggacaagatgtaccgtgcgcggatcagccttcagtgaagaaagaggcaatggaaaacgaaatgaggaaatttatgatgaggtggataaaagaaaacgatgctttttcggctttggtctttaattttaatgagctaattaattaagcaatgctttggaattaaactataaaatcatctaaatatttgtcccttattccttcgctcctcatttactcattcattttaattagtccatttgtaattgcatacattctgtatgatgggctttttcggcgtctgtatgtgtataatcatttcctttccagctctttgtcgttatttactcttgtcacaatcacatttattatccaataaataaaaccatcatgtataattgtgcggaatacctatcccttaattagggctaatttgcaatttttatatgaccttaaaaatagacaactttttatggtcgtatgaactgcaatagagcctttaatattgaatttcgtgtttgtttacatgtcagttgttttttcataacggcttcagtcgataccagggttgttccgggttacccgatacccgaaacccggcctttttctcgacccgaaacccgacccgatgattttgggtcgggtttcgggtcgaaataagcactggtaagaaaggggtctgggtgaaaattaggtggataaggaaattgagaattttttttgaaacgattgtgttcaatggaatcgaaaattttgtatttgtttttgttcattattatcctttttctaaagatattttgtatgaatttcttgaatttaagcaaagcagatggctgaaaaacctgattccatttggttttatttccatcgtcctataaatggcgcaattcgctgcaaatattgcagtgccatttgatttttaaacaaattaaaaatttgtcaattgacccgaaacccggcctttttctcgacccgaaacccgacccgatgatttttcggccgacccgacccgaaacccgatatttttctcgacccggaacaaccctggtagggacactcgtaaaatattgctatattgtaaatgcaaaaaaatgagcaaatgtgacggacggacttggatgtgctcgttgactttgtgccgacgcattcgagctgaacaaccgtaataggcatttggacaagtgatcagtgtctgttttaaaatttaaaaaaaatgccaattctttttaatggaatgatgacggaccatggcacaaatgcattcgcggtgatccgccaatttacacgagtgcatccgaacaccacaatctgtacaacacaataaaaaacaacatttttttacaaattaagacacaaaatgaccaagactttaaaaaaaggaaattggcaaaaaaataatccaaaaattggcaaaaaataataatcctaaaatggcaaaatagttaaaacaaaaacaaatttgaagttggatgaagaaagatttaaaaaaaaagaataaagaaaaacagaaacgtgaaaacggagaaatgcattatctaccgtatcaaaaaatgcatgcacatacagtatctatccagtaatgaaaatgggaattgaaactttagggcatttgatttcaaagggcttaaaatcctaggaaaaactctatttaatcgaaaatggcaaaaacggaagcggctttaaatcaatcgcaaaatcctcaacaccaaccacccaccaggacagttgatcatggcacattcagtgccgtcggcgaaactgcagcaacccatgaaacatgaagcgcagtgtaattcatggaaggcatctgaggcaaccggcacaacacaataatcagtggcggcaatttgcattatttgcacgaaaaaataataataataataattaattttgctaaagttcaatttatgcgtccaatcaatttttgtgcgtccatcaatcaaatttttttattaaaataatcccttaaatattgattgctctaatccatctaccatgacaaattttggaaaaatatgtcaaaatagactggctac

SEQ ID NO: 2152 - DNA, 3170 bp, Heterodera glycines
cttggctatcgaatgataccaagaatgtaaaatttggttgcctttaagcaaagttatgccatgttttgtcgaaaaattcgctaaaatggcggatttacgaaacgacccagcacgccgaaaatgtttcttaaaaagggagttttttgaaaataagaaatgtttttttgtaagatattcttttgaaaatcttaagaaaaatgagttcttcgtcgccgaaaaaaaagtcaaattcttttttgtattgtggcgcggttgagccaagatttctccaaatggttctgctcctttatgtttaacaaatgcggatcaaatgaatttgtcggtgatttccgtgtgttttatccgttctatagattcataaaacaaatcgcattttgttgatttttaaaaaatacaaatttggcgggcgccacaaaacagaaaaatgccaaaattaatattttcggaggggaggggggcaggacgagctgctcccgtctacaaaatccacaacacaacgcaccagccaaatcctccattcggatgcgctcttgcaagtccgacaacgacttcaccgactgcatggacatgtccaaaatgttggtttcgtcgtttttgttgctgccgctactgttggtgttgttgccaaccatggacaatggtgttgatgatgatgatggcatcatggtcttctgttgccaagtctgaacaccaccagcagtgccattgttgttgccgttttgttgcggcggtgatggcactgccgccgattggcgccgtcgaattttgagcaaatggacaagctgttcacgacgccggtcagaaatggcatcaccgagcacgcccaaaagcctaacaaattccaattattactattgtgttcactgtttgctaaacatttatagtgagtaaaaacgaggaaaaagagaaaattccataaaatctttaaaagtacattcaatctggtaagaacaattttttaaaagacctcaaaaaatggcaaattgccagcaaaaaaatgtgacaaattcgggacgtaccaggccgttttcacgtggcccaagttcgggatgctaaaatttcggacattggatcgatttaattgttttttttatattcctttggcatcatttattttagcggtgttacagttacagtgagtgtacagacagagtgaacccgaagtgtagaaaatgataattttttgtttttgatttgctgttgctgacttgtcaatgagatcatccttgaagaattgaggtgatagaaccgtgtgtttgagaatgagacgccaattctgcgtggacaccgaatcgggggtctgttagtgaataaatgaaaatgattaagtgacgcattaaggaactaattaggcattgcattgtctaattattaagcaaatgatgagagaaagaatggagagatagcgagaggaaagcagagagtatacgagtaagaaagcggcggaagagagagaaaaagagagatggggagagagatagaggggggagcaaagagaagagaggaggataaagaaagaagcgacgggtgggttaataaaagtaacatagtacccgcaattttcacttaaactggtaccggtaaaactggaaatattttctgaggcataaaattttggacaggattttttttttaatttttcgtggcgaatttataccagtactgggaaccgtgttactctaatttaattactgtatttgataattaagtattaataatcatgttaaaagtggtgtgcctccaggtaggcgtgcaacaacaggttggcccacccggccaaacgacgcaactcgccaaattccagcccatcttcgccctgggacaccaggcgggtgagctcgaccagcagacgttgaagacagccttggtaaggttgaacaaaataaataatcgggacattttaaaacattttataacggaaatttaaatatttttcaatacaaacatttaaaaaagatgaaagatgcgctgaaaagcaggaaatcttggtaaaattttttattttatttttttgaatgaaaactaatgaatgggctggcttctttgtttaatagtgatggtactcgagaacgagaatttcccgattagtaaagaccgtcgacgccgatacacaaaaactcgagacttttcttggttcgagactctcgagcatcattattgtttaagtatgcccacctttgttgttgatcagtatgagaatgggccggtaataattctgctccatgacagtgatttcgtcaataaacttttcacgcgagaaaactataaaaaaaaaattgtattgaaaattttttatatgtagagtagtatttatttttccttcattcgtcatgtcccttgatttttgttttgaaaatgatttgcattttttcttaaattactctattggagagggataaaacagcgtctgtttgtaccattggtggttggccgaatcgtcaagccccgaggggctaaacttctcaaaaattcaggaaaaaaaattgtttttttgaaaaaatcgtcgggctatttcttgcccccacttgtccaaaaattgggctcgtccttgcggaaatactaaaaaaaaagcgatcgaatcttttatgaaaaaattttctagtaatttttaaattactacgccccgcccctcacccccttcacccaagaaaatgagcaaaaacaaacatttcaaatgtgtactaccgtcacatttgaacaacggaagccctcctcctcctccatcatcaacaacaacaacaaccacttcattatcatcatcatcattatcgtcaccatccccatcatcagcaatttcaccatcactcatcatcgacgagagattgttgttgatgccgctggttgttgctgtcgttgttgttgccaccaacgtctcgtcctcctcgtcaatgcagaacagtgaactcggcatttcatcgttgaagtcattggcaacaacggcattggcattatcaccacaaccattttccacatcggcttcttcctcctctgggatttggtgctgttgttggacatttgactttttgggagaggaggacgacgaaccaccggtgctggtggaggaggaggcgacagatgacggggccagacaggatttggccaaaaacaggaggaattctctgtgagattggggggggtgttttttcagggcaataaaaggcgacgggaaa

SEQ ID NO: 2153 - DNA, 1590 bp, Heterodera glycines
tttcaaaaataaattttctaggaatttttagaaaaaatttaaaaatttagcaattcatcataaaattcgaaaatgttacaatttaaaaaaaatttttttattttttgggtgggggggggggcccaattatttttaaagttgtgcataaatttcctcactcgggacattgttcaagcagtctttcaatgcccatgcacacacttttcatcgggcgtccctcaacattgggatggaactcgtccaggttgcgaaactgaaaatgcgacttttcggttggtgtttgcactgcactcactcgctcttctcctctctttcttcctaattttctctctctctctctctctcattttctgtctctcactctctcttcccctctctctctctcttcctgtctctcactcgctcttcttcctcttttctctctgttttcccgctctaccacgctctttccttttctctctccctctcgctacccccccccttctcactattttccatctctttccacactctctttctgtctctcacttgctcttccgcttctctctgatttccagctctcccacactctttcctccttctctccgttttccctctcgctcagtctctctttccactctctctctctctctctaatcaacccacttttctgcgccattcccgaaagcggttcatcacggtgatcagctgatgtccggtcattgctttgaatgcttcttgctgcttttcaacagtttcgcttgacaaattctccttgatcgcctcattgaatgggagggcccaatattgtcgctaaaacaattttttcataaatcttgatttttgtctagacgcctagaaggaaaaattgtgaattttagtgaaaagtataaaaatttcaaataattatagcgctgaatggaaaattcaaaaatccaaaaaaaaaaaaattgtggcattgtgttacaaatacataaaatgcgcacccaaagccaccgacggatgaacaaatttgcctgccgcatcaagtccaacggcggcatttggccatgggtcgccgcatgccgaagatcgaccacccaagacggaatggcaaactttaagcatggacgggggacaattagaattaaagcgcattggagaattgaaccgataaattaagtggtgccaaaccccggaaaaattttgaattttgtgtgtgatttggtaacatatttcaccaaaaatgaccaatttaagcggttttaacacaattattcaagaaaattgggagttttagggaagggggtggcggtgctaatagacatcaccgggacaattttttttggaatttttaatgattctaataaaattccaacatttgcgacccgaccccccaccccctaaaattgtatgaaaatgatgcacataacacactttgctaacggcagccgcaatgctcacattttggaccgcgtcttggcatacttcgttcagataattgatgactctggtgaaaaatggctggtaagtaaaaaacattttaaaaatggcgaaggccgatggaaattttgcaaaaaaatgaaaaaagttaaattaggggcaaatgcaaaaaaaatagtaaaatgggaa

SEQ ID NO: 2154 - DNA, 3134 bp, Heterodera glycines
  misc_feature (13)..(13): n is a, c, g, or t
  misc_feature (3077)..(3077): n is a, c, g, or t
atcaatgattttntgtgtgataacaaaattatttgaaaaacctcccttaattaattatttaattaattcattaatgattttgtttattttttaatcgcatatttccacatacaaattaaacataattaaatcaatttcattatgacaaagcaacaatatttggcaccaattctcttgaatattgtctttgttcatgcacggcattttgtgccatgagtgaaatcgctgctgaattcaatgcctccgcacaatccaaacgcgtgttatgccatcaacaatccgccaatcccaagagcaacaacttcgctgagtaacagcaccaatccgtcgaacatcaacaaccaaaacaatatcagcaacggaaacggaatggctggaggcgtacaacagcagcaacaacagcaggtaaaaacatcagtttaatgggttggactggtcgagagtcttggtctcaagccgggaaatttctcggatttttggaatattgagaatttgaaattttcgagtgtctctaacagtacaattttctgaaaaaatgatctgtctgtatgtaacccattgattggtgtctgatcagaagacactttggtcatattaatgtaggcttatctgaaatttccagcaaaaattatttaatgagtcacaaacaatttaatttaatttaattttgttttttttaatatttctctctaattgactattgttttttgaaaattttgattgactaaaaatttattttaaattgaggcctatgaaaaaaagctcttgaagggacacctgactgccctcgtaatgtccgtcgtctaatgttatacccatgaccctgaaaatctaatgatcaaaaaatagcacggcttttcaaactttaaaatttgcagcaaaagaatccgaagctgtacaaaacggagctgtgtcggtcatggatggaacacggacggtgcaattacggggaaaggtctgactgaacatgaggccgtgacattttgacaacccgttgaacaggtgccaatatgcgcatggtgagagggaaaagcggccggtgccgcggcacccaaaatacaaaacggaggcatgccaatcctaccacaaaacaggtgatgccggattttggtgtgttggcacaaaatttagtttgtccgttttgtaggttactgtccgtatggaccacgctgccatttcgttcgtttttcaaattgttttttctgcgtttggcattttacccaagtgccaaatttagattcacaacgagaacccgtcgcagctgaaggctctgattgatcagaatgaaaaggcgttgcgactggtgcaggaattggccgtcataccgatcagtgagtcgtttaactgctctgatgagtcactttcggcacttttactctcattaagcgtaattaggacgccctatcaatgagagaagggtttttaaatctcttatctttattttagaaaaataaatcctttatttttgtgctgatatttgcgaatcttcaggtggttccgcttctgaaatcccccgaaaatcgctaatcgtttcttcgtcgagcgcttcgctgggcaattcgccatttggctgcgttttgcagaaaaacaattccgtgcacacttttagcaagtaatttgcatcttttttacaaaaattattttattatatttttattttacttatttattcatttgtaattttttaaattattaattatttttgtttttttaataaaattattttttaaataattattttcttttctttgttataattttggcaaaactttgaatcctgtccccatattttttttacatttaaataatttaaacccattatattcatcatttttatatttagttaaatttatcgttattttaaataatatttctaaaaataaaatgtatttttaagctttcacggtcaatatttggagaagactcagagcaataatgctctacaacaacaacagctgcagcagcaagaaaactgtgcacatttcttccagtttaataacgcatcccaacaaaatcatcagcacaaccaccaacaacaactgccaattggggtgggactgaatttgatggggcacagtaacatcgtacagtaccagcagcagcaacagcaacaggacattacagtactgggaaaagaataaggaattaattgaaattttaatcacttggaaattataaattaaatttaaatgatatttattaattattcattttaaattatttattatttcattatctttttataaattattttaaattttgatctcttaacggtggtgagtcattatttaaaaaacatcataaagggcgttatttaaacaccatcaatttgaaaaaaaagagattcataacttagctccaaagcaacaaattaatcattcgatagccctaataaaattttaaaaaatttcgttaaatttcaaaaaaaaattatgaccaaaatactcagaaaaccttcgcattcgaacatttttggtcataactttcttgaaacaacaaaaattttttgcaatatttcatgctaatagaaaacacttattgttcgggctatcgaatggtatcaaggattaaaatttgggtgctttaaagcaaagttaaaagcaatatttttttattttgatggttttttaaataacgcccattagcagcaccctcttaaagattacacaaatataattttaaattctttattaattattcgaaatttttacatttttctcttctaaatttagttcttcgcctctcctcaacaatgttcgccagagaatcaaaatgcgcagcagtcgccgctttcgtccgcatcttatgaaatgttcggcggcatttcgcccaaaaaccaacaacaaatgacgacggaactgttcgatcacggggaaatgagctcaccacagcccaacaacactcacaatcagctccaccaccaccaccagcagcagcacttcaatcagcaccatcagcagaggtggccaattgatttatttacaattttacatttaaatataaaattttaattaggaataaaaggttgaaaaatttgcgattaatttgattctctacgagaaagaaatattgcgatncaattttggcttgcttaatcccactgtccataagtgttctttattcttaagattttc

SEQ ID NO: 2155 - DNA, 5451 bp, Heterodera glycines
aatttcagaattttttatgcaatttcatgtttttagcatatttaaatctgttctatggttataatcttaggcttgtgaagcatatttttattgcaaacactaattgttaatcccatgaaaagataaaaattggagaataaattaaaaaaaaaattccagtcgattgggccaccccgcaagtcagccgttgtccccattcggcaaggaacagcatcatcagcaacaacagtttggccacaacgctcaagaatggcatttggccaagcaaatgcaagagatttacagcaacggcaaaaatggcacaaaggccgcgagcggtgccaacaatcgcaacaaaaacggcaacagcgagttggacccgcaaaatatgctcgccaatctgtgctcaagcgatggtaaagaaatcatggaagctcgggatttttggctctcgaattgagcaattctgattggattttggagttaaatttcgactctattgcttcattttcgaaccccgtctcggaaaaatttcgaggaattttttgaatgaaaatgagtccttcatagattttgctccaaggtgttattttataacatttggctttttaaaaaattttacggttttaaaaaatcattttttataataaaaattctcggagagaaaagttcccgccccctattaattaattaccttgctaaaattgttctaagcactaataggggccggcttcaccttaataaatccaatatccaattgaactctgccgttattactttggtatatcattcaaaaaacaaatttgttcattttgtcagatgactattcacgctcttctctcctgtcctcaactgctgactcgggcacggagtctccgccaatgactttggcatttgatgacgatgtaaaattgataagtttaagtcattcattttatcaaataattttggccattaaggcattcattcggataattatcaatcaattagcgtttcaattaagaaaaaattactttgccaatcgataggctccgatggggaaaaatttgaaaatttttgttctaaaattattcaaaggcaatgaaaatttttaattttcatttcagacattgaccaaatcaaagggtgaaagcaaaaaattggccagccctcaactgattggacaaatcacgaatttatctgacgccgaaagcgatgcgcaaaatcgacggagcagtgacggagacactgtgaaaggtcagtggtagtttttgacgaacaatggcacaatggcttctcatttgggcatttggccaaagtaaaagatcggaaaatgaaaattgacttttcatagagcataagcatgtgaagtgaattataaaaaggatatcttattgggaaaggatcagctgttctattaattaaaattcatgttataaatccgttgggatttctttcaaattaaatgggataaccaagggctagcgccagacccttggcttcgggggggggggggctcaagtaaaaaattcgatttttaggaggtgtatttttctttttcattcgatttttaggggtgtattttttttttagttttttgaattcccgaattaggggggtgtattttacaaaatttttagtcgttttttcgccaaaaattactattttccattttggtctcaatttttcaaaaacatggcaaaatgggggtccggcggtgttgttaggcgccgccgggaaaattttttttttgaaatttttaatgcaatttgttaagaaattgcttgaaattacaaaaaattagctgaaaatttttacttttttggatttcgggagggctttagccccctcggccccccaggctacgcccttggggataccgtacttcttcgattatatccccccctcgattagaacctcctctcgaataaagccccccttctgaggggagttgagcaatagagcccccgggggctataatcgaagaagtacggtaactccgtcaattaacccaatcattgctgatcagcagtcccctttctttgttcagctaatttggtgatcaatggccccaacaaatccgcggacctccgccgccacaaccattcgaccgcctcgtcctccctggcctcgctgctctcctcctcctcctcttccaatgctcaccaccatctccagctgagcagcaacggcaaatcgtccgcgacggtgccaagtgcggcgctggcggtgtcctccaaaattcggttgcccgtctttgagcgtctttccctgaaccaataaatttaacaattaattgtccacaaatgcctgccccacaaaatgccaattcattttggcactttttttttaattttgtgccaacttcaaacaccgatagaaaggcaaaatctctcagccatggctagtacttaaatacttaattctttccttcacatttttgtgcttttgtatcatggaagagtccggagcaaagtttttttgtgccgcgagcctgggcattcttagacacggcacggcacggttatacaaattaaaaattatgacaaatgccgatttttcacaaaatttaatttaaaaaatgttaaaattgctccgaaattcaatgatacaacaattaataatcaatcattcattcattactcatcgtagaacaacacccattaatctctgcattagctctcttgaaattacaatcaccacaaaaaaagttgaaaaattggaaagggacgagcaaaataaatttgaaatttgattgaatgtttctttgtcttttttgtccctgccaatttttcgccgttttcattcaatcgccggtgtttcgtctgctaattgtgttcattatcgactcattaatcatttacttaattatgcgcttcacatttcactaattaatctctctcctctcttccatccgcttcttctccttcttcatcatctacttcagtgtccaataaatcattttgtccgtgtgcctttcattttctcatttaaacaccattacttacttatacaaaaggacaaaaagtgtgaattttgtttatttgtgtctgtgttaaattgatttttgttttatttaatttattattattttttttgaaaaaatatttattttattttatttttttctaaatttgaccaacatttctctgaatattgaacataaaaataaatattttctcgcttctttttcatctttttcttcatttttcatttttcaatttcattttttatctgaacctcaaagaccccaaaacacattttgatggtaaaatttgctctttttttttctaatttatcactctctatcaattaatcaattaattaattatcatccatcccttttttaaatttatttcaattattaatttattattattcatttctttctttctctgtcctccttttgctgctgctgatagaccagtgttagacacccctttcccctcattttcatttttttttaaatttatttttatttaaatttaatttaatcctccgatattattcatattaataataaataaatgcttattctttaaaaaactcacacacatgacaaatgtgttgttggccttctgaatctgtgcgttacacagctttttgtctaaagtctttcgcgacgctataaggtgtaaatattattattaattattttattaaaccaccaaagctggcattttctattggcatagttaacacaccaaacgacagagtttttgaagcggaaatgccattgaaaaatcaagaaaatgcaatccgtaaaaactcttgtcaatggtacaatcttcataacatgaaaatattcgcgtgtgtcacttcattttttggttgggcctgatcattgaaacactaattaaagtttaattaacttaattaatgcccgattaaataggcattaattagctttaattcatttcccaatctaattaccaccgagcaattgatcagaaggcccaactttgacttttcgattggctatttatagcacctttttattgatgtctctcaaattagattgaacgaaaattttgcgaaaatttatttgcattttttaattattattataattaaattttcgttccttttaaacaaattaactacggtttacattttgctgcgcattatcaccgattatagaacttaaatattgtctagatgttctttgatctgctagaactggtgtccaacaaattaatatattaatattccattagaatatatttgcatcattttttgtatttgtaaattttcatttaattgtaaattatttttaaattatttttgtgttcatcttagataaacgttagactgatgttctttggcatttacacataataataataataaaatttgcgcatttttcttatcatctttcattaaaattttcaaaatttttccgggcagatcctattggtactgccggaccatcattttacctcgtttttgaaaatttgaccccaaaatggcaaaaaatagtttgtttttttttggcgcaaaaacagctgcaaatccatgttttttgctctctggcgctgaaattttaaaaatgactggagaaaaaatttctttggcccaaagagcaaaaaaaaaaggtcttctgattccccccttttctggctacgggcttgatcatttcaaaccattttagacaaatttaatgaaaaattattattaaagctaaattaacaggattttttttcaatttaatggtggagaaaaacattgttatcatgaacattaatgaagtgtttacattaaagcgcgtgaagcgtgtaatgcttattgtagtatcgcgaggcgttggcatggcatggcattggcattggcacactgggtggcgggcgtattggcattggcatgcccaaccccaacagtcattactccattaagtggagcgcaatttgataattattcttgcctttttaatgcattatcacttttatctgagaccgaaacgggttgcacccgtatacgcgttcttcggaccctttggcgctataagccgtatatttttcaactgatatgggttttacgagttattgagcccgtagtccggaccccgtataggtaaccagcgcgtaattaattttataactgttgttattggttcttaatagcgatttttcgacgaaattacggaaacaaattaaattttgaaggggtcccagttcaaatgttttaccgtttgaaggcaaaacaaaaaaaaaggggggggggggaaattttcaaggtttgccaatataaaatgctgtttcgaccggtgtacttaagcatttttgaattcgaaactccctgaaaaagtgacaatggaaaagccaaataccggcggaaaatccgacggcgttgagaacagtttacaaaatgagaaaatgcgacaccgcgaaaataaaacaccgaatgatccagattaataaatttattctatgtacatatgttattaaatgaatatacataaaggagtttacagaacttttaattagggtaggtcgg

SEQ ID NO: 2156 - DNA, 1770 bp, Heterodera glycines
tagttaataaataggtatgttaaaactctctccgaaaattttgatttgatggatgcataaggaaagctttatctagcgcctattgtgtatgattatgaatagtgataaggaaagaaaacaaattgatacgggcctagaatagcaatacaaaattaacacatttatttcaactattgcagaagatctcttttttattcgttaggcaaaatctttagatcctcagaggatgaggatgggtggtagttcgatcctaaagaagtatcaatgataatgaataattagattaattataattcaatggaataatatttaagcagataataataattattttaaacatgttatattattattacatcagaaacgataatcaatgctgtcaatcttatttgccatattaataaaaattttcaatttataaaatatcgtccccttcagtgttaaaatcattattgtcatatattgacataaaaaatgaaaatattttttaaatagctctgttattctctggttcctgtctaattaggtggaagccggcaaatctggattcgaatgaacgagtgttagtgccggtcccaacctaccctacttcttaatatatataattgccaaaagcccccaaaatataaaaggtcaaaaaattgtctcattttttaacttttttcgctagcacaatgctaattaaaagcatttcaatgcttttaggggttaaattttatgaaactttgaaatccagtggttgaataaaatagaatttagtttgggagttttaggcatctgtaagaataaatagtaagtattatgttcggctcaattgtgcattaattttttaatttcaacatgttaccgatgccggtaagagcaatgtcattttgccaagaatttgattgccaaaaaagcttttttgcagagaaaaagacctaattaaaaaaaaaaatttaaaaaatataaatccgggccatgttcattaatcatagattaagtaattaaataaacgcctactcgttttagtattttttcctcaagtttttcccgaaataaaaaaatcattatgatagtttaattagcttggcaattcgcctttagaaaatagcgtgaagcataaagagcacattcattcacacatcgtagtacagcacgaagttatggcattacaccgacgaaggcggcggaatgccaaaaaatgcctcattaaaatggcatatctcaacctttttgacgtaacggaaataattttgaattttatgaattacaaaattttcgtcatcactaattgctctcatgaagggcgaaatgaccgtcaaatgcttagaaatgttgttaattagtatctgttttaaaaattgtattcagatacatatgatgggttaggacaatcattcaaaatatctttcttcatttttgataaaaattaattatttctatgtaattgtcaattaaaaatggcacagatggacggacgggcgacataatctggcactatgccataaggtgtccagcagaattgcgaattcccggcatatttaagcatggcaaattgcctcgaaatataatttgtttataattagggttagacagggattcggcactgagttcgacctgggtttaatggccaagtccgaaagtttcctaaaacaaaaagtaatttttttttatctgtttacgtctcattggttttacacatgaatgaaataaactcacaaatgcacaaattcaaattaatatttccacggcatgcaattcattcatatttattgcctttcattttaa

SEQ ID NO: 2157 - DNA, 1942 bp, Heterodera glycines
aaaatttttttcggaacaaatttttttttctagcttaatgatctaaaatttaaatcattcaatttgtttgttcgttttttaaaatttaattttattattatttactcaaaaggtacatggtgcatagcaattacattgacttcttcagccaaattgccaaaggcattgccaaatttggcattaaagtggcaccgaaagagcgcgaaactgtcgcaacatttgagcaggcatattatggacaatttatgaatttggatcaagcagacgatttgattgcattggtaattaaaatatttaaaaaatatatattttataaaataaattatttttaatttgagatacgcactttcctcgagttcgcttgtgtgaaggaagtgatcaacgaacggctgaacgagcttgatgtgccagacaacacagaatagtgaggggcaaacaaacatttaagaaaatatgggttcaaaagtcatgagtagggaacgaattttgaggcataccgtatatgctcaaattatagcccagtctctattaatcccgcagtctccaattatcccccagtctacgaggtgttttgaaaaataatccctctatcataatcccccagtctctaattatcgccccttttatggggaggttgaaaaataatcccccatgggctataattagagcatatacggtatgccttttttttttgctcattagttacgatacattaagcataaataaaatgcaataaaaaaatatatacccctaagaaatgaaaaattttctcaaaaattggtcgccaaaatttaatttaatttttttgataaaaaattttctgtttaaaaatattccttattcaaaaaaaattataaactatttaataatcatttaaatgagcaaaattaaaattttttgattaagttttacgtgttttgctccataaaaatccttaataaaaatttttaaatgacttttttatgcctatttgaggatttttatgccttttttgcatatttttggtacctattacagtgcctttttcgcgatttttagtgccttttttcgttctctagtcatgagacaaataaaaaattaaaatttggtaattttagggcaatttgggggcaatttattgacaaatttcgccaacaatttcaattcttaattaaaatgcattaagtcttttggaaaatgcgcaaaggattctgacggagcattactcgccaacccatgacgacataatccacgcgagagcagccacaaaaggcatttacgaaatcattttcgcattccgggaattcaaaataaggtaaaggaagaagacaaagcaaagggggttattaaaaagtgcagattttaatttagccactaattattattttcagactaattgatgagggtggacagaaaacggagagacgcaaatggatccattgctttggtaatgaatgaatgaaccgggcaatgtcatccccctgaaatttttttcaaataatttttttaggctgatttaaggtgctgatgtgggacgccgaaattgagggagggcgactacacacaccaataccccagggagaagggaggggcgaacgtgatttccaaataatcgatttcttctagtctaatctagtcaaaccggtgcgagaattcgatagaaataacattcacggtgcgaaaaatggggtttgacaagtctattggggaaaaaagactttactaaataatacccctgggagaagggagtgggaaacatgatttcaaaattttcaattttttatagtctaatctactcaaaacggttcagaattcaataaaaataacattcacggtgcgaaaaatggggtttgacaagtttattggggagaaaaagactttacaaaataatacccctgcgagaagggagtgggaaacatgatttcaaaattttcaattttttctagtctaatctactcaaacc

SEQ ID NO: 2158 - DNA, 2581 bp, Heterodera glycines
ggaattcaaaataaggtaaaggaagaagacaaagcaaagggggttataaaaagtgcagattttaatttagccactaattattattttcagactaattgatgtgggtggacagaaaacggagagacgcaaatggatccattgctttggtaatgaatgaatgaaccgggcaatgtcatccccctgaaatttttttcaaataatttttttaggctgatttaaggtgctgatcacgaatctgacgttaatttaggcctatcccgaacccccggacccgaactcggacaaaaaggtcgcacaaactcgacataaaatcgatttctaaaaattcgaatttgcgacttgtttgggttcgggtccgggattcgaaataggcaaaaatggatgccatattcgtgatcagcaaccccaaaaaaccattggtatatatattacctgttcgttttcacatcatgtgaattttcacctaactcgctggaaacatgttatagctaaaaataaacgtcagattcgtgatcagcacattaattcagcttagaaaaattaaaaaaaaaatttcagggggggggggtgacaaaacctacaagtaccgcaaaatggatccatttttaatttatttttatttttttattattattatcagaggatgttgctgcaatccttttcattgtgtcattgtcctgctacaaccaagtgatggaggaggacagccaaatcgtaaattaatttttgaaaatattttaattgatttaaactcttaggaaaaaaaaattaaatagttaattaatttcagaatcaaatgtcggactccatcgaaatgttcaagacaatgtaccgcaacagattcctccgttcttcgtccttcatcatgtttctgaacaagaaagacatcttcgccaaaaagattcatcaaattccaatggaacaatttttgcccaatttgggggtaattaaactaattaattggttaattttgttgttcccatctaatcgtcgtcgtttttatagacaaaatgaaagcaaatccaaatctgagcggtgatgagctttactcggcggcacttgagttcgtcaagcaaatgttcagttcggtgagttaattaattgtttaattattaaattactattttaaattttattttatttaaatattttactaaaaaatttaaaaaattctccttttttctaggttagaaggcaagacaaacggcaaatttacacacatgtgaccaatgcgacaggttgaaaaaagcatttaatttttttcctaatatttttaattttattcaatttcagatacaaggaacattggcaagtttaaaaataataataataataataatgtataattattagaataaatagctgataatgagtctgaaatttatataaaaaaaataaataaaatttctaaatggactcgaattccctgtaaatggcattaatcccttgaaatctcgttaaatctctgtccctgacccatttccaattgttcgatttcagctacaaagatttaataaataattgattttgaactttggtcataaacaattaacaagccaaattaacaaattcttgccatttttcagactttgtgttcaatgccacctgcgacattattctcgcaaagaatataaagtcagctggcatgaactaacaacagacagcttaagatgagaatctgccaatatttatttgaacaatttgctaatttatcaaattaaatttaataatatttgaatgtaaattgtgccgttgattgccataataggtatcaaattaaaaatgctttattttacataataaattcatcaacgtataaaaatattttcccaagaaaatccaatcattggcatcataattattaatttgataaatatttgaatattttctcatattaatatggaataatataacatcacctaaatttatctttatttagcggatttattttttatctatttaaatttaaatacttaatataggtaatcagtgactaaatgttgtgattaatgattaatttttaattatctttcttattttttctgtttctggttaaaattattttgtagttttgcaaaccaaaaataaaaaaatatatttaattattctaataaattatatttttccatcctaatcaaaaattccgtaacgattgaatgtttaccaagaaatttcacaaattagtaaacaattttttcatatgtaaacattttctcaaaaaattgacatttaaaaaataaatccgcttcttaaatcgttacataattaagaagtaattgtcctcgatcgatcaatagtagcggaaccaattgtcgtagggataataccagcggaaatgcggtaaactgttacttaaaaaatcattattgaactaagcgcattaaaatcattaattaaatttacgttttgtgcatttgcccagggaccatccatttccacaaatccaacgttacgtcctggtgggcatatttggaacggtgctaaacattcacagaaattgattaaattaattaaaaaaaattaatccacaaaaatattagttatttttttacttggattattaattaaatttaaataaatt

SEQ ID NO: 2159 - DNA, 10657 bp, Heterodera glycines
atattttattagcttggtccttctttaaacaaaaatatgttaaaaactattccaaattttcaagaaaaaattctttgccgccggccccccccgccgttctccaaaaaattttggtttggaagaatccgccgcaaaaaaatggttaaaacctgattttttgattccgattgcactgaaatatacgatcgatttgtaatttattccccaaattcaatatttggtaagtttttgaaaatccaacattcttgagtatcatccgaaagctcttcacatgctctattagctttaaaaaagcaaaaagattttttggcttcttaaaaaattattaagaaaaaatttcgactttttcgcaattttcatgtttaactttctcggtaattgaatctaatcgctatgcaatagcttagaaaaagattctaaacatgttaagctttcgaatgatataaaaaatattggattttgaagaacaaaaaaaagttataatggaaaaatatgctgggcccaaccgtgccggtccaactgaggtaaaccgaaaaaaacttgaaacaattttgcaaatgctttggttttcgaccccaatatctgattttttaagccctgttctgattttgaaaatatttcgatagcaaccctggtttagacatgtacaatatagaaaatttaattactcaattaggaggaaatggaaacgaattttgctgtgcagcggacggtcgggcaacggaaatggcacagaattagtaggatacttagtaaacacggatagtttcggcactgttcccattttgtcaattcctatccatttccaaattgtcaattcccttttaccattgaaatatttgtcaattaaaacattgaaacgtggcgaaattagtgccaatttgaggccgagttgaggacggtcaaaaaatgggaacatgtccatccaaacgtcaaagcaaatccagctaaaatgccggggaaaaataattgaatgattttaaaaaatgtttaattttaacccaataaattctcacattttcctcaaaattcgtttattcattttctttggcacgtgaacttttcgccgttttccaaatgatgtcacaactgaacccattatttgttgttcatattcaccaatttcggtggaagtttcatcggtggaggaatgcttttgcttttttctgggcgatgccattaaaaaaataataatttgcctaaatgaaagatattgtaataaattttaatttaaatattttggatgcaattataaaaatataaggcctaaatatgttcatggaatgggagatccgacgtttaataatgccgacaacattaatgagcaaaaatggacccacggacaaaggatcagtcaaataataatttaattaagaatatatttaaaatgggaaaataaaaaaatatactaaatttaaaatttgtactttcgttcagcttttatagcacttatttcaggcatcggcgaaatctaatcctaatttgttcagattagagattttttggtcaattaagtcatatacatagcatttttctcacagtccaaattgagtaaattagtcacaggaattctctcagcttatttttaatcttttttaaaattcaaactattattttatggattctttgtctgtgggtcctttgtctctgtgggtcctttgtctagatattttgaatgggggtgctgataggcgccgctgggaaaattcttgaaaatttgagtccaatttgttactaaaattacccataaaatccaaaatttttcgtttgcggaggattaaaaatttttttccattattcgcttgaaaatttttaaagttttcatttcggggagggggggggggggaattcttcccctagctacgcccttggctacgataaaagaaaagttttgggttattatgaaaaagcgccggggaacgacctactttgagaggaaggggaggagcagtggcgttgccaacttggcgcctcaaagacaatagtgtaataaattgttcaatttccagcttatccggaacttgtggcacttctgggccgaaccgaacacgtgccagccacctccacagttacttgtgagtaaaaataataattgactttgaaaaaagaaaaaaaccaataatttttcttatctttttcgaataaactggtcaaaataatttatctttagtcacattaaatgattaaatagaaaattgtttttttttcagtgacgtctgccgagttacgcgatttggtgacaagtgcccttgatgccaatatgcgcgcggcggtcaaccaaacgggtaattttatttgaaaaattgaaaaaaaaaattgagtttccgtgtgaaaagggaggggtttgagatttcaacggtcaaaacccctgcatttttacttttaaaatgatatttttataaaaaaaaatttttttgctttttttttatttttatgtaaatgagcatttttcaaaaaataaaaaaggaaaacttgagaaattcttttaaaaaatagtcattaaaattttgggaggaaacgatgcgtggggggtggggcatttcccgccaaaacatatggttggtgctggaacttttactcatcaaaagaaataacaaagtgaaaaaaatttttcaaatttttatgctgactaaattttttcaaaatccaaaaatcgtttggaattttttttgaaaaaactttattttatgtggtattgaaattccctgtttttcagtcagaaacacggtggctgaagaatctcacaatcagcaacaactcattaatcggatcagcgaattggaaaatcaagttcggcagctgcaaattcttggccctcaacctggtgagtagaggaatggtccaacagattctgacattcttcaaattccaaaaacactgttttttaaactttttagagtgccctttcaggggagggggcatcggaagtggggagatcgcagaggagggaaaccgagaaaaatttcttggaaattttggcttattgaaaagaatttggtttttttagtgtatttttgcttcttttgcgtccgattctacccccttttttcatgatcgaaaaaaatcacatcttttttgtttgtttcccgggagtagtgaatgaaacaaaatgcacataaataaagcaataaacattttcagtgacgacttcgaacggaacctccggaattcgcggtaaacatttctttttattttcggtttgtggcattgcaaagccaacaattattttgattatagtataaaaacatagtaccatttggtgtgtatgcttcatccctcccccccccccccctcgagaaaatttttgaaagacaacgcggaattcttagaacttctttaaatcaaaaaatctatgaaagggacgacatggagggaaggaaaaatttgatccgtcactcgaaaggctgaagcatattatagaaacaaaaaattttcactgagaaattctcaaaaaaagtcttggctatttttttataaaaaaatcctcggaaaaaaccaaaaaatttcttgcgcttttttgaaaatctaattcgataaattttcttataaaaaattttcctaaaacctttttttgaaaaatttctgtatgaaaatttttttaatttggggttcgacttggcgccaaccaactgggcaccagcccggttttttggagaataacttttttgttattcgaattgaattaaattaatagcattcggtagccctaggtattttctatatgccaaaaatcgaaaaatttgtttgagtttcggaaaagtatttccaaaaaacctagcaaactttgttttccgaaaatttttggccataaatttctgaaacttaacgaaatttttcaaaatttagcatgctaatataaaatacataggttataagaaaatttaaagaaaaaattattgaaaatttttcagcaattgatggttcaatgggttccggcggtgccggatggcgctgcagggaataattttttgaaattttatgtactttaataagaaattatgcaattttatacaaaaaattgtttcttgaagcatttttcatttcatgtggcacgtgccccccccttttcccccctggatacgggcctgattcggctgagtgtctgtcattcgagccgtgttccaaaataagctgaccaaatttaattgagacattccaaaattttcttcttttttttgcatatattaattttcggttcaaatgtaacagtgattcgttattaagctcgtttcactgccttttgccagcaacggattacgtcattggaagcagcagaaaatgccctctccaatgctgaagtggttagactgttcaatgtgacgccggccaatgcgaacttgcttacatcctttttgcgcgaggaaatccaaagatctcttaaattttataacacaattttatattcacttgtctttgttgatgcactccttgtgcagttgtctgatccggtctattttgctcttgctttgttgtcatttgtcgcgttggtttatcgcttcgccggcttttctgtttacactgccgctgctctattgctttctctatttctttcattttaccgcatttattgttatttttaccgtaaataattatgtttgcccatttttgtgaagtgtggaacgattgggcatttcacgtttacaatatttttccaaaaattttttaaaattttcattctccaatttttggaaaggaatgttagctgagacaaaagcttcgcataaatcgaggttaaattggttttgaacatcttttagtgttgtcaaaaattgctgctgttgtcctcctctgttccgttccaattttgccttgtgttttgccgtttcgttatgttgtttgagatgcgcgaattgcgtacaagaaatctgtgatttttttctttgttgttgttatcgaacgggtgttgccgcagttacctgttgctcgcataattgacaataaattattttgccagttgttgaatagaagtcagttgcaccgatccgtcgtatccattcccgaaaatttgccgattttgattttatttttggcatatccaaagtctaatataaaagaagaaaaatatattgtgatatttatttttgttgagcaattttcccaaaaatgtcaaaaaagtgaaaaaatagtgacaaaatgccaaaaaaagtgaattttcactattttaagtgacgaaacgctaaaatagtgatttctagtgacgaaaagtgacgtccaaagaaaaaatttaatgtagaaatgcgtttttgagctcctttcttcaaaacaattgagcgaaaaaaagttttttcactagaaatcccgaccctactaatgtgcgaagggggagggaccggagggcctttcagtgcagcacccctcacatttgctcatcccggccgttcccccatctcatttatgcaacatttctccagcgaagcgacgccactattttttcagcgctcattccccatcccatttaatttgcatttatgcgtttttacgatttaaaaatatttttaaatatttatgtaatattttaaatatttatgtaccaaaattttattaattgaaactgatcagaaaagcgcctgattaaacatttattgcgttttcccctttaatcttttgcttcaaatatggtgattttccaaatatatttattctccaaaaataataataataattgggttatggcccagacaaaacggcattatttttccccactcaaatttaccgatcactataccgtatccttttttgggttttcaaatgataattttggatcatttttactcaatcaatttccaattttatttggacttatttttaattcgttttccctttacgtgtattacaattcaataaacaattgcttattttcgttaaatttaatttccatttgtttttttccattgtttattgccgtttttattttcaatgcgctgttcctggtttgatcagccgatttggcatttacctccaaacatttttcacttttggccgacacttatttatgtatttttatttttttttatttccccattggacgtttgtttgaattttgtcattgccaatgcattttttggcatgctttgttgaccaccttttccctacatttctttttgcatttcttttatgccgattccataaaggcatatattaattgcttattacaaatgctgataaagtaaagtagttaacccctttatcgtgcatggtcaaaggttgggccaaggcccaaaagagttgtgaatggaatcaatcgcaaagtataattattaatagagcccggacgggaccgggatcccgccgggattttgccgggactcccggtccctgcttttttggacaaaccaccgggaccgggagtcccggaaaaacgggagtcccagtcccgggatcccgtcccggtccattttccaagtcccggtcccggccatttcaaaattccgggctctaattattaattaagtcaatcaataattgattgggtgaatcaaaataaaagtattattaattataattcaaataattatggtacaccaccaaaggggaccatggtccgaaatattacagaaatccataatgaacactctatttctacagtattgcattgagtctacagtatctatacttttatgatactgtagcatttaaataatacgaaccaaaataaataataatgacaataatcaataccataaataacaaaataaataaataaaaataataataataaaaagaaaacgaagtgtaaagtacaattttttttctttctcacaatcctgtgttttctccgacattctctaatggtgtaaaattggtgaccgatgacttttgtaactttgtacactaatgcttactgtaatcagaggtcgtttcccacgctaatgcatttccgattgtgcattgactattgtgttttcaattcaatacacattgtctaattagtctttcactttcacaaattaatcataaaatgtactcactattttctattactcattatcatcattcagctattccaaatcccaaatccgttccaattgtcttttcctctcattgttcattgccaacacctatgacctcagggtcaactggtgcgattggagaaagtggttgggccatggcccaaaatcataatgatgatgaaatggtagcagtcagagtgtttaataaaaatgtatttaactctccctctcttttctctccccctctctctccttttttctctccccctccctctctttctccttctctctttatctttccctctctaattttttattttgaattactcaatccgaaggtaattaaagcgaattttattgggcagcggatattttggcagaccaaaatgtggcaaaatgtccatccaaacatcgctacaaatccaactgaaattgttaaaatatgttgagcggtcttaaaaatgaatttcataaattgttaacccaatacattctcacattttcttcaaaattcgatggttctttttcattgccacgcggagacttcgccgtttgccaaattctgtcacaaatgagcccatcggttgctgttcatgttcactaattgcagcagaagaaaatgccgggcccagtggacagcgcatgaaaaagtgaaagaataattggggaattagaaattctgatcgattattatgaatggaaattgataggataattgcatatcatatttatttgttactatcatgtgcgcttcttcgttcctgttttccgtcctccttttggatactttcctgtttttaaggcacacccattttttaaaatgcacaaaagcgttcaatattaatagacttacatattttggaggcataaaagcaaaacaatttctgccaaaattacatcaaatacaaattttttggttattttattttaagctgtgatcattcgttcgttaatttattctcttactcttctatgagtacattttctgtgatcagtcatcagagtaagtgatccccgcccttcttctgttggcaatttttctttaccgataaataaataaaattggagtgtgccttcaaaacaggaaaatgctctgcttttggtgtattcccccgtttccgaaaaaaatcacccaactctatttctaaccaatttaaaactgcgaaaaccaaatgttcctatttaaacttctgcatatttgacgctatttgcaaagagtaaccttttgaaatttttttcacttttttttgacacatttttttttgtttaaattggctgagcaaaaaaggtttcgttccatgacacagagaactccaagtttgttcctttgtcgaacatttgctgattggcacggataaatgcgatgaaagaatggtcgatgtagctgaaaataggaacattgtatccgttaatccatgtcggaatttgaattaccaaatccgaagatgcttaaaacgaattttcttgggcagcgaatggtcgggcaccggaaagggcacataattggcattgtcaataaacacgcgcaattctggcaccgctgtcactttgttcttgcgcaatacgatatttttcaaaattggcaattcgcttgtgccatcgaaatgtttgtcgaccaaaaattcgaaacgtggcgaaagaagtgccaatttgagtccgagttgaagacggtcaaaaaatgggaacatgtccatccacacgtcggtgtaaagccaactgaaattgtggaaaatcaaatcagggcaatggaaaactttgtctaaatattattttaccggcggttcattttgttggaaattagcacaattacgaagaacgtcacaaaggggcacaataataattatgttagaaatatttttacacaatgagaaaccaatcgaaaaaacaaacatttttatagtcacgaaaaacgaaaatgaaaacgtagaagcaaatgcttaaatctttactctttctctctttataaatgtattaaaatcgaccaatgccttcagtctccctaagtatcctctaattagcctgcaaaagtgatgcaatcagccgcttgcaattctgatctcccaattttggtatttagcatttattcagagaaatacaataatacaattataacgcggacaaacatccaatacaatacacatataatggtgtcctcatgccaaatattcatacaaatcgcgatcctcctccgagcgcttcaaatattctttctcaatcagcgagtcgatgcacttcttgatgatcggcaccttaaaaggaaaggaaaggcattcatttgcacccaaaatcattctcccccacctttggctggaaacgcgttgtcaattggttgagcacctcggccaccaacagctgatgcttcaacgatttgcgcattttcataatacggacaatggcagccttaatgagggagaagaaaggggtcattaaaattgatttgtcaattttctcacctggatgaccaacttcctgtcctcgtccaccgtcttctgcacgtcctcactctccttgtttgtctccctggcagaggacatggcacggaccaagtcgactttgagcttgcggctgaaaagacgggaaattgaaaaataatttagaactaacggtattttacattcatttttaaaatttaattacccccgttcattttcaaattcacctctggaattccgagttaaaggtgaatttctgctcgttgtcattgagtttcgtctcggtcaaagctgtcccatcggcgctggtgagcttcagcagattcgtcttgaccaaggattgaacaacggcgcacagctgatcagcgggaaagtcggtgccaagagtgacgtgcagctcgccaagtgtgtacgtgttgcgttcgttgtactgcatgaggatgacaatttgttgcgtgttgcactggaaaagaaaaacatttatttttacgaggaaacccaacttttaatgtcggaattgcttaccaaaaatgagtatttgaacgggaaagtgttgctcgtcgtcaccacttcaccgcggcataagccacctgcttatggcaacggcagcaccattaaattcattccggcctcaatcgccgctagggcaagcctgaagccaaaaaattaagggagggtgagtaggggttgttttaaattgcggaccttggcaaggagttcagcggttcatcaaccaaatggttaaattcgtaattatggagggggtggggctcgtgtcgtcctcccagaaaaaaatagaaattttttttatttttgtaagtcatgcgggagatgacgtaaaagacgaaaaaaacatttaaaaattgcggtgtttttttgttttttgcaaatgtcacgtagaataaactaacaaaacgcactaaaccattgctattggtttgaaggcaccaaatgccacaatttgatcgtttacttatgcaaaaacaaaaacgtcctttgttgtttttttgaaaaaaagatttaggtaaggactgactgtgagacctaaaaaccaagacaaaacaattggtattataacaacttgtgtaaatcagggaggacaattttttcagaaacgtaaccatccccgataaaaaatccgtttcggcaccaacctttttgggtttattgagagcaataaacgggtcaattctgtcgccgtcttcttcttgaagtcgcccagcaacttctcgcagtgctccccgcgcgaaatgctgtccatctgaaaatgggttg

SEQ ID NO: 2160 - DNA, 1408 bp, Heterodera glycines
tactttcgagttcttgtctggcattcgaaattggtcacactgaatggcattttcgagatcaacgtccctaaaaccccaataacatgttttcaaaacctttttttccaaaaaggggtggggaccatctgcagtattaccagatcagaaatcctctaacgtcgtctaaaatctgtgaaaattggataaaaaattcctatgctttttttaatgcgcgattcgcgtactgctaccgcggcacccttaaccttcactaaatgaacggatggatgaaatggataagatattccttttttttctaaaattcatatttatagaaaatttgttttgtcaaaatgtcgtcaaaacccgaaactttggtggagcggatgaagcatttgttgagctcgggcgatgacgcggacgttctctttttggtgggggaaggagagggaaaggaggcgagttttaaggggaaattgttacaaatttaaatgcttaattaatttaaattaattttaatttaatattgttttctttaagcatgtgcccgcgcacagagcgattctgaattcggcttcggacgtttttgaagcgatgttccgttttgacaccacaaaaaatgcgactgactatgaatcagcggctggagaaggtgtgaaaaaacaacaaaaaattttgtatttaaaaaaaaaaaatttaatttgaagcgaagggtcccgtagaagtcactgacatcgatgcgcatgtgttcaaagtgatgctcaacttcatttatgcggatgatttaagtgaattgaatggagacaacgcaatggcagtgctttacacgggccagaaaattagtttttaattatgttaaacagggacggtcccgggattttggcttgggagtgtcccttttttctaacaggttttcactaaagattgataattttttggattttcgaaagaactgctttgtaaattttgatgaggggggtaccaacaagaaaaaccgatatttttccataaaattagggtgcggaggggagtttttttttggggccccccaacctgagacttaccgttcctgggtatgcggggcatttttgcaagaggttttccttattgacacccactccagggacggtcccagggcgacgaccttttttttttgtggaacaggggtccggcggtgccgataggcgccgccgggaaaatttttcattttataatgaattccaaaaaatggcaacttttgccatttttagcagattttcattaaaaaattgtggattttttgataaatttagcgaaattttttggaaaatttgggtgaggctaagtctggggggagggtaccagcaaggaaaatctgaaattttcagcaaaaatactaaattttccttaaaaatttcgggtgcggaggggccttggggggggggggggg

SEQ ID NO: 2161 - DNA, 1331 bp, Heterodera glycines
catatatttatttttttatgtttagccaaaaagtataatcctaatgcattggccaaagcgtgttgaaatgttcccatttccgagctcggcaatgtgtttctcgcttatgaccaatctcgccttctcagcgaaaaagcatgaaattttgtttccattttatcattaaattaaaatcaatcaataatttttgtcatatacaaattttaattttttctttgaagtttggtacaaaaaatcagatcaaatcgatctcttattttttttcttttttttgaggatttctcttgtcgctgcttggattacattgaccaaaatgcggaatcgctgatccaatcggatgcctttttggaaatggaacaaaatttgctgtatgaaattatcgaacgtgaccagttgaaaatcatcagcggcgaactcattatttggaatgctgtactaataatgtacaaatttttgaatgaaattcattttcaggcactccgttgggctgacgcgcaatgccttcaaaatggcaccgaatgttcggcagagaatcgtcgtgttgtcctcggcctggcactgtccaaaattcgttttccgctcatctctctttcggatttctctgaccatgttggtaggtcgtccgtcaatacaatattttaaataatatttattttaaaattcctatttttgttagtgccatccggcgtgttgaccagtgacgagttggtcggcgtcttcctgacccacgcccacgcggaccgtcgtgccaactccgagttgtaccccaaccaatttcccacccaccatcgcactctgctcagcgcttttttcaacgaaaaattgattagtcgataaagctattttgcaaattgttctgatttttaaccaaaaaattcattaaatttatatcttttctttcttttgtcgctttaagttttgacttttgaaattaacaacaatgaaagatcgaactttttttggcattttttgcgatttaaatttgatttttgacaattttattgcacatcaacattatttaatgtgcaagaaaaatttacgcatttttcccctgaacatttcggcgacgggatcgaaagtttaaaattaactttttttttcagtatatcatacatatactgtacccaaagcaaagtagtttttgaaaatttttcaggcaaatgaccttatcaaaaaagtttttgccaagaccatacgtttcggcatcggtaagggcaaatctattggatttattggtcataaatctgcggattatttttcttccacggaaatatgtattgaaaaaatgaaatttatctttctatatttaaagcaaaaaaaaatgttggata

SEQ ID NO: 2162 - DNA, 6499 bp, Heterodera glycines
cgcccaaaatggttacaatcaatttctaattaccttttatcatcataaaaatcactcctgaggtgcggaaatggcaaaaaactggtttttgaaccggtttaaaacttgaaaatttgagtgaaaaggggggctcctgaccctttaaaacggtcaaattcggacaaatttggtatcattcgaaagctcttgatgagctaagtttaaaaaacaaggttataaattcggaccgatgccatctaagcactgggacaactgagtcccagtgaaaatcgacacttcagtaccaaaaacataaaataagttttcttatataatgcacgaaaatcgtttagccttgaatatcgagtattgcgctaaaaaaccgccgcacactcgatgctccgtcttcgcatgctcccttttgcggttgtaggtaatcctggaaaaaaataaatttttttaaaaacacatttccgcacctcgggactattttttatactcattagaggtcataagagatcgattggaacaagttttgggcgttttttaacggggccacttctaaagtacacccaatagtttttgccatatacaaattttaattttttctttgaagtttggtacaaaaaatcagatcaaatcgatctcttatttttttttctttttttgaggatttctctcgtcgctgcttggattacattgaccaaaatgcggaatcgctgatccaatcggatgcctttttggaaatggaacaaaatttgctgtatgaaattctcgaacgtgaccagttgaaaatcatcagcggcgaactcattatttggaatgctgtactaataatgtacaaatttttgaatgaaattcattttcaggcactccgttgggctgacgcgcaatgccttcaaaatggcaccgaatgttcggcagagaatcgtcgtgttgtcctcggcctggcactgtccaaaattcgttttccgctcatctctctttcggatttctctgaccatgttggtaggtcgtccgtcaatacaatattttaaataatatttattttaaaattcctatttttgttagtgccttccggcgtgttgaccagtgacgagttggtcggcatttttctgacccatgcccacgcggaccgtcgtgccaactgcgagttgtaccccaaccaatttcccacccaccatcgcactctgatcgggaaccggcttttttttctacgaaaaattgattagtcgataaagctattttgcaaattgttctgatttttaaccaaaaaattcattaaatttatatcttttctttcttttgtcgctttaagttttgacttttgaaattaacaacaatgaaagatcaaacaaactttttttggcattttttgcgatttaaatttttgacaattttattgcacatcaacattatttaatgtgcaagaaaaatttacgcatttttcccctgaacatttcggcgacgggatcgaaagtttaaaattaacttttttttttcagtatatcatacgtatactgtacccaaagcaaagtagtttttgaaaatttttcaggcaaatgaccttatcaaaaaagtttttgccaagaccatacgtttcggcatcggtaagggcaaatctattggatttattggtcataaatctgcggattatttttcttcaacggaaatatgtattgaaaaaatgaaattttatctttctatatttaaaaagcaaaaaaaaaaaaatgttggataatctgttaccttcagaggcagtaagggaacgaacctgagagtaaaaagtgttgaggaattaatttttaaaaatgagagcatacatgtacaaggggtgcgccagtcagacccccataccgtcggacgtttggcgcagggggggtgcgcccgacgcaccccccttgtccatgtatgaatgagagaatgccaaaataaaaagaattgctacacatgacatcatacaattgacatgaattagtagaaaaaaagaaagctggggtcgggaattaaaaatatgaatgaattttactgatccgacaatttgcgcttcgtcccttttttctcctcttccacagtgatgtcaacggccaatgtcactttgtccccgtctttgtcataaaatcctctgcttgggtccattaattgcttaattatgctcatttattaaatgagggtttacgaatggaaaaagctcaccgcaaaagtgatgaaagtggggaatcccaaattgttcaatttattgttgaaaattcggccattgaattgcccaattaaattcaccgccccgcccttttgtgagacaatttgaattgtggccgaacatttgcaactccaattttcaccttaattgccaatttaaataatgggataaatccatattttgtgcccactttttgagccggcacacaaaaggtaaaatgccaaacacttttcgctgcttttattattctgattgattatcagtgccaatatcttccacgaaagtccctttatttgtttgatttcgctgctccgttcactcaaacaaatctctcgcgaaaactcagtcaatttgccaatttccatcacaattttcccgtttgttttgtttggatttgaataatccaatttatccgctttttcttccttcacaataacatcgatggccaatgtcactttgtccccgtctttgtcataaaatcctttgtccttttccatcaattccttaattatggtcaattataaaaaaagacatctcttaattgtttcttacagaaaaagtgatgaaatttgagaaacccaaagtgttcattttgttgttaaaaatgtgatcattgcgttttccaattaaatgctccgtgccgcgcttttgagaaatgattcgaaatgtcgctgaacatttgcaactccatttcgggtcttataataaaataaaaaataattaattagaattaaaacaccattaattatcattatcccaccttctcttggcgcggtgcactgaaggaaaaagcccaaacacttttcggtggtgccattttcgtttttcgtcgtatttattttggcacatattttccacggaagtgcctttatgtgcactttgcctttgctaagtcggcactttccctcgtcccttcgcgcaaattgagaaaatttcgtaatttccattgcgagtgttcccgcatttcccctgggggtattattccacgcggaaatccgtgcatggcttggaaatgccaccggagataaaagcccaggcaaatgaaactgacaaatgccgacagattcctctgatgttaaaacgccagaaggaactgcgaaaaaaaaattatatttgtacatatttcgcgatttatgcttttttgtgcttatttggacatttttccaaaaaatcccttttaattagagtgccacgggaccgggaattttgggcaaacccgggaccgtgaccttttcgggttgaaaaaccgggaatttttggctgggaaaaccgggactagtcccggtcccggtcaaaaccgagaccttggtactcagttgtccgctaccaggtcccggtcccgtggcactctacttttaatccctttattttttactattttttttaaataatcagttttagtcttattttggttttcatatttagaatatttattatctaccaatattcgtggaaaattctctttgcgggatgagtgggaaacgaattttgaacagtgccgggccaagcgcagaacgacgattcgcagcagaacattcgatggcattttgacgacacttttcgtcggcccaacggagtgcctaaatgagtcaaatgatttgaacaataatttttattctatttttaaacattaattattacgctattccaaattgtgagctcgtcgctgattctcaactgatcactttcgagtatttcacacaacatattctggtcaatttgtgcaaattcctccgattgcaataaaattttcgtattttggtcaatgaaatccaagcagcgaagagcaaaatccttaaaaaaggcaatttaaaatacattaaattcatttacaaaaaattcctcaaaattcagtgcaaaaactttactttttcgctgagaaaacgagcatggtcaatgacaaggaaaacattggacaattgaccaattagactgaagcagccaaattcaaatttaagccctttcttcggatgttcaaaaatttaggaattgatggacccgaacagaggattatatgaccaaaatgaggacaaagtgacattggccatcgatgtcattgtggaagaacaaataacggagcgattcatcatttccgaaccaaacaaatccaacgggacaattgaaatggaaattgacaaattgtcggaatttgcgcgagaagtttcacagagtgaacggagcagcgaaaccatacaaataatgggattgtcatggaaaatagtgacagaaattaatacgaaaaatgacagaaatggaaaatgtttgtgctttttcctgtgtggcacttaaatacataattgaggttttttttgctcaaatcgactaaattgattcccccaccgccggcgggactcaacttgagacttgagcatacatttttgcggggggggggtcacaaattttagaaaatttctcaactagcacaaggttgtctatggcgcccagttggcgtaggttcggcagcgcccagtttgccccgatctcgcaattgtctccccctccgtcctaatttttatctcattaagatgaaaattggagccgcaaatgtatggcaacatttcgaattgtttctcaaatgatcgaccttggggacttctcaagaaaatttgatgaaaagagaatttttagtgctgggaataagaaccgaggatttactaatttcatcacttttgcggtgagtgataattaaaatttaaaagttcattttctcaataaaatgctcaaaattaaagaattgatggacccggagaagggattttatgacaaaaatgaggacaaagtgactttggtcgtttattttactgtggaggaaccataatttggagcataaatgacaatatttgatgaaaaaaccattcaatttttgattgcgtgtaacttttaataaaattttcatttagcttatttaaaagaattgtttgtgaatttttccagttttttctctggctgtgaacttattgctttttacaccatctttaaaattaaggtcaaacgatgccgcctaagttaaattttgcgtgagttatgcaaaatttacggttacccggcatttgcggaaaacgacattttgcggaccgacatttgcgggtttctaaaagtcgacatttgcagacaaatttttagaataaacatttataaaaaaaatttcaaacttagaaatttttcaaggaaaaattcttagaattttttataaagttttaagaaaaaaaattatttgttaagtttttcttgaaaattttttgaaatttatcataaaaattcaaaaaaaaaattactgaaaacaaaaattttttttctttcaatttcttataaaaaaactttctaagatttttttcctgaaaaatttctaagtttgaaattcgcaaatgtcgcgacacgaaatttacatttaaaattgtaaattttctttggtctcccaaattgccttcatctttaaaaaatggtttctttgttattatatttttgaatctaatccgaaaactgattttttttttattataacataaaattttatgagtgatttatttttaagaaatacaaaattagatttattattttttgaaaaaattaatcctctaaatttaaaagttttgtatttaatttcaattcaaaaaaaaattttcttttttcataatacggtacttctgcttgaaattaaatggaattgaggggtcgccaatgccaacaggcgccgctagtgaaaattttttggaattagctgaaagtgtatgaaaaatgattcgttaacactcaaaactaaatgctttattgtataaaaatttttaaaaaaatgaaagtgagtgattgattgtatgggtgaaagtgagtgattgattgtatgggcttattaatcgttcaatttgcgctttgtccctttttttcttccactgcaaaatcaatgactaatgtgactttgtcctcattttggtcatacactcctattgctactttaatttgaatttttttttataactttttgaattttttaaaattttttagtcaaaaatttttcttaaaaaaattaaatcgatttagcaacatagcgagcgatctttaaatattaatggattttatttttaaaattaaaaaaacataattttgccagacaatcgctttgtgcagcaggacagcacacggcaaatgatgcgcaaccggcgggaatgggctgtccaacggttgttcaggcattatgccaatgtcggtgtgccgtaactcaacgcgtacggttgggcgtaaattctgctgttgctgcctgagttggaggtgttacaatatggggactgcaatgtgggaattacgatcaaatatcgacccacaaaa

SEQ ID NO: 2163 - DNA, 1352 bp, Heterodera glycines
gggaaaaacaagcactggtttttttattttgtatactcgtgggtttcctataaagaaaatatgattcctcatagttttttttaaattgatacatattttatcattttttaaatgaaaatcctagcaattgagcttaataatcgtaaaaaccaacctttttttgttgaaaatctgttaacaaattgcacccaaatttttaaaatttcacccggcggcgcctatcggcaccgccggaccccttctttcccaaagttttttgaaaaagcgctccgaaaaaaagtgatgtgaaaatcaaatctgaatttctattaatattcgatgatttagtccaaaaatgattaattgtttgaaataattgaagaaaatttgtttgaaaattttcattaatttaatttattataaaaaaccaaataattttgtattattttcacttgatataaattaaaatttgaatttttttttaaatttttaaaatttttttgaatttttaaaatttcccggttggtccctgttcccggtcccggacaaaaaccgaggtcccggtcccggcttctcaggtcccggcaagtcccggtcccggtttgcccaaaattcccggtcccgctctactctaattttaatgaaccgcgacaaataacataatgccaatttttttaattttgttttttgttagtaatttcgtttttgttttagtttaattaatactttatcaaatttttgtttttattttctaaaccaagaatatattatttattctaattcttttcaatttgattttaaatttttgtctttttattttaatgaatgtatttgtttttttgatttcttttcttaagttattttttgaaataaaaacctttgcaaaaacaaatatggaaacaagggaagaaagaaagagagagacataaagagagatggagagagagagagagagagaagagtgatagagagagaaagagggaggtgtagagagagagataaggagagatggagagagagaaacagagagaaagagatagagagagagggaaaggagaaaagagagagagagagagaagttggagagaaaggaagaaagagatggagagagtgagagagagagagagggaaatgggagagaattgagaaagagagagcgagagagagaagagtgatagagagagaaaagtggagggttgagagaggggcaatgagaggtaatgatagagagagagtgagggagaaagggagatagagggagggaaaggagaagagagagagagagaagttggagagaaaggattgaagagatggggagagagaaacagagagtgagagagggaaacgggagagagtgagaaagagagaaaaga

SEQ ID NO: 2164 - DNA, 1581 bp, Heterodera glycines
taatgatagagagagagtgagggagaaagagataaagatagatggatcgagagagagagggaaagagatggagaaaagaattatagtgagaaagagaaggagggagagagaggtgggatgagagagagagagagaagagtgattcagagagaaagagggagggagagagagagaagagtgattcagaaagaaaaagagatggagagagagagatagagagagagagagagagagataaagagagatggagagagagagacaggggaaaaggagaagagagagagagagagagaagttggagagaaaggaagaaagagatggagagagtgagagagagaaaaaaagagagagagagtgaaaggcgagagagttgagaaagagatgagtgacggagagagaaagagaaggaggcagatagagagagaaagagagggagagagagtgagggggaatgagagagagagaaaaagaaaagtcatagagagagaaagagggaggtgtagagagagataaggagagatggagagagagaaacagagagaaagagatagagagagagggaaaggagaaaaaagagagagagagagagaagttggagagaaaggaagaaagagatggagagagtgagagagagagagagggaaatgggagagaattgagaaagagagagcgagagatagaagagtgatagagagagaaacgtggagggttgagagaggggcaatgagaggtaatgatagagagagtgagggagaaagggagatagagggagggaaaggagaagagagagagagagaagttggagagaaaggattgaagagatggggagagagaaacagagagtgagagagggaaacgggagagagttgagaaagagagagaagagtgatagagagagaaaagtggagggttgagagagggggaatgagagataatgatagagagagagtgagggagaaagagataaagagagatggatcgagagagagagggaaagagatggagaaaataattatagagagaaagagaaggagggagagagaggtgggatgagagagagagagagagaagagtgattcagagagaaagagggagggagagagagaagagtgattcagaaagaaaaagagatggagagagagagatagagagagagagagagataaagagagatggagagagagagacaggggaaaaggagaagagagagagagagagagagagaagttggagagaaaggaagaaagagatggagagagtgagagagagaaaaaaagagagagagagtgaaaggcgagagagttgagaaagagatgagtggcggagagagaaagagaaggagggagatagagagagaaagagagggagagagagtgagggggaatgaaagagagagaaaaagaaaagtcatagagggagagaaagagggagggtgagagagagagacaaagagagatggggagagagagagagataaagagagatggagagagagagagggataaaggggagaggagagaaatgaaacttggatgaaaaaatagtaataaactattaaaatttatttttaaatatttaaaa

SEQ ID NO: 2165 - DNA, 3603 bp, Heterodera glycines
  misc_feature (2212)..(2212): n is a, c, g, or t
tcttttaaagtagattttttcgctgaaaatgagtaaatttaagctttatctttgttttttcttctaaaatggtttttaataccatatttagccatttttgaaacttttactttatatttagggatttagagaaattttggtaaataaactctaaatttggaaaaatttatgtccatatttttgcattttatgttcatattttgcgatttttggtcaatattttatggccatattctgcgattttatatccatataattataagccctagtaataaatgtttctttgatgcggataaaaattttaaataaaagtttcgcgatcaaaattttatatttttaaggtagtccttacaacctcgtatccgaacgtgccgtggaacgctacgacctcgaaggactagtgaatcgaaacaatatttaccggttaagcggcgtcggggggacgcccgtgactacatgcgggaggtcattttattcttattaattttgtgaaatatatttatagttattttttttatcttaaaaatgccttttaattaatttaaaaaatgaactccgctttaaggtgtttaccctccgcagtcccacccttgaccctatttcctcattaaaatccgactttaatgatgaataaggacaaattagcaagcactaagggttcattaagatattaaatatgaattaagacataatttagtcgtatcgaaatacatcaccactgttgaaaactaacagctttttatttatcattaaaattctaaaccagttgaattattattttttgctcttccacaatttgcagcggtcgcattcatgcgaatttctaagatttttacttattttggcctacaatgctttttcaactttgggtattattatgaaaatgaagtaaaaataatttttaatttttttgttattggagtaatctattcactataaaatttatttcaggccgattccaatgcccaacaacgatttgatgagtggaaagacctttatttatgggaaaataactaataaaattatgttttatcctcagagacaaggtattccaaaagatcatagtctcgcttagaatccggtcggctaacacttttattgccttctcacattggacttttggcgttgtttattgtccatttgttatttggtcctttatcttttaatctccacaaacataaagcacatttgtttagtattttgcggatttttagagtgactaatttgcatttgttttggttaaatgcaaaaaaaaataaatattgaaaatattcactactataaacggtgatgaataaagtttatatttacgtttatgatttaatggatttgtgaatggaaaataataataatatttccagtatctgttttttaatttggtctcttcgcctgatgaatgctttaatcttttttttttgggtgataaataaattctttggagctctttagtgaatttatctctccgcctaataaagataacataaaagattttttatcctaaattatacaatgatttactgtaacagaaaaatgacataacataaaattattggaaaatgaatcttcagctaaattgaggttaattgtaaacctcttcgcctgctacataaaattgttgaccaaacgccaattattgctcgagtgaaaggcacagtacggaatcccaagcgagattttgcggaatatccgtcctgcagcatttgatcaccgcatcaccattgatcagacttgtttgatcggagtacgaccgtagtgtcagtcgacttgatatttaagtgtcaaaagtgatcagaaaaaatatccggaaatacatataaaatttgaaaaatttccaaaattttcctcacaaatttataacagattaattattatgagttcaaataagcccgactttggaaaaatttaaattttataaacaaccgcttaagaaagtgaattgttttaataaaagtttaagagatttcttccaactcgactatcaatttctcaaaagttttaaaaaatagcgctgaaaatatgaaaaggaaaagtaactaatttgaatgaacaaatctgacacccccccccccattaggcgacgacctttctttgctatcttcacactgtttttttacggacgcattttttcctaaaaactattggaaccaaggcagggggccaatcacattttacgaacgacaagcgacaaaaacggacgacaaacgaacaaatnttggcatatgtcattacgacaaaaaattatgtccgtttgaataagccgtttttccgtttgtcgttcgtaattgtgattggccccagggggaggagtcccggcgttgccagctttcagtgacggtctcatcttcaagtctaatttcaaaaaattttcagcggcacctaccagcactgccggaccctcctgttttccaaaagttttattgaaaaaatgcgccggtgttcaactcaaaaaacagctcgtcgtctaacatttattttaaaagttattaaataataaaaatattaataataccaaaagatgttcgtcatatgacaaaaattcccatttaaaattatatatgaaaataaaaattattaatacttttatttaaatttttcttttttctgcacatcactgttgtcttaaaacgtaaagttttcaaccaatcaaaaatataaagactgagaagcaacttgtattattaaaaaagagaggattgctaaaatgtcttttttctccatcatttccaatcaaagaacaattcaatttttattgcttatggttttattaaaaatgacttaaatcgctaaatttggtcatttttggacaaatttgtttttattatgttttatgttttttgaaaaatttccgagttccgaattgcgatttccgacttccgaaaaatttttgggcctcggaattctgatttccgatttccgaaaaattttggacccccggaattccgatttccgaaaatttttggggcctcggaatgccatccctgctatgtaccttaaaaagttacaggctatttgtactccctcgtctttgtcctaaaagcctttgcttgggtccatcaattccttaattgcacaaattgattggtcaattaatgcttctggtcaattaattgtcacacgccgtaaaagtggtaaagtgtgggaatcccgagctgttcgacgtgttgttaaaaacttcgccattaaaatctaaaatctctattcaaatccgccacttcgctctttaataaattgccaatgtcactttgtcctctttttaactcagtaaattattgtttgcgttttgcttcagacggtgactggacaatcggacagtggacaatcggacagtggacaatcggacagtggacaatcggacagtggacaatccgacagtgaggacaatcggacagaagtggacaatcggacagtggacaatccgacagtggacaatccgacagtgaggacaatcggacagaagtggacaatcggacagtcaaatataaaatagataagaaaataccggtcgccttgtactcaaaaccgtccgccaaaagaacagcccggcgctgtgttgtttcagcaacaaaaaacattttttcatttggttgaaggttcgggaggggg

SEQ ID NO: 2166 - DNA, 4035 bp, Heterodera glycines
aaattaaattaataaaaattttcaaacaaatttctttaattatttcaaacaattaatattttttggactaaatgattgatattattataaattaatatttgcttttcacataacattttttcggcgcgctatttcaaaaaatctttgggaaagaaggggtccggcggtgccgataggcgccgccggggaaaattttgaaatttgggtgtaatttgttaacagattttcaacaaaaaaggttaaaatgtggttgaaaaatgcgccgtaaagacccctaaagattgaccaaaatttcaattaagggaggtttcaatcagaatatcaaattgattatcatttgtcctccatttttgcttctttcacagtgaaatcgatggccaatttcacgttgtcttcgcctttgtcgtagaaaccgttgcttgggtccatcaattccttgattgtcataattggaacaattaagggaatgtttaattgtcacttacagcaattgaaataaaattaaagtatccccagcctctgtttttattgttaaaagtatcttcattagtaaatcttttgtaatcctttacgccgctcttttgcgaaacaactcgaaatgttcccaaacatttgcaactccaattttctgctcaatatcaattaattaattgttgttaatatatatattaattattagtaattttgcaccttcttcagaagcatcacacaaaagggaaatgcctaaccatttctcatttttgtcagtgctttcatctttcttttttatttctgcccatattttccatggcattcctttgatgtgcacagtttcgcttttacgttcactctcaaagatttctcgcgcaaattccgacactttttcaatttccataaagagtgtgcctttcgaattgctttgatccaaattgaatttgtccacttttggttcatcaacagttgtgagatcgatggtcaatttcactttgtcttcttccctgtcgtaaaaaccattgttaaggtccatcaattccttaatttaaatcatctaatttaatttttgtttatgcgtggtcaattggttatgttttagaaattaatttattttgttatgatttctttacaccaggcaaataaataaatgaacttcaatattggctggtccacgaatgtcaaatttaaatatttgtttgaattggcacttaccgcaaacgaaacgaaattagggaatcccaaattggtcaatttattgtccaacacaaagttactaagtgtcccaacgcaattctccgtcccatttttttgcgagataattcgaaaagttgccgaacgaacgcagcagcgccaaagcgaatcttaatggagtattaattattgctgttaattagtactaattaacaattaattgttgttaatatatatattaactattagtaattttgcaccttttttcgaagtatcgcaacaaatgaaaatgcccaaccatttctcattgtcagtgcctccatttttcgtttttatttttgcccatatattccatggcaatccatttatgtacactttttcgctgtaccgactgctctcaacctcctctcgtgcaaattctgacactttttcaatgtcaattaaaagtgtgcctttttccgatcggaaatccgtccattagtcggaaattgcattgggaaaaatccgtcggaaatcccatgataatttggaaggaatttgaactgataaacggcgatcacttcatcttttgacaaaacaccgaagggaactgtaaatatgtattaacttattgaaaaataaatttttaaaaacattttaaaaaatcgccacaaaaacaatgaatattttacggcatctcatcagagaatgagtttgaaattttgacttattttttaccaattttcctcgtaaattcctcatttgacaaaagcggaaagcgaattttgaacagtgccgggccaagcatttgacggcgattctctgctgaacaatcaatgccataatggataaaaattaaaattattgaaaaaattttaattaataatttgatattagttattttaccaattttcttcgaaaatttctcaattgagaaaagcggaaagcgaattttgaacagtgccgggccgagaacggcacgacgattctttgccgagcattcaattccattttgatggcattttgcatcggcccaacggagtgccgaaaaataaataggaaataatggttaatttaaaaaataaataaatgaataataaaatttagagttttaatttatttgtaaaataatttcagcgttccaaattgaaatttctccattgatttgcaattcgtcacgcgacaaaatttcacacaatgttttttggtcaatttgtaaaaattcctccgatttgatcaaatcgtccgcattttcatacaaaaaaaagtctctaaagccaagggtttttcgatctcacaatcagacagcaacaattaattggtcttaaagtagcttggttccacggtcctcactagggctgggatttttaggcaaaagcctattttttcctgagctccccgtggcctgaaacgcactaaaacatggttttttgggatgttgttaagctacttttcgagttattagagcctattttctaggtttttatttttagagcctaaaagcctaaaaattttttgaaagaacctatttttgccttttgtccaaaattataataaaaatgcaataaaaacgaaaaatacacccctaagaatcgacctaaaattttttttcaaaaaatagacccctaagaatcgacccaaaaaagcaaaattttaaatttttacaaaatgcaaaaatttacggcattccatatggcaatttcttggcttacaaccaactgatcccggcacagaattttgaacaataatttctggtcaatttgcaaaaatgcctctgatttgaacaaggtgtccgcattccgatcaatgtaagccaaacaacggtcggcaaaatcatgaaatgagggaaaaaattgaactgtaaatttgttagtttatgttatactttttcggtcagaagcgagctttggcaaaagagatgaacacattgcccagcttcgcaataggaatgccaacacatgctttgaccaatggttggggtaaaacagatttatgaggtgaggcacaagtttattttcgttaacttcctgacaatgactctcctaaaagttacagagcaacatccaattgaaaggtgtcgcgactgaacgtcagccgcgaatgtccgttgagcggacaaatgaggagaacggggaggaatgaacgaagcagcaaacgaggagtgatgaatggatggaaagatgggaaaaatagggcaaacgggaaatgatgaagggaagggaggacaaaaagggggcgaagggagggacggcagcaggcgagcacgtgaattaggggaaggaaagcgataaaaagcggatgtggcgccttctccgcgtgaaggacgcccgaggcagtgcaaaaacgccgatcggaccatcgcggtgcgacgggcgaaacaaaacatcaccaaggcggacagccgatgaaaatcggcgatcatttgatggaaaattgcgaatttgcgggagatcaaattcgcccggacccttccccccccccgcttttctccggtgatgtgcccccttccccgcgactcaccccacctttgtgccccccaattgtgccatttttccctttgcatttcccctcgcattttgtccccattgtcacaattttcccccctttgtatttctcacacatttcttatgtatgggtttaattacccaagtttgagtttgagataaacttgcggagtaattttggtgcaaattcttggggcggcaaattggcaattggcggcagcaaatcggaacaaacggcgcggacccctcccccatccgcgtcaagtggcgaccctggcacttcaacggaccgtgcgtggacaaaaagtggccgacagacattgcacacaggagcatttgggattagtgagtaaattgggggaagaggaaattttgagattgggcaggg

SEQ ID NO: 2167 - DNA, 4431 bp, Heterodera glycines
aaacaacttgacataaaaattttattaaaaaggaaagatatattttcgaaatttttgctttgcagttttaggaaacgcccatggtggcggtttttaggaaacgcccacttggcgggttttaggaaacgcccatggtggcggtttttaggaaacgcccacttggcggtttttaggaaatgcccatggtggcggtttttaggaaacgcccacttggcggtttttaggaaacgcccatggtggcggtttttaggaaacgcccatttggcggtttttaggaaacgcccaatgtggcggtttttaggaaacgcccacttggcggtttttaggaaacgcccatttggcggtttttaggaaacgcccaatgtggcggtttttaggaaacgacctagcacccctctaaggaagctggatgaacaaaaatgaaaaataaaaaacaaaaatcaaagggattcaaaaggacatggaaaatgcagaagtaaaagaaatacacagtttgatgaacaattaaaattttattgcttcttaaattgatttttgttttgtgattttgacttaaaaaagttgtagaaaaaatttcgctttcgagtttcttggaatttcgcgtttcgcattttatttttcgatttggcccatccctgatgctcaatctaaagcccggaaaaaactccaaaaaaaagaaaggagtggtcaaattttaaatgggatgaatccataaaatttgacgattatatatatatttcatatcaatttgtccgccttggtttttcagattttttgtgggattggaactcaaaatttttggggatccctcgagattaatcccgcggatccagcaaaactcaactctgaaattcatggtcacgatcacgaaaaccgtgaatttcacggtttttggatcatggttacggttacgattcacgatgcacaggtttttttcaatcacggcacacctctactcatgctggagcgcggacagaaaaatcccgcggtcgcggatggcgcatcgcggattcaatttgccgcggtcgtggatcgcggtcgcgctccactcctgacctctactaaccacctctaggccattataacaacaatagaaatgctttttcctaaatttaagctcattgtcagaccaagtcttagaaatgtgtgttattttcaatctatagttcccattcggatttaaaagtcaagatcgagattggagttttgaaaaccggtgtcgaaatcgagatctgcttccgaaaaagtcgggattccgaccaaaaatcagtcgggatctcaatgccgtgcaactccactaaaaatcaaccgtaaaaaataacagcataactgtttgagtgaaaaaaattattttaaaaaataaaataatgttcccgggttattttaatttttttttccaatttgctattaaaaaaataattattttgctgctcgtggctgtgcaaagaaagaactgggaaaactctaataagcccaactttatcaccagacaatgaaaataagaaataatttaattcacattttaatttaaattgtattttataatataattttaattttataatattattcgcttatttccttcataaccattctacgattaacaatttaaaaatctttgttaattaattgcattcccttttaattttcgtttgttttttagcttccttactaaataatttttcttaaaaacatggcaattaattgtgctcctctcacccgttttccctatgacataatgatgtttttcataagacatttaataaatcataattaattggactaaagaacaagtttaatttgtgtcaaatcattccatataaatgcattatttgtcgtcattattttattttactttacatttttattcttttaaatgtcgctatttaaataatcatttcaatttaatgtcttttttaatataactttaattgctaattaatttatttttaatgtttcagttaaaatgaacaagatcccttttttatttattgctctttttgttgtgcaaattattgccgcttatgagccaagttgcaaagtttgtgatcaaaaaaataataaattcaataaataacaaattttagtgccccgaaaatgaggagccgggccaaaagagttgcaacggatgtgagccaagttgtgacaatccgaagccggagatttgcactgcgcgcttttgtgactgttcatgcgactgtgtgaagggattgttccgcgacaaaacgaaaaaatgtgtgcccaaatgcccgtattgaggaaggaaattgatactaacgatgtaataatatcaaattatttaatcattcattaggaattatttaaaaattgaaaagaattagaatttgttagttttcaataaatccgttaattatgtgtgtaaaagtcaacacaaagcattcttagtgaatcattaagcaacaattgtaattgattcaaaaatgattcattccctggaccatatgaacgcatttcactatcccaatttatcagtattttgctgaattttttgaggaaatttgctgatttatgctgatttttagaaaaaactcaccaaaaatggccatttctatgtaaaactgttaccgaaaagttttcaaaatttacttaaaatttactaattttttcatataaattagctcaaaatcgcaaaaattgatcatttttggtcaactctaattaacaatggcattaaaatttttctcagcggcgcctgccgatgccgccggccccctgttcccaaaaaaaagtttaggaaacgcgtgccgtaaaaaacatttttttttttgtttttttatttggaataaaattttccaaaatggggattttgaaaattttcatctagcagccctgtttagatattcatttcgaaaatccatcgttttagctatttttcgacaaaatatgatattattttgctagaaaatttccagaatgggcctaaaagggggtgaaaatatttgtgctcatttgtgagtactaatttgttctgtaagttttggagttttaaaattttttaaatttttttggcccttgggaattttgtttaatttttgaaaatgcatctcatttctttgctgtcattttttgtgtaattttaaagaattaatgctttttatttagaatttctatcttcaaaaggaaaaaagttattccagagacttggaaaatttcgatttttcaaaaaattcataacacccttccgaataagtctttgtaaaataaaaatactaaaaaaattggcatctgtgaaaaattgctttaatttatttataaaaagagtgttcactaactacttgatgtccaactacaaataaatatcaaaaataataataatcttctcaattcatcatctaatttcaagcaatgttatttcggttcagcattcattgggtgtgtgagccggccaatccaggcatagaaatcacactttccgagttgggcacattttgaacatggacaccttaagagattaaatggatttgattattcctttcttaattgactttacccttgggaccgttgatgggcactttgccaatgctaataccaaactctgcacatttcgagtcaatttcagtgactttctgaccaaactgtgtactcaatgcctgccattcgctgttgttgctggcatgggaagaagcggaggcggcaatggcgaacatggcacggacgaagccgaggctgagggcacactcatctaaaaggggaaagagatatttaaaaatgatttaaaaataaataaataattattaggcaattgcccattaattggttattaccagcagaatgagtggcaagggatgcttcgatttcggccaaaagagttcgatcaccgccattcgagcagccgatcagttggcctttcaacgcgtccgcaacattttgggcatccgaacaaagcgatgacttggaaatggaattggcaaaagtgccaacgtaattggacataagtgaaaccactttttggctgccgggacagcacggatctgtcggaaaacaacaaattagtaaattaaaataataaattaaaaataatacgcggtgccgaaaagcaacattggcacatcaaacagacaattgcgacgatggcgagcacagagacggacggggaagaagacatttttggagggatttcttcggatttatgaaattaatggtattggttggtttggatgttggaattggatatttttttggagccttaaatacatttttattgtaaaatggaagccaaagtgaaagaaaaattgacgttggcatttgccgacaaaaattttttgtaaaaaagcacatttaattttgaaaggaaggaaattgttgtaatttgcaggtgttttttttcaatgtttgtcggcaaatgccaacatcaatttgccatctttagggagtgccgttttacaataaaaatgtatttaagctcatagt

SEQ ID NO: 2168 - DNA, 2137 bp, Heterodera glycines
agcaacaacaatgaatggcaggcattgagtacacagtttggtcagaaaatcactgaaaatgactcgaaatgtgcagagtttggtattagcattggcaaagtgcccatcaacggtcgcaagggtaaagtcaattaagaaaggaataatcaaatccatttaatctcttaaggtgtccatgttcaaaatgtgcccaactcggaaagtgtgatttctattcctggattggccgcgctcacacacccccaagataaaaaatgcatcactgaaaagatttggtaccttatgattattgtgcattaattagctgtggattttgtaaatttaggtaattatatgtaaataaatattaattcgttggagaaacaagattatttttcagaaatattttcttaaagaataatgtggaaattttgagaattataaaaaaatataattgtaaaatgacgataataaatgagaaaaccaactcggatcttactgctgtaaaattagtttttactctttttaactcaattttccaatgttttttttttaaaaaatgttggccaaaaaccggaagattaaaaatggcatcttttgtgttttgtcggcattatttgaaaacccaaagggaaattgagtgggcattaaaattgttggcacaaaatcaattacaaaaatgcgataaacttttattggaattttccaaattatttttatgtaaaacattaagtttaataaatttttcttctctttgatcaaatatttttacataaacaatagaatttttcatctgttgacaaatccgaatatgaattttaaaactaattaaattttttgagtttttctcaaaattggtgacacataataatataagcaatttattttttattgtgcatcttttttgagttaaacattaaaaaaagctgaaaaaaatcatttccgaagtaaccttatgttgctgatattcaatgttgttagcaaattaaatttttaataatttttcaagcaaatatatttgagaaaaatttaagtttgccaaaaatggacaaaatttatgttaccgtttattcttatttcattgaaatatgtattatgatgtttattcatttgattttttattgtttagctaattgatcatattttatcgtttatttcgatattttgttttttttcttcaaccccagcatttgtaatcgcaatcggcggagcattcgtcgaatgccgaaaggcatttcatgtggcattcggtggcaacaccgtggcacttggacaagcatttcacattttgcgcgttgcatccggtgcagcaactgaaaagcaatttgaataaacaattatatccacttccattagattagcataaatattttcataagatgtaatatatgaaaaaaaaatactctttttcttcagcaaatgatgaaaatgggaccaaaagcagtgccaaaagtgaaagccaacgcagaaacattggccaatatcaattctttgagaaagtctttataaacaaattaataaaaatttgtctttaatcttttttgattgcttattaattttttttagtccgtccaattaaatcgtaattatataaaaaaaattccaaaagtgaagccatattaatttttcacaattttgatcgggaatttataattttctttaagctgagtggttttaaaaattctatctgtgtggcgagcgaaaataaaatgcttattatggaatgtgaaaaggaaaaaaaggagtttgcgaagaatttattaatataattatattttgcctacaaattcttatggagaaaaatgatatcactaaaatattgaattaaacaaattaaaaacaatttaaaatacagaaataaaccgattaaaattattatatatacgaaataacagagagtaacgaaataaaaaggccaacattttgttaagacagctaattttcttcccgatttcaagttcttcggggcgtaatgggacattgcgggccgacatttcgggaatcggattcaagttattttttctcgtggttggtcgaccgcgaaaagtgcaaaaatcaaacacttgataagcacatgatttttcatctaattatttgataatttcattcaaaattaaaagttatcttatatataaagtaaaattaatttttgctattt

SEQ ID NO: 2169 - DNA, 4988 bp, Heterodera glycines
atttgattttttattgtttagctaattgatcatatttccttataatttcgatattttgttttttttcttcaaccccaccatttgtaatcgcaatcggcggagcattcgtcgaatgccgaaaggcatttcatgtggcattcggtggcaacaccgtggcacttggacaagcatttcacattttgcgcgttgcatccggtgcagcaactgaaaagcaatttgaataaacaattatatccacttccattagattagcataaatattttcataagatgtaatatatgaaaaaaaaaactctttttcttcagcaaatgatgaaaatgggaacaaaagcagtgccaaaagggaaagccaaagcagaaacattggccaatatcaattctttgagaaagtctttataaacaaattaataaaaatttgtctttaatcttttttgattgcttattaatttttttagtccgtccaattaaatcgtaattatataaaaaaaatccaaaagtgaagccatattaatttttcacaatttttgatcgggaatttataattttctttaagctgtgtggttttaaaaattctctctgtgtggcgagcgaaaataaaatgctttttatggaatgtgaaaaggaaaaaaaggagtttgcgaagaatttattaatataattatattttgcctacaaattcttatggagaaaaatgatatcactaaaatattgaattaaacaaattaaaaacaatttaaaatacagaaataaaccgattaaaattattatacatacgaaataacagagagtaacgaaataaaaaggccaacattttgttaagacagctaattttcttcccgatttcaagttattcggggcgttgcgggccgacatttcgggaatcggattcaagttattttttctcgtggttggtcgaccgcgaaaagtgcaaaaatcaaacacctgataagcacatgatttttcatctaattatttgataatttcattcaaaattaaaagttatcttatatataaagtaaaattaatttttgctattttgcaaacgaagcaaaagaaaaaaacttattaataataattcaattaaataaaaaattacttttttcaattttcccgatttttagttgtaaaaatattgaaacactttgacgaagaccaataaaaaaaatacaatttaccatgatgttaaattgtgtcatggtgaaacatacaaaggaaaacgtacataggcatgctaggcttaggctatggctgagttttaggctaggcataggataattttactatatataatatatatagtaactttttgaattcaaatataatataatttttgtaatttctttaactttaatctaataattagatgaaaaatcatatgcagaaatcaaggacttggtttttgcacttttcgtcggtcgacatagcaccatttttccttgatgaccattgtgcgtggcgtgcacttggcggccaaaaaacagaaatgcaatttgtgaaacttttatatatatataaaaatttttttctttatttttaacaatttttagcaacaaaatttattaaaagctattcgaaacttttgtaaattaaaaattttccggagtttttattttaaaacttaaaacgctaaaaatattttagattttgacaaaaaaataaacaaaaaaattttcataccttttttatattacggaaatctccatattcatcgtgaatttttattatttttacataatatattttataaaacatttatgcgtgagaaataaaataaggcttatatctcattaaaacattgattatcttagtgtatggcatgcgtttcatcttctagaagagattgccaatatttacaatgacttcaccctactattcataaaaatgcatttttaaatattataaaaccataaatattatataatttaaagttaaaataataataataatcatttttattgttttaaattacctatttttaacgttgtaattacttatttttgatgtgtcttcaaccgcattgcctcatttacactattatcttcttcctccaaatagaaatatcaaatgcatatccaggcgaagaaattgctcatggtaaaagattagtttgtggggactgctggatggaaattctcaatatttcaagctcagcttccagatcaatttaatccttcatgcattttttcgctaaattttctaatttatttattttggtcttgctttttttgatgtcaaataagcgagatatctcaggttaatcctatctgctgaaggattaaatgattttttacttaaaaaagctttttctgtcgggaaattctcgactttcccgcgtcatattcctcggcccctttttcttcatgcctctcaggccattaaagtgccgatcccgtcaactttagtaaaaattaccaatttaggatttcattttatgtacaccatccttcgctttccattttggccttacgatggggcacaacacattttgttggacaacagctatttgcactatttcaaaacaacgtccgaagaatatacagaagggttggctctgaaaattgcaatttacacccatttttacatgctcaagtggaaaacggaacagaacaaagaaatattggagcagaggagaatatccggctcggaaaactcattatacacggaaatcaacaaccatttgaaaacgtaaataatttataattaattacatttttaataattagatgaaaatttttaggtattaaagtgcaaaatatgcttcgaaatgccaaacaaattttaaaaaaattaggaaaaaaatagtaaacaaatgttccatttgtaaatgaaaaagattaaataaagtgaaaaaaaatattagaaacacaaaatttttaattggaattttcaaaaatcccaaaaataggtaccaaaaatcctgaaatagatacgatttttgcaacccaattttttaaacggtaagattagaaatccgagcatttggtattttgtcgactcattaaaacattgctcataatttttttttttagaatttccataggtagtgcgcttaaaagtctcaatattgcgacagtttgtttactgttaagagaaaaatatactcttttgagtacattaaatggtgccgaattcaaacggcaaaatccgccgtgcccatcgtgtgaaacccaagagaaagcgcaacagacagtgaaagatcattttgaggaaatggcagaatggatgctcagcgatctgctcaaatcatttcactcgagaaaaagattaataaaatatttgaaatggtcattaaaattgtgaaacaataaaattattttttaaaaattcaaaaaacaattatttttcagcgaaattgcagcaaaaaataaccaatacgaaattgaaaaggcgtggaaaaagctggtcaatctgttcggatttgcacgtgctctacttctttgtagaacatttcggcaggaatttggcattttgtgtaagcgaaattagtggttcatttaaaattattcgtcaattatttactagggatgtcaattttatgtaaatacatatttttcctggcttctccatgctttgaatagtaggaaaaacactttcttttttgtgtcttcgaacaaaaaccgggacttttatttacatatttcggggttttattcatattttacttacattaaagacttattgttagaaaaattaattgctatatttttgagagattcgtgcgttttaagccattgaacggttagtagttaaccgccccggtgcgtagtttgggcgggaaaatttcccgcacaaacgccagcctattgggcggttttaggctttgaagttgccgccacctgtcaatcaaaaggtggcgggggaggggaggggtcgagagtgagtgatcggtggagagggtgcgcgggagggggtgttgggtttaagcctaaacctattgcgtagtttggggaggagtcccgtaggtgttgatgggtgggtcgggattttttttgaaactgagggggtcaagaggtcaatgaccaggtgtgaaattcacacctggttttggatgaagtggtgatgaatcggtgagggaggagggggacggatgagttaaggtgtgaaattcacaccttttttttgaacggtgacaaaagttggttggggggggcgttcggacagtttaaggtgtgaagttcacaccttgttctgagaaaggagggaaggggcgatgaaatatgttaaaattctcactaatctgacatttgagatcgcgtaattgatgctttatctgttgaaattaaaataaatgattataatttgtgtgaaagttcatcaatatgaatctgtcactcattagatttttttatttttggtggggccagcaaatcggtggcaaaaatgttctttcgggcgcaatcttcgcacatctcaaagttcacagagaagtgctgatgatccacagcgcgcagcacctttcctttattgaagtacagctaaatgcaaagtgtgcgacgaatgccgtcgaaaacaacggctgtatgaaattagtgcgcggaaaaaaattattgcaagctgcggtggcgaccaccactatataaaaatgattgaactacggatgcgcgacttaaaattatataagcgagcttataggcgaattaaatctgtcatcgaccaagtggtggagggtttgtaatgtgtgggggagggtaaaaattttaaaaaatttagggccattccatgtaaagtgcacttcaaagtgccaggaggaattcacctattatttaattaaatgggaatgttgcagtgaggattttgggtggggagttggctgcacatatgcagaaattagtgatatagtaagaaaaaatataataattaaaataatatttaattggtagagtcaaaatgagttgttggcatattgcaatcgccaacgcatgcagggcaatatcgatgcgccgttggctatggatggaattatagccgagttgcggggtgaaaatttg

SEQ ID NO: 2170 - DNA, 11807 bp, Heterodera glycines
  misc_feature (3837)..(3837): n is a, c, g, or t
gggctggcccacctgttcgtttattttcgattgtaaccattccactgcccgcttgtcaagacgcgccatattcacatttccactgccaagttccaccgccacgtcggatggggcataaattctggctgagtctgcagcggaatcccgatgccgcgaagaggagcgagacctcaaaaaaggatatttggacagtcattagaagggatattccagaatagaaatgaaatgcttcattgtacataccgatctcttcgcctatctttatgagacgaacgcgacgccttttgacgcttttcgctgcttcgctcacgcgaacgtttccggttggagcgatgcgaacggtcgcggttagtattaggagttgtagaacgagaatggggcattgcgctaaacaaaattaattttaaggcaggtggagcaaaaaaagtgtaaattacaaattgacaaattaaatttttcgttaaaaaattcctattccagacggatttccgttaaaattgacaggatcgggaatcctttttccgttcgctttttctttattcccgtttccgtaaattttttaccgggctctattttaataaaaataaattggcattttgtttcatataattctgttggtggttgagctgacactaatgattggatcagcccatttaagttctcaattcgtttcacttcattcactttagcattcacattcgtccttttcaaaatcttcttctctcagtattcttattattaaattttttttgtactgtcggtggtaggctccttttgaattttttttttttgttttcaaaagacatcctagggttttcggggtcgttcgaaaatttgaattttcgaacttttgttcgaattcaggtccggggttcgaaattggtcgaaatagatgccagattcgtgacagcggccccgaaaaccctaggaagcttaacaaaaaaaatttaaaaaaaaggggggggggtaccatcgacagtattaccgaaatgcctattgtaagtttatcaatctttatttggcctcatttgatcagaggcccaggcatacaaaaaaaaatccgatacaaaagtggcatttaatcatagtaatattctagttatattcagatatatgccaccggaaattgtacgtcggcaacccgaagtaaaaaactaatttcaagaaaatctcaaaatttcaaaaaaatttccagggctacggccaatgcgcggattggtggagcttcggtgtcattgcgtttgaactgctcaccggctgttccccgtttacggttgacggcaaccagaactcaacggaggacattgcacgacgcattttgaccaaaaaagtgccatacccaaaatggatggaccgaacggcgcgcgacttcatcggccaactgttgaacagggacccgaagttgaggtgtgatcaccgattaagtctgatctgtcattgatcaagaatgatcaaccactgatcaacaaatgattactcattgatcaaagcatgatcagtcactgataaataaggatcagccacagaccaataatgatcagccattgataaataatgaacactcactgttcaagtataatcagtcactgattactgaagtttgagacatttatggttcggatatttgtcccggtcaatttcctcaaaatttaaaacataattaaatgcaaatggggctcaaatgccaagggctggtttgatctgaaagaatattgaaaaaatgatcagaaatgttttttacaaccttagttatacattgaattgaagagtattaatgttttttttaaattcatttatttatcctaaatttcattataattttttatatacttccatattttaatcaaatgtaaaaaattcatattccccacagacttggcgcccggggcgctgccgaagtgaagaagcatcacttttttgacggcaccgattgggaggcggtggaacggcgtcagacaaccgggcccatcaagccgagcatggccggctgtgttgcggacgtggaaaactttgccacaggcaataaaaattattttttgaaattttcaaagaaaattttacagaatttactgcccaagcaccgctgttctcgcctgcggataaaccaccaccggaatgccacacattcttcagcggctactcctttgtgtcgccgtcagtgatttttgccagcgacaatgtgatcgggcaggagtgcctggagtcaaggtggcctccggggaattttttttaaatttttgatttgatttacatttcaaaaaattttcttaaaaattaatttcattttttaaattcaaaaattttaacttttaaattcttacatatcggcccgattaggagaattaaatttttgaattgattgtttaaaatttaaaaaaaaatttaaaaattttcttgtcagggattattccatttttatagtaaaattaattctttttttcaatacattataagccctaaatgtttgggaaatttttttaaatgaaaattggaaatagaaggaatttttcgacaggctttgaaaattaaaaaatgatttttttttttttttacaaaaaaattcacccattaaaaatttattcaattttttaaattcaaaaattaaaaattctaacatctcggcggaacaattcatgttattttaagaaataccgtaaccgaatgagttttataaccgtcactaccgggtgctttttttaccataataaatttcttaccgtaccattaaaatactaaaaatatttaaaattttgtcacagtgttcgcctcctgtccgcccagtcgtccccattttttgccaattatcggctggacatcacggcacagggactgctcggcaaaggctcattttcaatttgtcgcaaatgcgaacgcatcgcggacggacgacaatttgctgtcaaaattgtgtcgcaacgtttcgcgcaccaagcacgacgagaggtgattaaataaaaaagcaaaaggagataaaatttgaatttattattattattttttaaatagcaaattttaattaattttttaaccctcttgtaaaagaaggttttaaaaatttttgttccactttttattgattattcatttttttaacttaatttattgatcactcatatcacttttaaaagtgatcagtagtccgcaaaattttgcatgtgtacgaaaaaaagtgataattgtttatcccaaattaatttaaaaaatcataaaaaaaaaaaaattaaaaaaaaaatgcaatatgcaaaaaggaaaagctacatttagcgatttttgaattatccgattcgttaaaatttttattttttgtgtattttagaaaaaaaaaatgtttaatggataaaaacccaataatttaagcgcataaatccaacgggcaaatacaagattatgtatgtaaaatccattctcaaaggatatctccaatacaaatttggtgtgatgggagccaaaatttataggaattacattggcaaatactcttgcccattttgtgccaggtccgcgtgctggaggcgttgcaaccgcactcgcacattgtgccgttggtagacgccatgtcggacgcctttcaccattacattgtgcttgaactgcttgacggcggtgaactgttgcaacggttgcgacgcatggaaaagttcacggaattgcaagcggccgaaatcatggcacaacttgttgctgctgtcaagcacatgcacgaccgagacattgtgcacaggtagaaggaagaagcattgaaaatttaatcaatcagaactggtcaatttttttaaatcttttttttgatgggattaggaaaccccgtcaaaaagtataatttaaaaaatatataanatatttactattcattattgtcctaatataataattaaatataagtctgattagagtaaaatcacatcagcattttgatcattttccgatcatggtcaatagtttggaatctttcttttatatagattttagcggaattggaaatcggagttccaatgccttaaaaaaaatatcgggaatttttttgaaattttaatcaattttcttaacaaattgcattaaaattctcaaaaattttcccggcggcgcctaccggcaccgccggaccaccattttaccatatttttgaaaaatggagaccaaaatggcaaaaaatagtaattttttggcaaaaaaaaacggctaaaaattttgtaaaatacacccccccccctaatttgggatttcaaaaaacgaaaaatacacccctaaaaatcgactgaaaaaagaaaaatacacccctaaaaaaccaaatttttgactttagccccccccccccctctgaagccaagggtctggctacgccttttggttggataagactgatcagggagctctatcatttcagcagctcaaattttgctgtgttaatttctaaaagttagaatttataattaaacattaagctcatcagcattaagctatcctgttttaaataataaatatatttgataacattttcagggacctgaaaccggaaaacattctgtttgaacgtgatgggcccgacgacgcaaagccaagacttcgccttgtggacttcggttttgctcgcattttgccacggcctgccgccatcggctcaacaatgggctcccaatcgctgatcaccccgttgtgcggcacgcttcactacgcggcacccgaagtgttggacattgaagacgaattaccccaatacaacgaggtgggcgggtgcgaaaagtgatttgatcaaatgaaaagataaactttgaacaacaacttgatcaaaatgagtgaaaaattaatcaagggtttgatcaaaatgagcgaaaatagattagcgacttgatcaaattaagcgacaaaatcgatcaatggcttgatcaaaacaaacgctaaattggttaatgatttgatcaaaatgagcgtcaaattgaacagaacttggccatcattaaatcttttttactcgtaaatggatgatttttaaaaaatttaggtatttatttttcatttttaaatattataaaataaattaaatttttactcaaagccaaactatggcgattaaattttatttgtatgttgggattttttggatttttgtcagaaaatttttttataattttcttcattaccaaatgtttagcaatgcgacctgtggagccttggcgttgttttgttcacaatgctttctggcaaagtgccgttccatgcgaaaagccaagccgagtcagcggcggaaattattgcgcgcatccgtgccgcggatttctcattttcggaccccgtctggtcaatggtttcacaatcggccaaggatttgagtgagatttttggccaattatttaagtgttttattttggttggaatataaacaacattttgttggaaaagaaaagttacttagagaaataaaaatcacacccacacaacggtctcgtggtgtagttggttatcacgtcagtctaacacactgaaggtcgccggttcgaacccggccgagatcatttcttttttcaatttttttgttttttgtttggaaaagcggaaatgcaatttataattatttttttaaaaaacttattttgttatttgagcttaataaaaaaaagaataggtattagcatatgatatttttttctcctaacgaaatacaaaatttattaaataaaaaattttttaatattttttgttatttcttacaaaagaaattttaagtttttgagtcgtaaactatttttttaaaattacagtttgaaccaacaaaagctttaagcctaatgggaagaataggtggtggtacctcgttctcaaaataaaatacacaatattttttccggcgataaggaaaaaattagagtcgagcaataccggtctcgtggtgtagttggttatcacgtcagtctaacacactgaaggtcgccggttcgaacccggccgagatcatttcttttttaattttattttaatacgctaatttttatttcctaataaaaaaagccaatttaaatttgccactttttttacagtcaccggactgctaacagtggaccccacgcggcgcttgtcgttggcccaactcggtgcccatccctggctacaatcggtctcaacaaccaccgatgacggcactgtgccggacggcggtgccggtggtggcggtggcaccgaattgccaacaccgaccattttgccgtccagcgctgacgccacatttaatgccactctgtccgcctttttgcatgccaatcgggacggctttcaactaatggatgtgcagaccgcaccgctgctggtcaaacggcgtggcatgaagcggcaacgcggtccggacacaacagcaacaacagcatcgggaagcggaggaaccgcggcaggtggcgtggcattaataaggaaaaaaagctgcgggtgggaagacggaattttctcgaaaaatttcttttttaggcgtatttagaaaagttaattttttaaaaattatatagaaaaataattctctgctcggggtaacctgaaatttttaaaaaaattacataattctttttcaaaaaaaaaattttttttttgttctcaagaaaattcaaaaaaaaatttattaaattttttatcaattacaaggtttttcctgaattctcttattttttaaaaaatcattaatttttttctttttttgattttttcttttacttttcctaagaaaaaatgtattgtattgttaaagaatcaaaaaataaatttaaaaaatttacaaatttggcaaaaattgactcaaaaaaagaggaaaacagttcatctcatcaatgcatataatgtttaggtgccaacgacggcggtggcattggtgccgagagaatggagcagtgcgcggcgaacaacaccaacaacaacagcatgacaacggcgacgacactttgcactgtgtcagaatgtccagaactgacaatgaatatgaacagcagcggcggtgatcagcaccaccagcaacaaaaatttaaacgacgtccaacaacgctgaatttgttcggcaccatcggggaggtggagcagcaacagcaacaacatgaacaccaacaaccgcagggcacgccaaactcggcggcatttaccgagtatcgggtaaataattaatgggcgggcgaataatcagatttttatttaaatttatatttaatcgcattaaaattagttttttttggagggctaggttgtttcgtgaaaagtgccaattttacagattttagcgagaaaacttgtcaaattattcgtataataaatacgataccttttggatgctttcttagcatgaaaaatttaaaaaaacaaattaattacattttcaaaaaaattatgactaaaaatgctcaaaaaatgacatattatttcctcgattttttaaccagattttcagcaaaaaaaaaactagttttggtgaattttcggaaaaatttcgtgaatttctgaatttttttggggaattttagtggtagaccttggaggagatagtaccaagaagaaaaccgaaaaatttttagcaaaaaaattttttcctttaaaatattattttttttttaatttataattgtttaatcgtatttaaatattaactttttgtataggacaccaagccgccctatttgaagtacagtcgtgacgattttacgcgtgccgaatgtggcggaagtggcgccactgttgaacagcagcagcacattggcggcggcacacccggcatggccaatgatcagtcaagcgggtgctcatcactgtctggtgcatcgacaatccgactgtccaacgattcgaatgagtcccaatgatcagcagctgatcagtgatcatgatggactgtttatttttaagtgatcagaaaaatttcctttgggccaaaggggctttgatttgacattcactgatcagaaaaatatttgttggcgtaatgaagaaaatactaatttgtttttctatttaaatatatttgttaaatttttattttttaatatattgacaaaaattgcatcccattttttttttgttttcttcacaaatataatcaaattaatgtaatgatcgcaaatttggcattttctgggtctcattttatgcaatattgcctagaaatctggcaaaaaatctgaagaaatcaacgattaaattggaaaaatataattgggacttggatccaagaaagtgccaaagtcgaaatcatcattacaaatcatgcaagtctccatttacatgccccgtgaaaagaaaaatgcagtatttgtttgtttgcttgttcattttgttcatttgagattcgaaatttatcattattagacacatttaaacaatgccaaacccaattaacaaaatgatgtgatgatgccttatcaattaattacccacccattattaattagttgacgctccattgttttttgccatccaaaacgaacaattttattttttgtaatggattgattgtttgatattatgtgctaaacgagaataaagtgagaaaagcgatttctgttgattgttttttttataacaaatgatatcatagtgaaatagcgaataaattaatttttatttaattaatttgcatttgtttaaacgatttctcgacaattttggcactgaattttcgtccattttaaaatgccaatctcgcagttgttgtgtgtcttggtctcacaaattgattttcatctcctgcactgagtaataatggtgtgccggcgccgtttggtgctggtggtaaaaggttccgtccgccgatgggggtaaaagaggcgccgggggcaaaggtcgtcgcctaattaggcaagtaattaattaattaattaatgagacaactgacaaagaaattttattaccgtttaatccaaagggaaattaaaatccatcctttttcttttgccatcatatttttttaaaaaaacttagtaatccatcataaaattttttagtaatcgttaggaaatttaaaaaatttttcatgaaatttaaaaaaattctatgatttttgaaaaatattaccaaattttggcaatgcttttctgtgagttgtgtgaggaggaaggcgttggaggcgaaggaaaaaataaatatcctaaccgggtctaccgaaaaaaagtcggggcggcaaagaagctttgaattcgggccagaaaatgccgaaaaagtcaagagaaagtttggcaaaaaaaaatcaggatgaatttcgggtcagaaaaatattagaccagatgggattgagccaaaaacggcttgaaacccgcacgaatcatcacccgactgactcggcatgcgcagaagcggcacggatgttgccagccgccagtgccaatcgcttctccgcctcaaagcgacgccggtgttggcacagcaaaacgccaaccgttgtgccgacggcgaaaaacagtgcgccaaagatcagtgccaaggcgagcaaaagttggccaaatgtcgttggacgcggcgccgccgttgggcccaattttgttgggcgattagcgcccaaaaattcggcgccgccctttgcccaagacgaagaagccacaaacaaattctgtttttgggaagaaaaaagaatgtgcgccaaattttaaatttacaaatttaaataacaaaaatgtgaaaaaatagttaaattaatactaagaataggcaaattataaaatttaattatgtatgggaatttatttaatatatgcaaaaaaatttataataaactaataaattaggaatatatgcccaagacgaagaagccacaaacaaattctgtttttgggaagaaaaagtgcgttaatttgaaatttaaataattatttacaataaaataaataatggataaaagcgggtttttaaattttttaaaaatttcttttaaaatttaaatgagataacctcccaactctcgaatgcttttcctgctttgtaaagtactgcttccccttgcccacctgttcaaacccgtcgatgccctccaccgtgtccgcgtcgcgcagcgtgcgctccaccgcctcatacggcaccacgtgcgtgccgttcacgaaacacacttgcatcactacctttgcggcttgcgatggtgacgcgtcgcttggtccggatgcagtcgcggtgccggcggggtaatggcgcaacgcgtgcagaaccgggcgtgcgggacgcgtgcgcaaggaaatcgcactaattttttaaattaataaataattaatattaatttaatttagttttaataattttttaaaaatccattttttggcaccttaggaatgtggacagtgtggcggcgttcatttccgcggcatttcgcgcgaccagcaccgacacaatgtccgactcgtcgcacacccacacccaaaattaattaaaatttataaatggatagttttatttttgtcatttttaattattttatttattcatctcttaattttttcaataaataattaataaaatcattgttgaattaaaagcaataaaataatatttaaacttttgatttcgatcgtttgttgttttttaaactaatttaatttataattatttgcaattattttaattttaaaattttataaaaagagagtatttcgcgagagagtgccaaaaacataaaaaatgtcattattggcattacatttgctgtggcattgtgtcccgctgctttgccatccaatgcgaaaaatgtcaagcgaaagagcgcccccggcgttcggtccaccggcgtgcgcaaccaaatgctaccgtagttgtcggttaccgtagtgtcgagtttgaatgcgagttcgggcgggttaacatgtctcacttcccgcgcataatgaaagtcgcaggagagcaaatgcagggatgggaagcctgacaaaacacaaataccataggtgaatatggtaatcgttgggacaaaagtgggagtggccaacgtttattgtcaatttcatcgctgcttattttctacagaatataattaggaaagttgacgaaaatgggcgtggccaacacttattggtcaatttcatacactggtaaaaatcgggtgacctatgccacagcgtgtgtctaccgtatatcaaaagaaaggggcgtggccggccaacgccgccgcctattggtcattcggttgacttacactcatcgccgttgttttcgtcgcaggcgtccgcgtcccgaacattcacacgcccaactaccgtacccacgggtgcagttcgctccactacaaattcatagttggactgatcaaaaacgggcgcattgtcattgctgtagggggggggggaattattttaatttaatttttaatttttttgaattttaaagttacaatttttaatttaaaataaattttgatttttaatttaaattaattgattgaatttttatttaatttttattcacatgtcatggatcctcagctgtacgtccaacacagcagcactttggtgttggtccatcgtatcgccgtccctttgagctttgattgaaaaattcaaaattgccaaatcgttggccaaatgtttgttgtccattggcaatgcttcgaagtccggcgaatgcaataaacgcaacttaattcacatctttttaagtggttaaaataatatttgagctaaaaagattcctattgagagaattaatttaaaatacaaaattaaatccgaaatagggattaattaatcaattaattaaaaattttgactaaagcgagtaaataaattcaattttttacattttatttattcagaaaaatattgcgagatttaaatttatcatatttttttcgtaaaaatttttgaggcacttaaatt

SEQ ID NO: 2171 - DNA, 2850 bp, Heterodera glycines
  misc_feature (2805)..(2805): n is a, c, g, or t
tagtaagacgtgaggatccatgccagagcgggatgggaggagacggattgtcccaggactgaagggtcttaatcttaggaatcgggccctgatccccaagaagtccaaagggtccaatcgttcgtatggctcttttattatgtcggattaaatgcgcgaataaataaatgattaataaataattaatttgtctttgatcgctccgacgtccgactctcatctccttcgactcgactgactgattggtgggggaaacaattgaacggaaaaggggcggggatttgcggggatttgtgagagttagagaaaagagaaatagtgaataaaatggtgaacggggggaatgtggaaaagatgaataacatcgattggccaaaaagggaaatgtgtgaagggttcgtcttcgctcatgggtgataattagaatatgttacacctcccttcccaatgaaaatggccccccatttttaattcacaaccaaagcttggatggctgttgctcttttctgtcccttttattttatttttgtttttttttattgtttttttttttaaatttttttgatgacattttctttttttttatcatccttccctcttaattattgtccatttgttgtccctctgctctttttttttgttgcttcctctttttgttgtccgctgtttcaaatgttgtaattgacggaagagttgctctgttgtcagagttctcttttcgaagctaacttggtgttgctcaaattgtccaaatgtccatcaattgagccgacttttctgaatgacggtccttctgtcgtttctgtctttctcttctgttgtcctttctctctctcttggcgggctgttgaccacaaatggcgatgctgttgatgtttcccgtcgtttgctgtgctgttccgcggtttgtactgctcgaagttgaagaaattgtcgtttggacttacgtgaggggaaaattttttttgttttttttatgggcagtgtccaagagcattggttatggattaaaaataaataaattttgcccgggtaaagaggtgtaagataagttaaaattaaaaaatagagcaaagacgaaatgaaagaaaatgtgaaaatttaaatgaagaaaagtgagggaaagaaagggagaaaatggcagggagttcagtcgtttcgtttcgtctgcctcttccatcatttgtgcgattggtccattgattcgagtggtctgctgttgaacggttcatgtttcgtgatgcgccggggcggtcaggacagtcgcgaaggaagtgaccagggcgcaggcagtaatggcacagaccagcgggcatgttcggatgagctgaaccaggttgacgtgctgactgctgctgcctcgaagtgccagcgaataacatgcgcggaggtctaattgacctaggcagaaagggaccatcagagccttgccaatcatcgtaaaagtcgaatgctttcactgatccgttgggggtggcaattacgccatccacaaattgtggatgcggatccatcatcgcatggatgtactccggagtcacagcaatggccttgtccagagctctgcgcaggaatcgccgccaaatgccgccagctgaccacaacagcttcaaatcgccgacaaccatcatgccgaacttgctgcggctgagggccacgttaacacgccgttcatcgttccaaaaggcgccgctgttgtcattcgagctcaggccgctttttgttgtgacaacgaagacgaattcggcctcgtgcccctggcaaccatcaactgttgttaccattacgttcggcatgttgagcgcagacacttcggttccaatttccttcgcttggccagcgtaaaagcagacaacgcgaatcaatccgttgaaacatggccgtaggaaagtcaagcacttcatgacagtccgggtttgcattggattcgttgccgaaaatgaggtcgggtcctcttgcattcgatcaatttgatggacaaaaatgatgggacactgcggcactggaagtgaaatgggagtttttgatgttaattggtccatctgtttgatggttcgtccagtggtcagaatttcgttgtgcgcggcatatactccggcagaaatgcattccgtgatgaatgggtgtgatcgaaagttgacagtcaaagtcgtccgatcaacgcccgccgctgcgtcaagatttaaaatggcggtgtccaatccatagccattttgtacagcttccggcacatctttcaaattcacactcagctgccaacggtcacctgctaccaacaatttgttcaaattgggaaaattggtgagcatggataacagttggacataagaggcttgcccactctcgtccacaatgatcatgtcggtgtcgtcaaagagtgtgccaatctgttcagcaagtaaagagtgcagaagatgatccgtcgcttttccttgctcaaaaggatttgtgcagcttttccctcgttcgctgtcttggcgacgtctcacaggccttgatgtagcggagcactgtgcgtttctgatcatccttcagctattcaaacaaatgaggcgcgcgcaaagcggctgccaacaaatgaggaccaattttcttgagctccagcatgtacttctttttgccggatcctgaaaataaggccaacatgtcctcccgccatcccactcgttccatcgttttggccatctcttcgactgctttcacaacggcaacgttcaacggggccacaaagagcacatgcgcgtcgggattggtgcgcagatgggcggcgattatgtcaacagacacttttgttttgcctgtgcncgggtggtgcctgcatgaacacgatgcgtgggactgaatcaagca

SEQ ID NO: 2172 - DNA, 5871 bp, Heterodera glycines
  misc_feature (5744)..(5744): n is a, c, g, or t
  misc_feature (5813)..(5813): n is a, c, g, or t
  misc_feature (5839)..(5839): n is a, c, g, or t
agcatggataagagttggacgtatgaagcttgcccactctcgtccacgatgatcatgtcggtttcatcaaagattgtgccaatctgttcagccaaggaaagtgtgcagaagatgatccgtcgcttttccttgctcaaaaggatttgcgcagcttttccctcgttcgcagttcttggcgacgtctcacaggctttgatgtagcggagcactgtgcgtttctgatcatccttcagctcttcaaacaattggggtgcgcgcaacgctgcagccaacaaatgagggccaattttgttcagctccagcatgtatttctttttgccggatcctgaaaataaggccaacatgtcctctcgccatcccattcgttccatcgttttggccatctcttcgactgctttcacaacggcaacgttcagcggggccacaaaaagcacatgtgcgtccggattggtgcgcagatgggcggcgattatgtcaacagacacttttgttttgcctgtgccgggtggtgcctgcatgaacacgacgcgggggactgaatcaagcattagcctagccgtctctcgctgtcctccaatcaaatcatttaatgctggttgtttagctacgaatagctcatcccatgaattttgtggaggtgttcattccccttggcgtgccattagaatggacataattgtgccgagtcccgtcgttgtgtttttcgccatttcagtgaataaattaactgaaaatttttcggccctttgcattaggattttcctagaatgcaaaggctcaatttcggtcaattccccgtccattattcggtcccatgcctcctcacaatcgtagttcttggcttcttggtacgctaggaagagtttggcgacaatgctgagtcccgtttccgattcctgtcgttcaacattcatgatgaagccggtggcacatggtttggcccctttggctgccacacgcacatggattggctggtcttcagtccacattttcgacatgtcgaccatttcctgcttgttgtctaagcgatgtcgaatggtgattatggcagtgtcggcttccgctccatattccacttgaggttcggcagtgatggtaaaccgcaggatgtcctcctccagcttgtccaaacatgctgtgactgccgcggcaattgcttgttcgccttgcgcaatggtggcatccaaatcccctcttctgaatggaaatttgtgcaaaattggggattgatcaatgccaacagccacaaaaggatggtaggctttccgatcattcacttggccaaacgggcaattgagcggcagtgcataaatttgattgactttccacaaattaggtctcattaattcaaccgtttcgacaagcacagcttgcccggttctaaaccaatccttctcaccaagagcccagcctggtaagctttgtgcaactttcatgccgggtgccacaaccgttaggctttggatgacgttcgttttgcgcattccacggcgtttgacattaagcacaatcccgattttgggaacgatgttcgtcggattggcgatgttggctttgattgccgttgcttggatgttgatgtttccggcattgagccatggaggagaagtgccgtcctggtcgaaatgccgcaggacttcgtagccacttttccaggcgaagttgacaatgtcgacttcgtcgcccaatcggagacggcgatcactccctgtcggagttccgttggaaatgccgaaaaaccaagggcaattcttggtgaatcgcttcagcattgcgacagccatggatgattgcacttggacaatggcacatcgaagatgagaagtcccaaatccggcggtgtcgttgctttcgtcgatgttgtccaatgcctgatgcatttcatcatctaaaataaacccaaaacccgccttttgagctttctctggcatttccgtgccactcatttcattaaccacattcaggatttctgccacgaatggcattccctcatttttctctccttcttctgtctccatgagatcatttgtcccggcacttttttcacttccttcaccacttttctcaggattattcgtcacgaatgacgctccttccaattcaagcattttggcccccagcgtggccattgggtccacgcttgtctccaaaatcattgcctcaagggcactcactcggccggcgctgacggctagggggtctgtgcgcgggagtttctctcccgtccctcgggcccaattcactcaaattgccgaatttgctgctgccgtcgggtccgtgcccaagggagtgaactggggagggggtggggaggacaaacaagatggggttggctgttgttgctgtaacggcaccaccgactttttgaagagctgccggcgctcccggttgaggttcgggagaagagttggacttccggccgcgaactgcgtcaaccgccgggaactggctcccgtccttgtttgctgctgctctgcgggggattgtcccccgcttcgattctcggggctttggctccccttcggtcacttcgttcccgagcgatgattatatgcgagatgttgatggattatatggtgaaaattggaggaagggaagggcgataaggattattgaggggggtcaaaaattgggaatgattcttaaggactacagaagagcaagaagtgaatgtgtgtggaaaattagacgataaacaatacttaagtaccaaaccatttcccccgggggggggcaaagattaagatgcaaaaaggcggcgccgaagggtacaaaaatcggcggggagaaaaaatgccaaacaaagggaaaaatgagatgaatgaatggccaaatggaaaaatgtgatctgagaaagtgtgaacaaagagacaaaaaattcggaggcagatgtgaatggcagaaaaattgaaaagaaaaggcaaatggtggagttgaagaaaacattatgtaaatgagaaaaaatgaagagaaatggaaagtttaaataaagagagaaataaagaggggtgaaaatgtcgacaaataaaaaagggatcgttccctcctcgcgcactctcgtcggcaacaaaattgccgacagaaacaattaattaattggagacggcaaattaatggagactggcattaaaaagagaaactatggtaaatagttgtttgatgtctaaatttaaaatgaaaacctaaatttgcgacataaaatatggtaacgttaatgcacaagactttttctagaagcatccaaattaagcatgcttagtacatatcattcaataggcccaataatcctctattagtctgcaaaattaaaaaaaaaattagttttttgaagttttcaggccatgactttgttgaaacataatattttttgaatttttcaggattttaagcgcgagtccgtgttctccgctctgctcgagatggtgccgtccagcatcaacaagcagttgatcaccaccgacacgctgcgcgacgtttacattcgcattctggtaaacgtcacggtggtgaaggtgagcgcgagttgagtggcaattggtgtgccatggcatggcgactagggcatgggcccttacgaattttgggcatggctgacgatgcctcaccaactttgagaaaattttcatgaaatattttgtcagcggttcgggaggggaaatattcggaatggatgaaatacccttctcccacccttttcgtgtgcttcatccaacttcccccgtcctcccccctcccgaaaaatagtaaagaaaattcaaacaatttttttttgtcagcggatcgggggggggggaagatgcggaatagatgaaatgccacttttgccaccggtttcactggcgtaactgttactgtagtggtttttctagcttaagctgagggtgttgagaaattggatggatcatttagacgaatttaaaaaatttcatgattggaaaatatgtatatccgaaaatgtttagtgtctgtaagtgatataaaaaaaggaatatgattcgcggagacaatcaacctattcttgagtccttggaaaccatgaatatttttgaaataaatttttattcaatagtgggaaaaaactttctttttttgtttgcgtataaaaatcgcgacttttgtttgcatattttggggcatattttgcaaattttgggtttttctgcaattttcatgcatattttgacatttttcgaaaatttgcttaatcgtattgtgtgaacgatgaaacgaaagggaaaaaatagcacaagggaatgagaaagaaaggaatttgtatgaccattccgccattccctgctcattcggctatttaacatgcacagaaaaaaacattattcactaacaaagttggtgggcagaaggtgagacagatatcgattgattgaccaaaagagcaattgggcacagaagaagcagtagcaagtacatacgcatacgtgtgtatgtattttgaacattgttttggtgtttttggaaataaagggctccaaattcccaggcctatgtaaccaattgctgctccacaacgacagcactcagctcagtgggggatggcggtgccacggtcgaatttgccacttaaatggataaaataagttaaatgtaaataggtgcaaatcaataaaaaaaagtcttcaccttgcttggtggaagtgaagagaccacggcaccaatgtccaacagaacgtgcccaatcgataaaccatcaccggacgacttgcaccacatttttatgatcgccgtgtgcagctggatcttcagtgtagggaagttctgcagtttcctctcaaaaaatattaaaataaaaatttgtttgaatgttttaaaaaacaatataaaattgtgaaaaatcgctaaaaaaatttccttgaaacttttcttcatctaacaataaattgtaaaccgttggttgttttgagtacataaaaaagttttaaccttcaccagtgcacgaacagaagcgaagaccaaaacggcggcaccaattcccaaacgaacgaggaattttaatatgggggaagagggtccgacggtgccgatatgcgccacctatatcaaaatagtttatattttataccaatttattgcactttgggtcaaattgttaattatatgtttcgggaaaaatttgtagatttattgctacttaatagttgtcaaaaattaaccaaatttaatgcttttaagcatcgcttcctgtgaataataccgccgacaaacaaacccattgagcccatttacattgaaggtgccaacacttatctttgaaatcggtgaaaaataaatcatttcatgaccaaatcgaaatttataagaccctaatgctgtctgtacacgtgcacgaacccggacacattactcagaattgcgaccagcgttgatcccggacgagtgaatgggaagaaatgttgatcaacagatgagagagaatggacgaaatttatttggtaaatgatacataatcgaactgtttacaattgtgcctaaaatatttttttcttccaatttttggtgtaaacgtcaatcgtttagcctgagcaaatttttttccaagggatattcaaatcggaaaatatttgatgaaaaatgtcaaaatatgcatgaaaattgcagaaaaacccaaaatttgcaaaatatgccccaaaatatgcaaacaaaagtcgcgatttttatacgcaaacaaaaaaagaaagttttttcccactattgaataaaatttatttcaaaaatattcatgggttccnagggactcagaaataggtgattgtctccgcgaatcatattcccttttttatatcacttacagacactanacattttcggatatacatattttccnatcatgaaatttttttaattcgtctaaatgat

SEQ ID NO: 2173 - DNA, 5455 bp, Heterodera glycines
  misc_feature (5447)..(5447): n is a, c, g, or t
ttgctgatcactccagcacatttgatatccgctgactcattatttaagtctttttgttccactaacaaaggaaggtccccaggtgtccgtgggatttccgaatgaaatttggtgggtgcatagagcacccacaggttcttaagaaaagtgattttattttttgcggaatgaactcgagtgccgagttatgacgtgccaaagttttttagtgaataaataaattaaaatttatttgcgccttcatcaggtctctaatggcgcagcggtagtgagctagtcctcgttttttaagcccacaggttcggatccctgacatgcaaactcattttttaattttatttttgcctttttatgcaaaagtaaataatcaaatatgtttttttatgaactaaatttttttaccattttaacatataagatattcaataaaaatttaacagaaaggtgtgtatcttttaaattaaattattacgtctttatctttaatgatttttttgggtgttaatgaaataaaattaaaataactatttcataaaaaatatttttaataatagactgcaccagaaaagcaaaaataaaaattgtaaaatgtattagcatgcagaggattcgaatctgagacacaaaataaatttgactaacgcactacctctacaccaatagatgcttgttgcgtagcgaagtaattatttcttttctttaattagaaaacaccaaaaactttggcacgtcataactcggcactcgagttcattccgcaaaaaataaaatcacttttcttaagaacctgtgggtgctctatccacccaccaaatttcattcggaaatcccacggacacctggggaccttcctttgtaagtaattttgcctgagaaaatttcgcgattgcgtattttgtgggcgttgcggatttgcattgttcggttcgggtttataagcgggactttggcttgggtacaaggacaacggggttttatttgaacccgtcacattatgattttgttgcgaattatgattctgattgccttcttccgcctgacgccggaaacaatttcgcgcaatatgaccctctttttcacagtaaaaacattttggacggtttccagtggaatgttgaaaattggttttcggttcaggaccttgccgtgttagagttgctccaaagttcgtttttccataagcattatttgatgcaatgcgacgcgttgctttctgcgttgcctcggcgcgcgcagccatccccacaaattgatcgaatgtcattcccggccttctgcccatttccaaacttaaagctaactcagagctttcaaaggtcctgatcaaatgctttattgcatagtcatcaacgagatggtcagttaatccggggtaggcacgtctgactaaagtaattacgcgatcagccaaatcatccaaatcttctccattttttcgccgaatgcctgacatcaactgatcaaatgcattccattcgcgtgcatcggtctcctctaattgccgcaacatttcacgtttgattaactcatagcggaaaggtactgtcgaacatgccgacctaaaggccctctcggctcgtccaaaaactttggactcgagcgaacttatccttttcgcatttgtccattcgccagtattcgaatcaaaacgcttgaaaaattcacggaacttttccgcaccttcattgccttttagagcggggatttgactcattatgagtgcgtatgctacttggtccattcccggttctcttccccgttcaatgacattctcaattggacgattttcgaaattttggcgagccaaattttgagcggcattaatttgttgctgttgtggttgcgaaattggctgaacaacttgcggaatgtgtgcttggtttatcatgccaaattggtggttcccttggggcaaatacggctgttggaattgcgggttataagcattttgcatttgtggtggattttgcgcatttgtgctcataaaaccaatcatttgttggtttggaagctgcatgggtaatggtgctagctggtaaaatggatttattgccgggtaattcaaaaagggccctggaactgcttgctgaaccggcgggaaaaatgctattggttgctgaacgacttgtggttgcggcattgcggttttaggaataccatgctgttggtttttgtcacccatattttgtctgtttggcaaattttggtgtacagactgatgcacgttttgaatgagtaattccggaaatattgggccacttataggcgtggatgttcgaggcaacaagttttggttgagattgcgatgaccatcatttctattttcgtctccaaccaaccaattttctcttccgtcgtttgttcccacatttcggaatctcattcgcaaacctccgcgttgttcttcgtttccattgttttccgctccgttctcttgtccttcattttgtctgttcggttgagccaactcaagaagagcatttcgaatttgtgccgagtccatatttccgttcgtccttaaaatttctccatcaacaacagaattttcaagaacattttcggtgttagcggtgttatgcggtctttgtgtgttttggtgttcgttttgttgctgctgctggatatttcgtgcacgttggcgagtcaatggaggtgagcgtggaatgaacatcactttttcccaagcacgagagaaatttaacttgtttcaaacaacacgagtttattgtatgcctttaaatctaggctcagtacaacacgagtacttttaaacaattgtcgagcagaagttgtacagtcccacacgaggacaaaatcaaatcaacaaaatgcgccaacacgagggcttttttcaaatttcttcaaccgtcggttttcaagcaattttatgaccgcgtttatccccgtttaatgaaaatgtcactgagccagaccttggtcgtccaggagcgccaagttacactttttgaacaattaggctttggctttattttccaaattggcaagcgaaggcaacgaaagcaattcgatcaatttaaatttgttgatcagtcaaaggtgcttgccctgtctcaaaataaatcgaaacgataaaattatgctttatgcaaaacgaattaaagacacgaataaccaaaacaaacacaatttcaaacaaacttgaaaatcggcgagaattaggcacagacgaaaataaatcaatcacacaattaacttttatttttcaaacataaacactaattaataatgaaaccaaaacaaattatttaaggtcaatttgaataatcggaacgccaaaacaaacataataaattaaataattaatgaagtccaaaaatgatatcacaccccgaccctttatgagaagacggtccctcgtctaagcaattaattgggatgagagacagaaataaagagaattagaaatccgattggtggtggtccaaggcacatggctcagtgacgacgacgattctcaaagactctcccatctctgcgcccgcgagaattgtgaaatgattggcgaatagggtacgggtgaacacgaacatctcgagaatgagtatgagaacgagtgattgacaattccgacaattgagtagagacagaagaggaaacagaacgtgatggacggcgaattccaagggaattatcatcaggaaattgaggaatttgggtaaagatccaggcacggagacacttcagaccttcgggcaacatttttccgtctgctcgcacccgcgacatgtcgaatgtgtcgccgaacctccacagttcaaccagactacgcccgtgctctctgtaaattgactgtgaaaagtaaaacgtttttcacaaacattgcggcccaaatttctttattttaatgaggatttacaaaattacatatattttttgaagaatttaggtaaattttttggaaaatttgggtgaggctaagtctggggaggggaatctaaaattttcagcaaaaatactattttggggtacgtaccccgcgtcccccccccccccccctctgggaccaggggtgggcgaaacttcggcttcgaaaacttcgaaaacttcgggttttttgagcttcgaacttcgtgcttcggctattttacccgaagtttcgggaaaaatacacccctaaagattgagtttttaatgtgaaaatgcacccttagtgatgggcttttgataaacttaaattaatatatatttattaattttttgtttttatttttttgttcacacgcatggtcgagtggtagtgctctttgctcttttcattatgtttctttggatcagttcccatccaagtactttcttttcttctaatttttcaaaagtattcttttttcgacggaaatttaatataaatttaacaattaaaatcgcaaaatcttttcatttttgaactaaatctgtcactaaaatttcaaatttttcccgtcggcgcctatcggcaccgccggagttccaaaattccctttattttttaaattgactcaaaaactgtgagtattctaagaattataaaaatttagaaaatacattgttaaaaaaaatcattatatttatttatcgaaaggggttgttggttggtctatttgatatttaaccgaaattttgggatgaaaaaattttttggaattaaaaaaaaaattttgaaaaaacttcggcttcggcttcgaaaacttcgaaaacttcgggttttttgggcttcgagcttcggacttcggcttcgaataaaaattgggcttcgccttcggcttcgagtactaagccgagcttcgcccacccctgtctgggaccgtccctggattcgtccacgtgaaaaaacaccgtacaattcaagaaatcatggcttatttaaatataaaaaacaagatgccaaattttgagcatttaagtttttttttaaagaaaaaaattaaatttcgtaaaaaattgtaattaaacaaacttgttcaaataagtgtaattaagtcattaaatcgcatcatatatattagtcatttcttgcaatcattgcatgacctaagacaatatttactagatgcacccacaacaaacgacacaccgtgggcctggcattaagcaatggcggctgatcattcggaatttgtcgtttaatgtaaaaaatatttaagatatttttaatttaatgtttttttagacaactgtaaatgagttaaggcaacgagttgaaacattcggacatattcttgaaattattctgcccaaatgcaaagacaaacgctttcccaattcgtccgctgggttttgctttgtgcaattttcgcgacggaaagatgccgaagaagccaaaaatggattgaactttactgaattaaatgggcggaaagtggcggtcgattgggcaatagacaaagacaattacataacgaaattgcaatagtggggatgagtgtttgatttagaaaaatgtacaaaanttatttag

SEQ ID NO: 2174 - DNA, 3176 bp, Heterodera glycines
  misc_feature (69)..(69): n is a, c, g, or t
  misc_feature (77)..(77): n is a, c, g, or t
  misc_feature (136)..(136): n is a, c, g, or t
  misc_feature (2928)..(2928): n is a, c, g, or t
  misc_feature (3019)..(3019): n is a, c, g, or t
ctgaattaaatgtgcggaaagtggcggtcgattgggccttcacgagagacaattacataacgaaattgnaagaaggntttctttgtttgatttagaaaaatgtcaaaattatttagagaaaaaacattcgaaaagnagtgaaatggtcgtaaaaacggaaccaaaaattgaatctgaggaagaaagtgatggtgaattggaaataaacaatgaaaaagacgaagaaaagtcagaaggggaagaaaatgaaagtgagttaattgagtggacagttaacagtcactgaattaattaaaatagcaaatgataccaccgaaagcattaccaatggaaaaacggacaaaaaaccgacgaaaaaagaagcgaacagagaggtgactcgaaaaaaaactgggaaaatactgtaaagtttaagacaaaaaccaaaacggagaataagaaacaaatgacggaggacagtgcagtcacagaaggacgagtcgtttttttaaggcaaatggtggggggggggaaagctccgattaaaacatttccgaattttcaggaatatgccctttaccgtggacaatgaaaagctcaaaaatctttccgcggagtttggcgcaattcgattggcaatttgctgcagaaacaaagacaccggcgacccctcgggcaccgcctttgtccattttcaacagaaggagggagcagacaatttcctggacaaattgacggcggtgtcttttttgatttggttttgaaataaaatatccaatttatggcaggaagacggtgtccttttggatggtcggcgaatttacggacatcgcgcggtccaacgaaatgaggcaaaaaagttcaatgtgacagacaaaaagccggtgaaggacaaacgcaatttgtacctaatgagggcgtcgttgttacggcccggcacagcgctggcgaagggaatgtcggaagaggacgcgaaattgagacaacggatgctggaagtggccaagaccaaactcaaaaacttgacgatgttcgtctcaccaaatcgacttgtggtcagccaaaaggggcaaatcagcggagaaacgtttaaagtttttactgctttctcagatacacaacattcccttctcgtggaaggacgaccaactgaaaagcgtttgttcggaagcggccggcgattgtcccgcgacggccatctcagagtgccggataatgcggcaactgaagggccaaaacgaaaagggacgcgccattttgggaaaatccagcggattcggctttgtcaccttcaccgaacacactttggcgctgaactgcctgaggaagttgaacaacaatccgacgacattctctgacgaaagggttggtgaacgattggaatgccaacttggagaaaacatttttaattaaagaggccaatcgtcgaattttcaattgaaaatttgaatgcgttgagagtgaaggaaagacggcagcaaaaagaaacgaaaagcgaagaaaatgaggaggaaaaacaacaaacaaagaatagagtcggaaatgccgaggcattggagaaaacgaagcgcgaaatgatggccggcgggaagaaatggctgccgaaaaaattagggacgaaaattcggcacaaaaagccgcagaatggactcagcacgacgcctggcaaacgccgaggacagttcgtcgaacaaagggcggggatggtttaagaaaaaaacaattgagtctctaaaaaggaatccattaactgattcaatctctgcttcatcctctgctgcttcatcttgtcgttctaccccttttcccgtttaggacaaaaaataaaccaggaagtgtgaaaacgcaaagaaagagaaagacgagccgagggacagagacggagaaacgcgcgaaaaggaaaaggacggacaaatcgcaatgaaatgaaatcatttgttcaattctgatgctcaattcagttcgatattcttcggaagagtaaacataagatttcttcactcatttggttgggaaaaagtcagtgttggcaattgtcatttgccgggcaaatccgttggccaacattcttctgttggacggtgaccgccttggctcttccaccggcatagtcgggctttgactgttgcgaaacagtgaatttgctcgcgacagagaaggtgaagtgcggggcgacttgaacagggcgctcttcacttccctttccacgacgaacacattttgccgtgtttccaattcgccgattctgaaaatgtcgccttggggttaattgattttcaaatgcaagaaataaaatattgggctgacaattcaaaaatgaatttgcgcatttcacctgtcgtaaataattgcgtccacattttgccgtctgaaatatgcgacgtgttccaatttgtccaagtcctctccccagacaaaagtgatcagtttcattgcaacggcccttttcagggatgacgggtcggagagcaattcttcgctgtgcaaattgatgccctaaggggcggtgggaggcggagcaatttcaaagaatggcattttagccttgccaaaaggttggagcaggcggcaaagttggtgcccactctcgtcactttgctccgttcatccagaaatggcacatatctatgtaacaattaaaacagagttcaattgaaataggacatttaaaatatgtcagtcaattaatcgttaattgcctgtcggtttggcccacacaaaggaacagcaccgggtacttattctgtttgacggacagtctaaaaaggaactgagcaaattcattttgacattttttatatgcgtacagcgtgcaaatgtccgggtcaaatgacgaaaaaacaatgcgtcttttgccggcgtgtctgaacacgtccaccagcagttggtccatgtactggttgcgctcgaagtaattctcacattcgtgcgacccatccttcaattganaggggggagggcattcaattcgaaaacgttaagaaaatgctattctcgactccccccccccccggtgcccaattaccttcattctcattgngtatttgatctccacattgaatcccgcgtgttcatccactcgttgtaatgcctcgaccaaagtgggaaatgatcgcaattcgtctctttcgtccgcttctcccggtcatcagtgaccgcggttctgctgctgcccatttcgctttatgtctctgctt

SEQ ID NO: 2175 - DNA, 914 bp, Heterodera glycines
cgtggaaaacaaccaccgatcggtcgcggctcagctgcacgtcgaactcgacgaagtcggcgcccctttgggcggcgttattcagcgagaaaattgtgttttcccgcgcggttgcgaatctgacgcggcagaattgggaaaacaaaggcgaggctccgtcgctcactttgtgaaagattcgccgctgccgcggtggcccacctccaaagtgcgtcgcttcttccaatgcttcacaaaggtcgtctccattctgtccgtcaattggcactttcactttttcaattggctcacctcgtggcatgcttttcctcctcctcctcttcccagtccactgaggttgccaacaaatagtcaacttttatttggcccatcggcttctgcgttttcacagcgaccaatggcagggaaagggagccaattgtgtccggcattgaggagggcatgccttaagggacagcagacaatgatggcacccgacccgatagcagcagacggacaataagcaagcgcaaatcgggacggagttaggccaatctttgattctgtcgaagcccaattccgttgctggagcataaataattcaattcgaaatgcctaaaacgaaaaagaaaaatgtagataaaaacagtttatttgtgcaaaatcaccaaaaactcaatggccactgaagttgtgcggaacacaaagtaatcttcgccgtcgtttcggaagggttcgccattttcggactgttctctaaagaatgggtcggcatcggacagcaaattctgaagcggaacggaccgataaaaattgaggaaaatactgtaaaaccgcaaattctgtgaaggaatgacttggcaagggaatgtgtgccgattgtggagcagcttagaattgttgcggatggtcttcctcttctgccagcgaatcca

SEQ ID NO: 2176 - DNA, 1866 bp, Heterodera glycines
tcatgtatacgggctgcaaattttatgtaaatacattttttttcctggcttttccttgctctaaatagcaggaaaaacactttcttttttgtgtttgcgaacaaaaaccgggacttttatttacatatttttacatatttcgggattttcttacatatttgtacatattttggatttttttcatatatattttcatttttttttacatattttgagtattttttacggaaatttttggaaatatcaaaaaaaaaaatccaaaatttcggcaaatattttgggtacatattttcatttttttacatattttgaaaatttataaaaaaaaaaaaagtttgaaaatgttgcctaaaaataccaaaaaaaaaaagtaatttttatgtcattttgtggctatttcatactttacggggattttctttcccaaaaaataccattaaaaaaaattttatttacatatttggggttttttttgtacatattttgggatttttcttacatatttatgtacatatttggaccactttttgtacatattttttgcagccctagtcatgtaatctaaaatttgatggcggactaaacacgcaaaaatatttgcataaatttaatgaattaatttggaaattgttgaggaattaaaattttaaaatgttttttttaatttttgactccattttgggcctcaactatttaccaatcttttcttaaatattatttttaattatctccattccaaagctaagatcccaatttatttgggatttttttgtgctggatgaatctcgagccaaattttgcgagaaaaaaattttttttttttgaaaattttcaccgaaacgcttattgaaaaataccgactgatttacggcaaattttttcgatttatcctaatcattacttctcttctgatcagatattatttgagtcaaaaaatgattaatttttgaaatatttgaagtaaatttgatttcaaaatattaattaatatattataattataatttagttttgctttaacttttggattttataaaataaaaaacaaaagaaaaatttatttttcagccaccaacggacagacgatcatggaaaggaaatagtgcacagctaatggaaaagaaacgagtgggtttggggagagagtgccttctctttccactctgtctctccatctctcccctattttccaccccatctctcctttcttctttcaatggcctgtcagttggactggttgctgctctctaaacttacctggctggggagttcctgcgatcacaaaggcagggctcctgtggcgaggctccaccattgcactttcggtcggggctgacccgcagggcggtcccgaactgggataggcccacagctaaatttttgagtgcgggggacggcgttcgcgcctcccctttaaaagatttgcttggatttggaatttggatgttcaaaacctcttcttgtcctttaatttgtgagtccaatttaaatgcgatttttagggggtgtattttctgacatgtttttttggtagattctttgggtgtgtttttggtttttattgcgtgggttttacgaaaatcttgacaataagcgccaaaaagccggaaataggcaaaaatgagcattataaaatccgccgtagaaaccctaaaccaagctgaaagcgcattttgcatgcttaagtatctgtgtgtatcaattgcgcagaaatgttaggcatttgcataaaatgaaagtcctaattatcacatattctatttgaatccgacattttcctgataatttatttatcaatttttatttgttcaatataaatcaatacaataattataattatataaaaaaattaaaaataaacaaaaa

SEQ ID NO: 2177 - DNA, 3306 bp, Heterodera glycines
  misc_feature (88)..(88): n is a, c, g, or t
aaacgagtgtgcctgggagagagtgtcctctctttccacaatcctctccatctctcaccactttccaccccatctctcatttcttctntaatttgcctgtcaattggactgcttgctgctttctaaacttacctggctggggagttcctgcgatcacaaaggcagggctcctgtggcgaggctccaccattgcactttcggtcggggctgacccgcagggcggtcccgaactgggataggcccacagctaaatttttgagtgcgggggacggcgttcgcgcctcccctttaaaaaatttgctttggattttggattttgaaatttgggctgttcaaaattgtcttggttggtttaattctctaagctagagttgagcgggaccgggaaatttgacaaaaaccgggaccgggacttaccgggaccagaaaagtcgggaccgggaccaagtttttcgaccgggaccgcgaaaaaacccgggaccaatcgggacttttcccaagtgaaaattttttttgaaaaaaattgaaaatttaagtgcactttgttacgaaaattgccaatattcaaaaatgcacccataaaattttgtatttacgttttgggggacgagttcgaggaaaatttttaaaaattttgttttcagggggggttcttggaattttctgagtcccaaaattctgtattttttaaaaataaatttacaatcttttaaattttttgcttttaatggttaatttatgggtttttaggctattaaaaatgaaaaaaataataattttaaattaaaatattttttattaattaaattgcataaaatgaaagtcctaattatcacatattatatttgattccgacattttcctgataatttatttatcaacttttatttgttctaaataaatcaatacaataattatatttatataaaacaaattaaaaataaacaaaaaaaaatggcaacgtctcataaaataataaagagaaaatggaatgatttttacaacaatttgaaaaaatggtgtaaaaaagatcgaaaaacaccaaaaacattggcggcggagtgaaagtgaatggcaattggcaaaaagtgccgagtctggccgatcagtagtgatcaaagcgaagtgagcgagcatttgcagttcagacaatgcattggggctgagaagcgagcagcgactcgcggtgactcatttcctccaattcgatggcctaaaaattgggcaaaaaaatgaggaatttttgcaaaaaaatggaaattattttttgtttacacatctccaagctgggcagcccatttaaaagcagacagaaaatgattacaaatttgtaaaaaatttaccaattttatttaaaaattttcattttatagataaaaaaaatgttttccaatttttattgacgaaatttactaaaaaaattgcatagttttgatggatttattgttagatttcgggattttcaaattatttatgtaacggaaaatttttaattttcttagttctttttgatggaaaatctaaaatttcttttccatccttgagctgatcatacagtacagggcccatgatcccatgattcacatttccccctgcttggacatgtgttgccaagaaaagaaatttgtgccaaaatcggactttggccgcctccatttccagctgatgactctgctcactgtgccgtttgctcagctgttcctcgtgtctgccacatctgacatttgattgatcatttcatattattatcatttctgatcacacaattggccattttaattgcatttatcattttttttgtttaattttgtatttttgtaattctattaaaaagtttacaatttttgtaacattaatttttgataatgaattatttcacaatgtttaccctaatttttggggcggaaactctggaattttataaaatcctctccaaaatctaatccccgaaatcttaaaacccccgaaattggattgtatatatccacaagattaggggtgaggggagtggagtttcccgtaaatttttattaaatcaaaaacaattcatttttactcggccaacagtcgttttagcagtgcattttcctcttgaatttgttctttgtgctgctcaaattcctcctgctcaagtcgcctcaacagctgtgaccattcgtccgtttgaatttgcaccaatgagcgcatctgaacaaaacaaacaaaacggaaaagggtgctaattaggtaattagtcattcaactcattagatgctaattagctaattagtcattcaactcattagatgctaattagctaattagtcattcaactcattagatgctaattagctaattagtcaatcaaaagcactattatgaatgataattaaaatgggactgaatctacaataattagcaaattagacagtaactcactcacaaacgccaattcataaatgataattatttaattatacatagtacactaatgtcttatcatttaaaaactgagttaaatttgtttctcatgaattatagaaaacaagaaacaaatactagaaacacaaaatattgaaggtgtagaagagatttatcattatgttataataagaaattaaacagaaaaatttatttaaaaagagaaatttttcaagccctaaatcaaacaaaaaaattaacaaatggatgttttttaaattgggcaaaataaggcttttcgatgttgttatgtgccactttcctcttttttttcttgcgtttttgtcagctcacaataaaaaccagcgtgcttttttggaaaattttttgaaaaccctaacaattcagcataatattttgaaaaaatcgcaataaaatatttcaagaaattaaaaataaattctaagatttttttgaccgtattaatatgaaccctcgtaaatttatattggctaccacaaaaattttttttatattaatttgatttttttttttactaattttatcgagcaaaattttctgaaaacattctaaaacatcttttttatttttttatttaattttttatttttactcctaatatgccataaaatgtacctcaattcaatttcagcatttttatataataattggcttgaaaaattctttaattcacaaagcatagtaaataaaaatgtgccatgccattgtggttggtggtggtgaattaccacatttacggatgctttatcttcccccccccccctactcgctgtcgctgcttttctttcttccccggtgaaatttattcaattttctcggcccattttgggggttttccccgcatcgaatgagcccccccccccc

SEQ ID NO: 2178 - DNA, 2573 bp, Heterodera glycines
tttataatattgttcgtttcaaataaccaattgattttttctaaatttgcagaattttaaggggtgccgttaccgtagttatatcctcgcccatacggtgggactcttcttggcacaacccccataacggcactcggttactgtagttataccccctccccatacggtgggactcttttggcaaccccaaaaacggtacttcacttgccttcacacttttgtcctgctgaatggccctgctgtcctccatgctcttcttggcttgtgcctggttcagttccttcttctccgcatcaaatttcgcccgaacagtgatgatttgttgtcgttgccgtcttgaagaaaaaaaaattttttttttgttttttgaatttttaatggcacggggaagcggggaccccgcaacattttcttcggggacgggaaataatacagaaaaaattacaaaaaattgaataaatttgccaatgaagaaatggggtcttgataaggaagcattttccgattacaaaatgatttaatttatattaaaaatttagaaaattcaaaaaatcaaaattttgtattttttgtaattctattaaaaagtttacaatttttgtaacattaatttttgataatgaattatttcacaatgtttaccctaatttttggggcggaaactctggaattttataaaatcctctccaaaatctaatccccgaaatcttaaaacccccgaaattggattgtatatatccacaagattaggggtgaggggagtggagtttcccgtaaatttttattaaatcaaaaacaattcatttttactcggccaacagtcgttttagcagtgcattttcctcttgaatttgttctttgtgctgctcaaattcctcctgctcaagtcgcctcaacagctgtgaccattcgtccgtttgaatttgcaccaatgaacgcatctgaaacaaacaagcaaacagttatgggttctaattagctaattagtcaatcagctcattaggtgctaattagctaattagtcattcaactcattagatgctaattagctaattagtcactcagcttattaaatgataatagctaattagtcaatcagctcattaggtgctaattagctaattagtcatacaggctatagtgttgatcacaaatactgatttatataaaaaatatatattcacttgcattcattaattaaacaattttcatattttcgaagaactgattgcaaaaatattataaaaagcgaaaaatacatcccctaaaggtcaattaaaaaaaaactcccctaaaaatgggaaaagtctttaaaaatttatttgttcatttttttttttttgcaaaatcccggtaaccgaccgacccgtttctggtccccggtcaattccaccgttgttacggtatgtgccggatccgaaattcgtagtgccaatgaattgtgttgttgttggttttgttggcaattgttgtccttgttgtccccgtcattgctggcctgcttctcccccagactggtgctgttcaaatggttacgctttttcagcgacattttgtgactttggtcaacgagtcgttccacaacgcattgctgaaggcggggtgaggaaaataacataaaatttagggtggaaatgcgtgcatagaattttccgagagtttcgagaattgagtcagggtgggagtcaagaataggatataataaaacagccgcataatatagagccgagaatttcgaaaaagtcgggaacaggatcgggagattacatgtcatgctgggattggaatcctgacgtttccgaattgtgatcaggaccggttctgactaggataggattatcggaattcaaagctcgattattcgggatcctggccccgacatgttttcaaaaaaattcaaaagcaggatcctgggaaaatctcgattctctccgagctcaactaatcgaaaaacgagtttttcttgctcgcccacctgttgtttttgcactgattcgcgcattttctgatgcctgcgctttatctcttcccattccttggcgtgccgtttctgcaacttcaaaaatggcttctcacgtcgcaaatcagcaacattgatccattccacttgctgttgtttgaaaaggttgggtttaaattttaacgtttttttccgaatgattttaaatggggaaaaaaaggggagaaaaaacgggaaaatatttaggacaaaatacataattggacaataaatggtataaaaacgggtcgaaaaattgttaaacaatacatacatataaaaaaataaaatcaaaatggggaaaatagaatgaaaataataataattttaaaaggaaaataaaaaaataaattaacaaaactgagggaataaaattgatttctcgattccttctcgagaatgacaagaaaaggtgaagaagtaacattgacaaaaatgggatgaaaaaagtggacaaataaatatttatggggaaaataaacataaaataaatgttttaaatgggcgaaattttaataaataagtctttgccaattttgtggattaaacaatttttgtgaaaatgtaaaaaaca

SEQ ID NO: 2179 - DNA, 4526 bp, Heterodera glycines
ttttatgaaattactaatttcataaaattattaatttcactgcagaccggttgcgccggggaaaaggccgcatcgcttcgcacctccacaaagtggcacgcatggaaaaagcccgctgattggccaagccttttcaagctcctcgctcagttgatgttgtttgcaggcaacagcatcatcctgggcttcttcatccaggtgagtgtggcaaattgttgttatggctttaagccgtcgttgtgctctttaaattgccgtggtggtgttcgggcacgcaaccgaggctgtccaaatcggagctgttgcggcggttgctgctgctgcgattgctgctgctgcgattggtgctgcggcggttgctgctgctgcgattgctgctgctgcgattggtgctgcggcggttgctgctgctatgcaaaaaagtatttaaaaaaatttggtatgattttttgcataactcattttcgaaaaccccgaaacaggcaaattttataaaaattccaatttctcgctcatttatcctctctccacctctctctctctctctctcatttctcctctctctctctctccctgtcactctctacagccctctctctctctctctctctttcgctctctaattcacgctatctttctctaatttctctctctcttgcattttctttctctctctctctctcgttctctctcatttcatctttatttctctcccccctctctctctctctctctcgttctctggcacaaattgttccaatatttttgcaactgactgtaaattgaccaaattcttgccaaaatatttccaatttcgtttttaccagtgtttttttaattttccaggaaaaattgtcgaaactgcctcggggcccagtacattttacaaaatttcccccacttgacccccaccccccccttgccaatcctatttttttcgaaattgaattcatacctcccagcccggcttgtatccaagcccgggtctttgataatttgagcacgacaaaaagtaagagtgttcttcgatgggtgttggccgtccagttccatatttgccaagagcaggtttgctgatcccgagcatttccattgcataaactaaacattccggttgctgctgctgcgattgctgctgcggcggttgctgctgcggcggttgctgctgcggcggttgctgctgctggaaacttgctgcgtcgaacgaagcaagatacggtcggttctcccgtttccgtccatgaatgggtggatcttaatctgagaagatggaagaaattgtttccacttttgatgtcttttcggttcaaataaaaaaattttattatcaaaggattaagcctaagttctaagagtctaggccttagcaagcctaagataaggcccaagctttaggtttcttaaatggttactttattaaaaggtttactgattcatactaattatttatttatttatcgagcaaaccaacggcacattagtgctcttacatggtgcaaaaatgaaaacaaacaaataaatttgatcaaataaaaaatacaaaatgaataccgtcataaaaatgaataaaaataaatcaaaggttaaaaattcacaggcgattaaaatatagtgtaaatgtggcacagaacagaaaatctcctactcagaactcattgcttttagcaaacccctgaattcctttgccttattaatttgcaccgctaccagtggaagattattcagttttttactattctattgaaaaaattattttgagttttggccgtggggcgctttactcgcaaaagtaaaggcctcctgcgcctttccgagaaaaagaaacttttcccagcatcgaggctggtgaaccctttaattattttaaaagctgttgttaaataattgatttttcttctttcttctaatttgtgtaaatcagtgatttttagtctttccccatattttttgtacacaaagccacattttctaaatgcttttctcgtgaaaaacttttgaacgcgttcaattttatctatatctttttttaagttagggttccaaacttctgtagcatattctaattgaggtcgtacaaaagttttataggctgctgttagagtctttatttccctgctttttaacactctcaaaatttggaaagttctaagatatgcatttcgtacaattttgctaatatgttctgaagatttaataaataaaaaaaattattttatttggcaattctagttttttatttcttcatacaaaaaccatgaaagattaaaagtttttaaaaaggctagatttttggaaaatttaagaaattttcatagaaaattttcagttctaaaccccaaagcgacaaaggctcttgagtttttcagttcattaaaggcatgtccggcaaatgggaattacccaatctgcccagcctaactaacactaagccactctcgcttgccaaagaagcctctcgtaataatctccgcacaattatataattaattaccccgcctcttcagctggggcggaaaaaaacaaagaaatattcaattgttcaaacgtaacgacgatatggggggttaactacttcaatgaacctcaaaaattaaaatattttaaaatacttaacggtttttgaatcattattgtttttgaatcattatattttcttgaaaactctaattcatttttctatctcattttttctttctctacctctctttctcatgtcagatctctctctctctctgatttttttaaatttttactctatttatttttcaagtgaaagtattatattttaaaaggtttgagtctacgtaaaaaattaaaattgttttggacaaaaattgaattttcggaattttttagtttaaaaatatgaaggttacacccttttcaacggtattggcaaaaactggtaattttctgttctaaaatttttaaaaatttatagttcataattttggttaaaattgtctattatttttaaaataagaaaaaataactttaaagttggaatttttttattaattaagtttcaatcgaaataatttaaagaaaaatggaaatatttcacattacaatgaggaattaaaacgaagccgcaaataatgaaagacaaaaggcttaagcattaggcttttcatgcggatcccattcccaccgttctttagtacatatttttaattttttttatccgttgataatgggtataggtgcgccgtgactcacggtcacggttatagtgaatttcacggtttttgggtcatggtcatggtcacaattcactttttccgtgaataatttacaagggataaaattaaaacttcaggattccatattaattgcatataaaaatttagtcatttttcgggcaaagcttgttaggaaatagtgaaaatttctaaaatttccccgatgacttgaatatattttttaaatgtctattttataattaactaaattggatggggcgcgtaaaatgccatgggacgcttaaatttttgttgggacgcgtaaaacgtcatgggaccgtaaactgtttttgggatcaaagaatttgatgggacgcataaaatgtgaacggacgcgtaaaacgccatggaacaattaaaatgccacgggacaattaaaatctatgtcatggaacgcttaaatgtcatgggacgcttaaaatgccacgggacaattaaaatgccacgggacaattaaaatgccacgggacaattaaaatctatgtcatggaacgcttaaatgtcatgggacgcttaaaatgtcatgggacgcttaaaatgccatgggacaattaaaatgccatgggacaattaaaatgccacgggacaattaaaatctatgtcatggaacgcttaaatgtcatgggacgcttaaaatgccatgggacaattaaaatgccacgggacaattaaaatctatgtcatggaacgcttaaatgtcatgggacgctttgtttccgatcaatggccaaatgttgcgcaaaaagaattgcaccccaaaatgcgcaaagcgatggcattgcggtcaattgagaattctaagaattggattaattcttctaaaatttttcaaatttttacctataaattggctaattttcagtgaaaacttgtttataaatgatcaaaatttccaatttttcccccggcggcgcctatcggcaccgccgcgccccaaaagctcttctattttttcttagaaaaatagcacaaaaatcggaaaatttggtaattttttggtgaaaatctgttcccaacggcgcctatcggcacctccgcgccccaaaactcttatttttccttagaaaaatgatacaaaaatcgcaaaatttgatcattttttagtgaaaaaatgtcaacaaattttattaaaattttcaaaaattttcccggctgcgcctaccggcaccgcctgcctcctcttcccaaaaagttttttggaaaaagcgcccctcaaaaaagctttttattgatttttaaaatttgcaataaaattttacaaaaaataattttttctttatgatt

SEQ ID NO: 2180 - DNA, 2594 bp, Heterodera glycines
  misc_feature (43)..(44): n is a, c, g, or t
  misc_feature (106)..(106): n is a, c, g, or t
  misc_feature (116)..(116): n is a, c, g, or t
tgattaaaggcaaaaatttaatttaaaaatgacaaaaataagnnccatactaaaacttgcaaaaacaaagggtttcggatcaattccggcgttatatttccccatntattaaaatntcggtttttgagtttgaggatcagaactcctgccccacttcctggctaagtctaagaccattagatatgacaattaaattaaaattccgaaaaatttggactccccgtggcacacaccttccaatgccgccattttcgtccgcttcctgcgcgacggcaaagagtgcgaacggttgtcgctgctgaaagggctgaaacgcggcatcgtcaaccccgtcgatgggaatggcatcggtgccgaaaattgacaggcagaggaaaagcggcgaaacaattagtggcaaaatgccaaaatgagaacgatggtgatgagccagtgatgatgaagaagaaacagaagaagccatttcgtaatactgaaatacgacaaatttaaattggcattgttactcatttaaaaaatttattaattgaaaaattttaaggttaacttttttggcattttatttagcctacccataaaattaagcatttttaaattatttgtggttatttgacaacaaaaaatggctatcttttctgataaaataataaatatttttcttgtttatgatttcccattaccgtatctctttttcgtttgttttcccgataataactgatgggcaatgggaaaaaatgttttattttttcactgaaataataagcggttgtgtgttgtggccgaatgctttttatagtgcaaaatgatagcctggaaaaatttttaattaaaaatctgtgaaaatatttgccaaattttgagacgattaattttttaaggaaagttttggacaaatattgcctgaggcaatgtgcgaaaatgaaaatatttttcagacaatgggcaaaaaaagaataataatattcgtatagtgtgcggaaatgacgcaattgcttaaaaatatatttatgaaattccaacaaattttttttcaatttttttgattgcttaaatataattcggaattataagttacataaatacgtagaaatattttatcaatttcaaatttcacccattaaattcaagtgtaaaagaacaaatttcccaaatatgatttaaaaattataaataattaaattatagtgaacgaatataaaaattgtgatttggatgtacaagaagttcaaaattagcatggtatgtttaaatttcaaaataatattcacaaaggttaaactaaagattttaaaattttaatatttagtaatttaaatgcccaaaaataatgtttgaaatattggaaatcagaaattattagcctaaacgaaaaaaaaaattaactataaattgaaccccataaaaaatcgagaatttacctgagttaatccaaatagtttcttttaaaattgaaatttcaaaactgaaaaaattatttttcgtttggcgcaaaagtcaatctctaaaattgcaatgaatgcaaatgggaaagagctgcaaaaataatcaaaattacaatcaccaaaagaattaatctaatttttcccctatttaaattgataattttgttttggcccttgctgcacaaaaaatggtgcacaatgccataatatgggttaagcaaatttaaacaatttaccaatactcaaactctccccactcattcactcacatctcattactaatgccaaatgccaatgtcattcatacaattcgttcattcattgtgtggcactaccaaaatcccccccccccacttaaatatgccaaaattgttttgtgccgtccaaaaatagtgcccgtttttgatggcaatttttcggcacaatttgggtttttgtgtgattggttaataatatttattaactcaattttttcgctgcaaggctgtaagtaataataatgttgtgccgctttgtttattatagcgcataattgcaatttatcaagtgttgtgaaatgtcagtaaaattaaatttaggcgggaaatgttggcgcattttgccatttttggaaataattaaattaaaaattgttcatatatttccaggccaataatatgtaaaacattaatagaaacttaataaaaacaaattaattcagggccagtggaaagaaattgggcacaaaacggtcattaaaataaaaatggccgataaaataaaatggcaaaaaaacaaaaacaccaacatgcttagaacatgtgtaaaattttcctttagtcctttgtatggaattgtccttaaattttttttttaatttcaagaatttacccgctacgcagcccagcgatctttcaaaaattgacatgaaaaattccgtgaaaatttttaatgaaaatgattggtaacagaacactaaattttcaaaatttccatacaaaattcatttccgtttttgtttttattgttttagcgtcgttgggtgcacttaattttcaggaactcccaccccatttaatttccgtcaatcattgatctgagatgtggcgtcataagtccatcagctgaaaagcatctgagaaagatgcggacaaagaattgccgtgggacgag

SEQ ID NO: 2181 - DNA, 7351 bp, Heterodera glycines
  misc_feature (149)..(149): n is a, c, g, or t
  misc_feature (160)..(160): n is a, c, g, or t
gccaaatgccaaagccattcatacaattggttcattcatggggggcattcccaaaatccccccccccacttaaatatccaaaattgttttgtgcgtccaaaaaatagtgccggtttttgatggcaattttcggggcacaattggggttnttgtgtgatgngttaataatatttattaactcattttttcgctgcaaggctgtaagtaataataatgttgtgccgctttgtttattatagcgcataattgcaatttatcaagtgttgtgaaatgtcagtaaaattaaatttaggcgggaaatgttggcgcattttgccatttttggaaataattaaattaaaaattgttcatatatttccaggccaataatatgtaaaaaattaatagaaacttaataaaaacaaattaattcagggccagtggaaagaaattggacacaaaacggtcattaaaataaaaatggccgataaaataaaaatggcaaaaaaacaaaaacaccaacaggcttagaccatgtgtaaaattttcctttagtcctttgtatggaattgtccttaaatttttttaaaaatttcaagaatttacccgctacgcagcccagcgatctttcaaaaattgacatgaaaaattccgtgaaaatttttaatgaaaatgattggtaacagaacactaaattttcaaaatttccatacaaaattcatttccgtttttgtttttattgttttagcgccgttgggtgcacttaattttcaggaactcccaccccatttaatttccgtcaatcattgatctgagatgtggcgtcatagttccatcagctgaaaagcatctgagaaagatgcggacaaagattgccgtgggacgagaaaaaaaaagtcgggattcgggatgggacggccaaaatgttttgtgtcaggattcgggatgaaaaaattccgagacttggggttcgggacaatttcaaaaactgatgctgacaaaaattatgcaaaataaatcgtggaaatattttctccgcgttatgattttgcgggaaaacgccgcatattcgcggcggttatcctctccaaaacactgacaagttgtgatgctcgagagttatgatctcgagtcgaaaaaaaactcacatgttattatttatttttttttgagtcgtgggccccggacaaagagtttctattctcaaaaaagctccacagaagagtgccagggatatggtgattggcctctctctatataacaaaacaaaaaatgtattaataaaatttggtgcgcaaaattgttttgaggtgtatatgatgtcattgaatgtgccagaaaataaacacaatgccacaaaaacgtcataatttttcgaccgcccatttgaacggtggcaatctttttaggcatttgttgtttttgtacacagacacaggagcaaggcgagtttattttaagaaaagcatcgaaataatttgtttagggtaaccgaaaataaaaaaataattaatttaaattattttgtgcccggtttcaagctttttttgtcattgtgttaaaattggaagctcaaagcatcgccgcttaaatctgccaaaacaccagcagcagcagggaaagggttgttttgtcaccacccaacaagcatcagcaagaaattttcaatttcaaatatttttaaatattataaaaaaaagaagaaaatttatattttttcgcaattttatgaaacattccaagggcaattcggtagcgaattttgtgttctttctaagtcagttttgcgaacagactccgccgggataatttttaaatttttcttaaattattaatttatcaaaaaaataattttaagttattttgataaaattttgttatttttttaatgaagtgggtaggattggagaaaaaacagcataactttcctcaaatccaaatgcaaaaaagccgaaaaagtattattctttcaaaaaaaatcacaagtcgctaattaattctataattttaaaataaacaataaatatttccaaaagttaatttctaattttgaacagttcaataacttccgaattgaatggaacgtttgctaaacaaattgtagaattattaaatagagaacagtttggtgggtacaattaataataaatgagaaaaattttgggccacgaagatttgttgttgttttaaaaaaattgcgaaatttaaaacaaaattggtgcaataattttacaaattccacagaaaagccaaaaaaggtaaaagtgccgccgccgccgccgccctccgaattcgctaaattttatcacatgaattcactaattatatataatttttcaaatgttcctttaaatttttacatgaggaagtttatttatatgggtaagaaataatttttaattacaaaattttagagtgaaaaccggcgaaaaaaattttaaattgaaaatttttacacaaagccataaacattcaatgagtgatggtgggatcacaaagtttaccaatttggacagaatattgaaaattggtttctttttaattatttttcttttatttttggacacagagattttgattgaagacttaaatttaaaaaaaaacgtaggaccaggcaggatagtactggaatttgtcaaaatcgtccagaagtcttgattaacatggccaaaaatcccggataagaggcggaccttatcaaaattagccaaggttttccggtctgcaaatctttgctcgggcactgactggatatgtgcaatagtctcagttattggctctcgggttttctgtgatttctcgggctccaatttttggtctcgaaaagtgagattaaccgagaattttcaaagattcaacaattaaaaaaaatttataattgacataaagccagttcgtcaatggccatgcagaaacattgaaagagtgaccaaatttcgcggaatattaaataaaaatgtatgattttgttcaaatgggaatcgaaaagccaagaaaagcgtttgaccgcatttatacatggactagagttaatcgatgggcaattattaactaattaattaattaatacccaaattttgcgttcaaaataaataaatttgtggaacgggaggaaagggtaattaataattatttaataattttaaattatgtacctttcttaaatatgaagatgaaaagtgaactctctaagaatagatttttactgatcaaaaaccaaaacatatttcaattctcattaataattattcagtaatttgcagttttgcaacaaccgcaaaagaccaatatttttttaactttcactttcaaattaattaatttattgaacttttagcgtctgatatcttagaagaaatttatttaactaattaatgttattgcaattagacattgtaagaacaaagcaatactgctgattaaataaagttataaataggattataattaaatggactaaaaaagagaaaaatatggacataacatttatgggttaaaaggcctgaaatatggactaaaaactgccataatatactcaatatttgtttcaattaacttaaaaaatacattgaaatttacgaaaaatggttaaacattaaaaaatgccaaatttttcaaattctagctcacattgcaaaccaaatacatctcaagattttttggtaataatctcattcttttgtcagcaaaaattttcgggtgcgaataaaatacctaaaaaatttaccaaaatttcaaaaaatctctttttaggggtgtatttttaaaaatttccagtatatcttttggggtttttcgctttttttctcatttttcttttaaaatttcataaaaatggcagaaataggactgaaacacaaaaaatggcgaaatatgaatttattcccgaacaaatgtaatacaattaaggtatcaccagttgtttgtttttttgaattttcttcggtaatccggtgccatccctgatagggaccgccggaccccctgttcctagttttttgaaaaattgcaccgcaaaaaaatgggttttaaaagaaaaaaatagtcaaatttatgaaccgttaataatttgatttccgatcaacattttaccgtcggatccaatcgaaaaatcttagtcgacccatcagccccttttaatgcatcccgccagcccttaaaaatttatttttcagcattttttgatttttggaaattttttgaagttaattgaaattttttcgaattttccaaaatcccgcaatcccgcacgggatcccgcaaattttaaatgcgggatttgcgggattaatcccgcgggatcccgtcccgcaaaaaattttgagttccagtcccgcagcgggatccgcaaatttgaaatttccggtctctagtaaaaacaattaaaatcaaaaattaattgatatataatattgatttgtaagcatattttctgtttccgatagatagcaccccccccccccccatgggtcggggagcaaccctagtttataagaagaatcaggaagctaacaaacgttttttggctacctttttcaattattttcccaacttttacaccattgatagagcttcaatagctctacaattttactcagaggtgatctttcgctttttctattgataaaaatggtttaggtattgtttttttttgggaaaagataaaaaaattcaaaaaaaccgaaacggtataccgaaaatttttcttcggttttttcggtttcggtttttttcggtttttataccgaaaccgaccgaccgaaaatgaaaaatttgtcgccgctgggacaaattcaatgagatttgttaatagatttttaactcaaagtttctttgaaacaaagcgtggaatggggggggcgagaagccctgcattaattaaatggagtccctaataagtatttgtccaaattttcacgattaaaaaattctcataaaatgccatatttaagaactttttatccaaactggcaaatttcaataaatacttttaatgatggcttcgcctccatgttgcttaaaaatatgtttgaaaaaaagaagatatttttactcactgcttgtcatcttttgttttttaagcaatggattcaaatggacaaaaaagcaccgataaattccgtcgaaaaggccaatttttcgaacgcacttcgaacccacaaatttgaggctgttcaggcataaaatgttaatgtttggttatcatcccataaaatgtcatttctcctccgctttatccttcagctcggtttggcccttttccatcgttgcacttttggcattggcacttggagtggccctttccttttcgtcgattgcctcaaagtccgttcgatttgtcgccgccgtgggattgttaggcaaatggcgaaggaaatgatcagagtaatttgaaaacgaaaataaatcactgaggggataaatctattaaattttgagttggcatcactctttaatttaattcttttttagatcgccgccaaatcgaatgatccactgatcggatggattgccaaagaggacgcgaccacggatgccttcttccaatccgttttttaatacgaaataaatttttatcttttatttaaattttaaattggagcgaccaattgagcgacaaggaaaacactcattgtttattcataatgggagtgattaatggtcgcaaaaggaattaattaattgaaaggagttaattaattgatgagtttgttgatttatttatttccaagaaatttcatttaattactgttaaatttattttttattcaacattaatggtttggatcgcagaatactgaatgatttctaaaatttggtgccattttcggttccgtttttcattttttcattcggcgcccgccgagaaagagcggcttaaccgtgcctttgtccgacgatgctttttcctctcccttttgcgctgcctcggcttttccttcgtttttagctttaaacgacaaattaattagtaaattagtgagaaattggttgggcccggcaccctcaaggccggactccgaccgtttatttttggattttctgatttatctgtacattcatgttgtgtgactataagccaaaattttaaaaaatcagcaaaaaacacttacaaaattcaccttcccacccaaaaacagcgaaatgtccctcaattttattttcttagcaaatttgtagccgaattagtgaagaaattgcgcgatctttgttgattttttaaaatttaggcttatagtcacacaaaatcagatttttaaacaattttttgcggcgcattaagcccattgttttaaagttttttttcaaataaggacaatttttaaagcaaaagaataacaaaaaattaaattttgagtatcaatttttgagaaaatttttcataggggtgtatttttcattttttagcatttttattaaggatttttccgaaaatcccgaaaaaggcgacaaaaatggcgaaataggcaaaaaaatagacatttaggcattaagcacaaaaagctgaaaataggcaaagttcggcattataaaagtcatcgtagacaccctaaaccaagcggaaaatgcgtttttcgtgcttaactgtgcgtattaggtcgtagaaattttaggatttgcctaaaaaacgaatccctaatcatcatcattttgtgtacatagttctttttcagaatattttccctttactaaagtaaatttcgatttgagtcttttgtttcaataaaaaggtggtggctttcggggtcgaatttagcggtttcaaaattttttttaaataattgaaaaaaaatatacaaatttacaaaaaagaaaaagaaaaaagcaataaattaaaaaagaaattctctattttaaacaaacaaaaaaataatgattaattattattttgcactcgacagaagaggctttagataaggggtccaagccaaggaaaagtcaaaaattttcattttctaataaaatactaaataaaataatatttataaataaattctaatattaattttagtcttatttaaatacaataatttcgttttacagctttttcacttccctttccaatttatcatcgatggaatgcttctgattgccatccaaaaattgtgatcaatgaaagcacaaatgccattcagcgcaatacgacggggacagaaggtgataaaattatcaatgaaatttcgatattttctcaattttaatttttttttaagaatttcttggtggtgatggccttctaattcctcgttcatgccgagcagggccaattcaaatgtcatatgcttctgctggtcgcattggcattatttatgcggaatatcgaattcttgctggaaatggcccgtgagttaaatagcaaaaataaacaaaa

SEQ ID NO: 2182 - DNA, 3245 bp, Heterodera glycines
  misc_feature (3112)..(3112): n is a, c, g, or t
  misc_feature (3182)..(3182): n is a, c, g, or t
cttcggtcacaatttcaaatacgatctgtctaaggaattttaagactttggaaatgtttgtttatacaaaccaactgaaatgttttttttctgattatcactgaatatttgagattgaattttctaagtgatcagtcagaagctccccaaattttaaaattttccgttatctttttcatttagtaaaaactagagaccggcgcgggacgggatcccgcgcgggattttgcgggatcccagtccgcaatcccgcattttttggaaaatgcgggattgcgggatttgcgggattaatcccgcgggatcccgtcccgcaaagaattttgagttccaatcccgcagtgggatccgcaaatttgattttttgtgcgggattatgcgggattttattgatttttttgaaaatttttctaagacagaatgccaaatatttttaaataaattaaataataaatttaattaaagttaactcatttttcgtcgcaaatttcattcaaaatttgtgaaattttcccggcggcgcctatcggcaccgccgtaccctcctccaagttcccaaaaagtttttgaaaaaatcgcgctgtaaaaaacatgtaaatagtcactcctttttccaaaaatgttctaaaataatgaaaaatgacaaaaagaaatgattaattttaaaaaacaatattttaagccgaaaaagggggaaaaaaatattaacgaaattttgggacatttttttttgcagaatacagagaacatatagagcaatcgctatctgtgactttgttttaattcgagcaactatacaaacgaattatgcactagaaaaccgtgccatcgaccattatctgccaccggtccgggttatcccccctcccaaaaaaaaaaatcaaaaaattgcttatttgcagagaagcgtgtttactgcgcaagtgttcgaggtgccctgctttgctgtgccaatgacatccttgaggaaaatattgcgcgcaattggattgaggcggaggaaaagaacgtggacataatcatttccgcccgaattgccaccactgttgaaacggaattatttgcactgacctatgagactggtgagtgagtgggggctgccgagaaaaattttggaaaattaggggtatgttatattttcatcaaaaaatgacccaaaaattttgtgatttgagcaataaaccacccccccccccctccccacctaaaaagtgtataaaaatctcgtcccgcaaaaaatgttgtaattttttgaataatttgtggacaccatgtgccataccatatacacttacgcatatttacggacaaaaaatcattgcgtatttaaaacgaaattttaattcatatttgatgcttaatgtaatggtgccaacaatttcaatcgcccaaaaacagcagaaattaatttaattaattatcattttaatagacggcgccaaactgttgccctcttgcgactgtaccgaccctcacttgctttttgatgggaaaagaagtcttagccactattgcaagcttccttgtaaggccgactcgacatgcaaaatattttccctttactaaagtaaatttcgatttgagtcttttgtttcaataaaaaggtggtggctttcgggggtcgctgatcacgaatattcattgatttttttgaaaaaaccgattttttatcgatatattttcaaaaatttttttattattttcacaagaatttttaccaaatcttaaaaatctcaaaaaataatgtataaaaaccgccaaaaatcaaaaatatgtaattgtgggatgatttttagacgatccccgacttttttatgcacgatctttggttttgattagattttcagaaattgtttaccatttctttttgcttttgtgtaattttctttccctcgtccttttttcgtccgtttgattttgctccgtccaattgatcacaatcattcacttaacacttctctgatcaacacttcattcctcctcatcccccttttttgttcattcattcacttctcattaaacttttttgttgcgataaaatggcaacgaaaaattaatttttgattaagaaaaaggaatgaaatgaaaattatttcacaaataatttttcatttttatatttgttgaattttgaattctttttagcttttagaatacatcaaaatgcaattgcttaagtatttcatggcctcttttctttgccttttctttgtttttggaatttctttcggcgcttctaatggtaaaaaatgaattatttctattgacgggaagaaaatgctaagtttttgaggttaagattaagaaatttttaagggaatggcatgcgttgtcggcactttccttttgtgtgactataagcctaaattttaaaaaatcaacaaagatcgcgcaatttcttcactaattcggctacaaatttgctaagaaaataaaattgagggacatttcgctgtttttgggtgggaaggtgaattttgtaagtgttttttgctgattttttaaaattttggcttatagtcacacaacatgaatgtacagataaatcagaaaatccaaaaataaacggtcggagtccggccttgagggtgccgggcccaaccaatttctcactaatttactaattaatttgtcgtttaaagctaaaaacgaaggaaaagccgaggcagcgcaaaagggagaggaaaaagcctcgtcggacaaaggcacggttaagccgctctttctcggcgggcgccgaatgaaaaaatgaaaaacggaaccgaaaatggcaccaaattttaggaatcattcagtattctgcgatccaaaccattaatgttgaataaaaaataaatttaacagtaattaaatgaaatttcttggaaataaataaatcaacaaactcatcaattaattaactcctttcaattaattaattccttttgcgaccattaatcactcccattatgaataaacaatgagtgttttccttgtcgctcaattggtcgctccaatttaaaatttaaataaaagataaaaatttatttcgtattaaaaaacggattgggagaaggcatccgtggtcgcgtcctctttggcatccatccgatcagtggatcattcgattggncggcgatctaaaaaagaattaaattaaagagtgatgccaactcaaattttaatagatttatcccctcagngattttattttttgttttcaaattactctgatcatttccctccgccatttgcctaacaatccc

SEQ ID NO: 2183 - DNA, 4873 bp, Heterodera glycines
acattttatcctcaccctcgaaaaaacatacaatacacacatacgcacacgcatagacacgcacacacgcgcacatgcatacatacgcatacacacgcaaatgcatacatacgcaatacacacacaccccatgtgtgtaatttttacacatttttgagtaattccttcatttaatcattatttttcttaatttttgctaaattatatcttctattccttaataatttacaaattgtaacttctttcgcttaattctgcacttttctacctaaaaacgacgttcccaaatgtttaataattttcaaattgtgtcttccgttgcttaattctgcatacatgttaatgtgtttaattatgcacttttctacctagaaatgacaggttcgtgcacataataaaaattgtatcttccactccttaataatttacaaattgtgtcttcttgctcttaattatgcatttttctacctaaaaatgacgttcccaattgcttaataattttcaaattgtatcttccattgcttaattctgcatacatgttaatgtttaattatgcacttttctacctaaaaacgacaagttcgtgtattttttaaaattgtatcttctattccttaataatttacaaattgtgttacaaaaccctgactatttttctcgttaaatacctttttaatttataccttttaatattagtaatgacacatttttcaattttatttctgaataaacattcaaatgaaaaatacaagtgtaaaatagagaataaagagaaatgataaaaagaaagtatacaactcttttgatagatttgaaggaatatcagaattcttagagttccctttgaaaaaagtgagcaaacacacccagggaacggcttcacccttcggtccccaacccaaacactcacgcaccaggctgcgcattacaataatgagcagctcgtccaccttcatctcagatggatggcctggagtgatggggaggatcaaccaggggtcattccgtcccacatgagtgatataaacagagagaaagaaaagaagggaacaataagaaaactaatatacagaaaatttaattgagaatgcatacttatcatttgcgataaccaaattcgaggacttggaatgaatcattaataataccttttgtgaagacaggttgataatgcttagttagagattgagtgtacactttgccttggataaggttgggacgaataaaatggggatatgttacaatgatagggtcaggggggtcttcggagccatagcgtaagatttggtccttaacagtatcgtaatgaattttttgaatagtttgtgcatcaagggtgaaccctcttattttcaaatcgtgttctatttcaccggtgtccttgcgttgcagcttcatcccataattcttgcagccagcgctgatgaactccaagatattgtggtcggggttttcgtctgttagttctccaaggtgtccctttcctgtcgggagtgggtcgttgtcctcggggtgcacgtagatgacgctgtcggtgtcgtaataaaggatttcgcagtcgggggtgtcggcaacttttttgagggcatcgtagaggtagaggcgagctgcagatgtcgtgaagagggagatgacaacattggagtatttattttcgtcgacaaattcttcttttggtcggtaagtcagcataaaaacatcgttgtcgtcgtccatcatttccaagtccactaattcgattttcttgtcgtcggtatattggcgaatcaggctttcgtcgttgttgattattgcttttgagagtagatttcgcatcgagaagcggccccagagtgagttgaggcaaagtttggcgatgtaccgcttccctggttcagccttcatcttttcgttgtctaacaaaattccaaatcgctgacggttctcctcaatgtattccttcttctcctcttcgttgctgcaccatgaagggaagccggttgcgtggatcttcagggccatcatttcgctaacgtaagatttgaagatgttgtcgctccattggtcgtattgcaggacatggaagagttttctgacggtgtagccgacctccaaggcagcattcaattcaaggtgagtgcaggtagagacaaaggcacggtcattgggattgaagtgtggacacgagtagttgtcgtctttgaggccattcgggtgttcattggtgatgtgtttggcacatttttcgcagagtggaaagaggagtcgctcatcaaattttacgggcattacggtcacattgatattcctgtttgggggtaaaagtaaaacttttaaaagtcccttgtatggattgtcggatggagctcgccagttgacagtttgctcatttaatctaaagttgataatttttgggtgaccgagtggataacttgtagaaaagttggtccatggataaaggctggtgaagtccttgtagctgattttttgtcccggctttgctgtgtggagtagcttcattggtccagtccgtcctccatgaaatgcgtctctgattttaattggtgagcggtccttccaattgtcaaagtagcccctcattgttgcgtccttttttagctgctcattgatttcatgttcccatacaacttccaagtcgacgtaccggcgaataatctcgtgcttccttacctccctctctcttatctcacgcagtgtcttcccatttggcatcctcgtctcttcgtccaagtcctcaaaacattccccacacccatgccacagacaaccatttacctcaataattttatccctcttcccattagtcccttttatataaccatccacttgatacacctgaccctcacgtttaaagacatattcaccatagcgggagtgtgctgtttggatgttgacgttgttaatatgtgagtaccaatccaagtatttgatggcaagggcactttggttctgttgaggtgtatagcctttttccgggacgatggcaagcgagttaggcttcagatgattgagtgcaaagttcttgacgcatgcgctggcgatggtcattgcttgccacaggatgtcaattcctccgtgttttccatctcttttggtgagttgcttgaattcacgtctaagttccactagggcatgggtgagtatttgtacgtcgttgcaacaatattcagggagtttttccttaaggttaaaaggttggttgtaattactattgtaccaattgtcaaatttctgttgatcggggattttcatttgatcaggacagtattcttcacgtggaggaagatgggaaaggacattatcatagtttgatgctttgttgaacatgtgtggaaaatgttgtttatcctaataattaaaaattaattgaattttaaagaatattattcacctgtattttgagaccaaaggatttgatgaggccagataatttgatgggcataaggttgtagctgtcgcgaagtatggtttgaggcccgtgttcattttgattaattttgagttcgtagagtcggttcccttgtttgatgatgtcggggttgtgaattccttgattgataaaaattaattaaatatttaataaatttttaccttgcgaaatgacttccttgataaccatggtcatgtcgtagcggcccccaaaatgtgcaaaggcaaccgtgggaaattttttgttgtggtcgaagagtagccattggacaaagtcgcgcagcgggtgcctagtggtgactttttggtccactatcgtgtttgagaagtcgaatggtgcgaaggtgattgtgcggtggggtccacaaattttgcaagaggatcctttaagtgagtccttccaatttccattgatgcaatcggtacaaattatggtagccgacacaaagtttacctcgtgttcgaatttattacctacttttttatcctgtgtcgcttcaaaatcataagcgatgatcctgtatggtttaagtttatggggttttaggggttggataaaacagctactgcacggattatcctcatcatcctcttttacatggaattgcttgcaaagtcgacaaaacttttccccgcattggtgacctgttttaccgtgatactttacattataaattaccccacagtcctcgcatcgctgaaatttggtgcatagatccttgtgtaggtgacgttcatagcagaccttgttgtagaaattgttgttgcagtgctcacattttttgaagtatccctgttgtggctcgcatgggtagtcgacgccaacctcccgacatccatggcagagtgaagagcaattcattgaatgttgagatttgcgctcgtagacgctttcacaagagaggcaatagtaacgtttattgaagaatttggacagggttttgatgccgtcaaagtggttgttgttgtggtagagaagaatggggaattggtagtcggtgacatcagatttggtgattggtcgtatctggtaatcgttaaatatgaaaattttgtactcaccgggatatttgacgttccataacccttgcacttgatggatgtatatttctgcatcgtattccggttcagttgtcggaatcccggcatcgcggagtaaaagtagtactttttgacgaagaacagtagtttggttattgttcatccatctccatcttttttcagatataattccgcgtttatacaaagagtagaagcgcattaattccagagcataaaagaggcaatagttgtcgttgttgttgactttgaagatgtgtgattgggaagagaagattggaggggcacttcctttgattgtccgtaggcggggaagtccgacagtgtttagaacagttacgcttgggaggatggggccccgtaaaaattgacgtatttgcttttg

SEQ ID NO: 2184 - DNA, 1661 bp, Heterodera glycines
  misc_feature (42)..(42): n is a, c, g, or t
  misc_feature (1458)..(1458): n is a, c, g, or t
  misc_feature (1490)..(1490): n is a, c, g, or t
  misc_feature (1510)..(1510): n is a, c, g, or t
  misc_feature (1587)..(1587): n is a, c, g, or t
cccacagtcctcgcatcgctgaaattggtgcatagatcctgntgtaggtgaagttcatagcagaccttgttgtagaaattgttgttacattgatcacattttttgaagtatccctgttgtggctcgcatgggtagtcaacgcccacctcccgacatccatggcagagtgaagagcaattcattgaatgttgagatttgcgctcgtagacgctttcacaagagaggcaataataatttttattgaagaatttggaaagtgttttgatgccgtcgaaatgtttgtcgtggtggtagagaataatagagaattggtattcattgacgtcagactttgtgatgggtcgggtttggtagtcattaaagatgaatattttatactcgcctgtaacaaataatgtaatttatttcattaataaaaatcaatataaaaagtaaaataatcaccgggatattttgtgctccataatccttgcacttggtggatgtatatttctgcatcgtattccggttcagttgtcggaatcccggcatcgcggagtaaaagtagtactttttgacgaagaacagttgtttgattatctttgagccatctaaattgtttccttgaaattactcccctgatatataatgagtagtagcgcatcagttccagtgcataaaaaaggcaataattgtcgttgttgttaattttgaagatgtgtgattgggaagagtgaattggaggggcacttcctttggtcgttcgtcgtcgtggtaggccttcagtgtttagaacagttacggtgacaacaaaaggggccccatataagttgacgtgtttggacttgctctgctccactttacaaaactggttgaaaatggcgtccacgacatttgatgtaattggagttataggcatgatgatgtctccctggtctaaaagctccgaagaaataattacacctactttatttgctcctccaatggtgttttgtgcattctgaatggcctcttcaacagattggtgtacacatgaacggaattcggtaagaggatcagcacacttttgaatttcactaataacaaattttgatttagagcggatgaaatgatgtttaagacttttggaagtaaattggtcaattttacgaatgcatttattagtttgagatttttttggggagggagaagattgagtgtttgaagctctcttcattataatattgagtattatttatgagatttgtattaaaataattaatattttaattaaagtgcacaattttatatttaaatagtgatataagggtttatttttaggataatggtcaggaatgtaagcaaattctgacgaaagatgaattgggctctggaggatgtttttaagagcagagcgctgcggagactttttggttagaagagagagctgtgggcgctgcaggaattgcaaatgactgcaagaaaggggcttttcgctgngaatggtcggctatttataccctcacaagtgngcggagcttgaccttcactncagcatgtggtcatttggcacattgccaactaaattgttcatgtcatggcatatgcgctcaaatggcccctgcgtgncgtcaaatggcacgcgcgagcgctcaaatgcctgccattccttcctccccaaaggcacgacagctgatgtccgt

SEQ ID NO: 2185 - DNA, 5724 bp, Heterodera glycines
  misc_feature (109)..(109): n is a, c, g, or t
  misc_feature (4112)..(4112): n is a, c, g, or t
  misc_feature (5637)..(5637): n is a, c, g, or t
aaaactggttgaaaacggcgtccacgacgtttgacgtaattggtgtatggggcagtatgatgtcacctggtctaaagtcagaaaagaaattatgacacctaccttattngcagcgccaagtgtgttttgtccatctaaaattgcttcctcgatcgaatggtgcacacatgagcgtagctccgcagcggggtcagcacatttgtcaatttcctcaatgacgaacttggattttgagcgcaccagttgatattttttactttttgaagtgaggttatcaattttacgaatgcatttatttggttgggattttttggggaaggaggaggaagaattttgagagagggaaaaacgtttcattttatttgaataatatatgaataaaaactttatgatttatagatgatataagataatatgaaagaatattttgaattagaaaaatgtaaattttatagttgtaatagaaaattattgaaaaatttttttttttttataagttgaatattggtaaaatattggatgaaagggtaatgtagttgcaaatttgttagtttaaatattttttgacggagcgcacaagcaaagaatgttggtagaattttcgcgaatgaatgggagaagttgaattttgctagtaatagccggctatttataccctcacaagtgggcggagcttgaccttcactcaagcatgtggtcatttggcacattggcaactaaattgttcatgtcatggcatatgcgctcaaatggcctctgcgtgcggtcaaatggcacgcgcgagcgctcaaatggcctggcatcccttcactccctaaaaggcacgacagctgatgtccgtccatccaatacgatttgactttaataattatttaattaattaattttatatttttttcatttatttttaaatttttatctattattttaaatttatttaggtaataattttttaactattattattttaacaatttaattttaattaaatttaattttttaattaatttattattattattatttatattttaataatataacaattttaattttactcttaccttattttaattttatttattttaaccataattaattttaatttaattttgaattatttgaattttatttcaactttaattataataattcatttaactaaaattttaaatttatcacaatcgggctctcaaatagcccctgcgggcgctcaagtggtagcatacctacactcaatagaatttgagttacctctgaccaacagctggtgctttccattatcaccagcgagcgctcaaatggtccctacgtgcgctcaaatggcatacgcgagcgcttaaatggcacacacgcgggcgctcaggtggcatgcgtcccttcccttccctataaggcatgacagctgacgcccatcctctgcctccctttccttctctaataggatttggcgttgggttttatccttcagatgttttttcaattatttacctcttctgggattggatatatttattataggtgttttttaaaggtttaaatttggtactgaaacgtccctttccattgggactgaaatggcggggctgaaaattaagggccaaaatcttggggggtaactactaatattaaccatttttcattgcatataataaaaattttaaatgtccttggatttcatgaattttccccactatgtccttgaaaatcggcatacccgtccttggaaacggaggatggacgatggcagccctgtattagatgatgtcatattcgtgatcagcgtccccgataacccccgagtagaacaaaatatcataaaaacgcctttttttcttttttttagggaccagtaaaagtaaccattaccatcataattatcattagattgttgactgtaacttacaccctaatttttaggtatttactcctaattttgattacttttacaaattgcctccttttccgatgacttttgctttgtctgtgttcggcttcaaccaaccgttctttttcactttgatagggttttcaaaccttattttttctagtctaacttccccaattttcagtattattttggttttgcttcttacccttgcgctggtgggcagtgatcagtcgtcagacgacgaaaatgatacaggtttttgtggaagtgacgacagacccgaagtgacaattggtggaattttgaatcgccgttcgactggcgttagtttcttacacccatttaaattttagtgagacaaatgaggaaattattcgggtttaggagcattaaaatcaaaagaggaactcacttttatatttccaaacttattttagactggtaatatggttgtctccctttttcaacatttattcaaatttgctttcggggttttacattggtcaaaataggtgcccgtatttatcttcagccaagccgatagaaaaccctccaaaaaagctttcacaactaatttgatatttttacaattagtcaaatttgactgacccccatttatgttgtggttttgggtaattgcataaattggttttggacaattaaaacaaaattcgaaaaattagtttttggaaaaataattccccatttggttttcgttaccatgctataagaacataaataagattatcactgctattgaaatatccgacgcttttacaaaagtgctttctcaattacagttgctcaacagacggcatccatcccatgaacaattgttggacaaacggtcgccgacatggaagaaaagcataaacgaagtgatcgactgctgacaaccagcaaattgtaattttaaattctagtcatttctcttttttatgttatcttctattgtactatatttatcattttaccattcatttagccatttttattgggatctcataaaataaattttaaggtttggactttcttaactaatttttgaggattaaggtaaaatcaaaaattaattaggtatctccaagcattcagagatttttctttcaataaataagaaattgtctaatttataacaaacaaaattaaggttggcttcttcgcccttttagttttcttttctttcgcttcattccaattttttggccccttccgtcgtcgttttcgaacttttccctcctccgccgagcaccttcttccgctggatgaacatgtacctgaaaaagcagaattcacattttttaaaaagattaaattcacaattaaattacccgtaaagttttggaaaacccggcaaataaatgagacacagagcgatgataatgtagtaaaagttgaagctcatgttccacgaattgggctaaagccaaaaaagataatgtgaattaataaataaacaaatataaaagcaaagaattcttattttgaggacaataaataatttctagagcccgacctgcggacccacgcctgggcttttccagtccatttttcaacaatttgaattttgtccgggaaatccagttccaacagggaatccgggtccatgcttttttcaaaagcgtttgctgaccatttcaattgtaaaatgtttgcgtcgtgcaatttcgcccaatgcggcgaccattgtcagcacttctccgccggcacccatcggataaagcgcaatgaaaaaagtgtacctgaaaggacagatgggatgtaattcggataaatataaaacttaagaaggcagaattttatggaatttattcaattttttttttaaatggccaaatgtgagcaaaatcaaccatagttaggcattcttggaaaaacagaaacattctaaggagttcgcaaaatggcgtaccttttgccccccccatgtgaatggtccacgaaattacggcattttttttttttttttgctttttaattcacacctcatccacgtcaatgcgtagggcacagcgttcagcaaattgagcgcatagaacgaatagcggacaacttcagtgatggaccaggcgagcaaaagcattggcacaccaaaactgagacgggcctaaaatgggaaataaattgaaaaaccaaaagggctcttatgcagtttcatccccacaatttttccccacttttttcaaaattaaaaacgccaattttttgggggtttcatggnccgctgcccacgaatccgacattcatcttgaccacttttttctcaagattcgtgtttttttctgttattctcctcattcgttacgaatttcgcgcattcgaaaatggtcaaagatggatgcctaattcgtgatcagtggccatgaaaacccaaaaattggcattataaacatgtggtgggggtgaagagccgaaaattaaatcaaaaatttgctttccccccccctccatcggtcactaattctttaaatgcaattgtaataaatcataccgaggcaactttgtgcaaaatcatccaaacaacagtgacacgggagaaaacctggacaaaaaaggattgatttatgagcagaaagtagcaattgctttgatgtatgaccgacacagaaataacgaaggaggaatttgggagaacggaggggtttgaacaaaaagagaaaatcataaattgccgaaatttaaaaaagatcatttttatcgaaaaatttctaaaatttttcgaaaaattattccgaaaaattatcgacagtcacttagctgtacaatgaaaagattgaaaaccaatgacaacagggaacagttctttgaaaaattttgatggagaatatttggacaaaattttttttaaatgattaaaaaattcttacgaaattgcaaattattacttttttaggctcaattccactatttgtgctataaatttgtttctggggccttaagcaaaaaaaaaagtgccgacaacaaaacaataaacgaattaattcccagcatttcttggcattggaagccaaatgctggtaattgtaagcttacctggacaattgtggtgaacaccggcgaacggaccaaaccgacgacactgtgaacaatctgaaaaacaaacagaagaaataattggtgccaaagtcaatgcaaaaagccgacagaacccccaaaagcggtaaatgccaaccctcacattttcactgagaaaactcacttccaaaatggcagccgtttggaagattttcaattccatctccacgttttggtacagttcgggaaaggagtgtccgctggccaaccaaagcacagtcttcacaagaatggaaccccatcttgaaaagggattaattacttcaaatttaggattgccaatttttaatgataaaacttttaaacaaaaggcaagaaaaccaaaacagaaatcacaggcaaaggatgggaaaaaagaattggaaaaggcaaaaaaaatttcttccagactgaatgttttgaccaaaatattaattttttaaatttaaataaaaacaaaccccaaaaattggatggcattgtacgccagcaaataaacatctcctggtttcatgtttcaattaaattataaagtatataaaatcgtaattatacaaatattattctaaagatgtaataattaactaattgatacatgtcaatttctgatagaacagcaacgacacaaaagtgaagcgcaacgaattttgggctcctaggaaaaccccaaaaaaaagacataagcaggaggngatctgtgttgaaaaccagctagctaacttattgttttagtattttaatgatttttcttaaagtcttttcactttttttaaaaagga

SEQ ID NO: 2186 - DNA, 3847 bp, Heterodera glycines
gagaatgaaagagcgtacggagtcacaaccgtcgtattgtgatttctaaaaatatgcaattcgtcccaattttccatgatatcatagatagcggcattagccctctctcatttaatcacctttcttaccccccccccccccccttgagtttaacccattttaccccctttttgagttttggcaatattttaagaggaattcgataaaattttgaaatatttaatatttggcatttgttttcgtatttttaactaaattttcttacaaaatcgactaaaaacacaaaaaattttcccggcggcgcctgtcggcgtcgtcgtacataaaaattcctttaaaaattttaattgttaccttaaaatctagaaaaatgcccattttttgttaaagttttgtgaacaaataccactttaaattctatttttcccctatggcgccaagcccatcccctattttttaaaaactgtacgcaaaatttcaaccaggaagttactttttggacaaaatttttttggtcaaatctggccaaaaaaaagttatttggacaattttttagctatttataggcttttttactcaaatgccatctttttgtgtgctgacgccccacttttttttacccttatggtgggttgtcgcccctttttgatgttatgctatatataccctgtattcaacataaattaatatgtattcttctctagaatctattgtttttcttctctagaatacatttttttaacatttccgtgttttcattaattctttataagctttatttttgatactgtgtgctgaggtgcgtgacgtcaataggctcctggcttttatttaaataataactaaaaacgaaaacaaagatattaataaattgaatttttgtaatagatttgtatacaataccgcgctggaataaaaaatacgatcaaactcctaccaatctcaataacgtagtaaaaaataacgtttttttaattcatgtaatttttaaaaataatcatataaataacagtttatttgagcataaaataaagttttaataataattgttgtgaaatcttttaataacattgtctttttaatctacaaagacaccaatgttaaaaaatttaagatttccaaccgtaaaatgaaacgctctgcttctgcttcttcgaaaaaacaactgattgataaaaaatatttaattaatgttattgacgacattttttgcttcttttatgccttggaattgatgcgctactactcattacacaaacgtggaataattaccgaaaagcgatggcgatggattaacaacaaccaaacaacggttttacgacaaaaggtgctgcaactactccgcgatgccgggattccgacaactgaaccgaattacgaccctaaaatatatatacatcaagtgcaaggcctttggagcgtcaaatatccaggcgaatacaaaatattcattttcaacgactaccagacacggcctattattaaatcagatgtagtagactaccaattcccaattctactctaccacaaaaacaaccacttcgacgggattaaaaccatctccaaatttttcaacaaacattactattgtctctcttgtgaagctccgtatgactctaaatcaacacatacaatgaaatgcacttctttatgtctcggctgccgggaggtgggggtcgactatccttgtgaaactcaacagggatactacaaaaaatgtgaatactgcgtcaatatattctacaactacaattgttatgagcgccatcttcaaaaagacttgtgcaccaaattccaacgctgtgaagattgtggggtcatttacaacattaacgttcatggtagagaaggaagaaatgcgcaccaatgcggagagaaattttgtaaactttgcaagcaatttcacgtaaaggacgacgacgagatgaacccctgcagtagctgcttcatacaaccgctgaaacaacataaaatcaaaccgtaccgaatcatagcatacgactttgaggccacgcaggacaagaaggtggagaacaaattcgaacacgaggtcaacttcgcagcggctaccatcatctgcaccgattgtatcaacaatagcagttggaactactctctgaaagggaaaaactgtgcgatttgtggcccccaccgcacaataacattttcgccttttgactacactaaaacaacaatcgacaaaaaaatcgtcacacaaaaaccactgcgcgaattcgttcactggttattcgttgaacacaacaaaaagtttccaacagtcgcctttgcacactttggtggccgttatgatataacattgtacatcaaggaaattattaaacaaggtaataaatttttaataaataattatttagtttattcatataggaatgcgtaatcctcaaatcatcaaacaaggcaaccgaatttatgaacttaaattaaaagaaaatgattgcggacctctcacgattctgcgcgacagctacaatcatatgcccatcaaattatctggcttaatcaaatcgttcggacttaaaattcaggtgattaatagtacattttttaaactataattatcaacactttaaaacaaaaaaaatttgcaaaagtttaggtaatcattttctttgtacaaaaaaatttctttgacaataatttattactagggttggagaaagtatggatttctatatttttctgggtgtttattttaggctaataaacatataatagtatttgtagtttagtttgaaggttctaggacatattttttatttccatattccatatttttgtcaatatttcacagttttgtccatattttatccatatttcaacattttttttcggaaagtatctaaaaaaattcccaacttaatcaattttttcaattttcaaaatgcataatttcttaataatgccaaaaaaaacgtcaaaatagcactaaaacctcgagatgtatttgatctgtcaacaagagaaggaaaattattgattttatgattaaaaataaatgtttttatgtaattttacccatgaattttacataaatattttggcaatttcgtccatatttttagagttcttcgtccatataatccatatttttaatcgtttttgtaatccaggaaaagcttgagatgttttgatctgtctataagagaagaaaaaaagttaattattttattgaaataaatatttaaaatgagtctacttgtccatatttcttagaactctatttattacttatattaatgcataaaaaattttttgatctaaatataattttaggataaacagtacttcccacatatgttcaacaaatcggctaactacttcaacgtcctaccacacctccctccacgtgaagactactgtcctgatcaaatgaaaaaagccgatttacagaaatttgataattggtataactacaatcgcagtcaaccattcgaccttaaagagaaactacctgaatactgctgcaatgacgtccaaatccttacccacgccctcgtcgaactacgccgggaattcaaacaacttacacaaagggacggaaaacacggtggaatcgacattttgtggcaagccatgaccatcgccagtgcctgcgtcaaaatttttgccctcaatcatctaaagcccaactcacttgccatcgtcccggagaaaggctacacccctcaacaaaatcaaagcgcactcgccgtcaaatacctcgactggtactcccacatcaacaatgtcaatatccagacggcacactctcggtacggcgaatatgtctttaaacgcgaaggggaggtttaccaagtcgacggatacatcaaaggcacgaatggaa

SEQ ID NO: 2187 - DNA, 2766 bp, Heterodera glycines
  misc_feature (2762)..(2762): n is a, c, g, or t
acaacaaaaaaatcgaagtttcgggcgtcgaggaaatggatgaagaaaacgaggtgtatctgataagctacaaagagaaggaagaatttgtcgaggaaaataaatattctaatgttgtcatctccctctttacaacatctgcagcacgactacatctctatggaattttaaagaaagtggcagacacaccgaaatgtgaagttctatattttgatacggtaatttgacaatttaaaaaatatttaaattttatgaatttttattttaggacagtatcatctacgtccatcctgaggacaacgaccctctgccaaccggaaagggccacctcggtgagctgaccgacgagaaaccggaccacgacattttggaattcatcagcgcagggtgtaagaactacgggatgaaggtgagacgaaaggaaaccggtgaaattgaatatgacttaaaaataagagggttcaccctcgatgaaaaaacaacacaacgtattcattatgatagtgttaaaaaccaaataatcaaatatgtatctggctcacccgcatcaccaatttctgtcaattacccccattccattcgccctaatttgattcaaggcaaagtgtttacccaatccctcactaaactttatcaaccctctttcactaaaggaattgtaaataattcttatcatgttcatgattatggctatcgcaaataattgtctattttttcattttatttgtaagagaattaatttcaaaatattaaaaaattaattctcatttgttttgattctcgtttggtttgtgtatctaatttttattgtttgccttctatgtacaaaaatataaatatgtttgctcagagatacgaaacttagacttgggtgtagtaaagtatttaaagaaattgaaaaggaaaaaaacaatatgtttgctcagagatacgaaacttagacttgggtgtagtaaagtatttaaagaaattgaaaaggaaaaaaacttaggaagatatataataaaaaatgaaacggtctacgagaaattcgtcaaaaaaagaaaataaaaaatcccgaagttcggattcgctaagacaagaaaaacaacaagaaaaaagtcaaaattgtatcaaaaaaatagatgaatatacaactagtagtaaaaagtttcaactattaaggtcaaaatcaaaatttgtcgttcaaaatatagaccaatgtgataatcccactaaggagttagaagaatgtataaaatcgtcaattaatgaagctatcgaagatgctaagagaactttgggtggcgcggataaagccggagtagttatttcttcagaaatgttagatcaaggagacataattgtgccgataacacctattagctcaaatgtggcatacgcggtcttcaatcaatttatcaaagtagaacaaagtgtagcaagaaaaagtcttaacatttatggaacaccttttgtcattactgtaacagttcttaacattaatggattaagaaaaaataaagaataaattattgtttttttttaaatttataaaaaatgtgaataaaatattaaaaaatttaatggtgtattttattaaaaaccctagagaaaccggaataaaaaacatctttaagattagttggtgaccataaacttgtttgtcatgcatttgtggatttatatttatgggtttcgacattgggctagatatggtaacgctatatttgtgacacttgtgtacactaaatttgggggaccagacacttgggggtggggccgtgactcgacacttggggaccatacagttggggaccctacactttgggatcgtacagttggggaccctacgttaagggacccgacaattggggacctatacatttgggggaccgtacatttgagggtttatcatttgatgacttgactcttggtgacccgacatttggagatttcaaacagaaaaaataaaaatgatattacactttaggtgggacagctcatctttagaaaatgacaaaaaaatacaataatcattgaaaaattgactcacatccttagaaaatatcgtaattttcaatccaattttaaaaatactccgacacccattttttttcatgtaaaataaccaacatccccaggaaatacgataaaaaccaatgatttattcgaaattcaccccggtaattaattaacaaaaaatcatttgcagtcaagggggctcgaacttaggggccgaaatcttctggactaactacttgttttgttaccccaccccaaaatttaaatcgattccaaagtccatttcacctagtttcaacattaaaaaacggacatggacaagccagtcgacgagaatttgccgcattcgtccgtcaatggttttgtgcacggacagaaagtcgaagtccagcggggtgcgtctttcgagttgtcgcaagtagaggtcaacgtcgtcggcgtattcagcggggaacaatgttgcgccaccaccgaatttcaaggaggacaccggtttctcaatgtcatggtgttgaggctaaaagactgggaaatgacacgtgctaattggttgtttttttatttaatctccaaaactaatttttcaaattctttcaccaaacctcggcctttgcgatcttctccggaatgtttgattcattgccgctgagtactgtcgaatgcttttcgaattcggttcatttgtttttgtgggttaagtgttgaaggtccacggaaaatgcaagagaataaagaactttattgatttgaaaaaatgnggga

SEQ ID NO: 2188 - DNA, 4147 bp, Heterodera glycines
  misc_feature (5)..(5): n is a, c, g, or t
tttcncggattcccataataatgccgtggctttgataggagttgtacatttgataaccgcggcattgaattttctagggttatacttaaattcgcattcggtgatcgtcagagagtttagtttaattccggtaccgagattagcgagagcaattatatttacgattatcggtttttgcatttttgatacaatgtatcaatcaaatggtcctttcactccctttatataccccttctataaatagcaacccaaaataaaattaaattgaaaaatgaactgcccacataaaattaagtgttgtcattactgtccctgtcattacgagatttgtagcaggtgtaaaaagcacagtcttttgcatttcggtacatcattatttgataatttctggctatgccccaaatgcgcgaaacatgttccctatgaaaatataaataggtcaaataaataagaggaattaaaaatgtttcgcggtccgttcactctaattctctcgggggctaccgggagtggtaagacccgttggctattacggtttttaaaacaccataagaatctaattgaaccatcgcccaccaaaattctttattgttacggtgagatgaatgatagtattttaggattaatcggggagggtgtcgagacttttaacgggattccggacatgaataagattaaagaacaagaaaaacccctcttactgatacttgacgatttaatgcttaacatgcagaacaattttcttgatttactctttaccaggggctcccataattggaacgtaagcgtaatttttgtaacccagagtctctacggtcgggacattaaaacggcaagagctaacgcccattatctgattttaatgcgtaccccttcagggacattacaaagtggtttgatgagcaagctgatcagaatgtttcgtctgctgatcatagcaattcttcagatgatgaggatttctttaaaatttcgtgcaatttgttacagatttcgcccaaaaatgaataatttttgcgaattgggacaaaaaacttttttgattaaatctcttttttgcggcttgccttttacaaaatcttttgtggtacagggaggttaaattttgaaatttttagtgaaatttgttaacagattatgtccaaaaaatgaactataattggttaatttgtgggtttatggctgttgcaaaaataaagaaaaatattttttaaggttagaaaaagtttcttattaattaaatttcaattaaaataatttaaagaaaatataaaaatctcatattctaatgtggaattgaacccaagcgacaaataataaaagactagagtcttaaccactaggctacacatacatatgcacatttatttaattttttctaaaaaatttctcgtttcccaccaatttccttcaaaaattttcactcagacccccattcttaccagtgtacttttattcccgttttgagaaaaaagtaaataaggacataaataaggacacaaagattgaactgatcgaaaatttgataaaataagaaagaaaaaatttgtgggtttaaatatgacaaaaagaaaagaaacaaaattgagcacgaaattgccaatgaattgagagttcaattcaataaaatttaccagagaagaagtatttggtaagaaaataataaaaaaattaattatacttattatctcattgagatataattcaaatgaataaaaaacagaaaaatttgaacaatttgaaaatttccacgccaataataaccaagtcttaaaacttatgacggtatttagttttttggagttaggtatattattctacaacatttataaaagagaaagggaaattaacaatcatttttgaatttaaatcaattattcactcattaaaagttaataattatttaataattttcgcgtaaaaaattataagcaacatgttaatataaaaaatcaatactgatgcaattattggtgggggaaaatgaaaaaaatatttttaaaataatttttgtcaaatcataaaattaatatatgcagaaattctaaataatttaattttgaaaatactttgactcaaaaaatgttgaaaattatttttgagattattttcttcttattcattatcgtactaattgatggaattgatgaagatttatttgatgatttgtggaaaaatcttaagccatcaacctcaaaaaaagtttggcacatggcgaactgttgcaaattctctctgagccagtgccaaaaatggaaatttttgcaatttttttttgcggtgtgtaaaattttatttgtgggccaaaactctttcctcaaccgagtaatatttcttaaatttaccatatataaaattttttggaattccataattgtttttcaagggtttactatacggaaacggaaatttacatgtaaatgaaattattttttaatcaattatttacgattaaaaacaagataaattgcaattaatttgataatttctactttatgaaaaaattttttttataaattacataatatatatatatctatctataataaatataagctgaaaacaaaaatcatttgatttttttgactcaaaaaaatggaaattaattttgtaattattttcatcttatttctaatcgtactaattgacggaattgatgaagatttgtttaatgatttgtggaaaaatcttaagccatcgacctcaaaaaacatcaaaaaaccgatatttggagaaattaatgcgataaaggaagaaatagttgttaaaaatgaaaatgatgaacaaggaaatgccaatcaaattgaaacggaagacataaagccaaaattattacaaaagattaaaaaggaaaaaacattggaagaacaaactaataatttaaaaataaaaataaaaatgccaaaaattgaattggacaaattgagcgaagaatcatttggaaatgagtttaatgaggaagctgatcagaatgtttcgtctgctgatcacaacgattctgttgatgaagcgtattataatattatggtaattcaacaatcctgtaaaaaattatttaaaaattcattggttctaagttttgcatttctaaaaattttaatgatttaattaggagtctgaaacaagaaatgaaatggaaattttgaataaatttaatttaatcaaaacggaattgcgaaaagaaagtgtttataaaaatttgacaaatgttcaatttgagtgcgaaattgcgaaaaaattgggcacaaatcgaaacaaaatttctaaattgaagaaaaaattaggacaaaaaagagagaagagaacggaggaaagtgaagaaacaaaaatggaactgattagaaaatttgatcaaatgagaaaagaaaaaatttgtgggcttaaatatgacgagaagaaaagatcagtaattgaacgtgaaattgctaaagaattgggaacaaatcggaataaaatttataaattgaagaaaaaattaggacaaaaaagagagaagagaacggaggaaagtgaagaaacaaaaatggaactgattagaaaatttgatcaaatgagaaaagaaaaaatttgtgggcttaaatatgacgagaagaaaagatcagtaattgaacgtgaaattgctaatgaattgggaattaatcgtcataaaatttaccaatggaagaggaaatttggtaaaaaaaaacaataacaaattcactttatacttactgtctcattaaggtataataaagaaatttttatttacaaacgaagaaaaaatggaaaaacttgagcaatttgaaagaataaaagaagaatttaaaaaaaaattcaatttcgaacccaatagaaaaattgaatcaaaaatagcggaaaaaattggggttgtgtttgtaacaatttttaaatggaagaaaaaattcggtttaaccactcgtaatattttaattatttatatttaaaaaaaataaattaaattgcttttattttaaggaaagtccaaaatttattcggatgctgaaaaattggaatatgtgaaaagaagtgaggaaatgacagaaagaaaaccaatgatatgtgagaaaaaaattgccgaaactttgggcattccatataccaacttaaaacgatggatgaagaaattttgcagcaaatagattcatta

SEQ ID NO: 2189 - DNA, 3417 bp, Heterodera glycines
aggacaagaaaagaatgaagttgatgcctcatgaaactcgtgaattggttatgttttgtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcacaaataaaataaaaaatggctaatatgtaaaattggcgtccagaaatttttagactaatccgaagcaaagcacgaatgaattaaagaggcgaaagaattcacagtatcgtttctaatagggaaatattgacagaatattcggctaaaaacgggtttgatcatttttagcgcatttttaaaatgccgatgagtcgggttgccgctcgctgagctcgccgaccgtgctgccgcgtctgtcgtctgacccgttgaaccccgagttcgaggcgttcggcaacaagctctcggtcttctcgtgtccatggtcggccggcgatgaagaacgctagtcgtagaggccaggagaggaggagtgcggtgagtcggtagccgagatttaacaccacccgggcagaggagcagaaacagacgacccacccgatcagacaactgatcaacgacccggtgatgaagagcaagaccagggagagccgggggttacatctccaattagcaagctgatcgacgcagagggagcaacctatcaattcgcattcgtctatggctgggcaggcgatttcggcggtgcaactatgggtcgatgaaaggccgaaagttgcggaacagccgtaatcgttgacgataagatcggagggcagttcgtaattgatgttagacgcggctaaccgatcgaaacacgagttggagcagcagatcgttatcttttggacgacgggattagaggaaattttgacgcctcgtcgagtgcagttaagatggtttccgacacaatcggatttgggggttgattcggtatggtctgggtcaaatggccaaatcccgtgtgctggggaggcttgggcccacactaaaatgatggaaatgatggtgatcatcattgtggttggagcaatcccgagaagtcgcgccttgcgtcgtgtaagcatgccggggaggatccttggttctccggaaggtggtgggacaggcggcatctcttgcgcgtgcgattcggcggttttagggtctttgccgctttgatcagtcgggatagacacggtggcgtccggggcgggttccgggatctggttttcggtctccaaagggcaaagacggctgattggtcgcgtgacggtttgtccatttggcattcgcaactggacgcttctcacgttagggagtgagccgtttagtgcaacgacgatgcccatcggccataaattccggggcggaggtcctcttcgacgatgaccaattggccgatgtggggggcggtgggagttcgaaggcggggacctttatgagtccatccggcgcgctctctgatggcgaggaggtactcgtgactccatttgagccagaaatggtcggcggcctcccggtaagctttccaaagtgctgcgagacgcgcgggaccggagaggcaatcgtcgtagtcgagatcagagtcgacgatctccaagtcgttggggaggccgggctggataaggtctttcggagtgaggggcttcgatgagtccggttgatctgacacccatgtgatcgggcggctgttgacgctggcctcaatttcggcaaggaatgcgctcaaatcgtcgtagtcgagaattcgtcgaccgatcgtccttttgatgcaggatttgacgaggccgattagtcgctcgtagcaagcccccatccatggactataggcgggaatgaagtcccactggatgcctcggcgcgcggcaaaggtgacggcgtcggtttcgggcggagggccggtcagaatgtcgagagccttgctcgtttgaacgaatgtcggggcgttgtcactcagaattcgctttggtcggccgcgccgactgatgaaccgtcgtaagacattgatgaagctcggggctgacagatcggtggttgcctctagatatactgcccgggtgacaaaacaggtgacgatgaccaagtaggtcttggcgagcgatccgtcgcttagtcgagatgaggtaggcccagcaaagtcgaggccgacgaattcaaagggattagccggtttgacgcgcatagagggcaaagggggcatggttggcctcgcaaaagggggtgccgtgattcgccggcaggacgggcaacctcggaggataccacgaatggttcgtcgtgcttgaggcatccaataacggccaaggaactcagtcagagtccagtcaacgccggcgtgtctgaggtcggcgtggatttcttggacaattagccgagtcagggatgagtggcggtcgagaaggacgggagaggcgagagtgggcggaccgttcgcgtgcaagagccgggttttgaggcacaaaaggccatcctcattgaaaacagtggggtgtttgtcgtagccgtcgagcgagcttcgttggtcttgtcggatgaggaaagtcctggctgctctgaacgaatcgcccgtcggagggccaccccgtgggattgacgaggtgccgattttgagccattttggtcgacgacgcccgatgaattggaggacgagaatggtcgttccgagaagggtcagcatagtactgaaacgagccggatcaatgaggggagggggcagcggactttgtttggccatgagggtcttggtctccgatttttcaaacgggggatcggcagaaggggagtcggctggcgttgcgaacgttaactcgtcgggccattccgtttccggattcgtgagccactccggccctttccaccacatttgacgagtgcagagctcggccggagtacagcctctcgtcgctatgtcagcgggattttggtcggttctgacgaaatggaaggtggtggttggtccttgccgaatctcgacgagtcgtcgctgttcgaattgagctttgggctcctcggacttcacccatgagagggcaatttgggagtcggaccataaatgtcgctcttcgatcggacggcggagctctttctcggcgaaacgcatggcgcggatgccgacgaggattgcgaggagttcgagccgagggatggtgaagcgctggtttgctgttcgtggccggaggcggtttttggcgaaaattaggttcgcttgggagttgtcagcagtctcgcttcggatgtagacggcagcggcaaaggtgtgttcggaagcgtcgcaaaacacgtggagttgcaggcggctttgcttgtcgagaatggaatgccgcgggaccacaatcgtttggttttgcccataaggacagggtt

SEQ ID NO: 2190 - DNA, 6997 bp, Heterodera glycines
ttttagggtctttgccgctttgatcagtcgggatagacacggtggcgtccggggcgggttccgggatctggttttcggtctccaaagggcaaagacggctgattggtcgcgtgacggtttgtccatttggcattcgcaactggacgcttctcacgttagggggtgagccgtttagtgcaacgacgatgcccatcggccataaattccgggggcggaggtcctcttcgacgatgaccacttggccgatgcggggggcggtgggagttcgaaggcggggacctttatgagtccatccggcgcgctctctgatggcgaggaggtactcatgactccatttgagccagaaatggtcggcggcctcccggtaagctttccaaagtgctgcgagacgcgcgggaccggagaggcaatcgtcgtagtcgagatcagagtcgacgatctccaagtcgttggggaggccgggctggataaggtctttcggagtgaggggcttcgatgagtccggttgatctgacacccatgtgatcgggcggctgttgacgctggcctcaatttcggcaaggaatgcgctcaaatcgtcgtagtcgagaattcgtcgaccgatcgtccttttgatgcaggatttgacgaggccgattagtcgctcgtagcaagcccccatccatggactataggcgggaatgaagtcccattggatgcctcggcgcgcggcaaaggtgacggcgtcggtttcggacggagggccggtcagaatgtcgagagccttgctcgtttgaacgaatgtcggggcgttgtcactcagaattcgctttggtcggccgcgacgactgatgaatcgtcgtaagacattgatgaagctcggggctgacagatcggtggttgcctctagatatactgcccgggtgacaaaacaggtgacgatgaccaagtaggtcttggtgagcgatccgtcgcttagtcgagaggaggtaggcccagcaaagtcgagaccgacgaattcaaagggattagccggtttgacgcgcatagagggcaaagggggcattgttggcctcgcaaaagggggtgccgtgattcgccggcaggacgggcaacctcggaggataccacgaatggttcgtcgtgcttgaggcatccaataacggccaaggaactcagtcagagtccagtcaacgccggcgtgtctgaggtcggcgtggatttcttggacaattagccgagtcagagatgagtggcggtcgagaaggacgggagaggcgagagtgggcggaccgttcgcgtgcaggagccgggttttgaggcacaaaaggccatcctcattgaaaacagtggggtgtttgtcgtagccgtcgagcgagcttcgttggtcttgtcggatgaggaaagtcctggctgctctgaacgaatcgcccgtcggagggccactccgtgggattgacgaggtgccgattttgagccattttggtcgacgacgcccgatgaattggaggacgagaatggtcgttccgagaagggtcaggatagtgctgaaacgagccggatcaatgaggggagggggcagcggactttgtttggccatgagggtcttggtctccgatttttcaaacgggggatcggcggaaggggagtcggctggcgttgcgaacgttaactcgtcgggccattccgtttccggactcgtgagccactcaggccctttccaccacatgtagcgagttcggagctccgccggtgtgcagcctctcgtggctacgtcggcgggattttggtcggttctgatgaaatgaaaagtggtgggcggcccttgtcggatctcgacgagtcttcgctgttcaaactgggctttgggttcgtcggacttcacccatgagagggcaatttgggagtcggaccataagtgccgctcgtcgatcggacgtcggagctctttctcggcgaagcgcatggcgcgaattccgacgagaatggcgaggagttcgagtcgagggatggtgaagcgctggttcgcggttcgtggccggaggcggtttttggcgaagattaggttcgcttcggagctatcggcagcctcgcttcggatgtagacggcagcggcgaatgtgtgctcggacgcgtcgcaaaacacgtggagttggaggcggctttggttgccgagaatggagtgtcgagggacgaaaattgtttggtcttgccagagggagagggtttggctccaagtttgcgcctcggtgtcggggaggggggcgtcccaggcggttccttctccccatagccgttggaaaagccgtttggcgggcagaagacatggcccgacgagtccgagcgggtcgaacgtgctggcgatgatgctcaggactgagcgccttgtagcagtggcgtctgtgtcttttgggagactgaaagtgatgcggtcgcttagggtgtcccacgtcaggcccaaaactttggccggtgttttgtcgagtcggtcgtcctcgggaatttgcttcatgacgtttggggagtggctgaggaactccctgaggttcatgtcggcgtctttgaggatttgtttggcgatggacgacttgtcgattgcttcctcctccgtctcgcactcgatgaggagattgtcgacgtacatattcgcggccaacgcttgggcgaatgggtgctcgtgcttgtcgaagtgttggaggagaacagcggcgaggataaagggggaacatgtcgcgccgaaaactagccgtttgtagcggtagatcaagagattgtcgcctgagacgggacgggcagggtttttcagccaaagcattttgcagaagcgcctgtcctcgggttcgacttcgatggcatgaaaggcgccctgaacgtcggccaacacaggaattgtcgctgaacggaagcggaggagaatcccgcaaaggtcggggagcaacactggcccgcggtgaagacagtcgttgaggcttggggtgcccttggcacgagcactggcgtcaatgacgatccgcagtttctttggattgatgacggcgtggtgaggcaagaaatgctcgtcgttgtctcgcccggtcaactcaataatgtcggcgtccatttgccgtgtcagttcggcggagtaacggtcgagaagctcaggagagcattgcagacgcttggtcgttgagaggagccggcgatatgcgatggcccaattcgaggggaggggaggccgaggttcccgccaagtgaggcgaacggagtaacggccagacggcaattggcggacggtattgccaaattgctgcatggcaacttggtcgtcgttctgattggggtcgtcggtgattccaatcgcctcgagactccaaaagtcattgacggcgcgggatgaggggaacgactcgacgttactggggtgggacgtcagcatggcaattgtcggggtgtgccgtggggtctcgggaaactccgcttcaccaccaaccattgggccgaaaattgtttggatgaggtgaagcccggagtgaagcgttgaacggccaataaagaattgccaaaattcccggatgccgatcaaaatgtccggcgccttttcgacgaccttgaggacggcatttggggggaggggtccatcggtggtgtcccactggagggccttgattttggtcgtgatctcgtcgattacgttgagctcgagggtctcccagcctccgtccaggcgctgcagttgaatggcgaattttgctgatcggacggtcttagggcgggagtctccgaaggtgtgaattcggaggaggtgctctgagagtcgagggggtcggagcttctctgtcattgcccggcttatgtagccggactggctgccagggtcgtggaagacaaaagcaggaattccgtcgggtgggcccccttggcatgacgccttaagggtctgagtcatcaaatgagctactctcgtcgatttggggacgggaaaactgccgctgtcgacggggagggggtcaaaggcggcggcgcataccgcctcgggaatgctttcgccctcgtcgcacacgagcagtgcggttgtggtgggagtcgctctcggtcggaccggttcggcgttggctcccgtggcacgactgacgttgcgggacgcatttccattccgctcttgattctcttgtcgatggttggttcgccccggggggtcgattgacgggcagaggaggaagtgatggtcgttcgcctgacatttcgaacatcgatcttgacgagagcaatcgcgagtgacgtggtcttgacggaggcaacgcaggcagcgcccctgttcctcaagtcgtcgccggcgttgaatgacggtggtgtatcgctggcacgcactcggacggtgtccctcctgctcacaaagggagcaactgatgccattggcagagacgggttgggcgagagcaggaaaggcccgagtgttctccaaataacgtcgctccggcgctggtggtcgaaaagaacgaccacccggacgagagggggcccgttcgggaggacgttcgcggggctggatgtccatgtcctggaatgtgcggacgcacaagtccacctgctctttgtcggtgacgattgtcgcaaatccctcacgccaatttcgagccgtccaggaagtgtagctctcgcgctccattcggatcaggtcaagcagtactggtggtggaagtttgcttttgatgagattggtgaccagcgagctgttggcgattggcgagagctccccctcgggctcgaggctgcaaagttgggtgcagatccgctcgatctcttgctggagttggcgcaactccttgaggttgttccgggcaggtttgaggtggagaagctgggcattgagttggtctcgtcggttgccgacgtcgccgtagcggtctcgtagaatgctcacgactgtgctgtaattggcgtctgacggtgggtaaccttcaatcatccgtcgtggtggcgatcccttctcgaggtactgtaggaggaggaggtgcttttggaaggcggggtattggcgtgagtggacggcaaagtcaaaggcggcccaaaatgtgatccattcttctgccgatccgctgaacctcgggatttcgattcggctgacccgaagtgcgtcgtcgtcattggtcgactgtcggaagtggccatggtgaggttccgatcgatgggtggggcgattcgatgctcggggaaatgtgagattaagcgggaatgccggggttcgctggttgaataggttttgatcggctcgagccgaattggacggctgatgtgcattcgctggctgtgcctgagtcggtgggtcggtggattgccgttggcggtggatccggttttcgtcgtcggccccgtgatcagaaacacgactgctgctgcgagaagagatggcgtccgtcgtgtcgaatcgagcctcgatgtagacttggaggccgtcgaggatgagctgggctttagagagaagagtgatgactggccattcttcgacatttgggtcggcttgctcgtcgtcgaaggtcgggagtgcggccaggaggtcctcctccgcctgcttcagaaacgggtcgcctagcagctgaatatggtcaaaacattctcgtagcatgccattgacgcggtcgatgcttctctgtagcaattgtcggtcagttcgtacgcccttggcgagtttggtctcctcggcgagcgggatttcctctggcgccatcctggtgaattcagtgagcctcccgaccctttgtcggaggcgcttgacgaggtccgaaagggttcggacttcggcggtgagacgttgacgaatgagttccgacatttccgaaagtctaggattggcggctggacgcaagagtcgggcttggttggtcgagagcctagagaaggcggctgtcggttggtgggttgagtggagattagccgagagcccgagagggacggctgacgataagagttgagtggtgaaagccgggagccttaaaaggacggctgacgactcaattgagggcttgtcggaagcctaaaggggggctggcgacaaagagttgagtgatgaaagccgggagcctgaaagggcggctggcggctgagagaagagtgatgaatggtcgaaagcctgaaatgggcggctgacaactcggtgagggtttgtcgggagcctaagagggggcggctggcgacttgagttgagtgatgagtgccggaggcctaagatggtcggcgtacagcgaagggttgagttgccgggagcctaaagggtcggctggcggcagagagaagagtgatggatggtcgaaagtgaattgaagggtgaagggtttgtgttcccgggtcgtggcaccaaaaagtttgtcgaggaaggggggggacaaactggggggatggaagggaaggaggagattcgagactcgctcaaaagagcggcgacgcagattggcgatggagaaggcgagagaaagggtgtgccgctcgttcgattttgggggggtttctcgccgtctgtgtccacatttcccgtgtttcccgacccctacccaaaggcacctctttcaacaacaatttatttgaagcaaaaaaagggggaggaggcggttaggattaaaaaattgacgcagagcaaggcaacggttggaaaaaaaggagtgattatatgatgtggaagtgaagccccccgggggagacagaaacacttaaatagaccaacagaacggggagggagcaaagtattatgagatgggccgtgattatgcaaaaaagaaaggaaaaagggtgcgagcagcagatgccaacgaaagttgtccaatgaatacaaagagaaagaaaaagggaacaaagggacgaaatcggagagagaaggcgaagagaaatcggtgcagattttgaatggacggaggatggcgggtgaattagcacaaaggggggaaagaattggcaaactagaagagggggaaacggttggggtgaaggacagagaagaatggggggggggacgttaggaaagagaaaaaacattcaaaattaggaggaa

SEQ ID NO: 2191 - DNA, 1824 bp, Heterodera glycines
  misc_feature (1794)..(1794): n is a, c, g, or t
accaaagtcaattatgatctttcttgcccacaaatgtaccaaatgctcatttccaatcacaaattgtcagagaaaataggcggatgggaaaaatacttttgatgatcaattttaattgtttttacgctaataaaatattgttttaagtcaatttttcatgtttttattgcgtttccttcacgcaaatattagttttagaaaaatcttatttttggggtcagaatcttagtttttgggtcattttgtcttattttgaaaaaaaaaacttgggaactctgttttatatccatatttttaccagtcctacttataatccagtccttgtttcctgtttcttttttattttcttattaagaacaaagctcaaacgtaaaatgaattttgccgccatttttcatgagcttctgccggcttatccaatttctgttgtcttggtcattattatcgctgccatatttattgtcagccaatgcgccataggcggtaagaaggaacgcatcgaggcgagtttttgaccccattcgcccgcacaacccaattaaacttggtttttcaggaagtccgcgcaccagtcggcttgggagggggatctcccccgtacgtaattccgggtgagtggttaattagagtgagggatgcgcactgtgccccccagaccaaccgcaccgtctatcccggatggaacatgggagggaatggggaaagccatggccagtgactaagccccaaaatcccaacgactcattgactgtcgatatatttattcactcgttgttggatttacacgaagcgagaaaaggaataataattgaagtctgttccatcacaactaactgactaactgatcactgggggaaggagaaatgcgaagagaatgggcggagaaacattacagcgagaaaagaaacgtgtgaacggataaaatgtgattgaattgataatggccaatgggaaataattaagaaataattaaatgagggaaatgcgtcgaataacccttacaacttcccccttcccataggatcgtccccgatcctaaatgaaaaatgaaatgaaaatgaatgagacggatccaaactctcggcttcgcccttcgtctttccaatccgaacttcctcggcaagttgcgcattgcaataatgagcagcgcagtctaccttcatctcagatggatggcatgggaaatcgaagaaaagcaaccaggggtcattccggtttggggacgaaattaaaagcatgatgagaggaaagaaagaatggtccgagaaagtgtgaggaaaccgacgcattttaattaattttgagttttagggaattataaaaaaggccatttaacaattcgaaataaaaggaaaataaatgaatatttggaaaatgaattggacagtagagagagacaaagcagaaaatgaaattgataaaagatggggaaaggaaaagaaggaagtccatgcgcatttgtagttcatggctgaagtcgtacagcttggccttctttattcatctgcgcgcatcagaagttgaggcccgttcacgagtgccaccttgagagagataaggttagtatctgttctccgctcccttgacttaccagagttgttgcaccacacatttttaccatattttctgtaagtgcttttaccgtaccgcaccgctcttggctgagatcagctgttcattcctgtcgtaatagttgtctggattgttgaactgctcggtcgaagtactccgagccaaccattgtcgtctccgccgtcgcttggtacaatatcgtcgccacgtctcgggtccggntgagcagcaatcgccgaagatgatcattcc

SEQ ID NO: 2192 - DNA, 6928 bp, Heterodera glycines
cattgaaataatgagcagcgcagtccaccttcatctcagatgatgcatggaaatcgaagaaaagcaaccaggggtcattccggtttggggacgaaattaaaagcatgatgagaggaaagaaagaatgggtccgagaaagtgtgaggaaaccgacgcattttaattaattttgagtttgagggaattataaaaaaggccatttaacaattcgaaataaaaggaaaataaatgaatatttggaaaataaattggacagtagagagagacaaagcagaaaatgaaattgacaaaagatggggaaaggaaaagaaggaagtccatgcgcatttgtcgttcatggctgaagtcgtacagcttggccttctttattcatctgcgcgcaccagaagttgaagcccgttcacgagtgccaccttgagaaagataagattagtatctgttctccgcccccttgactcaccagagttgttgcaccacacatttttaccgtattagctgtaaaagagctttgaccgtactgcaccgcccttggccgagatcacctgtccatccttgtcttaatagttgccggggttgttgaactgctcggtcaagtactccgggccaaccattgtcgtctccgccgtcgcttggtccaaatatcgtcgccacgtctcggtccggttgagcagcagcacgtcgccgaagatgatcattctgtggctagcctctacttatgggttcaggctcagacttacaactgtccaagttcaagcagttcactttcactgctctcactttccacctcttcttccattcctccacttacccctttttctttttccacttcaacctattcctccttttctttttcacatcatccgtttccatcactatcgctaaaaacagcacatggagcgagttcgtttcactctcacaaacttttttttcaagcccgcaggcaaaggtttagaggcagaagaatcagaatgtttcgaaggagaaggctttttgcctaaaaatgaaaaacctaaatggaaaaactaaataaagatgggaagcggagggactggagatgttttttgggggaaattgcgaagttaagaaaaagataaagtggagaagaaaatgtttaaaataaagaatttttattatttggcatttaacctggtttttgtttggttaaaaatgaaaaaaaaataaatttcaggatttggatctggaaacaatgattacacctaaaagggacccaaaatgccaatgagaatcaaaggtcaagaaaaaaaaaattttccaattaattgtaattcgacccgttttctcaatttaccagttccagatttttaaataatcggaattattttccgttacaaataattcatcttcaacttacttttgctttatttcttgcccgcaggcaaaggagtttaagtgaattattggagttatttgtttttcgatagtttaagagaaaaaggtacatatatgagcaaaataaaagacagaaatgaaaatgaataactgtgaaaagaatttatgcaccgatcatggagaaaagggtgagacaatgtacacaaaactagtttaacagagagcagatgtaagcataaatggatgcaagagaaacgatttgagagacaaataaaataagtcaataaattggaatattttaattattattattttcgtttaaatttagacttaatactggcttttattttgttatttttccaaaacaaatattaaaaacctatgaaatataattattttatcaaaattattgttttcatatcgttaggatcgaatttaacgtaatgatgaacacttagaatattatttgcataatttggaacaaaatctcggccgacacgctatttaaaatagtactattatataattattggcgaaatgtatttaaattaaataatataattaagactgagtaccaagtaattattttattggctgtctatccttatttttagttaattttatgtgcttgtgcatttaaattatttttttaaaactttttgtcaattaaaaaatgttaaagggtgttgaaaaacatataaaccatcatttcagctttttctcggccgacatggtgtttgaaatagcggggattttacattaataaataatttatggcgtaatgtatttaataatatatacgattcaaaaaaacgtttgttgattgtaaacacaataaataatttgaatatttgctatgtaagctaattaaaataaaacattttttgcgatatttttatgcaaattttattaatatatttgtctaattcaattcttttttagcattgtatttttaaagtcgcaaaatctggaagtgagccgacaatttcaaaaatttcgttcgtcaaaattattgacaaattgcaacaattttaccaaatcaggtttattttttaattaactttttttccagcccttaggcttgggtaatgatttatgagagatgtagagagtaaaaaaaattgatttaaattaactgtttctcatcccttttttttgatacagcaacaaaattcgatttgtcgctggccagttggaccttggtaacaaaaagatgacgcgcctgtggacattcagtcgggcgctgcactgaaagatgcgacgtccgctttggtcggcatcggcgtaatattcgccgtcattagattgtacgaaaggcactataaactcaggtaaaatgcctaaaaattaagttttacggggaatgggaccaaaaaaaaaaaaatttataaaaagaaaaatgctgctaaatttcttgcgaatttcaggcaccacaaagcaatgaccgcttcctaaccaactcggactctccaaaatgtgtatccacataattctcttccagagcctctcagtttgctgctgtgcaattacagcgacattttgatgtgaaaatgatttttaagcgattataaaatttgatttgaaattctaccatttttgtgtttgattcaaatataacgtaaaaaaggcatatattcaagagcggaaaaaaactttgtaaattgaacgacccaaaagacttaaaacaataaaatgaaaataggagtactaaaaaggaaaaaaacaattttttttttgtttttttgctagagctatgtggggcaaaagcaatggggtgctagcgctctgaggggcaaaggcaatggggtgctagcgctccaaggggcaaaggcaatggggtgctagcgctccgagggccactatgtgtaagttggattaatcaaaataaaaaaaataaaatatgaaaaggaagaaaaattttggccctcaggcgggttatattgtaatgtttgactgagaaatagtaaagataattgggtctttaaatcaggtaaaatgcaattgtccggaaattcgagcaatcgcccaattttgtcagactaagaactttttcaaacattctttggtcacttcaaatttttgtatgcgttttttcctgcccacaggcatgggtgtattgggagtttttgataattaatgacattatttgagtataaacaaaatgattctaataacgtgttaaatattcatttccattagtgttcgagcgaattcggagtgtgctcacatttggaccatggctgagcttggtgttttggcccaccagcttggaataaagtggacattgaaaattagaagtgttattacctcttttttacaattatattttacaaaattcaaaatgaatgtgcaaaggagttgaatacaaaaaccatagcaaaattactaagataaatctctaaaaaggttcactaccgccactttgatttgtttctgacccgcaggtgagacattgctaatcactaatagtctctttaaattttatttgggcaatttctctatgacatcagaaccaacaattacattgtaatcctgggccccagtttgaattcggaatcattcacaaaaaaaaattaaataatgaattctaaatcaagcaatgttcaaattcacatgaacatatttcttaaagcgaagggcatggattgaataacttattacctacaaatcggtattagagcaccagtaaattgccagacttttgctatagacaaggagacatcggcagattaggcctaacagcagcagtgagtggcaaagtcattccaataagcattaatgaaattgcattaaggaggcgactttcgaacgcacatttggccgttcccagtttgctgttttaagacggtttgcttttgtttccggcccacaggcttgggattttttttgacagttcttcaccaacttgacacttttttacttccgtttcgggtttaatgtgtgtaagtgcattcattgctccggatctcggctcttcgtctttgtaattgcgacgctcctgaattttaagatctagcaaagcctgagccaagtttttgaaaaattcagctgaagcattcgaggaacttgggacatccatcatgttaacggaactctgcctattttgccattgtccttgcgattgctgtggctgttggttggaccatcttccttgactgaaattggcacggcgttgatagcagttgtaagccacatgtccaacgcggtcacaataatcgcatctgggattgcttgaccaatttctttgactaaattgttcttgatggctttctccccagttgcgagatcgattttgtccttctcctcccccttgttgctgggtttgttcatccgatcctgaaaaagaactgaatcctctgacattgttacctgatgcccactgtccagcaaagtcattgttcaggttcgcttctgtaaaccaacgggactgtgatgactgattgtttagcgcgttgactacgtcagagaggcgcactgtctcatcacccttgctcatcagcagtaaagcctccaactcctcagcttgtgctcttaccaagtccaaatcttttgctcgtgacaatcccaccaaacgaatgagaaagcttatatttggtttcaatctatccaaaaattcttcgcaaattttttcttttcgcgaattaccggtcaatgacgaatttgtcgcatccaccaacggagttaaacgcctcagaaattgtgccactgtctcatcttccctttgcttgcacaatgataatgttcgctttgtaatttcccgacgttgaggggagtccaatttccgtcgaagttcactcagtgctgtgtcgagagtgtccgtttgtgctggtaataattctttaaacaatgccagtggcgtgtccttcagagccaatttgagtctggtgactttttcgcgctcagtgtaagccttgcctgacacagaaaggtagtccttaaaacgttcagcccaatcgtcaaatgcaaaaactgactcttctctgaacatttccaaacctgaccctactgccggtccactcattagcatgttcaggccaaaaagagtcggcccgtcatcttcgtcttcgcttgacagttgctggattggcacttgattcggcatgagttggttgggctgtgcattgcccattggcatcacaaacggtgcgagcgatgctctgttttgattattaagactaaaagttccacctgaagtcgccccatcattgtcacgttccaaaatatcgactctttcggttagggtctcgaattgtaccttcagcgtttcaaaattggcatttgtattagccacaacatcattcacccaagtgactttttggtttaaggaacggttcaagtggcgaaaagctctattcactccatcttccaatttccccatgtcattttgaactttttctaagtcagaaatttttacagtgacctttccttgccaaagttttctatcaatagccgtaatcgaggactcatcatcctttccactcaaaaacatttttgtttcctgcccgaaggcttgggatgtaccgaaggagaactcatttgacgagccccctgatgtagacattcgaagtcgttcagttcgtaataagattttattattttgctaaaaaaattggtaatcccattatgcattaaggagaaaaaaaaattaatgaatgacagcggataaacgaatggatgcgaacgccttccaggaatggcttttatctgctccatctccgcttaaactccgcttaacgagagcaattaaacttctcaggcgctgcaaaagtgtgtaaagtaaaataatatcgctgactaaagtgcggcggcacgtgatcacgtgaatattcttatggcgtgagaaacgaaagaaaaatgaataaagtgaactttggaactctgaaaattgtaactcatacgataaacaaaataaatagggcctaattttcattttcagttggttcccttatttttagtcagttaaaatagcgcccctttgattggttaccagcccgggcttttttttgctttaccgaagcaaaagcgtgtgaaatggataaatgtgattgaattgataatggccaatggggattaattaaatgagggaaatgcgtcgaataatccttacaatattttgaccactttttgtacatattttttacatccctagttattacaaaaatgttggagagagtgcccgtagctcagttggttagagcacggcacggattgctggagtcgtgggttcgagtctcaccgggcgagttaccttttatgttctacacaaaaaaattcttcattcttatagccctaaaattgtacacattacgaaaaatataataagaattaattatatttctaaaatattaaaaatgaatcaataaacgtaaaaattttaattgtttaaagtgcatctatatattgtgtttggcattttctcaatgtgggcccaaaatattctgatcatttcagcgttggaaaatctgccaacgtgagtgggccagctgcatagaaatagttaagcaagcagtaatcaatgtctataaccttacaaaaaatagagaaaccacttaaaaaatattaatcgataaaaacactg

SEQ ID NO: 2193 - DNA, 2833 bp, Heterodera glycines
  misc_feature (12)..(12): n is a, c, g, or t
  misc_feature (66)..(66): n is a, c, g, or t
gatgacaaatcncaaacaaaaaagagaagtacgtgaaaagcgtgaagaaaggacagcgtgaaaagnccggacaaaagacgacgaaaacgatgacaaagcccaaacaaaatgagaaggacgggaaaagcgtgaagaaaggacagcgtgaaaaggccggacaaaagacgacgaaaacgatgacaaagcccaaacaaaatgagaaggacgggaaaagcgtgaagaaaggacagcgtgaaaaggccggacaaaagacgacgaaaacgatgacaaagcccaaacaaaatgagaaggacgggaaaagcgtgaagaaaggacagcgtgaaaaggccggtggacatggcgagaaggccggcggagatggcgacaaggccggcggagatggcgcgaaggctggcggacatggcgagaaggccggtgaacagagcgagaaggccggtgaacagagcgagaagactggcggacagggcgagaaaaaggccgatcaaaaggaggaatgggcgcatcaaacacgatctccgattgggtacagcccaaaatctagcaactaaataaaatgttttcttttcaggctgttccaaatacgattgttgcaactacgcctgctgcaaatatgccaaaaaaaggtggcaaataaaagcgcccatgaaggatgaatacgtatattaacatcaaaatacaattgatttgcatccatttgatgctcactcacacttttgttcaactctgatctgatcggactgcgtttttgtttccatttattgggccgaccctccgctgctccattttgatcaccagcactcgtgagttttttgctccgtttatgttgccagggcttcattaaattcgcattcttaataaaaataataattaccactgctaattgctttttgcctttgttcagttttactcgtttctctcttcttccggatttgtgcctttgctcgtcattctgatcactattcgtactctgatcgcttccgttggcattgtgtggaatttgcttttggtttttgtcacaatttcaaatcggtccgtatctttgctaaaatttcaaaacaatttaattattttcctcatttttagcaatttgcacggctccactaatgttttgattgccattgattctctttcgcttgccatttaccataccaattcggctttttcccaagtttttcattgttttgactggccaaaatctgattcgcttggaccaatgcttctctccgtttttgcctaagaatgtttctgccgctttgatggttgccatcggattggaccgacttaaatttgttattttcccacggtaatttggcactttttaatgtttcattttatatattttttacttttcattttaattcctttttcctcttttaagcatttcttcgcatctccaaaaatattttgctgttttatggcttcttttgtctgctcttctatccctttcattagctatcgaattatgcggcgaattctccaaaagtaagggccgattaattaattattagattatttaattaatgtatttgccatttccactgatttgtcccttttaatttggttttagtcttgtaatgtgtgccgcttcggatgtcactcagcaaaaagcggcctttgtttccttttattcaactttaacctcttatacgtccgaaggccaagtcagctcaaaaatataattaaataagtaagctctcccattccttttcaagaaaacaaaactcaaagtttgtctctcagtcagctgagtctgttccgctccatcttcgtgctgatgctcctccaactcctcggctggacttccaattccctttcgttgcttttcttccagaatttgttcgccatcatttcgctctccgatctgacaaaatgggcaattgtgtgtttagttacatttttgatcatcgcaaccgtccatcaatggcccattttgtatttttgcaggtgaaaattgaagaattacaatttgacaataattagagcaataattaattagataattaaataacgagggtaccctgagtatttttattcacttgctaatttaattcaataaattctcccccaatttttagttttgactacaaaaaagccattcaaaaacaattccgtgcgttttgcgaagcattggcaacatcaacagaagcaaaaagtcgcgggtggtggtgatcaaaattgagcagcggagggtcggcccaatgaacggaaacaaaaacacagtccgatcagatcagagttgaacaataagtgtgattgacctcccattgatacaaatcaattgtattttgatgttaatatgtaataaattattcactcctaattctgatatggcaagtattcctttttttgaaaaatatgcccttaaatggttaccgtattttctctaattaaggccctgtctgaagcaaaaaaattctaaagttatatccaagtaatcattttggtttttttcacatggcttagaacaaaatccaggaaaatccaagtccaggaaaaaaaagcttgaatccgtccaggtccaggtctagctcaagtaaggaatcatacatgaaataggcgggggtcgaccccccctgacttcgttcgtatgcggggccgaaagaggggggggggggacttcgtattggttgggacaaaaatgtgaaaaaatgtggggaaaagtcggagacgaaggaaaagagagaagagacttcgtaaaggcaaaaaaatgtaaataatttaacaaaatccttttaaatttagtcaattttgtacaaaaaatgcaaaaaatttacgaaattgagtaatacttgatttttttttaatcaaataggacttcgttttttaacaaatt

SEQ ID NO: 2194 - DNA, 1539 bp, Heterodera glycines
ttttttgtgagttggaccacttctcatgaaccgaacgagctgaaattttaactgtacgtatcaattctgaaaatattaagattctgaaagtgagaagacgaaatgatgacggaaaaaaatttgacgaatttttatccgaaaaaggggtgttaatttaaaatagacgcactttttcagaaggctgtaactttttgagttgagcattaaaaaatctgaaaaaatcatttaagcttagttttcgaaatgatgacggaaaaaaatttgacgaatttttatccgaaaaaggggtgttaatttaaaatagacgcactttttcagaaggctgtaactttttgagttgagcattaaaaaatctgaaaaaatcatttaagcttagttttcgaaatgatgacggaaaaaaatttgacgaatttttttccgaaaaaggggtgttaatttaaaatagacgcactttttcagaaggctgtaactttttgagttgagcatcaggggtggggcgcgcacagaaaaatcccgcggtcgcggatcgcgcatcgcggattcaatttgccgcggtcgcggatcgcggatcgcgcaaaaaaaatcccgcagtcgcggatcgcggattcaatttgccgcggtcgcggatcgcgcaaaaaaaatcccgcggtcgcggatcgcgcattttttccaatttttgaaaccattttttacatttttttttgaatttttccttattataaaaattaattaaatcccgatgcatataaaagtgttaaaatttgcgaaggagttccagtcatggaaactagagagcgggtacggaccggatccgtatacggatttttacggatccgtagtccgtaatccataaaaccctatgattttttgtttttcagaaagctttttttcggcgcgattttctaaaaattttaggaactgatgggaggggggtggatccggcggtgccgataggcgccgccgggaaaatttttaaaaatttgaatacgttacgatttggctaaagttttgtaaaaaatgacctattttgtgatttagaaccaatttttttaaaagaaaaatttaagattctgtcagctgtgacggggaaaaattggaattttgaaaagatttttgaaaaaaataaaccaatttttcaaaaaaaaaaaatttaaattttgaatattcaaaaaaacaatcgcttaaaaaaatttttattataaaaatttacaaccaaaaaatgcgcggcacgccgcgcaaaaaaaatcccgcggtcgcggatcgcgcatcgcggattcaaaatgccgcggtcgcggatcgcgcaaaaaaaacgccgcgaatcgcggatcgcggatcgcggtcgcgtcccagccctgttgagcattaaaaaatctgaaaaaatcatttaagcttagttttcgaaatgatgacggaaaaaaatttgacgaatttttatccgaaaaaggggtgttaatttaaaatagacgcactttttcagaaggctgtaactttttgagttgagcattaaaaaatctgaaaaaatcatttaagcttagtttt

SEQ ID NO: 2195 - DNA, 6123 bp, Heterodera glycines
ctgttgccgcagctatttgggacgtcacacggttggcctcccgtatgacggcagcggtatgttgttgctgcagtcgcccgctctccccaccatcactgaacatgcttcggattttagtgtgttcgttgttgttgttgttgatctgacgttgagacgatgttggcgtcgacgagtgtggcgacgacggtggcatgagaccggagtgacgaagccagcgtacaaccgacaaccaacaaatgatgaacaacggcagtatgatggcgtagttggtgaacaggagcagtgcggaccaaatctgcacagacatgactggggctgctgctgttgggcccacaccatctgcgctcatcgtaacgttcatctcaacggcagatggcacacttttgctcgtcagtgcaattccttaaatttacaaatgtctttgctggggggtggcggtggacataatgcttgaaggtaatttcacgctgaccgctgtgcaatggcgaaatgagtggcgcactgtcaatcacccgtgctcacttcaggtctggcattgaacaggggatgtggcgccaccagtccgtcccctcgtggctcatacaaaatcacccagcttaggtttggcatgtttatcttgggcagacaatatatgtttatgtttgtgtgaggtttatgaataagacactttgttgataggtacaaatttgaagcgttgagcaatgtgttgtttattattcataatatgggctcctttttatgcaatttttgagtcggatacaatatggcggttgtagtcgatcatgatcaactgatcgaattccccgagcacgaccatctcaacgccgcctgccggtatcgcttcgttgaacgcgagccgaatgctggtggtgccggagcggagcagttcaaagccgcaactatcgtccagcgtcgatgtcattggcaccacgaagatggtccatccgtcgtggaactgctccagcgtgatgtccatagagcgctccgagttggccatgcccaacgcctcgtacatgtcaacaaatggtcgaatgtaggcacagccggagaagtccatgcggtgtggcactgctggatacacatgaccggcagcgtgcacgctgatctcacggatcgcgtaaggcttgaagttgaacggtgacaatgccagctggccgttgaacgctccgttcgccaccaatgcaattgtcagccggcgcgggatggcggcggaaaatatgttgtggtccatctcggtacggccggcggtcagaaacacggacttcacctccgtcttccgtaccgcgtaggtggccggctgcttttccagcgtcttgtagatggacaggttcagcgacggttgcacctcaaccatcttcacgtacagctttatgtcgtgtaggtacagcgcgtaatgttgggccgccgctgctgctgctgccgccgccgctagactttgtaacaggaacgcatcttttgcccgatagatggtgaacaggacgtccatgttgttcaacagatacagctcctggttgcccaggtcgaagtccagccgggaaaggaagcgtgctttacgaccgcccgcgaagcgcgcacagcgtgccagaaaaccggcgtccgtcgcgtcgtcgtgcttccttgatgggtggtagcccgcgctggccataaagtgtccctttgcactgttcggaaaggacagttcgttggtcaagtacgccttgtaggggtagagggttccgctgtcgtataactccgtgttttgaacctcaacctgattaaatttggtgctggttattgcaatcatgaggactatgggacatcaaccttgagttgttgtacaaatgtctgtcctacgcattgggcgggcgcgacgagttgatcggcggccactgcagcttcaatgggcacccaacgtccgccgccatcctccttttggatggacagctcgaggaacaggtagacgcgcgacatgtccgcccacaggttgtcattgaacaagcggaacaggtagggcccctcctggctgatagtggacaatggcaacagttctcggaagaaggaacgcgacaccgacacatttgtgggcggaacggtgaacacgttcagcgcactgttgaacgcaagcgcactctgctcgctgatcttttttggacaactcattattggtgttgttggtgttgttgtttgtttttgtttgtttgccacttcgttttgatgtttattgtggctattgtctagtaggtgcccaaggtatcaaaacggagtcgtttgctgctgctgctgctgctgttgatattgctgctcgaacctggtttcttcactgacagtgggccaactgttgattgcaatggttttcgcttgcgcagatgcctttttatgcttttctcgttgcccagtgtgggctgtttatgatttctgttgccgcttttttgtcccctttttgtcgctgtagttgttgttaaacagcagctgtcattgttgttcaccatttgctttcgatagcgcttaaaatcaaagttgccaccggcgccgccccgttgtctgctcagattatcggccgccttctcgagcaaattttttagccccgcgcgtccctcgtccaccattgcatctttcacattgcgcccctctaacacttgggagagcatgcgcgagccgctctccaatccttggcgcccgatcgcagcaccggcttgccgaccgattggaaccaagaagcgcaaaaagctgcgaaacatggacccaattccgcctgctccccgttgatagggcagtccggtaaacactgggtatgacgcacccgctcctccgccaccgccgccacccattgcgctcccgccgccgctcattcctatcgccatcatcgccgagtccaaacgctgggccggccctgtgaagtgggaccagtccaccgacagagggtcaaagtcaacgtgcatttaaaaaacaaaaaagttatgctgctgcctttttttagtttacttatttatgctttttttattctcacatgctcaatttgcttcatccccaaacacatgggcacgtacaaaagcgctgaccaatcggtcgggctccgtcttttgggcattaatatggtcaacaatttgccgcaggctccagccctggcaacgatggtacaagaagtagaccacgtgctttccacaactgatggaccgttccgattgtaggcagcgactgttgtgctgcacggtgttgaaatggcgctccaaaaaaatgtgaatgggctccgacacgggtggccagtcggcgaacgagtcaaagtagtcggcgctgtgctccgacttaacatagatggccacccagtgtgttccaccgcctgtcgcctggtccgtgttcaccaccatgcagtgcggcatcggcgcggacagagagggaattcggtcggacggaaagcagccaacgtactgcccgcgcgtcgcatcacaccgtgtcaaaattttgtttatctcgtcactattcatattttattaagtgcaaaaaataggaataaacaacaaaacaacaataacaaatagcaccacaatatatgcactcagaaatagtgtgattttctaaaatgtagtgtgagtgtacaggtgccatactggaagggcataagggcgccggtgggggtccgtatctcgatgaaaatctcggcaatctcttttgtgatcagctgatggtattgtacagtggtgtatgcctcttcgatcatgtcgtccggttgggcgccacgaatgcagaccatgcgcagcactggggcgcacacgttgccgatgatcaccggctcaatgagtcccggcgcgtacacgtaaaaggatgagacaccgcctttcatgtccggctggtagcgcgccacgttcagcggtgcagacaggtggcgcttgtggaagccaaggatgtaggccagttgatccgacagctccacctgtctgatccgtgactggtcaagctccaggcggaagcgctgctgctccacgtcaaagttgaagcggcaagacaggcgtgccttgcggtaggactgcacccacagctccagccccactggcaggtgtcgttgaagctgcacacgctccgcctcactcattcggtccacaaccaatttgtcgagcgattgacggtaaagactgttgtacgcggcacgcttccattcctcttcctctttatcatcatcatcatcttttcctttctcgttaggcttaggttttgcactttcacgcttttccaattgcttcttctccgtcgcattctcctgttgttgtttttgttgttgctgttgctgctgttttttacggtcacgtattgccgcttccagttgtgttttggcacttgactcggcttcgctgatcagctggtggtaggtgagctggatttggcgcagctcagtggccaatttctcactgccttcacccaatgcgcgatgcaaactggtgagcagttcgctggggtttcgcactgtgctggccgggacggggatgcgcacctgttccccggtctgccattcgacccgcacaaattgctcctccgttgtgcccagagagggccaagagtgcgggtacagcagcactgccaaccccacgctccactgtgagccgaactgtagcttgcgtggcaaacgtacgcggaaggagttggtccggttgccctcaacctgtgtgtttgacggtaagacaatgtagaaggaggatgatgaggacatttgtgctctccctttctacctttttttgttgttgctgtgccctcggtttccctccccctttttatatgattgatgtagcagggatccagctgttgtgcgctgcggagtagcccttccacttgacaaggcaatgctccacaccatttcgtccttgccgtcgtcttttcagcacccgttcaatgtcataaacgggaccgacgacggcggctgcggcggcagcagcagcagatgcctctgccccttgttgtgttgggcgctgtggtggggctgggggcgggagcacaaggcacaagtcttgtgcgtagaaccagccggtgagcagctccccggtgtcgtcgcgcaatttatacgtggtaggcgtacgtgagtctcgcacctctgtcacagtgaacacctcatcggtgaagcgtggcaagtagccctttttgaacacatgcttgtgcttctcaattcgcacacggtctccagcgtggaagcgaggaggccgcggattccgtccccgcacctgcctgctatttttgcgtacgttgttggctaaccgctgcagttgttggcgtcgaatttgctccgcgtttgcaaaattgacgtcccggggccgtagcccagacagggcacgatgcggtgacgcattcagcgccgacaccaactgctgtatcacaccggtccagcactgggtgccacggtgggtgaagtatcgatacagtcgctcctatgaatagtaaaagtaaataacaattctttttttgtctagtctataccaccttgatgctgcggattgcccgttccgcaatcccggcgtgccactggggtgaggtgtgcatgcaatggtgttgcacctcttttttgttgaaaaagcgctgcactggggcggcggtgaactctttgccctggtccgtcatcagcttccatggcacgtagccggcccgtttgaatatgtggtcaaaagcgcggatcatgtccactgactgcttgctcttcaccggctccacaaacagctggcggctcagcgtgtcggcacacaccagcagataggcattgccacggttgttgcgccgaagcgagacgaaatcggccaggtcagcctgccagtcggtgtgcaggccggacgccagcgtgggcaggcgacggaaccgacgaacggcacgccggtgcagcgtgtacactcgctgtcgcgccagatagcgacgcacctccgcccgtcgtatgccccttgttggatgtactcgctgtgcctcacgcagtagcggctccacactggtgaaggcggcggccgaccttgtgtccttgtacagcgggtccagcagttgttcaaccacaatttcgcgcacttcttggggttgttgttgttgttgttgttgctgtagtcgtcgcatcaccataacatgggtttaaacaaaaaagtttagttgttggtagtgctgttggaccgtttcgtgtaatcagca

SEQ ID NO: 2196 - DNA, 4440 bp, Heterodera glycines
tgttgccgaacagcatccgtaccatgcgcgggtcttgtcgagcattgccaataaatgttttgtacccaggcggtgccttctccggtttgggctcagcaaaatgaaaagtgagtaaagcatccaaatcgctgttcttgatcggacggtacgcgccttgcatcagccggtacacctgctgtccatctccgatgcccagcgtgcccgcgttgcgtaacgcatagtcaatggcttgtcgtttcctctgctcagtgtcacgtaagactgctgctgctgctggtgctgttgatgttgatggatgcagttgcacgtccgcttcttcccgctgtcctttccttgcggggtcaactgccgccacattttggggtcggtcgtcgttggggctgtcttcacgctcagtcgtctcagctcctcctcctcctcctccattatcagtgcgtgtcaacaatgagacggcagatgacgatgacgggaagcggctagcttcggcgccatccgtagaggctgatgtcgtacggtgtgtccttttggctggtcgttgtctgcgacgtggaggctgcctcattgttgacgaatcagactgcgacgactgctgttgttgttggtgcagcgccggctgttttggttgaggttgttgttgttgaattgttcgcgccgcctcggaaagtgcatcgcgcagcagccccttcgaggcttcgtcggtgggcagttgggtgagacgaacaggcgctggacgctcctgctcatcctccagcaattttttgaacctcttgaactcctgttggtaatggatcaaccgttcgtcatcgttcagaaggtgttgttgtttcgatgccggagatacgccatccgtgctctgggtgatgccgccgctgtgtgcagcgcgcgccatgcgctttgccgtgtgctcaattggcgtggtatgctgcggtaagccgcccctcgcagaggatgcgtcggcaacaggagccgagctcctggccaacaaggagcggtacagttcctccggcactagcagcatgcgggttgtgtgcttcatgtttgtgtgctgtcttggcggttcataaacctatctgccagcagtggaagcacaacgctggccaccaagccagccaaggccgggacgccgcgcccggtctgctgtctcagcaacagtcgacgtgccccgtggccgcttctcgcacggcccaacgcacgcacgtgttgggcctgagcgcgcaagtgctgaagatgagtgctccggagcgggacgcgtgcacggagaatgttcaacgcactttccaccagacacaacagctgctcactgctcgcccccctcaccagctgacggtaggcacgtgcgcgtgccgagcgacagttgctcagttgcttgaaaaagctagtgttccgttgaatgtattgacttggtttcggccttttcttcgcttgcttttgttgttgttgttgttgttgtctcttttcttgttgtattgtttctggtctgtcgctgctgctgttaccgttgttgtttccgctcttatgcttcttctgcattgaacattgctgcccggtctcgtggtgcgtacacaacggtcagctcgcccggatatatatgagttttgaggcgcatctgtggtcgggtggtcgggtgcatgtccaccaacaggtaaccaaacgggtccgctgtcgcgtcatcgtacgcctcgaggaagtggcgcagcgcacccgggaacagctggacgcccaacgagcgtacctgaagtgcgcccgacgggttgcgcatcagcaccaggtagtgtgcattgttacgtgcaatgcgcagctcgcggatgaacaaatgctgcgtgatcaataccacactgacgccccagttgtgtgagccacgtgtgaacaacgtgtccaggaagggagcgcgcatgccaaccatcagatcgtccaacaccagcagcagtcggccattgcactcgcttgccgcccgcttcactccctcctcgtcaggcagcgcgtgacagacacgaacccatcgattaccaccactgctgctgttgctgctgctgctgctttttttgacaacattagttgaggttgttgttgttagagtgctgtcaacgctttccagctgttgcaagcgcagcacgtcctcattcacttccccgaaacagtaaagcactccatcaatgtgggcggggccaaccagtgcgtctaggttggccagcagacggagcacccatttagtcttcccactacccgtacacccggacacacacattgtgaacggatgtacaaacacgggttttgcgtgcgcaagctgctctgactgtgccatctccaacctccttttcatttagccccgatgacccacttttttatatatgctctcaaatttagtatcacattttaacaatttttgagccacacaaatttaatataaataagtttatgttgaaactgtttattgttcattctctaattattttgtcaatggacacgtcgtcacacgaatctgatcgcaaggccggcgatggtgctgataatgctgatgcacctgcagcatgccaacagcagcagcagccgagtttgaccgcggacgaaccgctgttggtccgacagccaaaggaagcacctgcgcaccagctaatgaagaaagaggaggaggaggagaaaccgcgacaggaaagcgcgccacttcctcagcccacacacaatgatgacgtcagcaaatcggtcagtcagtctgttgccgtccaccacaatgcacagaacaagaaattgtcaaaacaaaacaaaaaatcagtcgctcgtttgttaagatgacgaagctgagcagcgatagtaatgatgaacatggcggtggcgatggtggtgatgatggacaagcgttgccgaccgaggatgacggggtgggcggtgctcatctcccgcccctcttgttcatcgatgaggaggaggaggaggagagcaccgagtcgcgcactggggatgacgtgggccgagacggtgacggtcagattttcactgaaaaagtgaagcaggaaggggaggaggaatcaaccgacggtgacgttgacatggattctgtcagccatgacacgtgcagaagcagcagcaacagcagtagcagcaccatgagttcgtcgttgttcttgctgcatgactgtcatatgcaccaccactacaaccgccaccaccaccacgacaacaacaactgcaacagcccgccgcgaaaacaagcggcgacagagctgctcaagcttccgctcatcgactatttgtgtgggctgaacaacgggtgcagtgtgagagagctccacacgctgcttcagaccaagagcccacgtgcacacatgttggcccatctgcaacagcgctgtctgctgcgcaccgtccatttgcggcccgccgagcgcaacattgcgctacatgcgcatgccctaagtgccctaagtacaaacctgacctttgcatgcggcggttatctcaacctcacagtaataattttgtttaaagaagcgccgcccgcattctgtttgtttttttttgcctaggtgcgtcagtacttctatgccaaacacggtgtccgtttgcgccacccaaacctgccggcgctggttgagcgcggtggtggcgcacacatgtcctattatccgctagagtgtgtgcaggtgcatgtcatggtggcatcgcccacggaccccaacgagacggaggacaataaagaggaaagcgcgggctgcgcagatgatgagtgaaaattgacatgcatacaaatttttttctctcatttttgatgcgtcaatcccattgagataaaattctaatttcttgttgattttaagcaaggttatttcaaaatgaaatattttgtgcaaaatagtaccagcacattttctcttttcaaatcgtgtggcgctcaagcggcctcatctccacgacagcaacaagaacaacaacaacaacagcgctttacccgcgaccaattcttggcattggcacgcaacggtgcgtgcaccgaatatgcccctcgccgttttcacgccattgtgatgcgtctgcgcaccggttcaaccagcaccagcaccacgagcaccgccgccgtcaccaccaccaacaccataaccaacaccatcactggcaccacaactgcgcttattttccaaagcgggcgtgtggtgctaactggcattggtggtggcggtggtgatggtggtggtggtgttgcggtgcagaaaattcacgtactctgtcgacacgaagcgcaccgagtgtgccgccgtgtcgccgatgcactccggcgaggtggctttccggcgctcggtcgctcgcttcgtgtcaatggggtgcagttgcgcaacctggtttccacacttcatatgccctaccgcttgaacattgaggggatggcgcagcatcttttgcggtgtatgaccatcagtgggaagcgaccaaatgacaatgacaacaaca

SEQ ID NO: 2197 - DNA, 2165 bp, Heterodera glycines
ttgagacgcaggctgcgacaacaactgcgcgtgaacattacccggcaacagtttcctatgaaggaccgctgagcgcaacaacacggaaatgggagctggaaggcgctccgctgaactcacatgtgactgtgtaccatcatggccgctctgatttggcagcacctgagcaacaacaaccagtcgctgagaaagtcacaacgaagataagctcattgttcaagaggaagccacaccatgaggacttcccagtctcggagcccttcactggccaattggatgagacggcaagggtttcggagctgttccacgaaccaatcgacgcaagtgtcagcgtctactcggccggaagatctgatgagcatgtcgttgtccagccaacaacaattgctgaggcggagcccgtaccgctcgttgagtacccgcgcacgacagcatatgatggtccactgcaaagcacatcgaaaggagcagaaatggaggggcagccgttggatgcacatgtttccgcctatcaccatgggcgctccgacatggcacccccagcagcaccgaaggagacaatcacaacaaagctcacttcaattttcaagaagacaaccgctcaagaagacgagtacccgcccaagactgagcctttcctgggaccggtggcacaaacgaatcgccaacgggagttggaagccgttccggtggtggacaggattgaacggatacccaaagggttggtgaagtgcgaaaatagtcataataaaaaaagaaaacctttttttggtttatccatgttggggtggggtggtctcgacaactaacacgggaaaaagccggccagcttttatgttaaaaatgcaaatgttctggcaaaatagacttcgactaatggggaatgttagagccatagaattttgaaaaattttttgatcacgacaatcaatttccagcttctacgaggaaggcgaactgcatccagtggtggtccatgaggagaaggaattgactccgtctgaggcggagaaaaggccaggaacattggagcgaattacgcacttgttcaagcggacagccacagagggagagtggccaatggtcaccgagccgttcactggaccgcatgctgagacatcccgaaagggggagcttgaagcacgcccgcttggcgaactcgtggctgcctatgcttccggccgttctgacgaagtcggtccaatgcaaacgattgagacgcaggctgcgacaacaactgcgcgtgaacattacccggcaacagtttcctatgaaggaccgctgagcgcaacaacacggaaatgggagctggaaggcgctccgctgaactcacatgtgactgtgtaccatcatggccgctctgatttggcagcacttgagcaacaacaaccagtcgctgagaaagtcacaacgaagataagctcattgttcaagaggaagccacaccatgaggacttcccagtctcggagcccttcactggccaattggatgagacggcaagggtttcggagctgttccacgaaccaatcgacgcaagtgtcagcgtctactcggccggaagatctgatgagcatgtcgttgtccagccaacaacaattgctgaggcggagcccgtaccgctcgttgagtacccgcgcacgacagcatatgatggtccactgcaaagcacatcgaaaggagcagaaatggaggggcagccgttggatgcacatgtttccgcctatcaccatgggcgctccgacatggcacccccagcagcaccgaaggagacaatcacaacaaagctcacttcaattttcaagaagacaaccgctcatgaagacgagtacccgcccaagactgagcctttcctgggaccggtggcacaaacgaatcgccaacgggagttggaagccgttccggtggtggacaggattgaacggatacccaaagggttggtgaagtgcgaaaatagtcataataaaaaaagaaaacctttttttggtttatccatgttggggtggggtggtctcgacaactaacacgggaaaaagccggccagcttttatgttaaaaatgcaaatgttctggcaaaatagacttcgactaatggggaatgttagagccatagaattttgaaaaattttttgatcacgacaatcaatttccagcttctacgaggaag

SEQ ID NO: 2198 - DNA, 2662 bp, Heterodera glycines
  misc_feature (2651)..(2651): n is a, c, g, or t
  misc_feature (2654)..(2654): n is a, c, g, or t
tatttcgccttttttggcgcctttttctgaatttcggaaaaatccttagaaaaatgcaagaaaaatgaaaaatacacctaagtatcgacctgaaaaattttcaaaaaatacactcctaagaattgaaaaaatttttcatagaaattgatccccaaaacttaattattttttcttgttaaaaatttttggtttaaaattgtccttatttgaaaaaactttaaaataattgaaatataagcaaaattaaattttaaattaagttcttatgtatttttctacctaaaaagcgttaataagaaatttttttgcctatttttgtacctatttgaggatttttgattgcctatttaatgcctattttgcgatttttttatgcctttttaggtgcctatttcgcgatttttgtgcctaaaaatctcagccctaaatattagcataaatataataaaatatttctcgcaaaaacaaaatattaattaattaattggtcaacaacaaaacacagcaggggtaatctttgatgcattaatcattcggctggatgagttctattttttggcacctcaaagtgatgagtatcggcgaagcggaagtatttaataaccgaattcgtacatttgatgaatagtcctcattttgtggcggctttttgatgggtcaatgaggtttttggaaataaggggtttatgatttttataatttttttgagattttcctttgtctatcggtaagtggtaaatttgtcgggtttatttttcttttcaattttaacgagttgactttcattgtgcctaccattaatttgccataaaatttgatttatttacatttaaatttgaattgagttattttgtttatttgttttcccctctatccattcaattcactcacttttcttttcgtcctttcacaattatttttcatcactcaaaagaaagaccaatttattctttcgttaattgtgtaaaataaaaataagccatcggcgaaagacaaatatttgataaggaaatgaaaaagtcattcattcattcaaacattccatttcacttcgtacaatttaattgtattttattttgaattttataaaacaaatattttttagtatttttttaaaaagaaaatttcaatttgaaatgaccaaaaaacgctgtgccattgtgggagcagcagtaagtgggctgccatcagctcggtaaaacctttgaatatttaaaataaaaataaaaattaattattcaaaaaaggtgggcattggcttatgactttgagccggtgatttttgaacgccttgacaaaattggaggcctttggcgctataagcctgagcaattcaacccagaatgtaagcatactaaataaaaaagcttaaataaatttattaaaaaattattttatataaaaaagcaacaaatcttttaagtggcgagtgtaatgaaatcgaccgtaattgacacgtcaaaggaaatgaatgcgtattcggacttcccgccgcccgaacacttcgccaattatatgcataatgtacctaattattagtagggctgctaattttatgtaaatacatttttttcctggattctccatagcctaattagtaggaaaaacactttcttttttgtgtttgcgaacaaaagttggttatttacatattttcgggttttatatgtacatatttttatacatatttcacaatttttgtacatattttcattttttttttacatattttgaggatttttgagaatttatagaaattttttgtaaaaaatttaaaaaaattttttgaaaatgtatccctaagaaatcgaatttttttttcaaaaaatgatttatcaaaaattaattttttaaatactagcatgtgattctaagcctattttggtcattttatgcctaggtatttcactttttacgaagaattttttttcacaaaaaataaccattaaaaatttttatttacatattttagtacatatttgggggtttttgtatatttcatacattttttagcatttttatatatattttatttacataattcgcaaattttcttacataaaattagcagccctaattattagtttattagagagctaattttgagcgtatttggacaaaaaccgggtccgggtattaaccggtattgaaaaaccgggttcgggtccgggccatgaatttttatgccttttttggcgttttgtgcctttactggtcctttgcggaatttgcagaaaattctttaataaaaattcaattaaaatgaaaaaggcaccccttttaattatttgaaatcccaattaaaaaaaattttaattttttttttgttttttttattaaaatatttgtcaaaaagtgttaatttttccaaatctctttcctttactaagacacaaatgctcgcttatttggagctctacaccgaacatcatgggctttaccaatatatacggtaggcacaataataatacggtagacacttaccaatgtcaattgaataagcaatttattagatagtaatttagtcaaatattgttatttcctttgtatatccctcaatgtttggcaattattcccccacagtttccacaacaccgttctcgccatacgccgggcggacgattattcccgaaaaatgggcgttgacctgnccnaggcatgc

SEQ ID NO: 2199 - DNA, 2852 bp, Heterodera glycines
aaagattgtcaaatttgaggaccaaatcaaattcgaaggagacattattcactcccatgacttcaaaaatagcaaggaatatgaggtgtgagaatggcacggagagaatgatgtcattttaaagaagctcaagcgaataatttttttgaaaataggacaaagtgaacgttgtcgtcggggcgggtaattcggcgatggatttgaacgtggaattgggtcgagttggcaaaaagtgttatttgtccactcgtcgggggcgcatggattggcaaaagagttggcgaaggcggaatcccaggttaaatggacaaaaaaaacaaaaaaaaaacatttacatgccgcagaggactgtctgttcaacacacgattcaaagtttgtgtgctcaaccgcattttgccccaggccttcactaattggctgttcatccgccagtgccaaaagcgctttgaccatgcaaaatatggcattatgccaagccacggattcttcaggtcttgcggggccacacaatctcggaaaatttgaatcaattaaaaatgctttcgaattttatcacttcagccaacatttgaccgtcagtgatgatttgccttgccgaattatcacaggttcggtgcaggtcaagccggacattcgcgagttcacctctcatggcattgtgtgggcggacggcactgtcaccgatgacattgacaaaattgtgatggccaccggctatctgttcaactttgacctggtggagaacggacaattgatcccggtaaaagacaacacagtttggctctacaagaacatgttggcaccgcaattggccgattggaacactttggccattgtcggactcgcacaggcactttctccaatggcaatgaaccgcttggatttccaagttcctattagccttccggtgccattcatcccgttgccgaaatgcaagcgcgactgttctttgccgctctgtgcggcgatgccaaattaccaacgcgtgaagggatggagcacgacattgacagggcacaagctgaattggcaaaagcatttgtgaaaagcactcgacacaccatcgaagtgggggagggtggtgcctttcgctgtttattaaactacacaggtcaattacattttgttcatggacgagttggccgagctgatcggctgtcagccgaatcccgtggactttgccttttcaaagccccgtctcgcccatgcccttctctttggcccaaatgtgtcctatatgtaccgattgcgcggcccaaaagcatgggacggtgctgaggaagtgggttgaatacagtaccaaacacacacctcgttacagtaccagttccagcagcataattctgcactttttctctcaggcaattcttgacatcccacggcgcatggacatgtgtttgtcgggaagaaaagtgaaggaagcgccgacaacggaatgggccgaaattcgttccgttttggcactgattgtcgccataatggtgatcggagtgtatttgctgagagcactcatttaatgcacaattcacaacaattcattcattcggcccatcgttcgaactgtcaatcactcctttttcattgcacatttactatgggataacaatgataaaattcataatttaacagtctttcaagtcgcattttttaaaactgaaaaaataaggaattgaaaatttagcaaaaaaaaacttacaattagtgttaatttgttttttgtttttttttgaattttgcattttacattttgtctctgaaatataatacaaaacactaaggatagcataaatttaatgattcaaatgcaagaagtgaattaagctatttgttccgtgttgcaacttttgcgccgcgggcattagcgccgtttattgtgaaataacaaacaaaaaaaagctaatcaaaggaacggaaaaagaaaaaaggaatcaaagatagacatctaatttttgtttttgtaaatgcgtaaatcagcagcaacggcaaatccgatgccaaggaaaacaaagataatgaagattataataataataagccacattcatgcatttacaaaattatcttggcatgaaaggttacgaagaatggatttaattttcaaattaaaacatatgagtttgatttaaataaaattttttatattattttaaaatcttattttgaaatgaatggcgcaaatggattttgtgggacggcgcaagtgtcggtacacaattttcccatttagttttctttgaataaagcatgcttttttaaaatttaactccccttttcatcattttcgcccctatttaagccactattataggacttcccccccccctataaattccattctttcgagttttgaatattttaattaaataataagtgaaatctaagaaaggcttttcgaatcggactttcgagttcctaatatttttatttaattatatttttacatactagaaattttatactaaattaatgaattagcaatgagtttaattatttctcttgtacaaatggcatacatattaataatcggtgcattattgacgtttaccgtaggatttgcaaacattttcttccaataaattttaattggcttcatttgcacgtgattattatccattttgaattcattttttaaccataaaaactaaactataaaattggaatttttagtaaaatttgtttgaacagatataaaaaattgggagattattactagcttaattaatgcagccaaaattgtgtatttaaagcaaatttcttaaattatcacataaaatttggcattaaatttcaaatgaaattccatttatttctgctcttggtcattttcactgatgcgaaacagatccattca

SEQ ID NO: 2200 - DNA, 2007 bp, Heterodera glycines
attattttggctgattttctcacttaggtcaattagtgtctgttttgtgggcagtcaaaccaattagcaaaattatttttcccattattattttcttctcaaattcgcgatgaacaccagtcaaattgtgttttttgtgcttttttgtctgatcattcaattgaaatttctatcaacaaatggccaaccgattctaaaaaggtctttgtcctttttttaattaaatgcaaaaatatcaaaggaaaataaaaaatattttcatttaatttagaaaaaaattttcagcgatgagaattttaaataaaaatttgtccagcagtgttcgtgcaaagcgaggcgtcggtgaatttgcacgggtcgctgcttccggcgcagtcagtgcggtggcatggcacgccaccaacaaagcaatcaacaaaattgtgggcggataagggcaacacagaaaagaaaaataatggagacaaatagaatttgaaataatgataatttgataattaatcagtgtaaagcagatctgtgatttatgcttattttggcatgatgtgcttattttgtgcttattctttgattttggtataaaaatatttaaaatgtcccggttcttagatggcgtcgatttgactttattcttaggttatgaacgtaactcatcaagagctttgccatttccgcacctcaggtgtattttttctgagcattacaggccacgagagaataatgaatggcatcaattttattcaattttttttgagtacaataataatttgatttaaatattaaattttctgatcactgacgcctcacaaaagagcattttcttggacaaaaaaggttaataaatttattacaaaaggcgtacaaaaagaattggtaattttacgagcgaaatttttttggtcgtgacaattagtctatagtacagccgcaaaatctgttaataaatcgcataaaattttcaaaaatctcccccggcggcgcttttcggcaccgcctgcctaaaattcgtctatcatttttttataatttggccaaaaattcatataaatagtcttttttggtaaaagctggaggccattcaattcaacgattgccccaataattgaaaatgaattccaatttttgttttcaattatttctgctcctggcaattttcactgtgacgaaacaaaagcattcaccgaatcgaatcgaaaggattgtaaagcactgaatggtgtaaaagttgaaatttcctttgacgcaacaattaattttggccaaaatgggccatcaaattctgacgattcgtccgagtcaaacacgacgaataaaacccaagcagcagcgccgacgacgggatgttcattgaatggggtggaccttcaggcgaacggattcgaaaggatgtgtgccgaatggcccgacttggctcccatttattgctacggcaaaatcattgaggtgccgagcaatttggtcccaattaatcataatgacatcaaaattcattaattcattacgatgttgagagtgaattaattggttgaatgactttcgcttaaggccgtcaacttttggggcgcccgaatgcttttccagaacgactcgaaacattttgttgacagaccactgaaaaaggaggccaagaaaattgtcgaagagttcacatcgacctttggcggcaacgaattggacgtgagcaaaatgaacgaacaacaagtggaccaattggccaaattcgtccgtgaaaatttcggcagagccaacggagtgctaatagcgtaaaaattgatggaaaatggcaatcaattaaaaaaataattaagttatacgcccgaagattgggtggaaagcccaccgaaacttgaacggataaaagacgcggagttcaaaaaatgggcaaagcaattgaacgaactgtggaaggagctgagtcggaaaatgccagatgtaagagggaaaaagcattgcaaattagtcagtaattaagctctaattacttattagtggaatattaggtgcaaa

SEQ ID NO: 2201 - DNA, 1098 bp, Heterodera glycines
aaggccgtcaacttttggggcgcccgaatgcttttccagaacgactccaaacattttgttgacagaccactgaaaaaggaggccaagaaaattgtggaagaattcacatcgacctttggcggcaacgaattggacgtgagcaaaatgaacgaacaacaagtggaccaattggccaaattcgtccgtgaaaatttcggcagagccaacggagtgctaatagcgtaaaaactgatggaaaatggcaaataatttaaaaacattttaagttatacgcccgaagattgggtggaaaacccaccgaaacttgaacggataaaagacgcggagttcaaaaaatgggcaaagcaattgaacgaactgtggaaggagctgagtcggaaaatgcccgatgtaagagggaaaaagcattgcaaattagtcattaattaagctataattacttattagtggaatattaggtgcaaattagggaccattaatgacaataatcactaattgattgctccatctgttgctggttcagttgaactgcaaccctgatcagcaaaaccactcactcactcatctgcgtgccacaccctttcgtggtgccgggcggccgtttccgcgagttttactattgggacgcctattggatagtgaagggactgatcgcctcaggcaaagccaaagaccaaagatcggccaaaatgattctgatcagtttaaggcatgaccaaaatggtgaagaacatgtgcatgaactttgcggagatggtcaaccgtttcggttttgtgcccaacggcggacgcatttattacgacaaacgctcacagccgtccttcttcacattgtctgacaaacaaacccttgctaattgcatttcctaattactgctccgttttagcatggtctacgattatttcttggccacaaatgacaccaaatttctccactaagtgttgccagtgcttgaaaaggtcagtgccataacttatcaacgccataattatgtgctaataagccaaatccgaattttcattaaggaacttggccattggagcaaaaatcggtcggttgaagtcgaagtgggcggaaagaagcagacattttaccaa

SEQ ID NO: 2202 - DNA, 1970 bp, Heterodera glycines
cggccgtttccgcgagttttactattgggacgcctatcttctattgaagggactgatcgcctcaggcaaagccaaagaccaaagaaaggccaaaaatgattctgataagtttaaggcatgaccaaaatggtgaagaacatgtgcttgaactttgcggagatggtcaaccgtttcggttttgtgcccaacggcggacgcatttattacgacaaacgctcacagccgtctttcttcacattgtctgacaaacaaaccgttgctaattgcatttcctaattattacttccccactttagcatggtctacgattatttcttggccacaaatgacaccaaatttctccactaagtgttgccagtgcttgaaaaggtcagtgcaataacttatcaacgccataattacttcctgataagccaaatccaaattttcattaaggaacttggccattggagcaaaaatcggtcggttgaagtcgaagtgggcggaaagaagcagacattttaccaatacagagcggacagcaatgtttaaacagaaagaaattgagtcaaactgaagcccattttcagattccccgtcccgagtcattttgtcaagacgttcaactcgtcacgaacatttcgaacacacaaaggaaagccgacatttggaaaaacgtggcatcgacggccgagtcgggctgggactttagctgtgagctttaattgcaattttagctaattaattaattaatgtgcataattcatttagcacgatttatgaaaaaagacaacagcaacaaagccaacccgtggaatttggtcaatttacagaccacggacttattgccggtggatttgaacgcgttaatttgtggcaatctcagaatgttgggagaactcttttcaaaaataggcaactttactgcattttaattgggcatttggccaagccaattaaatgtaaatatttttcatattctcttcttaaatggttttaggtgacaatgcaaaagcatcaacttatgcggctgagcataatgagtttcgaagcgactttcaacggttattctataaggaagagcacggcgtatggtacgacttcaacattaaaagtggaaagctgcacgaggagtactacggtagtgtgacggtgccgttgttcacacagtgttacgacaccgacgatgttggcacggcggaacggatgtacaaccactggagaaaattggcgtactaaagcacaagttcggcgtgccgaccaggtgcccaatttagcgcttctcatcagagatggaatggcataaacacattttattttcagcaatgtaaactccacacaacagtgggacttcccaaacatttggccggtaatttaaggataaataaacataaataattatgaaaattggaattaacttcagtctttggcccatatgctcatcgaaagtttgaggcgatcgggaaacaaaaagtgaagcggaatttccataacattttcctaatttgttttaatgccttttaagaatggaggaaaaggccaaagaattggcacggcaatggctgtcggccaaccaccaaatgtatcagaactgtgggcagcacatgtgggagaaaatggcggcggacacgggcgtgccgggcgggggaggcgaatatgtgccgcaagtgagtgccaatgggacaactcaaaaggccatggcattccctccaaaatgctcacagattggcttcgggtggacaaacggtggcgttttggatttgctggtcacatacggagacgaaatgacactgcagcaaatgccaaacgtggaatgcaagcagaacgcggtggttgaagagccggcggagttcccacccgcttaagacgaaacgagcggacaatggcacggaattcgaatggacaaaataaaaagaaaaaccaggcaaagaatgttggtgcaatcaatcgagtggagattatcaaatcattattatcatttagttacaaaa

SEQ ID NO: 2203 - DNA, 1434 bp, Heterodera glycines
tgtagggatttcaaagtaattaatttatttgatttgattaacaaagaaaaaagttaagctctaaacttggcttgtacggaactggcgttactgaactgacccgttggggtgatgaaaaaaagaaaaatttttgaatagtgcaattgacagttagcatactgtatttcttgaattataacagtccaaggcttttttcaaacccatcttgaaaggggttacgaatctaggaaatacagtaacttgttgcatacatttattgcgtttaaaacagtcgttcattaaaaacatttaaatcaaaaaaatatatatttaagtccaaaattatttagtattgaaaacaatcaagcatttatacgtaaaagcgtttagcgttttatctgcgaaacgtcttttcccgctccctctacgcgtgctcctttgttgtttttttaatttggttctgtgtacacataaccgaaaagtacacacttttctatgctaattttaggcgctaatcaagcctctggcattaaaagctgcaaaaatctgtgatttcatctatgatattcatcatatattttgtcaataatttttttaaagaaataacattcctatcatattatcaaaggatttctctcgccgagaggaatcgaatggtaatagtttcagggttcaacgatgggcgatggttcagcagcctcgcaaccaattatatatatatatatatatatatatatatatatatatatatatatatatatatatatatatatatatatatatattttgaattaagaacaaataattatttagctgctccctttcattaacctttttatttatttatgaaaataaatttaattaaaataattatacctaaaagaacactttcattttgttttcataatatattttaacacttttcgaactatttattccgaatttacacttttttgatttgatgctaatgagaagaatgtcatgataattttgtggcgtgttttttctttttctttatttagcacaatttgtgaccaattatatattttatttttcaaaaataaattaaattaattaaaattattttagaataattatgtaaataaaacaaaaaacaaacagagagatgaataataataaaaaagtcactgaaatgagtaattcgaaaatattttccttccataatttgcaataatttgggaaaattaaatttttataatggatccaaatttttagccaaaaaatccgccaccgtacaatccaccaccatatcctccgccaccgtataaacctcctccatacagtcctccaccatatcctccgctaccatataagctaccaccataacttccgcccagcaatccggtaccgtatgcgcccatggagccgtatcctccaggaaatccgccaccaccacacatctgacatgatcccatgcgagcctcggcgatactt

SEQ ID NO: 2204 - DNA, 1074 bp, Heterodera glycines
  misc_feature (16)..(16): n is a, c, g, or t
  misc_feature (39)..(39): n is a, c, g, or t
  misc_feature (140)..(140): n is a, c, g, or t
tgggtaaatttgattngttgggtaataatttggatatgnatagtttgggatggttggactgattggatacgtcggatttgccgggtaactgggataaactgggtagtttggataagctgggttagtcggtgaaaccggantaaattggatttgtcggataaattggatatgttgggttgttgggataaatgggataagtcgggttgttggtataagttggatttattggtaaaggctgacctaaaatagaatatacaaactatgacaagtttgaaaggtgaacaagagttgcttaattgttgggcatttggacagtaaagaaaaatgccggattaatttggaccacccaaaaaccggctttaaattgaaagcccaaactcacaacaaactccttgaatgcatgtttcccttgggtcgacacagaaatttaaataattacacgctgaaaagggttattaaaatggttattcagaattaataattttaaaaaaagttttcttcgctaattgctcacctccctctctgtaatagccggccgggcactgattattaaagcagcaaattccgttgtagcacctttcatttcggctgatgcaaaacccaagagggcaaactaattacaaatcaagccttttgagcatttttgacttctttttttacctccgtctggcgttgcgccgaaagggcattgattttgcggtaaaatcgcttgtcctttaatgccgtttagattttgtgaggccaacagaaaagcggccaaaaaaaagtgccaaaaaagcgaagtcagcgccgatcgatcggccatcagagaaattaataagcaaacattggcaaaggaatgaaaagcggtttttgcttgcaaatttgtattcatcatcaaaaattgggcacaaaaccaacttcatcaaatgtttgttcaaatgtcccatcgaaatcattccgtcaatgttttaaatcgatccttttgacgaaattgccttaaaaacacacttattcatatttaaattttttattctccgtaaaaatctaacacttagaatttctcttgacttcaccttcttttcccatgtgtca

SEQ ID NO: 2205 - DNA, 3975 bp, Heterodera glycines
  misc_feature (3967)..(3968): n is a, c, g, or t
aagtaatgtcgttcatcattctgtggtggatgaagtagaatgtatagattttttcaggatagttctcgaaaaacagatgaaaaaaattccctcaccggaaattgtttatgggtttattccccacgacaaattccattgttgcgccgatatgactaaaaatttttttaaatataataatattgtatgaattatcaactgaccgaagtcgcaaaaaagatggtttgaaatagtatcggataaaccgcggagtgaaaggcttgtcgccctcttcagcattgccttcctcctccgcttcatcactattacccccagcttcggaacagtcgtcgttcgctgctgcgtctaacattgaaaatccgttttaatggcccgttggactgtaccacggcttattaatctcgaatagaacagtttcggaatcgatgtcgcgcactttgaagcggacaaactcaatgtctaaataaggagcaacgcaatgctcactaaacaggcttaattaagaaaaagccgaccgtagacattatcctcgggtcggcagaggaaatctgaaagggaatgccacttttggttttgttttgtgatcatactttcagtaatgcagttcaatccgagcacatcgtccggcatcaccatttctttcgccctaatttctgcttcggtgatcggcgcgcggatttcgttggtactttcgctccgtccttcgctttcattccgagcattattttggtccaaatctgccatattcgtttgcttagtgcgtctgaaaatagaatatcgtttaagtgagctctaaatgctttataattagagaaaaagtaacagaaggcgtcttagaacaattcacaaattaaataaaaaattaatggggacggcacacactttagcagaatgaaggaagcaatgctaaaatcaaagattaaaataactgtaaaagaatctctatgacaaccacaactttaaaatgcgttacggtgtaaaacgaaatgaacttatgctaaaaatgcatgtgttcatcaattgtttattgttttcaagtgatttaaataaatttacacatatattttacattaaaagttaataaaaaagataagaaaccaattagttaatgaaaggaaagtagggaacaattggggaaataaataagggcaatattataacaacattataagggtcgggcgtcttttaggcgctcggaatgttcaaggctaaataccatatttatcagagtatttggattaataaatcttctaattgtattccgaaaatcgtttcagttcaaattattaaaaaatgactcaaaacagaaaaaataataattttttagacatctgttaacaattacactagaatttgcaaacgttccctccttttcactgaatttttttgaaaaaagcgcagcgcaaaaggggatttaaaactcatcgatttaaatggcaggactccctttctaaagctggtcatcgccgccgccccccccccggcttttgcttgtaaacggtcagaccgatcccccatcccccattttatgtatgaagtggtgcttttcattcataaaatgcctaagcctacaaagtgaaaacgcaaacatccaatacgaattatcgcaccgttccataaaactgcagactttcgcgacggtacaatttcatagttcgattccaacaatcgaagaacaaccgattcatcgccatcttccgcatccattctttgacaggtgcactcggaaacgaaatcatcgaaacgagacgcattcttttgcatgcatttggaggacggaaaagaatcgcagtcgaacaaattggcagaaacaatttcgaaacaaagtttggccttaaacccatttaaatgaatagagaaaagaaaagaaagaccctgtcgaagaaaatcaacgcctgttgcttggtgagcattttgcagtgcgtaaaatgactaaaagaaacattcaaaaaagattggaagcaaagacggacggaaaacctcaaattgatgtgatgaagcgaattcactttcaatggacccaaagtgacaaaagacgaatgaattggaatcagaaagtcgctctctcccatgcttttgtcagcaccactcaaaattttaagggaggcgaaaatgggctgtgttctgtccaaaagtgctgcagttttgaaacatttataaatattcaaagaaataaatatggtttacttggattaaaagaaagcagcggcagttggttattgtcttcttccattttcggcacaaaaacatcagaaaaaccgatggcaaagtcaaatttggattctgatacggtgaaggggtgaagaaaatcactataaatcggtttatattattattggtagacattattataaatttgcaaactccatcatatcgtggtcctccgtctgattatgcattttcatcaaagcctcaactgcaattgacagtctggcatcgtccggactgccaacatcaatcggagtttcttcccgactatttgagcaatctccagaaaagttttgttccgcaacggcataagcccttttgatcagactttcgattttgaagggtttattgatagtcttttgttgcttttttgttgtcattgacttcaatttaagatgttgctttgtgttatcctctctaacttttgtgtagaaacacgaaataacggaccgaaaaggcgtttcggactttggcagttcggtgtaccttttccaaagggcaattcggtcagttacccgtttcgaatccaataaattggcgtccttaaagaaaagttgtaaaacgaagaaacaaaattaaggacgatgaatggttcgatgtgaagtgagcacataaaacgttcatttggcagtgcagtaaaaggcgggttggggcagtcgaaacagaaagaagcgtcgcaaaagtcgcaagaaaccatcctcttctcgacgaacctttatttagttattttgtacaaaataaaataggcaaattcgaaagtgttaaccttttacagtaaaaacatctcttcgaatttggctcatcttttgcgaaaagttcatcgaaaggcaatttgtaaaaacattcatcgacgcacaatttgtcaagagaaaattcacgagaattgattgcctttaaggagttcacaaattcagaaaaatcctcggacggcgcaccatctttcccggataagcggagtaagaagcgaacgaatgattggtttaatacatcttctttttcttgaaaaccctaaaatacattaaatttagaaaaactttttttttggaagagtagtagtaatatgtgaggaaaaattatgtgttataacgaaattaggtaaaattgatagattttgtaattcccaaaattaagaaacttaaaaaggaccaaaaaagcattttattgtaaatccattaatgaaattccttaccaaattccatttaatcctcggcacatgactgtaaaaatatttattattttgtaaaaactaaaaaaaacaattaccgtctgttgtattgtacttccatttcacaacgatgacaaatccaatcagaagaatagctgcctttgttaatgggaagagcgggaaaatgacaaatggaatgaaaggaagagttgcatcttgagcaattgtacaaaaggccgccaattatttcctggaaattttcataaaatcaaacaaaacgacgaaataagtagtaagattccttcaaagatctctcaacttagaatcaaaaaattaaatgaaaaagactcaccatacacgagcagcaacattggtttgaatcggtgggactggaacgaggcgaagaattgtaagagcgtttcaccggaggactttggaatgtctgttcgatttcatgttgaagcccaacctctttgtcgtacacaatgttgtctttccgaagcttcgactcgtagacaaaagtcatctaaacaaagtttgtttattcaaaatttaagaaattctttttaaataatcttttatttaagaaaacgaccnntgcaggc

SEQ ID NO: 2206 - DNA, 3436 bp, Heterodera glycines
gtattatcaccgctttcttgacagacttcttggcatttcttccctcgtaattaccaatgaatgtgaaaattggtacgcacttaaacttaacattgacttgggatggattccgtttgccaatttctttgctgttttactactgcattttcttttacactttcaatatcggtttgtgtttactttctttggttgaaataaagcgacgcaaaaatatatttttattcagatggacgaaaattggtgtaaaaaaacccattacaaaacgctccgccaaccaaagagtcggtgactcaagccaagaagaagtgaataaatttcaaatccaatcatttgcaaattattcttatccttcagttactttcgcctcaacacaccgctgaaacggcagatgttgctgcacttcagaggatcacttcggaaatgatggacagacagacaattagccaactcataaaacgttttacaaaaacaaaacttattaccaaatcaaaattccatttagcaaaacaagaagatgagccgggctttctgcttgttcgtgccttctccgaatttctctatttttgcctttaccattgctacgtttttgcccttctctccatgatggtctgtctatttttacccgttaatttgagttttcatttgtccctttcttttttcagatgtgggcccttctctaccattctgtgttcggccttctcttccttttgctcacttgtttcctctgggccctcgtaaattcgcgcaaatggacattcaaattgtcccccattcttttggcttacgttgaggtgactcccaaacaaaaggacaatttgtttttttatttgtttcttttcaagttccttttgttggttcaatatgtgttcagcatgaatttacacaaaaatgagcttggacttcccgaatcggtggaaatcattggcttcaaacttgagcaatccaggactgatgcatttatggcacttttgttgaaggtgggacaaataataacactgaacacacaaattcccaccctttttaacttttttcttaccgttgccttaaagatcactttttcaagtggctaaagtccaaaaatcaccgactgacagaaatgaaaaaaaaatatcaattttcttttgcctcgcaatatttgctgatgagaaaagatcttttgtatgtcaatgtactcaactgataattttgaggacatatataatttaattttaaatcgagttcaaattaatttcttttttccctcacattttatattttttactaaaagctaaatttattataatttaaccgaattttattgctttttggtttttcgctttttaaagccatttcaaggagaaccattgcaataaaaatcctaatgatgagggaacgatataatattatgaccatgcagtgaatagtcaatatttaattctttattgttttttcttcagattatcctcagtcttccacttttcattcttttacgtttgcatttgcgcgaggattattataactctttgaacggacgtgaacgattccgacaagtcaattacggcacattcgcagtgaacgacagtcaaaggcacgtaaagtgccggaaattcacactttcgagggcaaatgaggtgaagcttgatacatttgagcaacacaaaaataaattgtgaagtctcattttcaaattatttaggacccatttggctgcatttcatatcttttgacaaagtattggattttcctagcggtcttttgcattttggtgaattcgccaataatcggtgccagagggggcggcgtcactttcttttccatcggatttctcacctttttcattgtgttcattcttcttcttatcgtaagctaatcatacttttttacttaaatcttctctttttttcactaattaggcatctttccgactcttccggaaagtcgtcttcgcatttttcaccgttctcatcatttacgcttccgttgttttggtgtccatttatctctaccaattcaagggagtgcccgagttttggcaaaagtggacgcacataaacgaaacggtgtgggaggacattggactgatcgattacaaagcaaacgaatttgggttggattttttaaataaaaaacattgagtaacagttttattgggatattattgccattttagacttctgttcactaatttgacaaaactcatctctctcctcgtcgtcactatgctccagctgaaattcttccacagcccttggtcccgactcgtctccgattccgcagaagcgtctcatctcgaatgcgtggagaccgttgacaccgtacgcgccggtttgtaaaaacggaatcgtataaaattcatggcaccttaattttggaagcttattcgttgtgattgaatttgtttatttatttgtttttgaatatattatttaatatttgcccgttaccattctttgttccatttcaccgactttttcatttttgtcggattttttgttttctactaatcacagtctcaatagttgcatttatatgcttttggtttcttatccctttttttccgccagtcagaagatggtgttttttatttttgtatcccctcttccccttcctccctctttacgtttcatccctcaaaagagcaaaggaatcaatatattttttattatgtttgtgtaaggttttaaacagcgaaaaaatgcaaaagaggaaatcaaagcgctagcgaaacctgaaatttagggaatttataaaaaacaaacgatgaaagtgattaaaagaaattcaaaatttggtttctaaatacgatagaaactcacaattttgtttgtacatttgcacaattgtcaccctcgcacctaataataaagttttgtcgatttttcactgtttttccttgtgtttttcaccgttcaattcgtttgttcgtgattccctgcataaataaacctttaatcctcttaataattcgttttcaattcgcaataattttgtgtgttacattttcagagattcgacgggctgtaatgcgtgcttccgacctttggtccgcattcaaagagttcgcttggcgttttgccgaagtgcacatccaccgcttcgttctgttggtccttttggtcgtatgtttggatcaccattgtctcctcaacttcgtgcccgtcctctttatttccttggcactttccttcttcacgttggcacgattcatttccctttcgctgtgtctgtaccttggactgatgttcatcgcaaaaagagtgtaccaggtaatacggtgccaacaatacagtgacagaatcaactaattgctatacaatatcaacttgttaattaacgatcttacttaatttcaaaaaagggatacatttataaaccatttttagatgagttttgtcccaagacttaaagacgatgcaagcaattgtacaaatatttacaatgacggaccatttaacac

SEQ ID NO: 2207 - DNA, 1800 bp, Heterodera glycines
  misc_feature (1706)..(1706): n is a, c, g, or t
  misc_feature (1774)..(1774): n is a, c, g, or t
gctttgtttgaattttcttgtttatctctcaaatcagattatggtcttatgtgctggtctcggtggcacttccctatttgccttgggctatttgatgatcgctttttggatgctttggcagggcaataagctttacaccatgcataattactcgaggacgttggcgcgttggaatttcttggccatttattccgttgttgtgatgattgtcaaaatttctcttcaggcgagtcgtttgtgtccgtttgcccgattgtcacttttccccttttcagcttctcggctgtgttttcgtctctctccttttcggaatttgccctattcaacaacttttcgctgctttttgtgccaatccaattgcaagagacaatttggcatatttcagcagtgagaatctgaagacgtcgaacagttccatcaaatggaacattggcaatttcacgcagtgcggataccctggagggtcagccgaaaaggcggaaaactcgcagcacaatgaggcgatgatcggctacgatgtgctcgccttcgtgttcattgtgtttcagctgagaattctccattcgtggttcttccaacgctgcatgatcgagtttaggtgtgaggtcatccaagccaacaggtgagcagagataattccattcatttaatttaaaagttgtgtaaacaaattctaaaataattatcgctatttatttgccttttaggggtgccattcttatcaaccaactcattgagaaggaaatgcgtgaacagactgaacaacaaaacaagaaacttcacgaaatcaaagaccgaacggcagcgatccgaaaacgatacgaggaacagcaaaggcggagcactgggattagctttttctcgccccaaacatatggacaaggtccatttttgtataagtactttttatataattttttgctttgcaaaaattagcatttgttttttaatttcgttttaatttgttttgatcaatggtctatttctgtttcgtattattcgacccgttccgatggtctgcagtctttttctgacactttctttcgttcctctctaatgccatcactaatcattgtccaatctctctcttttgctttcaaattgggtgattagtcattactcccaaatgggtggtttcgttggtgttccactgattgtgtatgttttgtctgtcctcagtgtttcggcacagtccttcttcactcgtcgagcgtcttccgacttttgacgaagacgaccccttaccgagttacgacctccgactttctgtcccgtcttccgtccctggtttgttgtatttgcattgccttcttccgtgtgctcgactttcgctctctttcccgcacttcgcttttgtttttcgtttgctgtgtttttgtttctttggaataatatttaattttgttatttaggggactattaaaattctcgttaagtagcataatatttgttattggtgttggtttgtgaacattggcaattgccctaatgtgtttttttttgtaacccttccttatacagtaattacttttctgctattcttttgcctttctgctttattaatgcgacttttcccttggatttgcttttaacattttttattttgtgatattttttttcttatagccaaacgttctggcgactattacatgtttgactacgagccggacaaagatgaattagtcgtaccaattgagtcatttgtntcccgaaggtaaacaatcctaattattttttttacttaattttatttgtaagttacgcctggtgccgntgactttgacaactcgaccctgctca

SEQ ID NO: 2208 - DNA, 4612 bp, Heterodera glycines
  misc_feature (4599)..(4599): n is a, c, g, or t
ccgtaaaacggccaaaattgggtccttttttagtgaaacagttgagtttttacccagcagcgggaaaaagttttttttaagcagccgccgccgacgaccaaacaatagaaaagtctacaagtgggaaattgcagttatttgcagatcgtaaacaacttttatcacttttattcagcaaaaaaaaaattatggataaatttgcaaaaaaaaaaaaagtcttcggaccggaccccaccctttccccccccccccgaaaatttttcctggctacgggcttggtctgaacagcccgaactaaatgggtggatttgtattggcaaaacctggtaatttcatatttaatttaagaccaacaaactcaagaagatgaggagaccgatgttccatcgatgcgaaaactccccagacaagaaattggaactgagcgccaagaaaagttggcaggtgacgagacggaaaagaaatcgttggaggagaaaagtgaagaagagtcacgagccaaaagttggggtattgttttgtttttcgaaacatttccatttgtcagtcaatttcccttcccaaaaggtcaaacaattctttctctgttccttttcgccttgaaattgttccgttcactgatcggatgggtctccgcctttctcaaccgacggtctcgcgagcatcgatacgttgaatatgtgttgaacaaagagaaggagaagctgaagcaaatgatgtgcaacgtaaatgcccttaatacgcttttacgcttttccctccttttttcttttaggagcttttcaatgggcaaattacgacttcggcattgcgcgaccgatgggaagcgcacaatatgcatttggtatccagtgaggcggacatcaaaaggttggccgggaggatttgatggattataataaacaatattagtatttatttgtttcaatcgcttaaaattgaggtttttaggttggaagacgaggcgctcaatcgttgggagcagcgaaacattttcgcccgttttatcactgcgattggaaattgcatcgccgcccacaccgacataatttgctactgtttcgtgatcattgtgcacgggtacactgccggactgctcactttgccacttcctgcgcttgtctttctttgggggacgttggccagcccgcgcccctccaaattgttttggattgtcatgttcgttttgaaatagcccagctaaattttcatatttcattataggataatttacaccgaattcgaaatcgtggccaaattcgcttttcaattcggattttggccttggaatggggacacagtcggcaataacaaagtgtacaagacggagtatgtgttcggagttcagcgcattcagggctttgccggcaaggacgtcgccctgctcatcgcactctttttccaccggtaaaaacgaaatttgtgaggaatttcacacataaatgggctttttttaagttatatgttgaggaaatttggactttggagagacgcaagttccgacagattgattaacgaaatgcccaaaaaacggatggacaatgggtcatcttcatcatcatctgctgaaaaaagtccacagaaatcgactcaatcgacggttgttccatcgtcgagtggagaaaactttgaatcggtggccaaggcacaacaggaacaggtaatttggattttttggtagtttaaaacctaaaaacaaaaatagaactccgacgacatcgaaaagggcataaagcgacaaaggccgtcatcggattccgttgaagagattggaaaagagactcaatccatcgaaaaggatgagaaaacagttgcaccaatggttggtcttatattaatttgtataataataattaaatttttcataaggaattgccatcaaaagatgagaaacgggacagcattatgctcggatttgttcaaaaggtattttgttttgattggcattttctttccctgtcaatagatttccctcaattcattctcccattgtcagctcatttttcccaaattccgttacatccgcgacctctatccgctgatgttcttcctggacgtgttgtgcatgttaattgttgtttttggctattcatcttttggcgaaggcggcacaggcgacgttgtttcggacattcaggcactgattggttactgtagatcggatgttcagagtcatccggtttccgggtctatcaaaaaccggtcaagccggaaaactggtcactccggatttacccaaaaatatccgggcccggtaaaaaccggtactgggctctgctcggtccggtctctattgcttaccgccatctgacactggatggaattttcagagcaatcgcatccctataatgatggtcgccatcattctgatccaatctctgctgattgtcatcgatcgcggcctttatctgagaaaggcggtggttgccaaactcatttaccatttggtcactttggttttggtccatgtttggatcttcttcattttgccaagttacacgagaaagtccgtgccatttcctctcttaacataagaattccatttaaactttaaagggaagttttctacaattatacagcaaaaactctctactttgtgaaatgcatttactttctgatttcggcatggcaaattcgcaatggttacccctcattgtgtgtcggcaatttactcacccattcgtatgggttgatcaacatggtgcttttcaaaatgtaattttctgattttttaacaatatttataattaactttagctttatgctcaccccatttgtgttcgaattgaggacagctattgattgggtaggcattttattctttcttttaaccctttttgttttgtaatttcggcattttaagacatggacagacacttcgatgccaattttcgactttttcaacatggagaatttttacgctgtgatctacaacttgaagtgcgctcgcacttttgagctggcatttcccgccccgcggggcgaagccaaaggggcggtgatcaaatatatgatgggtcttccatttatcatcgtgctcattttgctcgtctggtcgccaataatcgccttcgctctgatcaacaccattggaaaagtacagtcgccggacagtgtgactctgatcgccagtttggagggatatccggttggttttatttactttttatctaattgtaaatcgtatattttatttatcaggcgatttacaaaatggaagcgcagggctctgatgaaataaaaaactttgaatatgctcagctggaggaactgaagaagaaatttggagatctgacggagcgaataaaagatttcaacgacggattgggcgacagagttcggatggcggtcgcgttcatcaatcagtactcacacaccgacgttttggtacattttttcaaaatatttttataattgtcattttattttgtttttagaaaatccgatttcggcccgagtcggaaacatcttggcaaatatcccccgagtctttggaggcactaaaagccgcattgagcaacaattccacaatcaaattgaacttccatttggaattcaccaggccgagccctgacgggaaaaaagacccgcaaaagcattcaaagacttttacaatcgatgcaaacagttcggcaatccttcatgccattgaaactaacgaacaatgggtacaaaattatgccaaccttatttcatccaaaaacttaaggcaaatatttcgaatgctctgccgctgtatttgtccgttccaagtcaaggcgaagtccaagcagcgcgccttttgcatttggtcgctttgaagccggacgaaggccaattggaatacacatacaattatttggccatgaaattgtcgccacaaacacagcaaaatgcgtcctattggaccagtcaagttgatctcaacccgaatatgacgctgtacaacatttgggagccgacaaaagtgacctatgggatggaccgttcgcttcattacaccgaatttgtggcctttgtggaccgcgtgttcccctcgtggttggacagttacgtccagggagggtaagtgaaagcatcagacatgcaattggacctcgtttctccacccccagcatcattctcatgtacgccggcattgtgctcgttgttggccgtcttatccgcgggttcgtctcctcacagccattggacgtgatcatcaacgaaattccgaaccccgactatttgctcaaaatttgtttggacatttatttggtgcgcgaggcgggcgactttttgctggagcaggtaaacaaccgactagaaaacaattactttgacacaacaatgtccattttaaggatcttttcgccaaattgatcttcctcttccgctccccgcaaacactgatcagatggacacgtcacaaatccaaaaccgagtgatgatcattttaacagcaattatttttacttttcttttctatttttgattcgactctccaccctttcccaagtttcttgtcctctcttacattattccttttgaactgtttcgagcctttcagggttagaattagcctcaaatatacataattttttcgtctcgaatcagttcgttctttgtattttccgctgntttctgtctctgt

SEQ ID NO: 2209 - DNA, 1654 bp, Heterodera glycines
catatatttatcggaattttcgtcaaaatttgtaaatgtaataaggtgagtctaaaaatggcgactggtggtaaaatgggattcggagagattgtgccgaaactgagtcaggtgaccgaatgggacacaatggccaatcaggtggacacgagtcgtttgtgcataattaggcttactgatttccttcgctttttcagtccctcgccgaaggcttacgctgcgagataaaacagacgtgggacgggaagccgttggatgggcacggacccatcaaaatttggatgcgatggcatttccggcgaatgttcgggcaaccccacaaaagagtggtgagacaatggcattatttgcttgggatgccggcaaaaattcgtcatccttaattctttttagattcgcgtggagatagaagctccgctcgtcgatgaccccgaaccgcccagcgaattcgccggcatttgcacggatgtgagtaaattaggcaggggtcgatcggtacagcagttgcacatttttcaagctgtacaactacgaatgtgtggagctgttctttgccaatgacaagggcttctacacggaggtaattaaataatttgtaaattaacttttgaacttgggggcgtgggaatggcattttgtcctcattggattggcatccgtttctgagttcacacatttctcattgtcaggtggaagtcggtccgcacgggcattggctcgtccttctccacaaaggctacagacaatgctttaacagtggcgacaatttgcaattggaagtgaaaaacgaatggaagggcaccgaatggcactgccaattggaaattccgttggcatatttgccgggaagtaagccaagcaaaagccactcattctgtcccgttctttgtttgcttcagatgtgaccaaattcaacgcgtacgctttgcacggttctgacgaacagcgccatttcgaggcactgcacgcggtcaccgacggcacactgacggagccggacttccacaatctgatgttttttggcaaactcgacacgaaacgaatcattccggatgggtacaatcggacggtgttcaacgacctcaaatacggcgatctttgggaagaagccaccagcgacaaatgaaaagccgaaatggacattttaacactttttatcgttgtgtatttatgtgcttttggtacttatcattctttgtttatggttgtttacgaataaatcaattaattattaattaattaattaattatggtcactttatcagtcaaacgtcctcttccctttgtatttgtttgttttgcaaatcatttgctgtgactctctttttcgtttctctccgttttcccatgtttacccctggcgacgatttctgcgccgcctgcggttccatcatgcaaactccgaatgaattgaccgccggctccggtgtcaccaatttcatcaaatgctccgtctgcgatgcaaaatggccctataaaagtgggcatttcccctggggctttgccattcgttgcacaaaagttggttgctggcgttttgcagttgtccacggccaattgcttagtcgtgcacgaaaggaatttcgagcagcgaaacgccgtgggggaagaaaaggcgaaagacagcagagaaaagagacggcgagggaagagg

SEQ ID NO: 2210 - DNA, 1664 bp, Heterodera glycines
  misc_feature (502)..(502): n is a, c, g, or t
taaatttggtgttttggcaaggaaaattttagtttctcatttttatgtgcataatgcatacggtaatttgtgggtgcgagacagtgggcggcgggcataaaggagtatttgggtgggcggggcggacagggggcgcaactgaataaggggacgcgatagcagcgacaacgggcgatgagacgcggagagtgaagtggttgtgccatgcgggcgggcccattagaggggtagggcggggcggagtgagcattaatcggtcgcaaatcgcattaacggcgtcgcggttgtgaaacgcgcctgcggggccgaccgccaaattttattgggcgaatgaatgaatgttcaatgaatgaataatggttgagtgactgtgattggataccgctgacgatgggagctaagtgatcagcagaaagcagtccaaataaatggcgaactgacaagatcagtcagtcaaacaaaacaaaaaaattcggtggctgatttggcgattgggtggagngagggggcggtggggcattcatcgcttaactcctccaccaccaccacacgggcggaaatcctaatccaaatcccaggtgaatgactctgtgaatggataaatgggattggctgaggcgattggggagcgaatttggcccctccggcagggaagcggcggcggagaggggattttcgagggaggtaatccgcgcgactcaccgaacaccaccaaatgcagaaggggagggagaagaggggataagccgaagtgcttacggacccaactaagtttatgatgtatttgttggtttatgctgcttgactttttgacggacgcgggagaaaagtgagagagagagaagactaacaactaagaggatgaggaagggttgttggaggacatactgactaagctatatgttggagatggattgtgcattttgcaccctcttcccccagcgccttaagtctcttttttttacaccgtcccctccggctgggattggtgcctaattttttgtcaagaagctttggccgttacagtgtccagcggcgaatctaactcaaacatgtgtccgctaattccgtactaaataattccttgtcaattgggttgtggggactgatgagagatgccagtgagtttatatctttgtttactgtatttgacacattcggtagtacaattttccccctggtatatttatagttcgtacatatccaatcagtcccagcaaaatggcacatttcactccggtactcaaacagcacacaatctctttggcgctgaagtgggtggtggcggtggtgatgggagacggattcgcgcctcccgaagtgtgattatcccccggggggacgagggctttagagggggagagagttgatggccccctattgtttgcccatgtcgtacacacattttgtgggtggtggagtgccgttaagagaattaatggacttgggccttaagcaaaacaaaacaaaaaaatttgttttcattaggatttttcagggtgaaggaatggaaaatgtgttaaaagtttttttttgttttcaatgtttaattaagggaaggaatggtgggggatgggatgaactttaaaatttaagtaaatgaaagcaatttccaataattatataagctacttcagacctgatgtaaagcaaatttacaaggg

SEQ ID NO: 2211 - DNA, 2667 bp, Heterodera glycines
  misc_feature (1885)..(1885): n is a, c, g, or t
  misc_feature (1918)..(1918): n is a, c, g, or t
  misc_feature (1948)..(1948): n is a, c, g, or t
ccgcaaatgtccgtccgcaatgtccgtccgcaaatgtccgtccgcaaatgtccgtccgcaaatgtccgtaaggctccctcggggggacgagggctttagagggggagagagttgatggcccactattgtttgcccatgtcgtacacacattttgtggtggtggagtgccgttaagagaattaatggacttgggccttaaaccaaacaaaaaaaacttttttgttcacatggattttttcagggtaaaggaatggaaaatgtgttaaaagtttttttttgttttcaatgtttaattaagggaaggaatggtggtggatgggatgaacttttaaattttaagtaaatgaaagcaatttccaataattatataagctacttcagacctgatgtaaagcaaatttacaagggataaatttaaaattttttattaaataattatttgaaaatttttcagtgtaattgtaaaagggtgcagaagtgccgtgctaaaatgaaaagtcgaaaaacggttttgaatgttttggcacgaaacaatggacactcgagaaaggagggcatgctgaatactgtaatccaaaaagcagaaaaaaacaagtcctaatttgtccattcattaattctcgggttttttgacttaatggaagatattgtctcgagagtttaatggaatttttatgagataattttttttattaaattgaaatttattaaaattagagtgttaatttagaagaaaacgtttaaaaatgatacaaaaaccaaaaaattataaattatttttttaatcagtcaaaacgatcaaaaaattagggttaatcatttgaggagagcccgaatgagccggaaagaatgggaaacgaaggatgagtgaatgagtggttttgggtgtgtgtgtgtgtacccgacgatgaccccttatggaagcgaaaagatttgagaggatttgtgtgggaaaaggacattttgcgcccaatcaaatggactaatctttgtcaatttgcacataaatgtgagagaaaagaaaaatatgtacaacaaagtcggtggctgttttgtgtgtacggcttgaagaagttggcgttttgtgttgcgcgccgctaatgagaacaaacaaaagtggatgggggtaattaagggaatttatgtaataatccggatgaacaaaagtgagattggttaggccgttattaaaaatatttgtggtttagtggttagtgcttcaagatttcgccctttttaaaaattggtgtaataattactgaagaaaaaaggcaacttatttctcgttgttttcaagccaaatttcaaaaaatcataaaaaatcaaagagttgatgaatccggatacgtttttttgcattcgattcagaattaggtggtatagaaatacaccgctggtaacgaaccccgaactccacgttaaaccggtctaaaacccgaaaaaccgttttcggcaattttgacctaaaccggttcaagaattttttttcttgccagtttgaaaagctgatcaaaagcttttaatgtgattttgtagaggacagatggggctattaaaatagcacaaaagcagatttttatcacatcaactttttgagattttcaccaaaaataacagggtgatcatttgttatgcaacgacctagtagaatagcagttaaagactcagcacatttttaaagcaaaatctagggtattccgtcgggagaagttaaatttcttaccggcggctcttaaaatattccaaataatttctgaatttaattcaatgtcagaaagttgctgtttagggttgttcggttgctcattttcagaaatacaaaaagctttatgcaaacttagactgtaaaaattcatcatttaataatatgactttctatttattnaatgaacgacattaaagttttttatgcattttntagcataacataattgatttaccaatagtntaagatttattctttgccaattgaataatattataaatatgattttttgattttcaagacaatataatcaaaatcaaaattatctgttttgttgtcttgtgcttaatcaaatttcgtaatggactttcttgcccagactttgaaattatattgtggtaagatttcttataataattgaaagatcaatttgatttatgacaatctcaactagattaaaaaagtttagctgttattattaagtttacttaagacaataatatctgctattaggataattctcttgttttccgccgctctgaggcacttaggcttttgaaccagaccaaaattttattggtgaaatcaatttgctaaattcaaaataagaaatttattttaaaatttaatgtaagttattttatcagtttttcttgagtgcttaatatttgtggaaatttttatcaaaagttcaatataaatatcatttataaaaatattatgattaatgaaaactttttaatttcaatttctgctattaggataattctcttgttttctgccgctcatggtacttaggttttttgtaccagaccaaaattttactgatgaaatcaatttattattataagattaagtgcgtttaatatacgttgattcattatgtaaacttaattatgtctaggtagcttattatttaattaaatgatttcaaaaaaaattcgttaatatttagctattaa

SEQ ID NO: 2212 - DNA, 1926 bp, Heterodera glycines
tgctaagccaatgtttagtgtccaacaaatataaatatttattttgggtgcagacaatacaatttatttagaagaaaataaatgaagagaaattggggaagaacaataatgtcaattgcacaaaaagtgaactgaatagggaagagtgaacatgaatgagggaaagggggaatttaaataacaaacgaacagaggggaaaagaatatcgattgggtcaaagggcattgcgtgtggcgttatgttgaccacactcgaaagccaaagggcgctgcccctaacacctccccttttaagaagtgccgcttccgcttaatgagggctgtagcggtccggtggccgtcgattccgtcgagggtatactcggggagtgatcggcctttcctcattcggctgttcctcctgttcgatacgtccatcattctgttcttcgactgcccggccgatttcatcctcatcggcttcacttcgaacggcttcgtcttgaggctgtacatcttccggttcggctcttacctgcggtggaaggccgaagacatcattgaaaatgttcaattgttctgtcgtcttgtcctcaatttgccgtgggcgaatttggttggcatggtaccgattggtcgtaccatctgcgaatttaatgtcgtaaattacgccggtctttttaacgacttttcctggacgccaattctgcgaaattcggtgacgggcgaagactttgtcgcctgggccaaactctcttggtttggcgccaaatcttttgttgaaacgccgctccatcagttcatcacgctccattggctgaaactgcggcgggcgcaacaaatccaatgtggtcctcacttttcttccaaggaacgcttccgctggtgacttacactcttgtagtgtgtcatttggggtggtacggtatgccgtcagaaatgtttcaatgatttctgcgctaagggctccctccccttttaactttcggaaagttctcttgaaggagtccacaaatctttcggcttgtccgttcgacattgggttgtacggcgccgaaaaacaatgatttatgccgttgctctgagtaaaatcggcaaattctttgcttgaaaattgagtgccgttgtccgagacgattgtctctggaaggccatgtcggctgaagagataccgtaatttttggacggttgctgctgtggattttgtcggcatttcgaagacttcggggtacttcgagaatgcgtccacaatgagcaggtactcttttccataaaatgggccggcatagtccatgtgaatccgttgccatggtttgctcgccttcggccatgagtgcaactctgtttttatgggtgatttggccgcgagttggcaaggctcacaatttctaacgaaatcctcgatttccgcgtccaattttggccagtacacttggttccgcgccagttgcttcatccgttttattcctggatggcctttgtggagcattcgtaggactttcgctcgaaattttggtgggatgacgactcgttctccgtacatcagacattcttttgtgatggagaggtcatcttttcgacgaaagaacaattttatttcttccgtttccgaagcaattgctttatcattgggccatccatctctgacaaatttcttaacctttttgatggtttcgtcttcgttccctgctgaaattatgtccttcgatgagaatgacactgtttccaaagtgttgctgaagaaattttcggcttccttctcaaattccatggacgcgatgactcggtcttcttcaggactggtgctttttgcaatcagccttgagagcgcatccgcttgtccaaattctgtggtgttcacatactcaatctcgaagtcatacgccaacagcataagtgaccatcgtaaaagacggttagcactcatttggcggattccctttttgt

SEQ ID NO: 2213 - DNA, 2674 bp, Heterodera glycines
acacatatactgaatagcctttttgtggattttttcacgtggtgttcacctgtgtttctctttctttaaggaggtatttcattagcgtttccttgcaattattttgtttgaaatgattttatttttattttttagctttggctcggaaagtttcgtattttccacgcatattttttttaatcatcttttcttcggaatctcattgtatcagagtatgcactattctcatcataaacaatcatgtttaagtaggcttgatgttaatcggaattccgttttctgttaattatgcattagcgttagtggctgactttgtctcatatttatttaaacatagttgaattttccataatcataaatatgtaaatgtccggattatggttttatttcagtaatgtcaggggagtgtatttgtattcagtgtgacgacctaaatatgttccgtagatcatttcgtgaaattttcgcactgcgtaaatcaaagccaatccctctttttcaatttgggaataatttctttcagcgggtgtcaaagatgatgaggcgtgttcgatggccttaattgctccgtttggaaatcggtgggaaatgactgcgccaattccatgttctgaggcgtcagcggccacgatgatttccaattttgggtcatagtgcgtcaggagcaaatccgaggacaaaatttccttgattttaatgaatgctccttggcattctttgccccagtcccagtctttgtccttcttcagtagttcatccattggttggcggatgaatcgcatgttcttcacaaattgttgataatggtttaccattccaaggaacgtgcgaagtgacgggacgtcttttggtgctggcatattcgttattgccgcgattttgccttggtcgggtcgtcttccatctttgtcgatgatttggccaagatacttgatttgttcttggaaaaacgaacatttgtccattttgacccgaaatccccagctttggattcgttcgaacactttttccagattttgaaagtgctcttctttcgatttgctgacaattatgatgtcatcaaggtacgccgtcgcaaactcgagtccggccaggagcttatccataacggattgaaaaattcctggtgccgtcttcacaccgaatggcaatctgttgaatttgtagtagccacggtgggttgcgaccgtgcatagctttttcgcttcagcagtcaactcaatttgcaggtaggcatcttttaagtccacctgagagaagacttttccaccattcaacgtcgcaaaaatgtcatttggcaacggaagtgggtgctgatggtccaatagagcgttgttgaggcccgtcgagtagtcgatgcacatacgggctgttccgtcggccttcttcacgattagaatcggtgccgcccaatccgtgtgctcaacttttgtgatgattcctaggctctccaacctttccagctctttctcgacaacttcccgtgagttgtgaggtaccggcctagcctttctgaaaattggctgtgcgtccggttttaggaccaaatttgcttttgcctttgtgcaaaatccgagttcttctttgaacacgtcggggaaagcttttttcagcttggtgaggtattcgttgacctcggtgccttttggtcggattggagcgttgtcctttttaccgcctttgcacatattcaccatttttgaggaaatcttttccttcaattcgtcgagcagcccaaatgcgtccattgtttgaatagacagcaaatttagggaatctttgccggccacataaaattcttgttcaacattcactccgttgaattcgaatgtgccggtcccttttccgatgaagcttcttgtgcttccatcgtaaagcactgcttgttctttacaggctttgattttagggctgccgatcaatttgtatgtcatttcgtttatgacattaacttctgcaccgctgtcgaggacaaattcgatgactttgccttgaaaggagaccttgacccttagcaatgttgactttgttgtcggttttgctgtggtgccaatgttgactgttactatgtggacattgccaacatttttcttgagccaacttttggcgttctttttgcgccattcctgcactgcttcacaacgcaactcgatgtgtccgttttgtgagcactttcggcatttgtagcctttctgcgggcaagctgcgtggtgatggttcgtttgaccgcacctccagcatttttgttgctccgtctttgtgctttgttggctttttggtctctcatagttcggcttttctcgttttggatggactgcatttacggcatgacttcgttgacttcctagacgaagactcgatgactttggcctccgcaattgtagtcataaaattcatgcagtcctccaccaccgcatcatacgtgatgttgtctccatccgcggtcaatttggacagaattctttgccttagcattgcatcgccgtgcgatttgagcgctgtcagcaacatcaggacatagaactgttgttcttttaagtcgctgaatttgaaatccgtgatcaaacgcttgtgacggttgacaaaagatcggaagtcctctccctcccctttgcgggcgatcaagcactcaaaaaggtcgatgaagatcgattgaggcttggcgaacagcttc

SEQ ID NO: 2214 - DNA, 2150 bp, Heterodera glycines
  misc_feature (184)..(184): n is a, c, g, or t
gcagcagcaagtggggaggtcaccgggtgcgcctcacgcacccattgcctctgtagtgacagtatcagcagcagcagcagcagcagctgacgtgtggcgttgttgttgttgccgtacgtctttctcatgccctgccttctgctcaacggtgtcctcaaatatggtgtgaaggccaccgtagcgngttggggtgttgggatgtcgacggtgattgatgaggcggaggcatgaggccggagcggcggagccagtgtacaaccatcatccaacacagtaggaacattggcagcacgattgcgtagttggcgataaggaacagggtggacaaaatctgaacagccccatccactcttgcccccgccgcggtcatcgccgtcgttgatgtcacggcggcggctgacgtcgtgcctattagtgtgctggtggtgttgttcagcaacgcagcttctgttacagtgtatgctacgccgctaccgccgccggagatgacagcatctgccacgctgtcgtctgattcattagcgtgttgggtggcttaaaaattattattattattacatggaacggtgcgatgtgcacattgccaagacatgtaatgtaaaagataataaaaaacaaacaaaaatatgccaagacatgtaatgtaaaagataataaaaaacaaacaaaaatatgatgtcgaaaaaagcggagcggtggcaatgacgcgcgccgacatttccggaccggggtcgaacagcggatggggtaccatacgaccaccctcacgtggctcgtacaaaatcatccagcttaggtttgacattttggatttgttatcgtcaatatgtttatgatgatgatgatgatgttacgatttttggaaacagaatggtcttttacacaacggcaactttatttatgcaatttttgagtcagacacaatgtgacggttgtagtctatcattatcaactgatcaaattccccgagcacaaccatctcaacgccgccggccggaatctcttcgttgaaagcgagccgaatgctggtagtgccggagcggagcagttcaaagccgcagctgtcatccagcgtcgaggtcatgggcaccacaaaaattgtccatccgtcgcggaactggtccagcgtgatgtccatggagcgttcagagttggccatgcccagcgcctcgtacatgtcaacaaagggtcgaatgtaggcggcgccggaaaagtccatgcgatgcggcactgccgggtacatttgaccgccggcgtgcacgctgatctcacggatggagtatggcttgaagttgaacggtgactgcgccagctgtccgttgaacgccccgtttgccaccagcgcaatggtcaaccgacgggggatggcggcggaaaatatgttgtggtccatctcggtacggccggcggtcaggaacacggacttcacctccgtcttccgtaccgcgtaggtggccggctgcttctccagcgttttgtagatggacaggttcagcgagggttgcacctccaccaccttcatgtacagctttatgtcgtgcagatacaaggcatactgctgcctggccgctgctcctgccgccggcgctggcgccaggttttgcaacagaaaagtgttctttgcacggtagatggtgaacaggacgtccatgttgtttaataggtacagctcctggttgcccaggtcaaagtccaggcgggacaggaagcgagcctttcgtcctccctcaaagcgagcacagcgtgccatgaagccggcatccgtcgcgctgtcatgcttcagtgagggatggtagcccgcgctggccatgaaatgaccctttgcactgtttgggaaggacagctcattggtcagatacgccttgtaggggtacaatgtgccgctgtcatacaactcagtgttttgcacttcaacctaaatattggtaattttctgcaagtgaagagtgttcggatgttgtatgtgtgaccttgagttgttgaacaaacgtttgtccaatgcattggataggtccgacaagttggtctgccgcttcaattggtacccatcgtccgccagcgtcctccttttggatggacaactccagaaacaggtagacacgagacatgtcggcccacaggtgtcatgaacatgcggaacagatacggtc

SEQ ID NO: 2215 - DNA, 988 bp, Heterodera glycines
atgcgctttgtttcagttgcatttgcttatgccgtgccactttggacgatttggtgcccttagtcggcagtacttccggtgatttattatctgtcgaatctgctttctcaatgtgttttaattggtgtcttttgctgtttaggaatgctcctcgccttcgtttaccccgccttgatcgatttgttcacttttgtccctcattaccgtgcggaaggacatcgtcaaaaggcttgttttcgccttcttctgaacctttttcttgccagcgtcggattgtttggcatggtggccggtttatacgcgagcgtcagcaatttgataagtcatggatcgaatgaatgcaatgcgatgacgacgactgggacgccaactattatgtggaacctttataatgggacaactttgtctagcagtattcagtgatagcccttctgtttcatttgtaaatatgttgtatttgattgtctgtacataaacatatgaataaatttatctttgttaaaatgcatattttatcaatggaaaattttattttttcctttgggaattttgacgatgagcgaatataagggagagaacgatagttttagggaaaagtgacaaaatatttttttaattaattttaataaattaacacagaattttccgtttattcttttgatattttctctcttccgtccgatgattcaattgaccttttcattttaagttttcctttcgttttgcgccgtgaataaatgttttctttctaattgatttagtcctttaaattccctcgagaaaaatgggcaaaataattttcgattgacgtcgaattgagggaaaacgaaacgaacgaattaaacgcatcagccaaagcaaacgatttgttgtttttgtatacattttaatctcccattagtcaatcaccttctttcgtctgatcgtcgcaaattaacgcccccaaaatatttatggtccatttaatttaattttgcccccccccccc

SEQ ID NO: 2216 - DNA, 6452 bp, Heterodera glycines
  misc_feature (6394)..(6395): n is a, c, g, or t
  misc_feature (6404)..(6404): n is a, c, g, or t
tcggattgtttggcatggtggccggtttatacgcgagcgtcagcaatttgataagtcatggatcgaatgaatgcgatgcgacgacgacgactgggacgccaactattatgtggaacctttataatgggacaactttgtctagcagtattcagtgatcgcccttctgtttcatttgtaaatatgttgtatttgattgtctgtacataaacatatgaataataaatttatctttgttaaaatgcatattttatcaatggaaaattttattttttcctttgggaattttgacgatgagcgaatataagggagagaacgatagttttagggaaaagtgacaaaatatatttttaaattaattttaataaattaacacagaatttttcgtttattcttttgatattttctctcttccgtccgatgattcaattgaccttttcattttaagttttcctttcgttttgcgccgtgaataaatgttttctttctaattgatttggtcctttaaattccctcgagaaaaatgggcaaaataattttcgattgacgtcgaattgagggaaaacgaaacgaacgaattaaacgcatcagccaaagcaaacgatttgttgtttttgtatacattttaatctcccaattagtcaatcgccttctttcgtctgatcgtcgcaaattaacgcccccaaaatatttatggtccatttaatttaatttgcccccccccccctcagtcattcctttcaatttttagtccaaatattctccgaattatggccaaattgcgcaccctttgcttttacgttttaattctctttctgttcggcttcaccgtctttgatgttcaaaaaattgtaaattattacaaatttaaatttcgaattctgtcgttttattaattcattgtgtgctgtgccgttaaggtcttccaattcttagacgataacaaagaaacggacatgttcgtggtgttcaacgacacaatgacaatgccaaatgtttgtttgtcttgtggatttgttactgtagaaagtgtcaaacggttacagtaccattcagataactttttgcatttccaaaaaccacgcgtggagtcatttcaaaaccacaaatgtgagtgacagcgaaattgacgacattgtgcaggtgagacgatgatgaatccacacagaaaaggacgactgaaattggagaaatttaaaaaacaatggaaagggaatactgtatgattgggatgggactgtaatcattgcttgggcatactgtagtgggacgttttaaaagaatactgaatccatctagaggggtaccgtaatgagaggagtgaacgaattccacgaccaattatgaaggagtacggtattttatttatttaaatgctacagaaaggtctaaagaagatgagaaacaaaagcgatttcctgagcagtccctgggacgatctgatggtggtcgacgcctttcaggtgaccgaccgttcgttcggctgacagagaaaaatcgccgaaattccatttgcgaattttaagacaatttcttctctgaattcgatggaagtcgaaacgaatccgacagtttttgcgatgactgtgcaaaaaattgggcaaactcagcgaatggccaatgtccgaaagatgtggcaagtaatgtccttgttcagcggttttagcattttccgtgccatttccattggcactctcttccacacagaaatggaacgacgccgtcgcgcaaagggacgtcactttcgacgaatttaggcaaaaggtcggctcggaaacggtgaaacggtgagaaaatgccgtagagaaaaagcaaacgaacgaagcgacagatcgttgaaaaatttccaacggatgggcggcggcgccaattggaggcctatccaggacgtcaaaatcacttggatttcactacgccaaatgtgcttccagccgctatacagcccggacgaattcaaagaccattgaagaacaggtcagagaaagagagggcggtgcagaaacagagaaagaagggagagagagtaaaaggaagagagagactggggataacgaaagagaggaagagagaatggaaagaggggaagagagagagagatatgtgaatctagggaggaagataaagcagtaattagagaggcgaagaggaatgaaaagggatggaaaggggatttagagagaatggagagaaagagattaagagagggtggaaaagaaagataaagacagagagagggaggaaagataatgaaaaggaaggggaaaattgccatttttcttgaggatcaattcttcaaaatgcttatcgttcacggaaaagaatacgagtcgttggactgcatgagcatcgacttccacggtcggcccggggaggaggcgcgctatttggggccgaagggacggacgaacgatggcacggacggagacgtacggacgaggggggcaattgaatttgggttaaaattctgttttttcagctctgtctgtccgaatcacacgaaattgtcgcggaagtgaaagaaatacagactttgctgccgggcgcggaagaagcggaagaaaaatgcatggaatacgggggggaggagcagttcgggacggagttggagtgccatggccaatgccgacttggcctaattcgggtcagctaaataccatttttggttggctgatcagagaactccctccaattttgcaatttaaaatttcaaaaatggactttttgatcaaaaaccatcatccgttagcaaattgaaaaattttgtgaatgtttcagaaaatttgcaaatgcaccgctcgcactttggaaagcctcgccgattcggaaactctacagaattttcccctttgtgactatgcgaaatgcaatttgaagttaaatggaaaaaaacaattaaaaagggtaattagtgaaattaagtgccaccgaagaagcattggaaaattgggaagcgacgctgaaaaattgcacgacggagtgtctgccgaattgtagccaaatcagattcagaataagcaaaaagacgaaaagcgcacagagagacggtgagaaaggaaaagcgaagggcaaagaaagggaaatgaggaaaagcatttcagacagcacagaagtgaagctgttctggggctcgttcgagtatttgcgactgatccaaaagcagaaatggtccttcaacaaattcgtctccaacctcggcggctctttgggcgtttggttgggcctttcggtggtttccatcattcaggtcgctgttttcaaagagcaaatgaatcattttgccatttttcaatttttggcttttcattttgccatttttcaatttttggcttttcattttgccattttcccttttcagttcatttcttttatgctcctccgactgcacaaaatgatgcacaaagaaagtgccgtcgaaggcgaagaaacggagagacagaacgaaccgcgtgaaatgccctcgccctcccgcgccggcggagacaccgaaatttcgatgagtccgatggacggcggcggagggcagcggaagaagcgatgatcggctaattatgcacactaatgggatatatgacgtcaaagcagtcaaacctaaacaccaattcatgccatcattaggggcgactgatcgataaaagaaaataaaaataaaatgggcgctgtctcaggccaaatgaaggcgaaacgctggcaaatcattgatttaaaaagcataatttacaaaataaataaaataaatgggcaattaaattccattcattcgtttgcctttatatcataaaaccaaaattcattttgtctgatctccaaaatgagtttttcatctttgccactgcaaatgctaataatttccacggctttcactggcggcgccattttggatttaattggagaagaaacggaaaagtttatccaatttaaggtttggttgggaaggggcttttgattttgcaacgcttaaaacatttgcccgaaaggtgcttccacccggcccatacaaactgattttttggaataaattcagcaagcgattttatggcgatttggacccctcaaaattattcaccaccgacgccaatggcaatttgaaattcaaattgggcgccctcagaaggaataaagaaacagcgatcagcgaacgcttcttcgacaaaatgctccaaagcgcacagacggaaaatggcgaattcataatcagaaaaagcgaagcgaacggaggcaacggacaaacgcacgtgacaattgtgccattggacatggaaatggtaaacaatggcattttaaaatgggaaacaaaggcaacaaatgggaaaagcctccgagtgttaaggagccttttgcgttgggagcagctgaagaacgggtgacagacaacgctgaacaaacggaccgatggataaacaccgatcggtgccccagccctaccgtactccattaccatagcattgagcgaaggaatgaaattgcgctgggaatgttcgaccgttggttgcttgacaatggcaattcgttgagtcgagccgactgcttctttgtggaggcgtatctacagcaaatggacacccatttgaagcagctaattcacgcgacaaaaggacgcccgcccgccgccgcagtcactaattatcctaatgattattaattaattacacgctttcattcattaaatgtgttggcgcctgccatttatgatgttctttcaaagttgcaggatcaagcgacggatttcgagttgtacttcgaatttggcgccaaactgtcaatggcgttccgttcgggccaattggccgaccgtgtgctgatgatcgacggaattatggtggccattcagacactttgtgtgaccatcgcaacttttcggcggattgtttggcggcaaaaacaattcgaaaaattggagcattgggacggaatttgcttgcatttgaatgaattgcgaactgttgcggagtcgctggccattaaccgttggctgaccatcggcggaggggaaattgctgatcagccattgcaaatgggcgatgcgaatgcattggccgatttagtggaacatttgctcttccaaacgcaattaatggcgaacaatggcaacggacaaatgcagcaggagcagcagaaatggcacaagagcacttcggcactttccatcgaagagcaaataaatcagcagcaggtgcaacaaaagtggcactcttttgtcggccatttgtccctttaggcaaaaatattcgccgaattgggacaaaagttagaaaaagcccgaaaaacgaatgctcaatgggcgggacgagtggcagcagtgagcggaatgttggacctgctcaactcattatgcgaaacaaaaagtgccattgcgacgaattgcggcgattgttcgagtgaatggacacgcgcaatcgaagcatggaattcgttttgcccgcacttggacgaagcacaaaatgaacgggttttgggtagtgttgaacgatggctgaaaggggaggaggaggtggtgccggacgagaactcgttgatggagatgaatttggaacatttggtggagaaaatggagccgtacggagatgcacagctggacgggggagacgtcgcactgctgcacaaaatcggactcgaattggccaaggcaaaggaggagaagcggctggcaggaagagtgatgacggctcctggcatttgggatcaactctcgaacatttgcattctgatcggagggtttgtcggtcgggcacagaccgcgactgaaaagcagcagatcacggcactgacaatgtgctgggagaacgcactctgtggccaattggaagagatttatgtgagtgcggtgatgaacgcgttggagcggtggcgcgccggggcgaccaatggcaccgacgcgggagtaatcattggaggcagcagaaaggcactgcaaacgatgaacagagtggcgagcgaagagggacaacacaatgagcggcaaaaaacggccatttcaaagacagagatggcattgatcgctgaattgggggcatatttcgcggaagtgatcgaagcgcagagaaaggcgggggcccaatggaaggagatgagaaaaacggaaccgatcgttggcatggacaaaatgctgaagaaacagtgcaaaaggtcagtcggaaggaccaagcaaacaaaagagagaatttattgtttaagttggacagaatttcgccggaaaattccgccagagaatcggaaaatgttcattagttggtcaaaaatttgtaaaactatgaatttaaaggagacgaaaaaagaaaacaatgagcaaattcgggacaaaatggaggaaaatatattaatgaaaagagaggaagaaaaaaaggaaaagaaaagcacaaagaagagaaaggatgaaaagccgaacaattaaattatgaannctgacttantttccattttattataccgctcttcgcgaccgacgactggtcgatgac

SEQ ID NO: 2217 - DNA, 3215 bp, Heterodera glycines
tctggattacaaaatcgcaaatttacccataatgtagttttaaattctacctcctttatctggaatttttagattctgtttttgcggtctttccaatgacaagaggaaagagttttgaggatgataacgaacccaaatgcagagagaaaggggtacgacctcaaaagaaggatttgctaactcgtttcttaagaatgagcgtcctttgcctgtcgatagttggctcggcactcaccgccaccttcaagtctttcctcccctaaaatgccataaaagctctcccttccctacccaccaaaggccgccgttgctgccattgaggaccgcatgttgttcttccgtttgtgcgaggagttggacggccgtggcatttcctacgagcgagtcgttgccgaaagaaccgtcggtggccatttgctgcgactgaccgagtgaaaagtgccgaaattcattaacatcactcggactttaagcatttctgccttgggccttcgccatgcgctcgaatctgcggacttcttcaacaatttgctgcactgcaacattcgcttgacacagtccttccccgagcgaaggtcgccccccccccctttgacgctgaatttgtgcgcttttacaatttccagtcaactcgagtgcacttttgtcaatccgccgttggtgcccgattttaataagaccgaggcggaggtggaggccgacaggagaagagtgagtggctttttgactcatttggcattcgaatgagagttggacattgtacagccccacacttgggtccaacccatcggcaccgttcttccgccgtcgcatttctcccgtgctaaaatgttggcggcggctgaccagcgacaggacgcggacaaaacggacaacacaccgcagggaggggcgccgctgatgagccaagtgagtgaggggacgcatccgcaaaaaagggacgagaaaaaccaattcgaaatagatatcaatcgctttgtaccttaacgagctcggcatcttgaaaaaagcttgcacctgggttccatattggacctggacatggacccaggaaaatccaggccttggccatatccatgccaaactaataatacacctcaaaatatttatggttatttttgaggatcattttgggttgattttgtttaggtgattgcccagaacattgaggaccgactgatcacttactgtcaaatttacgttccgatcaggcgattttcaactgcttactacgcacactttcggcatttttgcaacgttgttgaataattaattataaatggtatgttaaccaaacattttcaggtccgtaccttcgcctatttcaaactttcgttggcgtacggcgatgatcgcgaaatgctttttgttttggcctggcgttggcagaaatattcgctttgcttcggacaggcgcctgtgcccgcggggagcgcgtgggacggacgaaaagcggcgcgacggtgggaaaggggggaagaaacagccaaattcaaaagcgaatgaaacacacgtttatttaaggggcatttaaagaaatccatttcatccgccctttcagttttttctgattttgtgcccctcttaaaggcgttggaatccgcatgtgctcgtcactcagtcgctcacagaacgtttcaaccgcgacaaggacctgacttggctagttaattacctggtatttaaattttcttgcattttgaggatcattataattgtaccactaataataccaaaaaggagatattttttctaaatctcatgggggaggggacttttatgacaattcataaagttttaaacaaatctatcggggtttttggcgtcgcttatccgagacagaaatccatttgataaattccgaacgaatatgaaacttatttttattttgtggattttcttttagaaattatgaatcggcattaataaagcccttttgatcagatcaacacgcatcgttccctttgctcaatttacgatttcgcacgcacccaaatgcattccacgaaaacggcggcccaagtgcacggcacagaagccgcttttccggctgaactgatggtaataatttaatgggaccaaacagtccttccatgtttccgatgtggcaccatcagagacttttttcaacaaaattttatgatgaattactgtttttcaaaaaaaattcaaaaaccgttgaaatttttcaaaattttttttcacaatttctgtttgatcctttccctcccccgacagtgccatctcagtgccttggatgagagtaccattcgtctctcatacggctctcggctggccatggaatttcttcttctggacgacaaccgcgtggctgtccgcgactgcagcgtcggttccgcgcgctctatcggcggcggcggtccttcgctggccgacttttggcatttttggcgacaaaaaatgtgtgatggcatgtcccctgaggacgaaaatggggagggaattgggagacaaagaaagcaagagatggacatggacaccaactactgaatcaccattttttgatattttatttacaacgttcagtctttccttcctctatctctctcttttttcattcattttcattgtatctttttttttaaatttgttatcatgtttttctgtcctttgtttatgccaaatgtatttacctagttattttttaagaataaaaaatataaaatttgtttttcccatacaaaaattattggtaatgcttttttgttgttgtccatatgcgttttttcttccatcgatttgtgttgttcgttttaatatttttcgtgtccactgattttactgtgcatcgaaaggacagaaaagaaggaaaaggcgggcaaaggaccgaccgaccgaagacgccaccgccgcaatgcccggcggatccttcccgccccttcccccgacgacgtcagccaccgccaaacccaccaaacaggtcgttcgttgttcattcattcgttcgctggccgcccccattcaatcgcccgtcgatgacatttcatttctctgtttttctttggctttgctttttcccctttcgttggcatttgcctgttgcccttttctcatctttaatattttaagtgccgcctcggataatctcttcccttctcacattgattttggtgcgctcttttcgacaattacaaatatttattttctaaaaaaggagggctttccatcaattgaacgtcgttcccattttcccc

SEQ ID NO: 2218 - DNA, 3415 bp, Heterodera glycines
tttcccccaattcttcgttttgcccccccccccccccaaattcgccgccgtttcatccctttttcccctttttgcgttttcattttttaaattatatattttattaagcgtcaccaaaagtcctcttcttcctccgcttcgcattcgcctcattccgactccgtcctcttcctgcacacctccgtcaacagcaccaaacagcagcaacaggaacaacaccggcaacggcccgtctctgtcccgccgtcaattggccctggcgtttttgcagaatttgacagcaccgaaggcggagcagcaacagccgctgatacgatgaattttctcactgaggtgaaagcgcagtgccaaacggtcatccttcagttcattcacaagccgatgcaactgaccacgctcagtttgttggcccataccaccctttcttgaaatgtctgcatttttttatgccattacaaattagtctaaagagaaatggtccaccaaactgaggagaccggacccttaactaattttgatggtttctgtttcaactgtacgattgcagaagagttcgacaacccccgcaatgtccgctttgctcggccgacagccgacgatcaccgaagacgaagagaatgagcgggaggaagacgaggagcccatttcaatggcaattcaaaacatggcagacagcccataacccatttgttccgttgcttttagcctgattttggtgctgcggtgacgcgcattgtttccgatttcggcgctggtcgtgtcaaaagtgaggcgcacgaggaagtgattatgatggaggacgatgtccgccaccaacaacagcagcaaatgccgcgttttgctggcaaattaattggcgacggtggcgaatgtcgcgatggaagtgccgaaggcgccgcccattcgatacatttgaaacgggaggaggaggacgccgcgggagccgaacaacagcggcagagggaagaagcggaagacgcggcggatttgggcgcggacgcactcaaagcacggcgagcagcgcggcagcggaaacgcgagccggtggtggtcgggtggcgcacattggagaaggcaatgcgaacgacggccgaaggtgggcgacagaagggggagcaacagacaatgtacacggccagggggacaaaggacccaaaattaatgaaaaacaattggagtggggagagagaattcaaattaaattattgtaaatatatgtggtaaagtcagaaatatttttccaaattgttgctaaaaagaatttcattcgtttccctcaaattcccaacttcgctgatttttcagattgggtttaatttttaggacgggccaaatttagaaaaatatacgcttacaaattgctaatggacatttttatgatgaaatctgcttcaatttttcctgacgcatatcgacacccctccacagaaatttgttgaaaaacatcccgcaaaaaatactaaatttttttggattttgaagaaaatctgaattttgcttaatttgaagcaagctatgattttcctcaaaattttgcgaaattccttcaaatccccgtgcaaaaattgaagcattgaactcccccaccctcatttttgtattcataaattgaacttgatgaatttactttgaaaagtgcagacagtgacatgtctccgctggagcaattccttctcggctccacgctgctctcccgtctctgttccttcttcgaaatggcatttgccgaagcacagcgccaacagcgcgggaaattcaaattgccaatcaaagactacggagttggcactgacggagtgatgagcgcgacatttccgaggtgattagtcccacaaaacaaagcgattgtttttttttaaatttaaaaacttaaattgattgaaaatgaccaaattgaatcgggttttaacctaattttttttaaagaaaaccaaggggtttacgcacccggtttttagttcgggatttcttcgatttcattactctattcattcatagaaatccctattttgctttttgttcaattcggattaggttcgaaatggatcccaacaaaatggttattcttccatctgaaaaatctccaaaaacagacagtttccaaaaaacattcggcgctgtactttcaaataggaacgtgccgaacccgtcccttttttgtccatgctatctgatcacttttgtatcgctctctgctgtccttcagttaccccatgcccccgtccctcgcttcttcctcgctgcccaatgcgctcggttcgcccggtgaccattctgtccaccagcagtttcacccctccacccattgtatggttcgtctccaactgttcgtctgtccgcagcagttccgtttggtctccatgttggactatggttgtgtgtctcttcgtcaccacttttctttgtccatgtatcttccacccaatgccattttagccaccggcccccaatgtccggctgagtcggacgtgcgcattttcgagcgatttttcgcccgcgaagtcgtccgtatgaacaacgaattggccgtgttcgctttcgtcactctgtgccgtttttgtcacccgccaattttcgcctcctttgcccaactgatgatggcccaaatggtaagaaaaaaggccgagcgctgtttttgatttatttcgtattgcaaaaaggagtcccaaccccggtggccatggcgtgtcgaattggaattggtacacaacgccgaggaatcggcccaacccacgggagccaactctcatcagcagcagcagaagacgcaaaagatcgtcaaaaacagcattcaggcagcaataaaaacataaacgaaatagggagtcaaaatgagcgacccttttcaacaaggacagaaaaaaggaactgtacttttttcttaaaattctctaaaaaggtctggctactaaagaccgtaacagagtcgaaacatgtcagggttttcccgcggtgcgtatcctataatctggtcccgaaaaaaacaattgaccctgaaatctggtctggatgcatcctccggattgagttggatcacgatttgtttttctgggtttggcacaatgccatcttttttttattcacaaatacactcaccaaaaaaaagtcttgggacaaaaatgccaaaattggcaaaaaccaattaactctgcaatactaatgcgtctatgtccggttcagttcattgatcctgaatttttgagatattccgggctctattatctatgtctctgagcttacaacaattagctatagcttgtgatagcttctaaaaatgccgcgtcaacccgtttagcttggagacattgaaagagattctcaggtgcctgacatgtgcaaacgctttgtgtttgtgatttggttgaggccgcaatggcaaaacggggcaaattgccaactgcagccaacgcaacaa

SEQ ID NO: 2219 - DNA, 9565 bp, Heterodera glycines
tttttcaatttttccatttgtcagaccgccattctgttgaccaccaacttgttcggcattttcttcatttacccggcattcattgcgttggatttgaagcggcgcaaggcgggccgacgcgacttggaatttctgtgctattactgcctttgtgtggacgacgacgacaacgtcgacgcggaaacggcgcacaaaattcggcgttccgacgtaataaaaaaacagatcgggaaattgttgtgccatcttaccataattaggcattttgaaaaagcctgggcttggacttgggttccatgttgcgcatgaatttcttggacaaaaatataggaaaatccatgcttggttcattgcccacgtggatttattcaaacagagactgtttttgatacagtacttgtggtccatgacagtaatcaggacaagaacatgtccaaaatggacatgaaaatggccaaaaatgatgataaaaacccactctaaactttaatatagttgtttattgtgtgcagcatttatggccaaaaattacgaggaataacactttccatggagtgcccgtcaatgcacctttccatggtcttacagttccaacaaaatattaatttaaatacaattgaaaaccaaatataaattattttcttcaatttcgccgacgaattaaaaaaaaaatttcaaacttagaaaaaatttcttcggcgaaattttgtttcggcaaaacttttcataaaaaatacatatccctttgttttccccaagtgccaaaaaggggtggtgcacaaattgatggcggagacggcggacgacgaccacaagccggacaaaaagcgtgtgcccgcggagccacggtttggcacaacggcggaggaggaggacggcacggagccggaggatgagcaccacccgcaccatggccagcagaagccgtactttgcccgctgctcgttcaagccgatggtcattggacggacggcgccgagtgccgtcaaatatgtgcagcagccgaacggaaatcccaccggcgacggcactgtcattgtgcaaatgccaggggttagtacaaacggatggaaaatgtggcaaaattagtggtgtaacgatgcccgaaacaaaaaatttgggaatttgttaaaagatatatcaaattgattagtcgccactgttggtcaaacaaccaattaattagttttgccataaatgatttaaaatttatccattgttggcaaatatttaaatttaagcttgtcggtacatcccaaaaacgtcaccgcaaaaaaaaaaacaaacaaactttttaaaaattgttttaaaagttattttcaaaaatctaggtgttatttaaagaaacttgctatatttcaagggagaaaaacgaaaattggttcatttccgattaataatcgaccatgaacagcctttaaatatattttttaccaaaataactattttctattatttacaattgcttcaaaaatttcagtctcacaaaacgcgacgccgacgcccagcgcagaaacagtacaaaatttacactttgcacggttttttgcacattgtgtacattccgttgctgaggcgaagggctgtcaaagtgagtttggatgtcataaatttttttttaacaaattcatccttttggaatttgaaaattcagatttttaaattacaatttaaaaaaaaacgaaaatgacttttatctaagaaaattcaaaaaacaaaataaacaaatttcagcgatctgttgaaaattttttgaaaacagtaactcattcattatacagtaaaaacttgaaaaaatagttggaaacatttttttttaatttatggccctttccatccaattttaaaaattttctaattatttcttcggttttttttactaattacccccctcccaaaattgtgcccagtttgccattctcgtcacgatggtggcactgttcgctctcggcatttacggcctcagccgttcgaccatcggtctcgagctcagcgacgtgttgccggacaacacggcgccggccgccttcctgaaaacgcgcgacaaattattctccttctacccaatggcggtggtcattcgcggggcaaacgtcgattttgcagcgcaacagcaccaaattgacctgctgagacgggacattggtggggaaacggacggacggaataaattacaaaaatttgaattttggcatagaaaaacatttttaaaaacctaaaaacaaaaaggtttaactattgagtgcattctaaaatatcgtcgcccgaatgccgagaagaaatctcgccaccaatttaaaaaaaaaattatatttttgaatttttttctggaaaatttttttttgaaaatttttcaaaaaaaaattcagtgacgagatttttttcccgtatacgaaataatgcaatttttctaatttaaaataagaaattaatttggcattttcaggcttgtcaccatttgtggtcaaactgccggacggcgagccgagtgagtttttttttttaatttttacatattaaaatgttttttaattaatttcattcaaaaataataaaaaaatgaaataaaaatgggggatggcactttcgcccttcattcctttccctgaaatttaaaaagatttccaaaaattcgattaaaatttgtgcattttgccgtgccgttcaggtgaacgctattggctccagttgttccgcgattggctgcgcggtatgcaacagcggctggacgtggcgaagcgggacggactgttggacaattttgacggggatggcacaacgccaatgacggcgacaacaaatgcaagcagtacatccgcagcagcaacgacaccgaaggcgaaacatcattcgcccgacctgcaaattgcctattcgttggcctgctcctacgggcagaactacgactgtgctagggtgagtttttcaaaaaaaaaaaaccttgggatttttagtaaattttttgcctacaaaaaaaaattttaaaaaattgcggctaatgattcgaaaccatgttttttaatgacttttcgtccatgcttttgaaaaaatgaaatttccatgtagagctgctatcttctgttaaattggttgcatttggaaaaaatttacgaatttttcattgttaccgaaataaaaaaaaaaattccagaatcaaaattgcctccttttttttcctgtaaggccggcacagtgcgtctgattgatgagagcggcacaatcaacacggaaggcttctacaactatttgtatggatggcacgaatacgaacaaatggtatggggttgccctcctaattttactgtttttttctcgaatttttttatgaaaattttgaaaattaatcaaaaaatgtagaaaatttcccttcctttcagttctattccgtctctcaggccagcttctacccccgtcttcgcaagttgcgccagggaccgcctgggcctatgaaatatgtgcgttttagcagtttcaatcttaaaaaggactatttcgtgattttaattacgaaaattagtgctccgactttaaaaatttaagaaaattgccagaaaattcttccaaaaattaccattaaaaaactcattgtcgggcctcaattaatattttacactttataataatttatttttaaattttttttcccaatttgtccctcccatttcagcgctattttcattccgccggcgccgaagccgttgttcagccgaattccgttttactgtgacgggttgcgcgacacgccgaccatcatgcgcatgatccgcgagatcagggcaatcagcgaaaattacagccgcgcgggcctgccaaattacccggaaggtgtttttttggaaatttgggaaatttttaggggaaaacaccaaattttattaatttttcaaggcgtcgcttttaccttttgggagcagtatttgcacttggactactacttggtgttggctattggtgtaagtttttctttcttttttgatgaacaattattataagaaaaataaaatattcgactaaaagttaaaggagtttttcataacttttgcttgattatttcttaattaaaaagcaaaaaaaaaaatttttttatttaattttttaaaaatttttacaatttaatcacgtaaaaaatgaaaacaataagtcgctgaatacttcaaaagtttcttattgaaatatattaattgatgcatttattttagatcatttccgtgtccgtcttctgcgttatctccaccatcattttcaacccgtgggcgccgctttggtttgttacaaaaaaaaaaaaaagttttttttttgtctggccgaggccccaaccccattctcctgtatacaatttgttaaattttttggtcattcaaattctccaaacctttctaaatgtgtttctgacaaataaatcatattttgtttattttgacatggtcgatcttttgttcgctaattacttttccgcttttccgatcacttcttctgatcacatcatttcatgtccactttttaacttatttctgattatttctctcgtctctaatcactttccccattccaccatccgatcacatcactgacatcaaatcatacaatttcctttttctgatcgttcccgctcattcagagcacttcctaatcatttgtttctttgctttgctttttcctttttctgatcacttaccatttatccccaaacaacacaggtcacctgcgttgtggccagcatgaccgtggagttggccggcttcatgggccttgcgggcgtcaagctgaacccgatttcgtccgtcactctgatcaccgctgtcggcatcggtgtcgagttcactgcacatgttgcgctcgcatttctcacctcgttgggcacccgggaggagcggatggtcaatgcttgcagcacatgttcgtgccggtcatccacggcggcatgtccaccctgctggtcagtcagtcattcaatcagcaggctgaaagtgggaaatgccagaaaattaaaaatttcaataaaaatgaaaaaattttctctatttttaaaaattttagaaaaaaacctgccagaaaatttttttaaagtcgctgaaaatattttccattttttttgaaaattctttgaaaattcgggcgcctttgattttgaacacattcatttgcttgtattgaatttaccaaatatggtttaaaacagagtgaccaattacggttttaattaatctcttctttttcttccagggcatcatcatgttggcgttttccgactttgattttgtcgtccaatacttctttgttgtgctgactgcgctcgtcatcattggcctgttcaacggacttgctgttctgcctgtactgcttgcctatgtgggcccgccttgcgaggtgggcaaataaaactatgttattaatcgaaacataatttttttttaaatttttattgtaattagacccgcatggaattcaatgaaacccggaaaaatttatgatttgccgagatctcgatcccaatcagtcgcaatagtgaatatggaaaaggatatcggcagctttaagctcaaatggaactgttgctttttacagataaagccgattagcggacgacgaaatcgactgccgtttccgtcttcggcacgtgagcttcgggaaaggcaccgatcagcaacagaagtggtcaccaccacccaagacaacaacaacatcgctaattgaagacgcttcgttcaatctttgatggatgcaattgcaatttgccacgaattttgaatcatttttcatccctattttgaccaattaacatcaaaaacattttccactgacaccgatttcaatgattaatgattagacatacaaatgactgaccctcacgcagtgtttcccattttaattaattatttttttttgaatttaattaattttaaacgggcaaattaattgttcctaaaatttaaagatctataaatggcttttagttcaagcttttcatcaatattgactttaattaaaaaattggtaacactgcgtccgaatcttattattatttttaatatataatgtgcattcaattaattaattggataatatgataatcctttccgtccagcagttttttccgagtgcttgtgccattttttcattgtttttttttctttaggcattatttcacatttctttacacacccaatttgtttaaacgttcatttttagagcgattttttgccgtcattttaaaagtgccaaaaaattagggcaaaccattttttaatgtaaaaatcgcttttatttactgagctttaacttatatttgacttttcgatgttgtaatattttgttttctgctgatccaattattaccgtaatttatctcgtgtttttcctattaatttgatcatttcgttttgttcacttttgctttaaatgtaaattataatcatttatcgctgttgagcttcgttttattttgtgtgaccgaagaataaaaaatgcaatgcaaaaataaattaccattatcaaaatgggttttgagtagagttggtcggaaccgggactggtactgaaaaaaacgggtacaactgagtacccagtcccggttttgacaagttttgaccgggaccgggaaattcccgggttttttcccggttttcccagccaaaagtcccggtttttcaacccgaaaattcccggtcccgtttttgtcaaaattcccggtcccgaccaaccctagttttgaggaaaataatgtcctattttttatgtcaaaaatatgtgaaataaattttaattgaataaaaataattctaacatattattagggattcttttttaggtacaaaaaatcgcgaaataggcttttaaaatattttgtgactgaaccataacaaaaactaatgaaaagaattttgatcagaaccccatattgtcagcatattttttccgggttgagagaaaacttttggattggaaattttgaagaatgcccaaattgctcttaaaggatgcttcgagacgagggggaaaatatattcgaacaacaaaaaaaaacaatcaaatgagcaaaaattagcatcaaaaatacaatatccattcaataatctccaaaatagccaatcatttctcaattataattcacttccgcacagttcgattccctttttcgttgttttgactcgcttctttcgtcgttcctaaattaggtgcaatttgaatttgtgaatgccgtggaaatagtagtaagtaagtaaatgatcggagttttgaaattaagacggggccgtgacttggaaaatagactgggagcacttcgccaaatatatttttaaaatttttcaaatttaggtccatttccttcatcgagttgatgtttgggccctgactttaagatgttttagtttttaaaacccaaatggcaggacaaaaagtggggccaaatccatccgccaagtgttaggaaaataaaaaatttaggacatataaattcgtatcttggccaattttcaatcaaattaataattcttggtatcattcaatagctttaaatgttgtctatgagaatattaatttctaaaatttttatatgaaattataaaaaagttatggccattttatttggacttaattgcactttaatgacttgaaaattttaatgtttataattatatttgcatgaccatggcaaaaaacaaagcctattcaatgctttataattttttcagaagcaatatttttagaatttcaagtactctatttatctatttattgtttaggacaaaaaattccgacataagattttttggaatttaataaccataacttttttatactatttaaaaaaaaaattgaaaattaatattctgatagataacacatagaaccattgaatgataccataaatactattttggttgaaattcaccaagttgtgaatttatatactatacgttttttgtttttctatccctaggaagggtttaggaaacgacctagcacctttcgaaacattgaaagaattttccaggtacattttcatgcgaagtaaaagtgactgggaattgtttttaaattttctttttaattttttaattatataaatccaattcctttttattgaaataaccttttcatctctcctccaacatggccctgatcagtgccgccgcatctctcacgcattctcccttcacatttttcttcactttcttttcaaacttcataaactctgtcttattttctgttgacagaacaacagtgctttttcgcgctttcgccgccgccatcactttatagcgaaggccaccaaccttgccaatttgtttgttttttctgatcaccgctgatacggctatgtttttcttcacaaaaagcccactggccaaagcatacaacgcgattaaaatcgctgccgacccagatttgccgaacatctttccatcatcttctgggcccactggtggggctaacacctcgattttcgtggtctcgaaaaaaggtcctccatttgcttggcgaaagatgctttttgcaacttcgtacgctgtttgccatgattgctttaaaagagtttctgatgatggtcatatttagcaaccgaaaattcaatcctagacactcattagcaaaaaatacatacgaattcaggaaattttagaacatttcagtccgaaattcctggttattaatttttaaaggttcaagaaattagatttttactaatcacattgccattcaccgaatgagcggacgggccaacgagtctttttagtgtgaccatttattgtgagtgtcaaatgaaaatcaaccttttttattaacaacaatatgtatacatatgtggaattaaatactatattattctcaatttcgcagttccgaattggtttagccaaaatgaatgtcgtgataagcgacccaaaaccccagaaatagttttcatgtcacctgaacacaaaaaaaaaaaaaaattcaattaattgatctgagctcagcaggtccctaatcggtgtattttttcacactagaaaaatcaaatgaaaaatatttattttgttttcctccgggtcaccaattctccagtgttaccaaattacgcataccacttcccgtgaacgggtcaaactaaaatttttctattagcttttctgaaagtgttaagagccaacaagcatgcgatgattagataaattatggctatttcctcaaaatgggatgttatatcctggttttggtccagtgtattttgaaaaagctcaggagcatacatgaacaacggctgcgccaggacaaatttttcgtacgaaggcccccaattttctccggcggtgacctttttttgctattcaaaccacttttttgcgaccattttttcaccttttttttgcggtgcgcttttttcaaaaattatgcgaaaccggagggggtagcggggtccggtggtccagagagccgataggcgccgccggggaaatttttttaatgaatttcgcttaggaaattgttcttttaatttttcccccttcgttatgcccatccccctccccacgacgaacccccccggggggggggggggagaattgagtgtgataatagg

SEQ ID NO: 2220 - DNA, 1663 bp, Heterodera glycines
  misc_feature (1653)..(1653): n is a, c, g, or t
tttttgcggcgcgtttttccaaaaaattttttgcgccagcctcttacgacgagcggcggggttgggggagaggtgcgccggcgcaccccttgtttcacctatgcgcaggagccagtttaaaacagttaaaacaggacagaagaaaatattattttgccccgcggcactcagggttcacaggaagtggtcaagctcataaatactaattttaatctaccactattctaatacatattgttataaatatttcattgatgcatctttccgttttgaaaaatttgtaatattcgagccacactaaagaacaaatttgaaagaaaattttaaattaaatcctttttcagtttgtgtcattttttgctaaatatgaccaccataaatcttacacgggcatctcgtgaaaaactgccgacaaatgtcagcatatttttatggtttcttttagccattcgcgcgatgacgcgctgtgtgtagccttttgataaaaaaaataaatagattttctcattagcataagacagcggtacctttgcactttttcccactatccagaactactaatccaataacagtgacttgtcttcggaccattgtcacacaaaaataaaagcactaaatgactgcaagaaaaccgagtttcttccagcaagcactcctttcaaaatttgagccccaggataggtattcaaaaatagtcatatagcaagagaatgggctggcagcgcagagacaatttcattgcaaattttcgaatatacatatttgctcttatttttaattttctttttgaccaagagtttaatatggttatgagattttactttattcatatatcaaataaaaaataataattacaattgtagaaaaaaatcctttttaacagatgaatttaaaaagcgtttttcaaattctttaagattatatgatactcaaaaaacaactgaataaaatcataattggcagatatttttcaacaaccaaatttataaatagggaaggggaagccaagaaatagttaaaaaccgtgatcgattagctaaaatagaaattaatgcaaaaattttttgtgaaagattcgtactaagactcgattcgtactggtcctcgaatgcgcgggactggaccatgaaagtcgggatttgtccacggaactttgttcaaaatgttcatttttcatattttacaaaatttttgggtccctctttttcatgcgtagcatattcgcaaaaaggttaaaacatataaatccgggccctaatgataactttgtctttcttattttttgggttatagtctctttaattttatttgcctacaagttaaaataattttggattattcgatgcgttgattttattaattcggtctcgaaaaattcgtccctcaataattttcttcatcttttcgtactagtttacagtcaaatttgagaatccctcggacattggcggcaattttcaatttgttttacgcaggcaaagcagtggcgggatcaaatggggaataggcaatccggcataacatgcaataaaaaagtaatgagaatccgtaaactaaagttgtgactgtcatgtatgaggactcaaacgatgggactcaattggacaatttcatatttccactctttatccccaactgtgtctctgtctgttnaatgctgtct

SEQ ID NO: 2221 - DNA, 978 bp, Heterodera glycines
  misc_feature (858)..(858): n is a, c, g, or t
  misc_feature (891)..(892): n is a, c, g, or t
  misc_feature (916)..(916): n is a, c, g, or t
  misc_feature (952)..(952): n is a, c, g, or t
  misc_feature (962)..(963): n is a, c, g, or t
tatgttttactcacaaccgataagccattttggaccattttattaattagtcattcgctttttaaacatattggacaaagtgatagaaaagaagcatcgcggcgaacagaattaaaggggcggtcacgaaaagggcgatgatcacaatgttcacggagggccatttgtggccgcgggcggcggacgacgaaatttcgctggagacaatcgaccgccgagactgatcactttggtgatcagcagcagagcacaagccagcacattttggggcatctgccgaaaaacaaagtgtgaaaatgggataaaacaaatttaaaaatggagggcgggggagagagagcggccggctcagccccagccaagttttactgtatcgcaacaaacttggtgaccaattgtcattgttaattaactttgtacctccataccctaaccctaacttttcacattgttttttttcttggggcggtctctttgttttcttgcgcccctttgacttaatcaataagtgcccttcccgcttggctttcgctcattattctgtcggatcgatctcgagatcccaacaaatctcccctccagggaacttcacagtcactttatattgtccttacagaataaaggatattattattccattgtttaagcactttttaagaattttggactcaataaataaaaatgtgaagaataaccaaaaggtcggaaaagctgctgctcattgtggccaaagcttttgctgccctcaaattggtccattcggcttaattttatttaatttcaattgggaagggaaagcgttgttaaataattttgggcgctagttaaaagtgacagattttgaatctatcaaaaacnaattcgaggtcttttaccccaataacccattannataattttcatgactatatattanaaatttttgcaaccaaaagggtctccctcccccttntctttcactnnttgatggaattcaaa

SEQ ID NO: 2222 - DNA, 2516 bp, Heterodera glycines
gtaaaagatttaagattgaccgcaaaaatcagctgtttttgtgtactataactgattaatgacaaataaatatttggttaattaataattagtaaccaattattgtgcgaagtaatgaataatttattcatttattaataattagtaaataatgataattcatttgcctaattaggtaattagtaaagaaatagccattaatttaattggccaaaattggaccggcaaaggaaagtgcgtagggcagcacaaattcaatgcttagcacaagcgaagcaccgatcagagcggccattggctcaaccattccgctgatttggccgtacaaaaacgccttccatttggagtggccaaaggccgccagaggcaaagcgacggccatgccctcggggaagttttggaggccaatgctcagcgccaaatttgacgccttctccaggctaacggactccgaccggccggcaccgccgaagccaacgccgacggccaatccctgttggaattgggcagttgtttgggtaattaattaattggatggcacgggaaacgaatgaaaaaactgccaattgcaaaaaaccaaaaaaggtccctccctaattgttttttttctattttttcacctcggggaaattatgtgccgttatggcaatgatcagcatcataattcgatgccacgactgttcttgtgagcgcttttgctgctgctggccatccaagcgaattgtctctttgtcggccatccctttcgaatttggcgcttttacgcagcgttggcgtaacgaagcggccaattcgccagcgttttcgggattttcgctcctaaaatcaattatacgagttaattaaatggtaattaagattaataagggacacaattaaatcggttaattaagtaaaatgcaaattaatttgttttaaattgatgcttaatgactcaactctgtcggtctgtttcaaaatcgaatggagcattttcactatgaattccattttgctgattggccgaatgccaattctctaattgatttatctgatcggagagagcgctgccattgaaactaattaaaaaatgcataattagcacttaaaataataacatttaaaacttaattggtcattgttttttttaataatttgctcacttttgtgttaatcggtcggataaatatacaaaaaaggcacccaacgcaaatccaacggctgaattatttttcgactgatttttaattaaaatcagaaaaaaaagattaaatttttgttttttaccgactgggacaaaggccaatttggccatttgtctttcggaaatttcgatggccggcgaaagcaaagaccaaaaagaagcggccaacatgacaccagaagagaagccgaggctagcatctgatggaagaaaagaggcgaaaataaaatttataaaacaaaaaaaaggcagaaaaacatttaaattaatttaaatgataaaaaattaccgaggaaaactctgttcgaggacggaaaaacaaaaactaaatatgttttaattgaataattaaattaattaagcataattaaatgttaaacggacggaccaacggcggcgccgagggcggtcactgcccaagtgaaaagagaggcgaaaagcgactgaacgatgggggagaaatgggaaagggagaagagcatttcaagaaaaaggaaaaggaaattcaaataaatttaaatgggaatggaaaatcattaatattatttttatattttttgtaaattgttttttttgttgcgattctttccatttgcttttgccactgctgtgcatacaaaaaaataataataatattaataaatattaataataatattcattctctgcttttatttccttttgtccattttttggcttttccttcgcttttcttccgatgttttttccttttgcgattcttttgccattcaattgacttttgtcatttttcttcttcacaaatttctccgtttgtccatcgcttttattattttatcatttaatgattaaattctccccaaaatgataacattcgctgttttttgccttatgtatttgctttggcagataattttattttagaaaattaattttcggatgtttttacaaatattttattatttttttcggcaccaattagtgctttaatgtcgcccgttttagcgggcgtttatttttttcgtttactctttgaaactcatgaatattcagtgcacatcaatcacattacataataactaatagcttcataagaaataacaaattgatttacaaaattcaatcacttggaatgaaaaggactttgtacaattttttaaattttgcataatttggctctttcattttttcaaaaaaggtttgttggcatttcttccgccgtttttctctgtcacttctttttgtcgtacgattgctgtatcattgtaagtgttaatctgatcagaaaaggagatttaagtgataagagtgggaaaaagacatgtcgcattatgccaatgacttgtggatactg

SEQ ID NO: 2223 - DNA, 7223 bp, Heterodera glycines
aaaaaaaaaaaaaaaaaaaaaaaaaaaaaaaaaaaacccccccccccccccccccccgccggggggttttttttttttttttttttttttttttataaaaaaaaaaaaaaaaaaaaaaaaaaattttttttttttttttttttttggggggaaaaaaaaaaaataattttttttttttttttttttttaaatatttttggggggggggggaaaaaaaaaaaaaaaaaaaaaagagggggcccccctccccccccaaaaaagaaaaggggggggttttttttttttgggggaaaaaaaggggggggaaaaaaaatttttttttaaaaaaaaaaaaggggggaaaaaaaaacccttttttatttttttttaaaagtaaaaaaaatttccgggggggaaatttttttttggggggggggaaaaaaaaaaaaaaaaaaaagtttttatggaaaaattaaaattaataaagcttatttaaatgttaaacgggggggccaagggggggcccgggggccgttccttccccagggaaaaggagggcgaaaaggggttgacggatggggggaaaaaggggaggggagaagagcatttcaagaaaaaggaaaaggaaattcaaataaatttaaatgggaatggaaaatcattaatattatttttatttttttgtattgtttttttgttgcgattctttccgtttgcttttgccactgctgtgcatacaaaaaaatatatagtaatattaataaatattaataataataattcattctctgcttttacttccttttgtccattttttggcttttccttcgcttttcttccgatgttttttccttttgcgattcttttgcattcaattgacttttgtcatttttcttcttcacaaatttctccgtttgtccatcgcttttattattttatcatttaatgattaaattctccccaaaatgataacattcgctgttttttgccttatgtatttgctttggcagataattttattttagaaaattaattttcggatgtttttacaaatattttattattttttcgacaccaattagtgctttaatgtcgcccgttttagcgggcgtttatttttttcgtttactctttgaaactcatgaatattcagtgcacatcaatcacattacataataactaatagcttcataagaaataacaaattgatttacaaaattcaatcacttggaatgaaaaggtttttgtacaattttttaaattttgcataatttggctctttcattttttcaaaaaaggtttgttggcatttcttccgccgtttttctctgtcacttctttttgccgtacgattgttggcccaagttgaagctttgctctttgccctccagaaaataggtggtcacttcacctttgccctgaggcaacaaaactttgatttgttgaaaatctgctgatcagaaagtattttttgccccacggattgatcattaatgatcagcaactgatcgtttaccgggaaatagcccacccatttcagtgagtgatcactctgatcagagaatgattaaggaatttctcataataaattgatagtaaaaaatgatcaatcagtcaatttgcttaaacaaatggcggctcactttgatctccactttgccacgttcgatcatcacaaattggtggtaaaaacagctgagcaaattgaacgaatgttcactgatctgaaaattaaaataacagcaaaaataaataaaaactgaaaattttttgcctgaattttattcggaagtccatgggattcctaaaaaggcaaaaaataaaaataaaaacaaataaatttggctaatgaaattggcggaccattcgtgaagcgaagttgacagtttcgccgaataagcagtagcgaggcgcttgcaagcccacctatgagtattattatatcatttcgttgtttcattgaaaaaaatgttaaaatttaaatgataatttatttatttgagtttggcattttgtttgtgccattttggcaaaccgaccactccggcagccaccggtccgctgtggaagccgatgcgcaccatcatcacctcgtccggacggtgggccaatttgaaattggcgacaaatgtgcgcattttcagcccaatttccgaaatgtggtgcacatgcgcgttgccattctcgcgcggcagacccgagacaatcatataagcatcgccaatctgatcagaaagtgggataataatgtgggaaaacgattaatgatcgaagcgaaggtttataatgactaatctgatcataaaactgggagatgggaggggggagggagatgtgtaaactaatcagagcaaaagccaaaaatgatcaatgagcggatttaatttgatcagcagtgaaagggacagagttaactggatagtgggctattagctgatcagagtgggataaatgagatcagaaagcggggatgggtcgaataaaggtccagaaaacgtgacggacgagcatctgatcagtgtaagtgttaatctgatcagaaaaggagatttaagtgatcagagtgggaaaaagacgggtcgcattatgccaatgccttgtggctactgtaatgcttgctggcacctaccgtttccactttgtacgcgtcgtgtttggcgatgatcgcatcgaaaccgctgaaaaggtcgttcagaaaagcgaccacttggatgggcgttgaagtggaggaaatgcgcgtgaaactgaacaaaaaggggtgggggattatttgggatttaaaacattaaaaaataattattttttaaattttaaatttaagatttgagtataaaatacccccttatgtcggaaaagagaacggtggcatttgaataaagttggggcggcacagaacggccggcctaaaggggcggtaaaagacggcaattgaattaaacttttcttcatcaaaaatgcctttaaatcgtcggcaattgccgccggcaacatgctcttcagcagccgatcagcttgttgctgcgtgtcctccaacatttgggtccgttccttcactaattgctccaaattgctggtgtactgtagcggggaaacagttgtttaatgataaagaccggactaaggtaagctaatccgattccaatcaccgaaatccgatccctaacattttttagagatggcatgactttcccgattccaaaattatttcttctcatccctttaaatgcatccacgaagcatactgtaatgagacggaaggtaattgactgccctcccgtctttggtttgttcatttccccattatagagcacatttcctcctatattcattaccttctgctgcgctgtcctagcagtttttttgccacccattgttttgtccaaatgggcaattaattacaatgttaattagccataattaccccctccccctccctccggctcacttcctccatcattttcatcatttggtccaccagtgagccgctgcccgtcgagcgaaggttggcgaagacgatcattttgatgcgtttgatgttcggccgcatctccgggatttccaaccagcacgcctcgagagcggacagcagctgcaagttgtacgcctgctcctcctcctcctgcgactgttgctgcttgggcgccaaattttgttgctgattgggaaaggacgggcgaatgatttggtcgttgtcgttggacatggcaattttagacacaatttctgaacaacataattcatcaaattagtgagaaagtgccgttaaatccgcaaaaatggaccaattttcggcaaaaaatgcaatcgaaattgttattttttggcaaataatttaatagtcttttaaatattcattgaaagaaattaaccgttatttttaattcctaataggctaattaattgtcattttatattttgtcgcatataataataacaaattgctcactgttgggcggcaaattgcgctcatagaacggctccaatttgaacataatttggtacaaaaccatcgccatgccaacaaattaatgggggaaaaggatttgaattgaatggcattccgccccaattactataaatgtcggccgcgggtgtccccgggggcaaatgctttgagctgagatattcgcggacaatctccggcgcttgttggatcagttcttaatgagaattatgaattggttaagctgtttccttccatttgcaataaattaatctttttgaaaacgaattctcgatccaatctctagtcaatcaaaaaacgattaattgtaaactcatccaaccaaaatttgtctgccccaccattttatgatcattaattacgcactctttcccatccctttgacccttgcgcccacccaattgatcaatttggccatttgtatgttgtccgatcttccgattccgaatactcttggtcatcctaattccatccccattccgatcactttgccccccccccccctctaactgatcattctacaaaattctgcttcccattcattttgtccctcaattagcattgtcagcccattgccaatttgaactactttttgcgttttttttctcgcgcattttgatcgccgccatatccatctccgagtcgtcccgcactccgtccgaatcgattgagtcgcgccgtttgcgccgtttctcgcgctccttcgccttttccgctttctcctgctgctgatcatccgtgccgttctcgcgttctctgtgctcccgcttctcgcgctttcgctttgcctttcgttttaaatttaaattttaaaatttaatttaaatttaatttccaaatttccattcattttttatttacttcttgttggtccatctcgtctctgtcaacgtatttcagttcgttgtgcttcaatttgtccccgatgatctcttccgtgacgaaattggtcagtttgatgttccaattggagtccaccaaacagttttggaggcacagaaagccgtgcattcggatgggggaattgtgcaggaagtaaaggccctgcggggggagaagggaacaatgaatgactttgttccactagttgaccatttgtcccacgaattggccatttgtcccactaagtgcctatttgtcctactgattgtgcatttgtcccactaattgtccatttgtcccactaattgccaatttatcccattaattgcccatctcttccgcgccccctaattgctcaatttgtcctacgtctttggcaaaggtcacttgaagagttgcgcccgattttgatctccccactgaataaaacgtcctccaaactgccgcgttggcacagcacccaaagcgcgatgagttcattctgctgattgaagctgatcccatagaacttgttcaggttctcattctccatcatctgacatttcaaaatggctttttttatttttaattatttaaatttaatttccatttttaatttatttaatttcaatttcccattagtttcgttttgccttcagctccttcagccgtgtcaagtcgtgtttgttgaacgaaatgttgcgcgtctgcaggtagcgtttgcacgcgcacttaaccccattggccaccgcttgtttcgttgacagtcgcttaaggggaaaacaaacatttgacatttttgtcggcatttaaattatttaattgagtgaatttagtcaaatcaactctctgctgacccaattcgcgaccattgagccggcggaggcgctttccatcgatttgcccagcgacgggtcggagcggcgctggtgtttgccgccttcgcccaacagtttgatctgctcgcgcgggatgcgccacgtcatgtcgtacagcatgcgctccttttcgcgcacgtacagaaaatagccgaacggaatgaccactgaaaggggcggaaataaattcgaaaagtgatcggaaggagcaaaaattggaatgatcagagagacaataaaagaagtgataaaaagcaggaggaggagagaaggtgatcaaaaaagagataaggagaaaaggagaaaaaaaggaatgatcagagagggcaaaaaatgatcaaatatggacaaataaagagatttgaaagcaaaaatcagaaacaaaaacgaactgatcaaagaagtgagcaggagagggagtagtggagagataattagcagaagtgaaactgataaatgagcatttaacatttattagtgacaaccaaatgaaatcagtgactggggaagaaatgttccaaatatttaaatggggacaaaaaatgttgtactgatccgtaaaaaaaaggccatgggacgcataaaaggccatgggacgcataaaaggccatgggacgcataaaagttctttgggacgcataaaaggccatgggacgcataaaaggccatgggacgcataaaagttctttgggacgcataaaaaaaaggccatgggacgcataaaaggccatgggacgcataaaagttctttgggacgcataaaaaaaaggccatgggacgcataaaagttctttgggacgcataaaaaaaaggccatgggacgcataaaagttctttgggacgcataaaaaaaaggccatgggacgcataaaaggccatgggacgcataaaagttctttgggacgcataaaaaaaaggccatgggacgcataaaagttcatgggacgcataaaaggtctttgggacgcataaaaaaaggccatgggacgcataaaaggccatgggacgcataaaagttctttgggacgcataaaaggccatgggacgcataaaaggccatgggacgcataaaagttctttgggacgcataaaaggccatgggacgcataaaagttctttgggacgcataaaaggccatgggacgcataaaagttctttgggacgcataaaaaaaaggccatgggacgcataaaagttctttgggacgcataaaaaaaaggccatgggacgcataaaaggccatgggacgcataaaagttctttgggacgcataaaaggccatgggacgcataaaagttctttgggacgcataaaaggccatgggacgcataaaagttctttgggacgcataaaaaaaaggccatgggacgcataaaaggccatgggacgcataaaagttctttgggacgcataaaaaaaaggccatgggacgcataaaaggccatgggacgcataaaagttctttgggacgcataaaagttctttgggacgcataaaaaaaaagccatgggacgcataaaagttctttgggacgcataaaa

SEQ ID NO: 2224 - DNA, 3298 bp, Heterodera glycines
gatcctgcgcaggattttgcaggatcccagtccgcaatcctgcatattttggaaaatacaggatttacaggatttgcaggattaatcctgccggatcctgtcctgtaaaaaattttgaattccaatcctgcaacaggacccgcaaatttgatttttatgcaggattcagcaggatcctgtattgattttttgaaaatttttaaaaatagaatgccaaatattcagaaactttcttttttcaaaaatttttttcttaataaaaatttttcgtttaaaaacttatccttattcgaaaaaagtttatacaattgaattttttatgtgttttgctacctaaaaagcgttaataaatttttttttttttgctattttcgtgcctattttaggatttttctgcctttttaagtgcctatttcgcgattttttgtgcctaaaaatcccatccctttacataatggattatggcttttttgcaaagaaattggcaaatcggtctttttaaacgcattaaagaagattcagtcgattgcttggagtgtaagcaaaaaaacgttattaatttttcatcttcatcattttttggtttaaaaatatattgaatacttttttatactttgaaagacttttttataatacagaattttttgaaatttcctaaaatccgcaatcctgcgcaggatcctgcagattttaaatgcaggatttgcaggattaatcctgccggatcctgtcctgtaaaaaattttgaattccaatcctgcaacaggacccgcaaatttgaaatttccggtctctaattcctagtgatgaaaagtggcgctaaaacaaaattttttgaaaaagaatgtgttttttgggggccaggccgttttcgtacgaacacatgtttttggactagagagcagggctgcacgcaattacggattgcggattacgaaaattacggggttttgggagttacggattacgggttacggatttttgggatttttccgtaattttgatccgtaatttgacttggattattttttcgagacgatttcttgtacgattatttttataaaaaacaaatttttctattttttatttaaagggctacccgtatttcgatttatttaagaattaaaatagtttataattttttatttgttgttgttaaggctatttgggtagttcgcctagaaaatagaggcatcacttttttgtcacacctatttttcacgcattttatgaaaattcataaaaccttagccaggtgaggggaggaattccccccttcccccgcccgaaatgaaaaattaaaaatttttacaggaaaaattgggacttttaaattttttttgtcgatttttcatgtttttttttttgtgtacataaaaacgctgcgccagaaatctctgacaaaaattgatttttaaaaattacggattacggattgcggattacgggaaattacggggtttttggacccccgtaattacggattacggatttccgtaactgagaaaatcgccgtaattacggttacggatttccgtaattgcaaatccagttgcgtgcagccctgctatgaacattttttgctcgcttttttgcaatataaataaaaaaaaattttttaaatgaagattttgaccacaaatgctgatttagaaaatttaatctgggagcactgttttttaaattggtttctcaacaaaagcaagttgattacaggaaaatttcacagttttcaattcctaccctgcagttgagaatttgtgaatcaagcggaggttttggattggaaaaaatacagaaaaattcagtcggtcgatgaaataaatgcaaacaaaaaatatatatatgaagcaatctttcggaggacaaacactatcgaccaaatgcggacgaacacagaagacgatgggtggacgacggacggttcacaaaaaataggctcaaggtcagcagaagcagaagagaatttaagtgggagggaagaaatggtttggggttggggtagcatcaacaaaaaaaaaaatattgagagaaaatgccgaccacaaataacggaaaaatgccaaaattgtaaattaaatgtgaatttggtttgtgagtgcaataaatttaataaatgaataaaagatttataaaaaagaaaaacaattgaaaaatttactaggcatgcaatccttgaaaagcagcaaaattatgctaaaatcagcagatttggcaacctgatttattatacatacaatacaatattcaaatcgtaaatttgcttagaaaatactaaaaacatagttatactgaaaatggttaaaaaaacatgaaatagagaaagacagttaggcaattaccgaaaatttccatttatttttgatatgaaataccaacattttttaaaatgtgtccttattatttagaaaaatttcaattgaattgttctataaatactcaaaaattgccagaatggatggtgggcgggggatatttaagtaaatgccgacaaaagcaattgagtcgtcccatctgttaaggattttctcttttataataggcacagaacccgcgtacaaaatatgacaggtgtgcaaaatttaaacgttttttgagggaaaatgaaaaaaaaaatgtccgattcagtaaaaaaaaaaagtgtggtggtgggggaggggtcgtggttaattctgcgccgaccgttcggcgccgccaactttgaaatgccataaattttttctttgtcagttaattttatccgattgtcaaaatatttccaaaattaggatatcattgggcaaatataagattttgtggacaacataaacatttttttgtgcaactattctcagattttgtgcaagaatgggcatttgagacatttttttaaaattaattaaaaatactatcttttaatttataaaaaatcgaagaaataaagaaaacaataaggacaaaatcgaagaaataaggacaagtgaaagccagagttcccaagtgtcctttttttaaagatttgtcctttattggaggggccggatctttgaaaactaaaatgtcctttttttaaagattgtcctttattttaggcttccccaaactttttttgtcggcaaaatgctgattttgaaaattttcagttgacaggccatgtttttacgctaataaaatgttgttttaaatcgattttcatgtattttattgcgtttctttcgggctaatattagttttagaaaaaatctttttttggggtccaaatcttagtttaagtatcgtttgtcctttttttgaaaaaaaaaacttgggaactctggtg

SEQ ID NO: 2225 - DNA, 5284 bp, Heterodera glycines
tttattaaaattagcaaaaaaatatattttatgactaaaaaatatttattttttagtgaaaaaataatttttggataaaaatgggcataatgcatggtaaaataataaatatttagaaaaaaccagcttgaacaatttttttgtgaatatgcagttaaaaaaaatgtaacaaattcttcatttatcgatccccccccccccctaacgcttccctaaatgccccattcatttcgctgttttaaaggcagcgaaaggagggggaggggcagtttaggaaatcaatggaattgaggattttcgattagaaatgcaaattatttttgaaattttgattctatatatagtatgtagtgagtagagagaggggggggcatagagcatacagaaatatgtagaaatatgtataaatcagggataggcgcgtattgtccgagttacgaccttttttggcttggaattccgactttcaattttttttcgggctacaggctcccgaatttggcatgaatatcggcatattggtggattgtgcttctcggggcggaatttttgccgtggagttaaaagactggaattcatccaagagaaaagtgcttttttctaagtcaaaatccgtgatcgattaataattcttaaaaaatatctattttttccacaaaaatttgcatattttaaaaagagaacgaactcttttctattatcccatcgcacagctgcgcaaaactgtgacctctctctttaatgagcctaatttggctctaaaatttttaattctcataaatctcataatcaatcttactataaattactggaccaaaaagtaaagttttgcgcgctcaaggcctcaaagattaggaaaaagatggaactttttttatttttgtgttaaaattttaatttattaaaaaaatatcaaaaatttgactctcatcaacattaattgaatgtgctatatgaatatcatttcatttatgcttttgccagtgaaatttgagaaggagctgtgatggaaagggttgtgacctttgaggaaactcggggattaacagaaacaacatggaagaaatgaagatttcatctaacaataagcatatataaatataaaagaaataaatatttatttatatatcttttataattataattataattataattattattcattatttttgtttgtcattctttgcgtgataggctgtggccgtttcagtttttgccgtgttaaattctgctttttgaaataaaaaatagattataaaaatcaaagttattaaatgaataaagctttggctttatccacgcttcaaaatcactgaaaattttttcagaaaatttttcttgaaattttattaggaaaaattcctaagatttttttcttgaaaaattcctaggtttgaattttttttttaattctcggggtgaaacgacgagacggggagaaatagcggcggggcaaggaaatgaagtgcacccaacatttaccaaccgatgatctccaatttggctgtgttcggatgggagatgacagtgaaaactgttgatcatgatgttgttgttgttgttgttgttgtcgaaatggcacattaaacacactgactgatccaagacaacttttgccgaactcatcaagttcaatggcggatgaggactgatgaaatttttgaatgcccaaatttttgtttttgtcattttgtccaataatgccatcgtcgccatgttgtcgcgtaattttggtcttaataatgtcagaagtggccgccgattcattacgacagtcgtcaacggcatcagttgggtggccggaatgaatgcttcctgctgacaaaattgcctgcatcggaggtggaccgaacaagaagggcgactcgcatttcctaaaaatattttaaaaatgcctatttttaatataaaatcttaaaataaaattaaatataaataatttcccgcaagcgccgcaggtctccgcaacccttcagtaaattgaaaaattttaaaaaacctcggcaattttttttactgtgatccacccctggtgaatattaaaaatttgctaaaataagtttcaggaaatttgtttattaatccccgagtttttctctccctgctgaaggtcggggagcacccaaccctaaattgaagaattaatcaattaacggcgaattagaaattaggaaaatataatggttcataaaatagtagtaattttatattttaacaattttcggattaatattgcacacacaaacacacctttgattgtcagagatgcttgtatcagtgagtttttgctgctgctgatagcaatggtagtcaagtggtggcggggtgggcgaggatgatgacgacacggcaatgccgtgcaactgttgctgatgccattctcggatacggccaggcattcgattgtcatgggtttcatcctcaagattttcttcagcactgtcatcttcaatttcgggccgatcagcttgaaaatcacaatatttattattgcgattagcgttattatcttgtttttgctggaacatttaaaaaaagtttatctctagcatgatgttggaatttttttttaggaatttttaaaattttaccaattttatcgatttttcagtacttaaatcgatttttccgatcaattttgagggtcttatttcaatgttcagcaatttttatgaaattcccatacaaaagccggaatttttatgtttcaaggattaaagacatttttagtacaaaatacatgaataaattatatccaaaaaaatttccggcagtgcctttagaatcgctgtatctttcattcttcaaaaatttggaaaaataacgcaacaaaatatttaataaatgattagaaatatttaaataagccatttactcaaactccgttgaatgccaattgaactgctgccctcctcctcggtccatcgtcgtaaccgttcccgaacttgttggtacttttgatcatcatctattattgctgaagccgaatgcttctgttgttgctgttgctgatcattttgccactgcataacgcccgatcgacggctaatgcgattaacaccggattttgtcgaagcacctctcgacaacggatcaatgtactgaaaatgaaaaaagaaaaatcggcactgaaaatggcatatggtttttggcaccgaaaatttccgactttctaaaggctcctgcgccagaaatttattttgactaattttaaaatccaaacctaaaattttgttctaaaattgagtagagtgataaaataatattaaatatattatttaaatttttattataattacatcgtatagaccgccttcttgctgctgggtatgctttggctgcttactctcctcgtcatccaattcacgtttacgaaaacttccattaaacacgctttttaatggctaataaaaatcgattttaattgtaataaaaataattttaaaaaataaatattattattaatttttactttattttttcgccttgcatcccaaatgttgtaaattgctgtaccaggcacaatcagcaatggtccgatcatcacaatccatgcaatcaattcatattcaatgggtaatatgatgccattgaatgttacacgttcatagtccaaaatggaagcgatcagaagcatctgaatcaaattgaatatggaataaatgatttaggcatattgtcattaaatatttttggaaaaatgatttaaatttaatgatttttgacattttgccattaaaatattttcggaatagcccaaatcagaaacgcaagaagcatcttaagcataaataatagaaaaatgatttaaatttcttaatttttggcattttagcattaaattatttttgaataaatatttaaaaatgaaaatttctttaaaatgtgaatcttttatgatttttcttataaaaaaatatttcctataattataatctcaccgtaagaacaattggtgtaaacattgaccacatccattttatgtaagaacctgttggtccaatgatgtgcataaattttcttaaatttaaaattgtaaaattaattaattattatttatattaaaaatcatatatttttctcaccgccacataaaatgttcacgactcgaaaagaaatcaactgatggcaatttttgaatgcgaagcatgtcagcaatatcttccaaaaatttgtccacaccttaatgcctacaaattagggttaatttaaataatattaaatattcagtcgcgatatgttactgtagttaatgtaccgtaccataaacatggcacacaagcaacacttggataagtgacagaaagaatgaattccaattggagtttaggttttcaattgcatgaaatatgtaaatgccgcctcgagtgcacaatggaatgccacacaaaaagcagaacacacatagcataattagctaaatcattagggaaacgctgatcgcggattagagagaaatcagagttaatcaatcactagagctgggaattcaatgtaaatatataaaaaaatgctaaattctaagtgctctaaatagtttgtaaaacactttcttttttgtgtttacgaacgaaaatctataaatagcttctttccaataaagaaatacaaaaattaaatttttaaatgtttaaaaaagaatttgttcacaaaaagatgtctaggtataaatgtaaattttttatacatattttgttttttacgtatttttatttattattatatatttgcgattttcttagatatatttcaagccctattaatcagtcatttattagaagtagtttaaaaaaaaaattactaaacggttctccagccttttctgtttgctcccaaatttgttcataatggaagcagcgatcatttcaagcctaatagtttaaaaaaaaaattattttatttttaattttttgtttttcaccaagcaaattcggcatcaagtgccgatactgtgagaattatgtagaacagaatggcccagacgaagccccattccaaatatgaggttacccctgggtaaacagtgaacgcaatatatgtcggatcaagtcctaaagaaaaagatttaaatgttgggcgctacttttaaaggaaaaccaaaaaagcgtattcccggatttttgggggccgcttatcacggtgacatccatttcgaccaatccgaatccccaatccgattcggagaaaaaatcgaaattcaaatttgagtttttttgttcgggttaggaaaaaatcatcttataattatttgcaaatcaaaataaaattatttaagtcatag

SEQ ID NO: 2226 - DNA, 3578 bp, Heterodera glycines
  misc_feature (89)..(89): n is a, c, g, or t
  misc_feature (95)..(95): n is a, c, g, or t
aaaaaaaaaattgttaagtgatggttatgaccatgaaaatgagtggacctgcgtcaatccccaaagaataaaaaacctggaaaaaaatntaaaanaattaaatttattaaaggaaattacttgctcagctgctttacgccagagctaagatacaaaaaaaagatataaacatagttgaagaaaattattttttgaattaattaaaccttttttagataatataaataatttaaataaaaattatattatattattgccttaaggctccataggtttttaaactcaggcttgaacagataaacgagtcccgacgaagcaccttcaagcgaaacactgcgaagcagaagaatgatcagcttaatccaattggtttgaagcttattggcatttgataggtatgattatcaatgttttctttaaattaaaaaaaataatcccaaataattcagttgcttttaaaaaatttaccactgaaataaactcatttttttaaaaaaaattggtgcgttttcatgaaaatttacgaaatccatttatgcttttgtgattaattaattttatcaaccaaaaaatatggtagcgttgcggtgaaagacactgcccagccgattgatccaagtcccttgaacacaccaaaaaatactgaaattcaaaaccaaattatacataaatattatttagtaatactataaataatccaaccaattatccaagaaattatcaacgaaatgagcaaatgttcttgaatttgtccaagagccgtactttgtatgtccttaaaaatttcattggaattttacgcaaaaaaatatttttttttaaataattttatataataaactaaccattgtgcgattcagcacctatggaaaactccaattgaaataagttgattaaacaagtccttttttgtcctacctgaaagcttaacaaaaataatgattaatttaaatttacaaaaaaaaaacaacaatttaaattaaataattcgtttttgttgttcaagcattttgttgtttttttaattaaatgcaaaagtttcattttaattcttccatttgaaaaaaaaatcaaaatttgttgaaaaacaaaaataaattttttcatattttgtatgcaagcaaaatcattactagaagaatgcctcaggcgctggcattgactgagtaccgtagccgccacacagttcaccgtttacagtagtcgtgagttcacaacagttaaattgttttatccattcgggcttgcaatgttcccacaccttgagatttaaaaaaatagttcaaaaaaaaattactgcagtgccgccttttactatggctggctataaaacataatttgtttttactactgtagattttttgttttaccgtaccatgccgtcctgctcgaaaatgccatgcaaagcaaaccacaggtagtaaaagccccaagcaacatagaaaatgtaataaattgacacgggtaatgccaataggacaagacttgaaaaaaaaaattaatttagaaatataaaataaataaaacgaacgcccagccgattcctgaaaataatgtgaaattattattcaataaagtgttaaaaatagtaaattgtatttattaaattatattcaaatattcccaaattgtttttaactgaaaaattgatttttatatgctttgaaaaacttctgctaattaaaaaaaatatatttatttatttcacagaccagaagcaattggcatcattttataaaaggctgcgcttgcagaaagtcctaaaataataaataaataattgcaaaaaataaataaataaatatattgcctgaatattggccaattgtcaagtgcatatagacaagcggaaatccgaaaataaccatgaaaaacagatgaggtatgaaaaaaataccttaaaatgataaaaaataaaataaaatcagagatatatttaggaggtgaaagttatttttgctgaaagaaatataatattattaaaccaaatatttacatcaataggttagaaatcacataattatatttatagctagggcgctatactaaacatttgaattttgacaagtaaattttgtaatttaattcataatcagaaagacttgaaaatttgcaaaataatatgtgcattttcataggtacaaatttcacagaaaatttgaaaaatagagagtaaaaattttggaatttttcagtctgtagggccttagtcaatttgtcaaggtaactgtaaacagagctacaaaaacccgactggcattttgtaaaaatttttaatccatacaactgatgatagttcctattttatagttaagtttggattttaaaaacgtaaatttaattattttaaaataaaaatgtaaataagaaataaaccaatattttttggtagtaaatcgaaaacttgttaattagttgctcatcatttttttgctcaccgccaaattcaaaaatcattgccgggaagcgcagcgtgttcccgccaccaacaatgaagcccagacaggacaaaaagaattcaatttgcgtgttccacaggtcgcgcacttcgtccgcccgtgcgccgcttgcccggtcgcgcagccgacgcatgccgcgatcagttatccgattccacaggctgcgcctgttcactgcattgtgccctcgactggcacgctttggcgtcttacctgtgataaaggggagagtgccataattagggctcaggatctttgagcatttaaaatttcttttcggattttcaaaaaattctttaaaaatgcttaaataaagaatacgtaaaaataaatatatacaaagcccccaattaaataccaaaatattattatttattaggatttttttttgacaaaaagttcttagaaaagcgtgaataagaatataatccattaaaaataataatttcatatctcttttttaggaaaaaaattctatttttccaggcctactcactcatcaagggcgtaggcaggggggggggtcccaaaaagtaaaaaattttcagtaaatttttttgaaattttaagtaattttcttaacaaaattgcattaaaatactcaaaaaattttcccggcggcgcctatcagcaccgccggacccccattttaccatatttttgaaaaatggaggccaaaatcgcaaaaaatattaattttttggcgaaaaacggcgaaaatgtttgtaaaatacaccccataattagggatttcaaaaaaccaaaaatgcatccctaaaaatcgacttaaaagtggaaaatacacccctaaaaatcgaattttttacttcagcccccccccgaagccaagggtctggctacgcccttgcaatccgtcaaaaaaaacgcatcaatttattcccacattttcaattagggtgacttaaaaaaaccaaaaaaacaatttttttatgaaaatagtcctcttaaaatacaaagccaggccaataaccataaaaaatggggggatccgaaaacagtttttttctgtcgcctgacggcctaaaaaatttttgtcttgcaaattttccagcagatggagaaaaaacaggcatttgtagcagtttttcgtccaaaaat

SEQ ID NO: 2227 - DNA, 3596 bp, Heterodera glycines
aacgagagataaggacaaaaaaagtatgttttttccgataaaaaaaaaatataagcaaaaatgatagactttttttgtgacttttttcactttttatggcttcattttaattcagcaataagaaaatgctaaaaataaatttgtgttaggtcgtaattattgagaagacctagggaattgttgaaataatcacctaattttgtcagattcttttaggcaaaaatgttgacttcaaaatctcacctaatttctgtcccattttacaatcaaaatttaatatgaccaaattttgaaatatactttttttttgctattgtaatcaaaataatagtttttattaaatactattctataaattgtttaaaaattgattattatttttacttttgcctaattttcatgattttttgcatttttgtcgtgattttttggtattttatgacttttcatgactttttggtgattttttttttgttttaagtcgacttttggaaattttcatgacttaaattaccagcccacgttagtactatgaatataatatattttttcaagaaattcacaaatttttaaataacatttactaaaaatttaaccaaaaatcggcaaatgttgtaaggattttaacgaaaattggataaaattaaaataaattaatatactcgaaaacgccttttagtaaagatatttttgtaatttttttcacttttttatactaaattctcatcttggaaagttgctaaaaatagctaaaattattcgtctatctttacaaataaaaaagagaatttttaaaatcaactcatttctaaaaaaggtgttctccacaaatcagcaaaataattgaaattgtcacgaaaacatatgcaacccttagaagtgctctctgatcagtggtgccgattctaatcactttgggctgctgatcggctgatcagcttgcccggcttcttcttcactttcagcttcgcctcctcgcatggatccgtcattgagggcacatttggatttcttcaaaatctgtgaaaagaactccttgccagcctcacacattgacgcccaatctaatagattaaaaaatatatataaagcataatttttattttccattgtaaccataatatatttaggatacatcccgttggcccttggaaaaggcgttttaaataaattagcaaaaaagtttactgtacataaattaaacgcaaaaaaaaagtctgctaactaactcttcacggttgcccggaaacagagttgatttaaaaaatattgttatttttcacaaaatagaattaagtatggcaaaagcagataattttgtcgagtttgaggctgagtacttaattttttataatattttttattttttcattaaaatccccaaatgtcgttttatttgaaaatgcccaaaagtggcgccacggaaaacagaaaacgtaaactttttttttagaaattcctaaatcccacacagcttgaggattttacccaatccaatttctttcattaattcccacagttttgcattttcttctcccattctcttcacaatttccttctgttctttctcgtttaaatttttgttttcaaagcgtttccattgtttttgatattcttccgacaccttttcaagttcaatcaaataattgtcaactttaatatttcttaatccatttaaggcctctaataatccttaaaataaaaagaatgttaatttggttgtcttgagcaacgaaatacgcaaaatatgcattaaataggcacaaaaataggcaagtaaaaattacttaaaaatttaccaaaagtcttaatttttttgggtcataatcttagggatatatttttcgtttttttgttaaggatttttccgaaaatcatcaaaatatgtaccaaaaatagcgaaataggcacaaaataggcgcctaggcatagagtacaaaaagtccaaaatagacattgtataattgatccaagaagcttcaaatcaagctaaaaattcgttttctgtgcttatctcaacgttaaatgcacgcaaaaattttatgcatttgcctaataaagtttgaaatatttaaaaaagaaaaataaataaatttgttaaaataaagtgagtggttatttattatttatttacccgcgacttcattaagcctcacatcaagctgaggcgttgcctttgaatttttaagctttaatcgcctccattgcggagctcatctgaagttcgccctggtccacaatgaaccgtgtcttcacaaaaaagaattttactgaattttcttaaaatatgaaaaaataaaataattaatgaaaaattgcacattttttagattgaaaaactattttatagggctcccggacttttcgacagcatagcactaaattccgtttaaattaacatactaatatgtattgctaaatcattattactaaggaaggatacggtttttacgttttttacctaaaaaaatttccaaagaataacccttaagaaacggcctttaaaatttcaaaaatacacccataagaagaatcaaaaattttctcaaaaattcatcttcaaaatttatttatttattttcttggttagaatttttgatttaaaaattatttatctcaataatgatttggcttaattttgttgctttttggataaaattttacgattttacacccccctttttgaaatttaattactttttactgtcgaaaagtcccctcctaaaatttataatatttctgtcgaaatgtcctttgctgtcgaaaagtcctctatcggaaaaatccggcgcccgtttagagttatatttaaaattgaatttggcagtccaaagtgaccactggcggggtgttggcacgacccgtgcttgctgaagtgccaacattggtcttcagtgtgttggttttcttctgctgaactagctgaacttgtgccacccctttgtacccgcttctcctcacattccatcccttcacataagcattcgctgctaaagccatcattttccaatgttcgcaaatctccaacatttttcatgggattgtttatatccaatttgttcaggacttatcattttctcttttttgcagtcccatttcaacaccatatttcgccaatagtacgttttgctcaatgccaatgccttggccatgtcttgctcttccgttgtgccatcttcgaccacttcattcgctgatagaacgacaatcgatgtgatcaagaccaaaatgggaaatagattcgaccaaaattgaaaatgatgcattttactgtaaaagtttaaaagcggtcaatttacttgtgccagtttcataaaaatgccaactttggtaatttacgacaaaaaaatctattaacctttattgctaccataaaatcaatcattttttgatttcaattaacaaacaaaagatgttaaatgaaacaaatgtgtgttatgtatcatattaattaacaattaacactaataaaaatacaaaatgcaatatttattaaaaattaaatattacaaaattagtattatgtatatttctttaaaactcaaaatgactaaatatgcatgaaaaagctaaagaaatttgctcgggttatcagg

SEQ ID NO: 2228 - DNA, 1190 bp, Heterodera glycines
acaactttttgtaaatcgttactattttttgaaaaattacttaagtagtagagaatatgtagagctacattataataccaagatgaataaattttactaagtttaagctaagttatgattaattatttagcaaataatttctaaataatattaaatttaattattacgaacactgatatttttgtcgcttcgtcattacaccactgaaaaagagccaaaaattttcggcattaaatcttaaaaaataaaaggagaatttaaatgagattaaattttcgaaacatagcgaaataattatattatcctttcataatccaggctaaatttgctcactaaaatgcgcgggcatattgattgtcgattcgccaatatgaacaatcattttcaaacaatgatgttttataattttgcccatctgtgaaccctattgattaacgtcaagctgcttaagtgaatttttccgatttttaattctatctaattcagaaaaagtatatgtgaaaaattttataatttggggaaatagcacttattaagggtcactgaaccaactccgaacaggggccgtagcaaaagaaggtggttatttgacgaggtcatttaaccatctccaaccatgggtaggggcagggttgcaatttagccatggtaacatggtaaagtatgggaatttaagtcataaaaattcacgaagttggaaaaaactaattttttttactaatttcatacatagttgttataatgactatttttcatataaatacagttaattaagggctatttctgcctgctaaattcataaaatttcatacatcagaaaacttttacaaaaatccgcacatgactttaattcccagcactagtctgatcacacggaacattttccaattttgctcccgtcatttctgatccaaaaaatcacttaacaaatatttgctgttaatttattctgccgaagtccacaattggaccccagaatgtcttatgggaatgaatcacatcattttggccaatggtaaattaaattcagcgctgtgatttttgtttgtcaaatcaagagaaacgccttcccccccccccccccattagcagtttaatttgacaatttctattccgccccctccccgccgttgtcccaatatttaaggtgcttcagatttccgaattcccaattttattccctcatttgc

SEQ ID NO: 2229 - DNA, 2310 bp, Heterodera glycines
aacaatttcaagtcattctgacagctaagaagtgaatatgaaatccgtaattttatattcgtaaattatatttctgtaaacatcctagctctacttatcaattttgtccactgacggattatccactgacggattgtccattactgacggattgtccttcactgacggattgtctactgacggattgaccactgaagaattatccactgacggattgtccggaccccgatattttagcaccacttttttaaggacaagatataaaatagaatttttgaagctctttaggctccgtttgttgctttttggctttgccactttttgggggtcagcgccatattttaacaacaaattcgaacatttaaggcaaagtatggactcaaaagtctgctgataccaagtccttgtcgagaaaggaaacagattaattcattattgataaaatttttaatgatgtcctaattattttttacatatcgaagaattatcaaaattatgaaaaattctaacgaatgatttaaacgatttataaataataaaaaaatattaaaaaaacatattgaagaagaaataacaaaaaatattaaaatcgcaggaaggaaacgaacaaaaagtcatagataaatcaatgaaaaaaatggttggcattggcatcatttccgggctcaaactttggcaaaaacacttccatttcaaaacaaataaatgctttttggaggaatataaaagccaaagaaagtcaagtgaaaattatattcgaaattattttttaatttaattacctaattacattttccaatcctttaaaatgcgtgccattctcttcctgaccatggtttgcttggtgatggctgttattcttgagacaggtggccaaattaattaaaattcaaaaatattttaaaattttagccaacccaaaggctgtgaagaaagacactaagaaaggtatcaataaattgataataaatattaatgggaatatgcttttcaaggtgcagtttcagcgcccgcaaaaggaaaagcggcgctgaaaggagcagcgaaaggaggtaaagcagaaaagagaaagggactaattgatgtaaattaattaattaataattaattgaggaattaaaaaggacgcaaaaccaaagggaaaaggaaaaaaggaagccaaaggcaaaaaaggtagagggattttgaaaataaaagggaaattaaaatttaattttgaattttagacaaaaagattaagccagccaaaggaaaaggagcgcctaaaaagggtaaatactattattgattataaatgttaattaaaaattgaataaatttagacaaaaaatccccagctgccaaagccaatgacaaaaagagtccaagtaaatcattaattcattctaatggaacattgtgccaatgttggcaatttgaagcgaaaccaatcgcagcatgaaagcggcagccgtgccaaaggcggcagcggcggaaaatgctcagaagggaccgctgagtgcggaagtggtggcggaggaaaacaacttggacaccgaggcggtcgacgacgacttgggggtggaagcatcggacattgacgaattggcagaggacgaactgctcgaggacgacgccatggacagtaaggcggatgcatttttggacatgggagaggaggcggagatggacagctaaatggacaactaaggccaattggagtgacaaatggaataatacgggacaaatgacacaaatatcattttaattatagaattatagagaagataaaaatatattaaatcatcatttctgtgcttctaacttcgaaaaaacattgaaatttctagaaaaacacacctttaaattattagacaaaaatatttacactttatccttgaattcaagatgtccttgaaaaagagcattcgaaaaaaacattcaaaatttttgaatttataatttgattcatagacacacacaaaaagcgttaaaatttgactaattttggacaactctgttaagaaattgcttaaaatttcaaaattttccttggtggcacctatcgcaaggctatgtcctggtttgagggtagtggaaaatgttgttccgattcttaaacatattcataattttgaaattttatgggcataatgtcattattatttagtaattttaaagtttgaaagcaaaatttggtcattattgaacaaataaaaattagtcaaatttcaagattttccccggcggcgcctataggcacatccggaccctaaacatcctttattttcttaaaatgacccaaatcacaaaatttggacaatttttcgg

SEQ ID NO: 2230 - DNA, 3931 bp, Heterodera glycines
  misc_feature (24)..(24): n is a, c, g, or t
ccctcacattcctcaaaagttttntggaaaaaagggccgcaataaaaattgttaaaaatctggttttttttatccccattgcactaaattacacatataatttgctaatttccttcccctaaacaatttttgcaaaatgttctgattctcgacccctaatctgattttttgcccgatgttctgattttgaaaaattttcgatccgaaccctgaccctatcggcaccgccggaccctccccctgcacctcaaaagtttttttttcattccggcgaaaattacaaattatttgaattaaaattaataatttttcattgcttatgacaaacttttaagttgtccttgaatttagtgaaattttcccgttatgtccttggtaatcagtatacccgtcctttgaaagcgagtttttcgaaaagattacattttttgctttaggacacgcaaaaaaaggtgtgaaatttgaataaaacaattaattaaatcttgttaaatggcacgcgattttttgtttaaactgcgctacggatatttattcttttagaacaaatgaaaaaaaaagaaaaaactgaaccaaatgaaaaacgcacgaaagttagtgaattgtaaaagtaaagcacaaaagaatgtttctgctcagattctctgtataaaagtgagagctttgaaaaaagaacttttttttcaaccaaaaatttaaaatttaaaagattttccattttcgaattctttgaataaaacagcaaattaattctcttttgaaatggatgattttgccgacaacaacaaattttgcgactatttgaacatcaccaccacaacaaaaagtgatgttgataatctgacgggaaaatttgctgcttttgaggcacagaaaaatttgtctgtttttgaatggcttttcagttcaatgactcatcaattaattgtcgctaattgcgcgtatcagttcaaagtggcgcaagttgcggtaaaaatgattttaaagatggcaaaattaaatttttaaaatttggcaatttaattaagtccaattggtacctcgacaatgttctcgtgttatatgacaagttgaattgcgtttcgccgcttctcgcttggattgtcttcccaaatattttcactccgatttccattctattaaatttgtctctaatttgggtcacatgtacaaaaatgtgaattttattatcataattaaatttaatttttgcttcaaggactaatcacaaagtgtgcaattggctgatcgcctttgattcgctgtgccaactttttgtggtcgctccgttcggcgtcaatgcgattggcgtcattttccaatacagtagcattgattaccgtttctgcctggccacccttatggcagccaccgtagcatcatacgcctctatcatggcaatgtatctgatctcagttgaacgcctgttgatcataatgtacccaatcaagtgagttcctcataaaatgtcaaatttaaatttattttccattttttcgaatgaattggaataaaaaatctacggttctttggtgttcaacagtttcggtggttttttgctcattttttggcattctgatgaatttgaaagtattcgatgtgtggacaattatcaacgtgccatatgagcggtatcctttgatctagggttgctccccgacccctcggggggcaaaatctcgggggccggggaccatcggggggcacatgtcgcgggtcggggaggaactaaattgtcgggggtcggcgaccccgatcgggtagtgatcaacaaatttttttaacgaaaaaaccaatttttattttaaatgctcgtaaattttcttttttttcactgtcaaccgaaatttttggtaaggagtctgggtggaggaggggggggggggcgtcagctccgatttttgaaggtatctcaacatcggatttgacgatgacccttttttttttttgcttttcaaaattggtttttgcggcgtgttttttccaaaagacttttggggagaaacaaaggggtccgtccggcggtgccggtaggtgccgccgggaaaaattttgaaaatttgaggcaatttgttaacagattatgtctaaaaaagtaccaaattttgaataattttttaagaaaaattaatacttttggtggccggaggtgcagatagtcgccgccggaaagtttttcagaatttttaatgaattttattaagaaatttttcaaaaattttcaatctttcacccttcctggttgaattaatttttaaatttttacaacgctcggggtccccggccacccgactaagtgtcggggggtcggggggggggggcaaaatgtcgggggtcggggagcaacccaactttgatcaatgtcaaattaatatcgcaataattattaatgactgaactacatttaccgcaaatttagttgcgtttactgtaacagtggactttatgctgacgtgctgaatacagttccatcttatgtaatccttttgatgtgcaccttaaattatgcggcaattttttgcctgattttatggcgtcatcaaacaaacaaaggatcaactcaaacaacgcaacaatcggctgcaaaatgttgccaattatccgattttaattttattttttatttccacatttaagcggctgctgatcggtcaatgcgcaaaatgttgcgctcggtgtttctgctgctgttggtgttgctgatcggctggctgatcagttcggctgcccgcaatctgatcaccacattttttagaaataacaccactctgatcataaacagtctcttttctgatacgaacactcagaaccgtctgattaccaatattacttcttgggtgatcggtgttatcacttgttttccaattttggcgtccgccagtggagcgcccatccttttgttgaacaggcaaaaaatatgcaataaaatggcaaatttattaaaatggttatttatataaactatttttcagtaacgattatcggactgcttacaaaaaagcgatttggcgccgaagtaacaatttgccgggagttgggccgctttttagcgccaaagttgttgatggaaaaatgaagtagagcataactattctgatttattttttatgaaaacataaaatctcgatattttttagctattacattatgtaattttccatcataaaaatattactaatttgtcaaatgggtttttaatcgggggtcattttaattgaatccccgattatggcaaaaaattctcaaaaattatttagaaaattggtggactgaacgaacgttccgttccgcctattaccaggctatagtaattacaaaaatattttcttctttttattcaacattaaattacactaattatggaataatatgaaaagagtttttttggcatagaaaatcacaataatgaaaagttaaaagaataatttttttgaaagataattatgcaaaaaaatgctttggaggttttacattgaaagaccggtgatcaaaaataatggaaattttattcaaaaaaacatttatttatattcaattgccggtctttaaaagttaatatcgaacaatgattgaaaactttcactattaacaaattagcgagtaaaaattaaatgggtattgtaatacagtatatatgggtacaacacaataataaaaataaaataaaaatgctagagggtttgtattcggggtgactttgtattctcccccgccgttccccccccccccccgatattgtttccccgcctgaaaatttaaaaaaaagtttacgaatttagaaattttccgaaaaaaatttaaaaaaatttttgtgatatgaaaagctacacctgggtattcgtcgttttaaaggacgtaatttagaccgatttttatccaatcggtttcgactgatcggatccataacaccccgaaaattacccaaaaagaa

SEQ ID NO: 2231 - DNA, 941 bp, Heterodera glycines
ttataatagtaaaactcccgctcatgattaaaaaaaatggaaactaataaaaaggaaaatgatctcaggcaaaaagtgaagaagatggggaagttaatgcaccaagacatcctacattctttaagacgaattaaaaatgtaaaattatatttttattttattttttcaacgatttttcaaattaatttttcactatgactccaattctaacattgcatcaaattcacgcgtttcacactaaaacgcgagaaagaaacccccaaaaaggcgagaatgcgaaaaagcaagacgaaactgattttccgtctccacctagaaaaacaacaaaagtgagttcatttgaaaaatttttgagctcttttagttgatgaatttcatcaaaatttccagtaaccatgaaaaaaagagattatataccccaacgaagaaagtgacagaggtaaataaccgcacagaattaggggggtgggggctgagttagaggtcagtaaaattcataataaaatttaggattatcccccccccttccaaatcctctcaaaaatagctgatttggcatccgattatcccttacaattcgatcaatttctcggctgagctcaaacgcactgccatcggtgctcgggtaccacttgcgctcccacgtgtccgccaaatgccttgccccgtaaatggaatccaagtgggaccactcgtggaacgcttcctccccgtccaggaagatcagttggagcgtgatatgctaaagcgattttgaattttatagggattttcaaaagcacacaatatgcactggtttctcgcataaaacgcgtaaaaagttttttgaatttttgaaattaaatttcaatatggcttaaaagaccaggaaaagataagataaccataactctggttagacaagacaaaaagcttattcattcatcaaaaagagcatgaca

SEQ ID NO: 2232 - DNA, 2330 bp, Heterodera glycines
  misc_feature (2257)..(2257): n is a, c, g, or t
tctggcactctccctttattgattcatctctcgttttttgaaacgctgtctaagtgtataaatatgcaaaaatttgcagtcaatccatcattattttcttcacttacaaattctgccttctgtgattgttcatctgtgacgacgacacttcgtgaacgaacatgacggacactgcaaatcgacagcgacgcggccgaggcgagagacgcacacgagtggtaagacagttggatggtgaacacgattctgacttctatttggaacccctgacccggattcgaaccaaaactcgaaatttcaattttcgacaaaattaaaattatgcaacaaaatgcacgaaataaaacggaaaatacgattctgaaggcaagacagtgtatttcaggcatatttgaactgtttttgttgcatgacttgaattttgccgaaaactgaattttcgagtttgtttgagtccgggttagggattcgaaatggacttcatacagcgcccccgaaaacccccctaaagcatcacaaagccgctcattccttttttactcttttatgggaccacaaacggattttgacattaattttagtcaattttcagcttctacgcgacagtgccaagaaaatcaccaaagcgtccattcttcgtctggcccgacgtgccggtgtcgcccgaatcaacgcagaagtctacgacgaggtccgtgccgcgctgcgctcgtacttggaaaccatcattcgagacgcggtaagttttcaaaaaatgattaatcccgatatatcacatcacccaatgctttcaggccatctactgtcagcatgagaggcgcaagaccatgaagagccgggacgtggtacacgcactgaagcgccagggcaatttgatgtacggcttcgaacaataagcgcaaggaagaggaggacggatatatttggaaccggcaccatatgacattttcatggataatatattatcattgtacatatgtgtgtatatgcctatattgtattgtatattgttttgtcatttatcagtgcaattcagggttgttccgggtcgagaaaaatatcgggtcgggtttcgggtcggccgaaaaatcatcgggtcgggtttcgggtcgagaaaaaggccgggtttcgggtcaattgacaaatttttaatttgtttaaaaatcaaatggcactgcaatatttgcagcgaattgcgccatttataggacgatggaaataaaaccaaatggaatcaggtttttcagccatctgctttgcttaaattcaagaaattcatacaaaatatctttagaaaaaggataataattagggacgtgaattttagtgaagaaaaatcccgaaatagttaactaaaatagtgagtaaaaatgccaaaatagtgaagaaatagtgacgaatagtgacataattttcagccaaaaattgagcaaaactaatttttattcactatttgcagttgcaaatgagttggactgggatttttaagaccaaaaaacccaaaatagttacctaaaaaattttttaaattaaaaatttttgccaagaaagtaaatttttgagaaaatttttttttgatttcttaggagtattttttgaaatttttttagctcgattcttaggggtgtattttttgattttattgcatttttgttaacaaattttccaaaaaatgtagaaatagtgaaaaatagtgacaaaacgccaaaaaagtgaattttcatttaagtgacgaaacgccaaaatagtgatttctagtgacgaaaaatgacgtccaaatgaaaaaattttaatgcataaatgcgttttttgagcacctttcttcaaatcaatcgagcaaaaaaaagtttttccactagaaatcgcgtccctagtaataaattgataattaattaatttgcagacaaggattagggttcatatcttttggcccggaccaggccgttttcgcgtgggcccagtttttgaactataattttttttttattgtcaactaaacccacgaacttgatacattcgaaagccctaagtgccctctattagccatcatttcaaaaaatttcgtttggttttaaaaaagttaggcaaaaaatgggtcgaacaaccagttttttgaagggccataacttttttgaactttaacgaaatttttcacaatttcagaactaagaaagagggtatttttttctttttagtttgaaaaatttattttctttttttattggtttttcttttggtccaattttcctctcaaggngtccccagctagcaaggggcgtaagccagaacccttaggctttcggagggggctggaagtcaaaaactcgatt

SEQ ID NO: 2233 - DNA, 2678 bp, Heterodera glycines
  misc_feature (119)..(119): n is a, c, g, or t
cattatcaatagcttaagagatgaggaaaatatggatgaattgaacatttttgctgaaaattatgacaaaaaattaatgattgacaagcaacaatcattaaaggaactgttggcaattntaatgaaaatctacgcggactatagcaatgccagcaaaagagaaataagcaaaaatgccattcggttgacacattctgggaatgtaactttacgatttggacaaattttatatgaaacgatagagaatttggaaaatttgccggaagaccgcgtgaagtacgatgaaaatgaacaattgctaaccattccattattatttgtcaatcatttgcttgagcgactcaatgaattcattgaaaggtttgtaaattagcctatggcgttttttgccacatttggtcaacattttctgctggcggttaaaaatggtttaattaattataatataaatgggaaacatagaatttttaattactttttttaagaaacttgaaagaaaatagtaaaatcagtgatgactttgatttcgtgctaacacttcaaacagttgccgaagagagcacggaattagaggcggagaaacggcaaaagccaatttcggctggagttaatgtgaacttgttccaattgcttttctcattagcaattcgtttgtgcttactaattgacgaaaaagaaaaattggcagaaaaatatttgccaaaattcgtattcgcattgaaaatgtgcacaacaaacactgggtaaaaaggcgtgtttcattttttattcattaagaatttaatctaatatataatatatatttatacaaggaaattaaaacaaaaagaaatatttggataaatatttgtaaaatgcacttaattaagttttaccaaattctatttcatcgaatacaaaatcaaaattgcacaacaatctgttaagattaatttgccaaattggaatttgccttataatgtttatatgaaaaatgaaaaggaattaaaaatggataaagctgaaagtaaatttgaaagtatttaataaatagttcattaatattattttttaatagacaaagagattgtgaaaaaattgagtgaattaatggaattgatcaaactgaaaagggtagagaaaggtaataatcttaaatttaataaaaaattttaaataatattgtttttttttaatagtgaaaggactcaaagaaaaatttgttgaattattggaaaaagatgaaggtaattttgaataaaagtcaacaattttttaaagtattatttttataatagtggaaaagctcatggaaaagctgctggaattgaaaaaattgcaagtggaaaaagccatgggtaattttaaattattattattatttaattaattaattttataaattatttctctaatagtcgaagagctcttaaaagaattgaagaatgtttataaagtataaaaatgtgaagagaaaggaaaacatcaaggccggaagaaaagcagaaaaaaggaacaaaaacaaaaaagaattttctcccattatccaacatttcttttttcactttatctaaaacgatgtaaaaaattttgcgcatttatttttgaaccaaattcttcgtattgttattaggctggacacaaattcgacaaattcattatgtccatgattttcatgcgtatacaaatttatttcagttctttatccatcaaaaaaaacttcggttcccaaaaactttcatttcgcctactaagccaaaaaggtaagctcgaacttgagcccgtaggaaatcaagattttcgtgagagaatatatgaaaaactccgctctttttgtagatagacctgaatgtttgaaagacaaatttaaaatagggagaaaaattttcacaatttttcctcacatgaaaagccgggatttccggcggagatgggagtgagtaaatcttcccagaatttctagtgctcttgcatgcccataactggctacttattattacattttttagcgatgcgatttagagccttaatttttgcccttttaatacgcctaatcctgattttagaaattttcctttaaaattttaagtaatttttgtgtgtatgcttactgatttacccttatttgttaggcagaaaaatgttaaatgattttttgctagaaaaacatgaaatttcttaaattttttaaaaatcatacaaatattttttgagtaaaaagtctcagtttttacaaaattattcaaaacataattaaaacgctcaaatgttaaataagaataaagaaattttcgtttagatgacattgaacctagtaaaaaatacacagcttttttcaaaatgtcgagctctattaaaaagcaaaatatttaaagattgtcaaacattatgccaatttatcaaaattaacataaaatttaacagattctgaaggtgggggtcggtgtagtctggccattatagtaagagggacagtatagtctggcaaggtgtttttgtcccccacatggattctaatctggtttttttcgaaaagagagcatggaagcaaattgaaaacgactatgtccggtccggattctgacaatttttcccaaaagcctcaaaaatcctcaaatcctcacttcaaaaagaaaaatcctcattgatctatgaaaaaaccacaaaatgagggtaaatcctcagatctgcgagtcctg

SEQ ID NO: 2234 - DNA, 1739 bp, Heterodera glycines
  misc_feature (1627)..(1627): n is a, c, g, or t
  misc_feature (1715)..(1715): n is a, c, g, or t
ctatcgcactaccagtgccggataatgatcagtttgacggaggtttaaaatctaaaaaatataaatataataataaaaaatttttgtatttttttagctttctctcactgatcaatcaaatcaagaaagacttaaaaatgcccatgtgaaaccaaatgaaatagacgaaaagggaacgaaaaatcataaaggaaaaaaaaaaggtatgatatttttggcacttttaaaattcaattaacgaaagaaaagagtcggcaccagtttgaaaattataaaaaatagaaaattaaattaaatttaaaaaatttagcggtaaaaatatattccaaggaagaaaaactacaattgcttaagaaattccaaaaaagaaagaaggaattcaaaatggatgaccaaataaatgcatttaatagaatggaagtagcaattgctcaggaattaggtgttagcataagaatgataaatgaatggaaacgagagttcggcttaacaagtaaaatttaattggttttcaaaaataaaatatcctacttttaatttaggaaaatacattaattattcaaaagaacagaaattagaattggtaaaggaatttcaaaaaaaaagaaaatgaattcattacaactgacaaaattaatacagttcgtagaatagaagaagcagttgcaagggaattgggcatcggtaggacgaccttaaaaaaatggaaaaaacaactcgggctaacaggtgattagaatcattttaattgttattctattaaacgatttatgttttagcgaaaaaaagttattcaaaagaagaaaaattcgaagtgattttgcaatttcataaaagaaatattgaatttaaaaaggatgaaattttaaattcatacaataaaattgtccaagcaattgcaagagaattaggcgtaagccgaaaaaatatatacaaatggaaaaaggaacttgggctatcaagtaagaatcattttaatattctatcattatttataaataaattttttaaagacgaacaatggttggagctaatccgaggaagaatgaatgaatttgaaaaagatgaaaatccgaatgaatttaacaatgccgaagatggaattgaagaggaaatggataattgtcatgtcaaaaaaggtgattttaaatgctacaaaagaaataataaaatattttaagagagcaaaatttattcaattaaagaaaaacttgagttgctagagcaattccaaaaagagaaaaatgcatccaaaaagaatgacgaattaaatacattgcgtaaaatagatgctgcaattgcaaagaaattaggcatctctcgaactgcgatttacagatggaagaagaaatttggactctccgggttatcaagtgattagaaagaatttaataaactatttgattaaatcaattagatttatattattattagggatggcatttttaggtttttacctattttttttttgcggcttagttatgatgagagaagcccaaaaatagcattttctcctaacaattgtcgatttagagcgactttttagcacctaaaaacacctatttttggcgttttggcacctaaaatagtttacaacctattttggcatttttcgaatttttagcancctattttgggattttcccagaaatttcatagtaaaaatgcaataaaaacgaaaaatacacccctaagaatcgatcccaaaaaaatanaaaaatataccccctaaaaattga

SEQ ID NO: 2235 - DNA, 1352 bp, Heterodera glycines
  misc_feature (1324)..(1325): n is a, c, g, or t
  misc_feature (1331)..(1331): n is a, c, g, or t
gcagagaaggaattaggcgctgatcaaatttcgcaaaacaattggaaaaataaaatggcttaaaaagtaagttcgattatacttatggtttagctaatctgacaatgcttggacatttaaatataaattagattttttgttttagagagaaaattatattccaaggaaaaaaaattagaattgctaaaggaatttcaaaaaagaaaaaacgaattcatcagaaatgacaaaattaattcagtcgaaaaaatagaagaagtaattgcaagggaattgggaatctgtcgacggacaataagaagatggaaaaaagaattcggcttaacaagtaaatttcaatttaacattaatttgtggtagaattgatgatttttatttgttttaaattaatttttaaatattacttagatttatgtaatttagggaggacgattagttattcagcggacgaaaaactcaaattgcttgagcaattccaaaaaatccgaaatgcattacaaaaaaatggaattacgaatatatgtgctaaaatcgaaaataaaattgcaaagaaaataggcgttgatcgaaaaaagataaagcgatgggaaaaatggcttttcatagcaagtaattttttgtccatttaggcctatgaataaggttatacaagaatgaggaacaaagttatccttaaattgggaattagaataaatgaaaaacatacaatgaattagtgctgctcgagagtctattcttgagtctcatcgagaaaagtctcggcttttgtggtctaagtctcgcgtctcggggtcaagtccgcggtctcggaaagtttcagactctagtgtcactactagagaggcggaacaggaccagaccctggcatgaatttacaggatctgaaagcatccgcatcctaaaaattttaaaacccaatcctataatatgatcccaaaattcgtaatttgccgatgtcgaaacactactattgttaatacatgttttggaattacatgttttggaaatctagaaaataattaagaaactaattttgtaatgaaatactcattttcagctttccaacatcagaatggacaaaaaaacaaagcagattcgcttaacgcagaatttaatgatcaaaacggtcaatcatcatttatcaaaagacaaaaacacgtcaactttgaagaaaattcaccgccaaattcgtcaccgatttcgcaatcaatttcttctgattcgccattgaataatgaacttcacgaaaaattggtcagtctaaggactaattgtttctttttggactccagatttcgcatagattttgatttttagaatgttnnctgcgnattggatcaaagcaattttat

SEQ ID NO: 2236 - DNA, 4447 bp, Heterodera glycines
  misc_feature (4435)..(4435): n is a, c, g, or t
taattaagaaattaaatttattttagagagaaacctcttgttatcccaaggaacgaaatttaaaaatatttgggcggatgaataatgaaaaaatatttacatatgacaaaacagaggatgatgaagcagagaaggaattaggcgctgatcaaatttcgcaaaacaattggaaaaataaaattggcttaaaaagtaagttcgattatacttattgtttagctaatctgacaatgcttggacatttaaatataaattagattttttgttttagagagaaaattatattccaaggaaaaaaaattagaattgctaaaggaatttcaaaaaagaaagaatgcctccacaaagaatgaagaattaaatacatggcataaaatagaagacaaaattgcaaaggaattgggaatctgtcgacggacaataaacaaatggaaaaaagaattcggcttaacaagtaaatttcaatttaacattaatttgtggtagaattgatgatttttatttgttttaaattaatttttaactattacttagatttatgtatatttagggaggacgattagttattcagcggacgaaaaactcaaattgcttgagcaattccaaaaaatccgaaatgcattacaaaaaaatggaattacgaatatatgtgctaaaatcgaaaataaaattgcaaagaaaataggcgttgatcgaaaaaagataaagcgatgggaaaaacggcttttcatagcaagtaattttttgtccatttaggcctatgaataaggttatacaagaatgaggaacaaagttatccttaaattgggaattagaataaatgaagaacatacaatgaattagtgctgctcgagagtctattcttgagtctcatcgagaaaagtctcggcttttgtggtctaagtctcgcgtctcggggtcaagtccgcggtctcggaaagtttcagactctagtgtcactactagagaggcggaacaggaccagaccctggcatgaatttacaggatctgaaagcatccgcatcctaaaaattttaaaacccaatcctataatatgatcccaaaattcgtaatttgccgatgtcgaaacactactattgttaatacatgttttggaaatctagaaaataattaagaaactcattttgtaatgaaatactcattttcagctttccaacatcggaatggaaaaaaaaacaaagcagattcgcttaacgcagaatttaatgatctgaacggtcaatcatcatttatcaaaagacaaaaacacgtcaactttgaagaaaattcaccgccaaattcgtcaccgatttcgcaatcaatttcttctgattcgccattgaataatgaacttcaggagaaattgtccagtctaaagactaattgtttctttttggactccagattatttcgcatagattttgatttttagaatgtttctgcggaattgcatcaaagcaattttattggcggaagatatccaaaacgacactgcaatcaaagagtaaaagataaaagtgttcaagaagaaaggcagaacagcagccaaccagtagtctattgtatcaaattgacgaatatattagtgctaatgagttagagcatgacgacacaatacacgcaatgaaaattagtggtgggatattttgcatttttattaattaatttttgcgctagttaaaaagtggagcactttgaattttcttaaaaccaagaaagggtaataagcccttttgctttgcaattttataaattcgtttgcgaattttatttgtggaattcgagttgggattagtaattagtgaaaaactgatgtcaaattcgtgctcaactactccgaagcacagctaaaataaattccacaatttaatacgaccaaataattttgctttttaaataaaattcaaaaaactccactttcaaaataatttcgatttttattattatagaatttacaatgaaatacgttagggaatctggcttgcttcatccacttttgttcagcgagccacctgaaaagttgggaatgaggtttataaagtaattttttttaaaataaattttgcattttaagaatgccaaatccacaagagtttagcattttggatgttcttggtaatttattcgttgttctgtatgaaatcagaaacttttaattacatttcagagcttgttggtggcgaaagacgaattgaagttttcgatgtacacactcaggaggggaaaaatatgcgactgaaagaatttgtcaaatatttcaggtgaataatatttatggttgggatactgtatgtgataaatggacgaaaaacaccatttttattgcttaattctttattaaatactattttgttaaattgtaaatataaataccaaccctaaataatataatttgttgatcagtggaatggaattatccaatcatcagattttttgttttagacaaagtccgtcaatgcgtaaaaatttgttgaattcgctctcactcgaaatctctgacaccaaattgtcagaacaggtttttaaaatgatttttatttatacattttggttcatttaggtgatagcgccgggttttgtaagaagaattgattggattgacaatgtgtggccaaaagaacttttggcacgtcagaaaaacctactaaaaaagagtcgttgggcacgaagcaacgatttttccacttacccaaaagtgcaaaagtttgtaaaatttaaaatatatttttatgattttttactttaagatattgcctgatgagcgttgctaattgctttacagactttcatattggtgagttatgaaaaactttttgttctacaaattttgctaaatttgtcgaacaaattcactcttccgatgggacttggatccacggccttttcccattgcgggaaatgctttaacaaactaagctatgggcgtttcctttagattttctcccaagtcctttatcccatttccccatacccgcttccttctggcaccaaactcaccacatcattttccggaaaattcctcttaaaattcatttattttaagattttggcggatcatcagtctggtaccatgttctgaagggtgaaaaagttggtgacggatgagaaaaatttaaataaaccttttatttgataatctcagaaaaagatgtagaatttgtataaattaaattttcataattcaataatgctacagcaaattttagattttttggctaattgaaccgactgaggaaaacctgaaactttatgaagaatggtttctgggcgggaatggagattcaaaattccttggcaaattgaccaaatgttcacgtgttcgactccgtcagggagaaacgcttattataccatcgggtgaattaaaacaaacatctttggtgaaaattgcataaacatttttcgtctggcttgttcacaaaaactgccaaattggctattcctaaaaattggcatttgctaaaactgccaaatagctgttttggcattttttgggaaacaatgaagcaccatgtttcttacggacgagtctgtgaataacattgatcgccgttaaggatggattcacagtgtttacacaccggtggatgcactcgtttttggtggcaactttctgcacagttacgcaattccgacacaaattcggatttcaacattggaagataacatcaaagtgaaatgatttattaaattaatatatattaattaataatatataataaatactctgtttggtacaaaaatttatatgatatttggtccctgaccaaattatcaaaaattttgtaaaaattttcaaaaatccacaaaatacccaattttggtgcaaatctatttaaaaatttggccaaatctcaatttttcaccgtcctactgtagtactaccgcacagctgggcctctcattccccgaaacttttttgaaaaaccgcaaaagcggtgtgcagtgaaaaacacatcctaggacgaccatcagtgatgctggtcgtatcataaaattttattatttattgcagcgcggcaaaaaatatcgcttccctcatttcaaacaaatattttggtgtttcattgcacaaattgtgcgcaaatgcacacatcgtctgtaccagaaaaagctgtcagaagaagcccacaatgttgaaggcctaaatttggtgcaggtcattgatgaaaggatggtcagtagcctttatttgtggttactggacatttgcgccccggatatttacacccgagcatatgcgctccagacattgcgccccgaacctttgagcataattatcattttaagcttaaattttaaactttgttcaaaaggatgacgaaatggcaaacaatggcccacggctgaatttggatggagaagaaatttgttacaacgaatttttgggaaatgcaattgatgtgagggaattttatagcaattaaagtccaanattaaactttaa

SEQ ID NO: 2237 - DNA, 1123 bp, Heterodera glycines
gtatcataaaattttattatttattgcagcgcggcaaaaaatatcgcttccctcatttcaaacaaatattttggtgtttcattgcacaaattgtgcgcaaatgcacacatcgtctgtaccagaaaaagctgtcagaagaagcccacaatgttgaaggcctaaatttggtgcaggtcattgatgaaaggatggtcagtagcctttatttgtggttactggacatttgcgccctgaacatttacatcccggacataagcgctccagacattgcgccccgaacctttgagcataattatcattttaagcttaaattttaaactttgttcaaaaggatgacgaaatggcaaacaatggcccccggctgaatttggatggagaagaaatttgttacaacgaatttttgggaaatgcaattgatgtgagggaattttatagcaattaaagtccaaattaaactttaagaaaaatcagtatcaaaattcggaaacaaaaaatatatttataaaattcggttttagggttcatatacatttaatccgattcaatcagtctacgacaataaagacaaggcgaaattcactcctacaaaaaactacaatattggtacgcacaaaaatattaatagattatcatttataaattaattttgatggttgaaaaaattaatgaattttaatttgatagtatgtataaatccgtgaaataattatgagtcgaacttgaagttccatttattgtgactccttggggtttatttttcaatcccattcaaaagaggggctttattttcagggggtgggtgtgcttgctgcatttagaaatacggtaatggggggtaagtcgttgtttttttagaaatacagtaatcctaattgctctaagatttccttcgttccattccaccgctggtgatcagtgggcttccaccgcttctgaactatgctaagcgattgttgaagttgaagcaacccgaagtgatcgagggcatcactcgacctaaccatttggtgaaagagtttcaagtttgttggcaaaacgcccttttttgtgccattgtttaatgggtactaatcggtagggatgagagttttaggcacaaaaactccaaaataggcaaagttag

SEQ ID NO: 2238 - DNA, 4544 bp, Heterodera glycines
  misc_feature (4500)..(4500): n is a, c, g, or t
agccccgggaattttttttttaaatagaaaaccctattatttctaatgatttcgcaaaactcaattcctctttttttagcaatgtgtttatttattagaaaaagaaaatctttaaattttctcaaaaattataaaaaagtttaatcacactacacttgtgaaaataatcattttcaaaaaaccaactcattatcagaaattacccagatttttttcgaattcacctgggacgactgaaaattgcggtatccgtccacgagccgctgcagcacggagggcgactcagagggggacggaagggcacagggcagcagcgcaattgcggcggccggtgtctaaaaattagggaaaatgaaattaaaaaaaatatttaaaactcgtattttacatcgacggaaggaccggcggtggtggcgagggactgttgctgaagagttgaagacggacgaacggacggagaaagtgcgaaatggagcaactgaatatgttaagagtcagtccaatcaaaaaaaatattagagtttaagggcaaaattttttggcgattgtgtaaatttactgttttttggtaccgatgccaaaatgattggaaaaattgaaaccgaaataccagcgatattgggttagttcaattgattattctcccaattaaattttaaaaatgcctttgacggcaaaaaatgaatttcttaaaagaaaaatgataccaacttttttttttattggatttggtcggtcaaataaggaaaaaatttatttacatcataaattgtggcagccatttcggcatcctaaaatcggtggatgtgtgacgacccgtttcggcatcactcaccccggcaggcagtgtcggggccgtcggcgccgccgtcgttgttgtggttgtcggcactgtcccgctgccatccggaaagaatgccgagctggacaatgcgggtggtgttggttgcattgcaccagtcgcactgctaatgccaatgccaccgattcggcgaagttcagagacggaagaagccaagctggaatggaggaaacaaagaagtgtaggggaaacatttcataaaagataaaaattatttatagaggacactgaattttcgaatatttttgaatttttttttgaaaaaaacgaacaacccctgcggtgaggagtttatgtttattgttaggtgcataatttgttgggggaatggacgaaaaaaatgagagtgtgatggaggaggatgcactacgttcaccccccccccccctccccagtatcagttcccgcccatcgcatcgtttcgtccgggaattttttttcaagaaaaaaatcttacaattagaaacttttttatcttctaagagaaaaaatttcgagaagtttcagcgattttttgaaaaatcttagtaagtgaccacaaaagttttcgaaaaaaatttgttcatagaattttgttacaaagaactttctattttggggatgcagccgagacgaaaactgccaatttcccattaatttttatgtttttgcattttagcaattttttggaagtcttggtctcgactatcggggccaattcccgattcctaatccagaaaactttgcctctgtgcctagtgggtccatcgttttccaaaccaaactcactcactcagcatttggtggtgaagcggcagtggtggtggtggtggtgggaactgtgcccaacggcgacgaagtgggaacagaggaggaggaggcaacacaggcaaaagcgcttagtccatcaaaaaaaaaaaattggtgtaaaatttaaatgaaaattggccgtcacacaaaccagtagtgggaatggcgggagcagcagcagcgacaactctttttctcttccgctcaattggtgctgaagaggaggaggagacggcggcattgtttttcttggcatttcgcttcccaattgggtcccggtacatttggacgtctgaaaaaaaaaatttaaatttttttatttcgtaatagtcgggtctccgccccctgtccctccctcccaatgttggcattttttgtaaaaatagaaattatatttttgatattttgcaggctaatagaaaactaaaaacgaaaatgcaacattcattttgaatcaaagaaaacccgaatattcgttcgatttgggccgggggttcggaatgcatcgattatcgtaatagaaacccatccaattaaaaactgaccctctctgttcatgccgagccgaatgcacaagtcatagcgacacgaacggcacatattccgcatttctaaaccaacaaaatgagagcggacggattaaaaggaaaatgtcattttttaaatttttaaaattaatacccttccgtatttcgcactgtccgttttgacggcatcggtacgttttcttctccaccactgtgcgacgaaagaaggcggcacaagcgctgaaaaaggggggggggtaagtttcacaaaaacagaagaggaataaatttggcatttttcgatttggttgccattttcctttggtccttttttggtaggcattcaaaataatttgtattttttcctagtgcttaaaaagcaaaaaaaaaaggaggttttcataaatagcaatgaaaaagcggtcttgccggcatgcgagaatgccaaagtggtagccgtggctgagatggccgcacactaagcaaaaccgcggctttccgctcgacccctcttcgtccgaatcgtcgctcagattgagtgggcctaaaaaataaaaacaataataatagggcaataagtagtaattatcgattaatttgggcaaggcctcgcccaaaaaaaaaaggattattcagggattaattagataatcacttgttgtagactcgacgaccacagattgtgtgggcaatgaagaagccatagaaaattttttgtcatccatcttagatgaaatttaatgtagaaaaatggggaaaataaaaaataggtaattaaatcttaaaaaatattttttatagacatataggtataaatcaaaagcatagatttatgtgacaaaatagccaaaggtgtaaatatctctggtatttttcatgccatttccaccaaatcacacgctctccgagcaaccgcccaaaaatgacttaaatattgcaatgggtcttgacccgctcgttgttggaattcagcgaagagttgccgcaaattgttgtcttgttgtagataaatggactttctcttaaggccctttccccttatcccatttgccggtgcattgtgaaaatcggcaacaatgtgctgccaacgttcaaattctttaagcattcgcttaacaaatttgctgaacagtgggtttggttcaagaagggccccccaaatgttatgccacgcttctaacgaattgttgcttcttgaaagaccaatttcgaggcgatgagtcagattccatagctaaattacagaaatatgtaaaagtagatagtcaagaattttttaccgctattggaaatagcatttggggaattacatttaggcactcatgtttgggaaacgagaaattttgacgtccattaaaaattttttacggtgatcactgatcagacactccaaaatttcaaatacataactttatttaaaaaaaaatagttttcactaataaataattctttattttatttcagtgacgaaaggttcagtgacgaaaagtttagtgacgaaaggttcagtgacgaaacgttcggccacccgaaaaagctttctttctccgatcaaagtgtgtgtgtatagtttgtgataagtagggcgtcaaattatatggacaacaaatcgcaaaatatggacataaaattgcaaaaatctcaaaatatggacataaaattgcaaaatatggacatacatttttccaaatttagtgtataatttctcaaaatttcttcaaatttattggttgaaatgcatataagatacatttccaaattttgagctgaaaaactcattcgattgtcggcaaatttaaatttattcaatatttttcgtgaaaattttgctaaaaaattattttttggaaaattttccggtttttgaggtcaaaaggccaatttgcctgttgggggccgttctattagaggtttttttaaaaaatgccaaaatatgggcataaaatatggacataaatgccaaaatatggacaaatatggaaatatggatataaatcgcaaaatatggaaaaatatggaaaatatgagtatagaaatacggtaggggtcaactccgtctcagcaatgttcaaaaagctataacttttttctttgttggccaaacttcacaatcatggtatcattcgaaagccctagatgtttagaagatatttataagctatttctcagtgattaatcagctctcaaaaaagttgtcagttgaaaaccgcaaaaaaggcagaattttcaaagttttttatttctatctttttttatagttcgaaattttctgtaatttttagtaggactaatagagcatgtgaagagctttcgaatgatatncagattgtttgatttggtcaataactttcagcagtatattgact

SEQ ID NO: 2239 - DNA, 5978 bp, Heterodera glycines
attatttaaggaggccgctaaacaaataaacgattcttcgtcctcagacagcaaaagcagcacgtgaattgatggaacaaaacagtgaagtggacgaagtgaggcgacgaattgcagcaaaaatcaaagcggaagtgatcaatgggaagtgaaaaatgatcgaaattaaataattaaaagtgatcggaatttgttaattggtaattaattggtcagtgaaaacacggtgattaaaatggatgaaaaagaaaagctacttttgagacattatctcaactaatttgggaagtgaaaaacaatggatatgttaggtgtgggaaagggtcattttggtgcccacgttttggcgccaagccatataccttaaaagggtaaattttttgatcaaaaattttacaaaaaaaaattgaaaaaattttaccttccaatgggcttactctaattttcaaaaaaaaaattccaaaccccataaattttttttttgggaaaattgacgaatactaccaattttgatttttcatataaattattatatatcattcgattcgtctcgatgagacaaatggaatgaaggagtgatctgatcaacttgccgaaaagatttttttgatcaacatggaaattgacttagcaagaattttcaggtctttcctacaaaaaatgtcaaaacattttgacgctcaatttttttctgttaaaatttcaaaaaggtttgtgattatatacataatgttgacggtatatttaagaaattagaacaaaatttggtcactaccccaagatttggaccctccaaattaaaacagttctgataaaacaaaacagatacaatccctgatctatatgttcaaaaaccctttttgttcgaaatcgagtccgggcttcgcagttgtcaaaatgaataccatattcgtgattagcgacccagaaaaccaaagaatatatattttgggacggggtcgttttggcgccgacgttttggcgccagcctcagtctttttttcttgttgaccaaatctaacaatcttggtatcattcgaaagcccttcacaagctctattagccttacaaaaaacaaaccaaaattttagcttctaaaaaagttattaagaaaaaactcaaaaatttcgacttttttggaatttcatgttataacttttttggtaattgtctaatcgcgaagcaatagcttagaaatatcttctaaacatgttaagctttcgattgataccaagattgctggatttggttaacaacaaaaaaagttataacccaaaaacttgggctggcgccaaaacgtcggcgccaaaacgatacggaccctaatttgacgccctagtgataagtactcacattttttcaaaaaaaacaaactacaacagcaaaacggaggagagtcgaacaaacaaacaaaacaaaacacaacacatgatggtattcataaataggttgtacgtaatgggagtgcgcgaagcaaatgttttagattttatttccgccgggagggccaaaaatatgcgccaaatgggcgtggaactacaaagtacaaagaacaaaagacggagacggaatggactgaaatacatagaaaggaatggtaatgggaacatttgtgattttattacgtaattaataggggttgaattaatggatataaaatcgtaaaatatggccataaaatatggacaacaaatcgcgaaatatggacataaaattgtgaaaatctcaaatatggacataaaatggaaaaaatatggacatcaatttttctaatttgtgggtataatttctccaaacttcttcaaactggctaaattcaaaataaaaaactttcaaaaatgcctaaatatttatttatttatttattcaagtaataaaagtccaaaagaagggacaaaggccgcttatactttcggaagagaatgatagtccgggaaacatgatggtgtcagatctccaacttgaaattaatcttgtaaaatactttttacttttttcttgaaggtgggcaatgatttgatattgaaatatctgaatttttgcagatttcttgtagatgttttgtggttctgttagtaaaggagtgttctgttttggtaatttttcgtttggttaccaaaataggaaaaggtgatcttttcctatttgaaaaattataaggtcttttgggttgaggtgagtagtatttttgataattttaaaggctgttatgatatcaagatattttctcctggtttcaagcttggaaagttttagaaattttagcctttcgctgtatgagatgtaggggagacagcattttctgaaaacattttttgtaaagtttttctgaaatttttccaggcggtttatttcttttttggtttgaggattccaaatttcggttgcgtattctaaaaggggtcgaatataacttttataaactgtaatccaagtcttggttgacttggttttaattttttttaaagaattctgcttttgagataagctttttggagaattattgaaacatgttcgttgaatttgagtttgttgtcgattaaaatacctagatcacgaataatttttgattcaggaaaagttgaatttttaattgtgtacggtatttttttgttatttttacctagatatgagacggaagatttttttactgaaaaatttaagccacatgtttcaattaaagactgaaattagagctgtttctaaaactttacgttgggattcatttgaatagcaatgataaatttttgtatcatctgcaaaaagtttaattgagatttcttttggaatttcttcaggcaaaagctaaagggattttaaaaatgcaaaaaaaaaagaatgaaatttgcccgggctagtctaaatgctaaaggggctgactgcaccgaaaattgacaaatttgacaatttgtaggagagagcgagagagagagaataagaaaagagagtgaaggaagccaaaaataaccaaaaaaagtcctggtagcaaacgaataaggtagactaatttataaaaatatttgaacgattgagaagcaaaaaaaagagagagagaaaaaagaagtgagacagaaaaaaatagaacaattttttttttgaggagagcaaaaaggcctgggctgataaccaatcaaaggggcactattttagctaattaaaaaaagagggaccaataaaaaatgaaaattaggccctatcattttgcttacagtatgagttacagtttttacaagttccaaagttcattttatctctttgttttctctcgtttttcacgccataagaatattcacgtaatcacgtgccgccgcattttttcattgggcaagatcattcactttacacatttttgcggcgcctgagaattgttaattgctcttgtcaggcggagtttaaatgaagatggagcagataagcccattcctggaaggcgttcgcatccattcgattacccgctgtcattcattaattttttttctctctcaatcaatgcataatgggattaccaaataatttttttttagcaaaataaaacaaaatcttattataactgaacgacttcgaatgtctacatcagggggctcgtcaaatgagttcccctttggtacatcccaagccttcgggcaggaaacaaagatgtttttgagtggaaaggaggatgagtcctcgatttcggctattgataggaaactttggcaaggaaagaccacgataaaaatctctgatttagaaaaagctcaaaatgatatggggaaattagaagatggagtgaacagagcttttcgctacatgaatcgttctttgaaccaaaaagtcaacaatgcctatacaactcaacaaattcaaacactatgtcggccgagaaatctcacaatggccttattcgaccgttttggcttacaattagcattagcctaataagagaaataaatttaaaaaaaaaacataaataaatttggataaaattttcaaagattaaagctaaacttaagtgaaattcatttaatagccaaacttattgaccctcttttcatttctctccaatcgttggatcttgcacccatttatgccaacattagccccttagtttaatgatgcattatgtacattgccccgccttcttctcaccaatcggtcaataaattctctccatagccactcattttcattttctgttttctttttcatcttgctcgtttatgaacatttttttttcactctttttagatctgagcaaaaattaatcccaataataatctgaaccccttcgcctgcgggcaagaaacagaaaatatggtcggaaatggaaatgaattagtggaaacagaggatgacgaaaattctgttaatttcatgaacttgtttgagaatttggaactgacggattctgaaaaattgcctagtctaatggaaattgagaaaatatttacggacaccacaccaacgccagctgatctgccaccaattgaaagctcagttatggggtttgtgttcatctcacaccccatactgtgggcactggtacaaccggacattttgggcgaacaaaatgagctattggaccggaaaaatttaagcttagaatcagatcaatttgtcttccaaagtacaccaagttatgtgacgacaattacattggaccctaacaataactggccacatttcacacaaatttcgttgaattggaacaaacaatctctattaggaactcggctcaaaacaattgatttgaagcaaatgacttatcctccaaaactgggaccatcagtgagtcaaattgtcccttcgagctgctgtggaataattagggaagtgatccaaaataaaatcacctcagaaattatggccattgatgtctttttgtatggggaagaaagtaatcagcgtttcttcccccaccaaatcgattcaagtgttaatttgatggaattagaaggcacccgggtccaaactacgggatttcgagccaagacttcagaaaatgaatggaccaacttcgggtgatggaattcgcgattggtgggctgagcagatctatgtcgggaccagggacgtatccaggatttgggcttggggggggggtaccgatccgaaaagtcaattcttaggggtgtatttttgaaaattcttcgcccgattcttaggggtgtatttttgaaaaactttcgtttttttttttgctcataccagcgacgctgggaaaataggcagacagtcagacagtgcattatttccttcttttcttccgcatagccacgagagaaaggaagaaatagtgcactgtctgactgtctgtctacgtggggctgcggcgggtggaagggtagacagtaaacagccgtgtgctcgctgtgcagcagcattgtgtgtgggaaaagggaagaagtgagaaaaataaagaaggaaatagtgcactgtctgactgtctggttacgcttttgaaaaatttgacccaaaagggggatacaaaccgaatgaggggggggggggggtatctgttgaccataacaaaaacgtattatatagaaaggaaaattattcaatattaaaaaacatttcaatttctttctgtcatataaaaaaaatattttttacgatcaatgtacatgcacttttccatgcttaaggattccatggagataatttttaaatcattaatactcttttcttggcagaaatggcatgacatgagtatgggcttgccaatctgacaatggaagagtacgtcgtggtaatgggacttttccagcaatagttattgagattgagtgaaatgcgttcacttttatacaaaatttttcgctttttctcgtgcgaaaacatttattatgttggctagcgatttctcctttttcttgaggcaccttttattttttagctcttatttccgttaaaaatattatgtgttttaacattgagacaccagtaacattataataataataataattattattattattattgttcttactttg

SEQ ID NO: 2240 - DNA, 2019 bp, Heterodera glycines
tatttggcgctgatgaactcgaagacaatcagcaatggctccataatgagcaatttcgattgtcataccgctacctatgtgccgccatggactctctacaatcaccaaaacgcagataagttagttaatttttctttcctttgtttctctcctttatccttttcggttctcattggcattctttggtccctttttgtctcctttttttctcccggttttaaggcaattctctttttgttgccattcatttcccatgggactttcgtggaaggcgccgttctttttgcacaaccaattccatttttttttctcttcaaggccaaagaattccttttttttttccttgcatcattttccctgactttttgtcccttttcgcaaatatccttgtgccggcatgtttgcggatgttccattccacaccgccccttattcttggcaatcatagtctccagagaccaaaattcattccgaataattcctaaaacattattgcctttttttaacccaacggaaaatttagatttaaatgccaaaacccaaaaatcttcatttattcatttttttccatgcctgcgggccggacaaaagaattgcttgcaaaaaattgctaatgattttattgctattcagttcgaacgttcaaattgtagagtctcctcaagaaaaggaaattaaaggaatttcagtggacaaagaaatttgtgatcatttttgtgcccatccatgccagccgactaatttaatttttccaaccgaagagagaaatgcaactttgggttggacttgtgtacacctaaagccaaaaattgtccctcaaagttggtcctcatttttctcgaaaaatgcttggacaattggcggcataatttttactcttgccggcatttccttttgtgtaattcgagcatatttgtggtcaattgacccgattcaattgaaattaatgtttgaaatttcttttcaaaatttgcaatttccccgcttttgactgcgtttttaattaattccatatgaccaaagttttgcagtgcccccccatttttttctctccgtgccaaatatggcagccgacggaaagcaattcatctcccgtcccctctcccgttttttgctcttccccgtcgcaacattagctttttgcggcgatgaatctcccctgccgctcgggagaaaaaggttttttgcctttttttcccattagctcgccgctgttgtaacatttgaaaaaataaattgcatttttgctgtaacgcccatcgtccactcggacccgtcgttatttaaggccggctcatccttcagaaaagccatttcttgctttcattctcatttttcctccgctccttcatttttttttcatttttccatttcctttttcaattttcaatttttttttttttttagatgcaaaaacctactccttctaaccgccccaattcctctgtctccaaaacccttgcctgcgggcttgaaaaaattgtgaatttgagtggaaatgagccactctcggtgccggtgctggcggatcggagtgatccgctgggactcaagtcggtccaacccgacacggtgccaatggaaagtgccgagggcaccaaggaagtggaaataatggaagtggatgaaatgagtggagaaaaagggaaaaagggtgaaatgggtaaagaaaaggtgaaaagtggtggaatggaagaggaagaagaaagtgagggcagtgaaagtgaactgctaggagaaggtggatttgacaatttgcaattgaaccccagcctgagggcgggaaataaagcagttgaaaaggaagataaggggaaaccctatctggtcgcccaagtgagaagcgacggtgtgatcgcggcacggatgaaacttttctgggatttcccggaattggtctttgtcccttttagcctcttcgacaacgcccagccgataaaaatcggcgatttgttccgcttacataagtgtgagtggacaaagagcgaaacaggatgggaagagcgcggagattggctg

SEQ ID NO: 2241 - DNA, 2407 bp, Heterodera glycines
tgactaagtttacgtgggggatggggaatggaatgttccgtttttaaattcgtacggtctttggcaaaataccgtaatgcttttttggatgttgcgtattacagtgtcccgctgtcccaatttttgttgaaatccctaaactttcagctcctccaccgcatcacctcccaatgagtaccgcttctccgtccccggcttcttcagcttctgcttcgtcttcccaccaaaaccgtcgtcctttttccatcagttcactccttaacccctcacaaaatgccacgcaaaaatgtcctccacttggctctgtcgccgcattttccgatgccctccagcaatgtctgccgatgcttttcgctgtgcggggaatgatcggcgaaggcgcaacgaacgcaatgccaaaagaggaagcttcagcggcaccgttcagaaatgctttccaaccgttgctgatgggaaaagttcggatgtgccaagaaggggccaaagaagaagaggaggaagaagaggagaatgggcacgaagtgccaacatcggaaggtaaatttgaaattgtacaggaaaggaagagggcgaaaaggtggatttgattacatataaggggaagggagggggataacgggggaggggggacgaaagaggaaaaggaagtaggaagtctttgaaaagggaaatggctaatgaaaattcaaaaatcaatttcagaatcctctcaatcggaggacgatgggattttggccaaagatggggaacagaaagtggagatgaaagaagaggaagaggagcaagattttggagagagtgagctgaagatggagcaggaacataagcagacgaaggcggagggaaagagagagggcgacgagagagacaaagggaacacaacgccaagagagggtgcgtttgaacaaccataccagtggaagctcgtaattaaaacgaaagtccccccagggcatactgtactatcaaaaagggaaggaaacggcgatgggggcatcagaaaagcaaaggaatgagcgaccacaagggcatgtgccggtccttttcccgttctccccgtgtcatgccaacttcgaaattgccttcccccaatgtccatcccaggctgttttgtgccatggttgctccctgtcctgcccccctcggcccaccaccattccccgtctttgctccctccgcccagcgccgtccgcggtccggcaccggcgcttttcccggcaccgtttgtccccgcctttctcaagtcgccgtttggccttccggcacaattttttctgtccgccggcacttttcccgccacttgtggcccatgcgcaccgcaaacagcacaaatgcaacaaccgcagcagcaacacaacccaaacaaccagcagaaccatcagcacagccaccaccatcaccacaaccaacacaaacggaaaggggggcaaatccgattcagcaacgaacagtaagagagagagagggggaaaggggagggaaagagggtaattagtggcaaaagcattgattgcattaaggacggacattctggagagcacattcgaagtgcgaaagtatttgaacaacacggaacggaaacgattggcaaaagcattggaattgaatgaaagacaggtggccaaaaggggggggggaccgaagctaatcggagcaaagctgttcaggtgaagacgtggtttcagaacagaagggcgaagtggtgagtaaagcgaaacattttatttttaaagcatttgaatttgtgatcccgtgccatttccgttgaaaattgaagaaattaattaggcgacgccaaatgccctcgtcaacggagtgccgagagggtgaggaaagcattagcgaaacgatgggagggacggcagcgacagaacagcaccgacaccacccgtacgagctgtacatgcagcgacagtaacagcagcaaattttgtggataaatcaagagaacatcggcatgataaaaagaaaagaagtccaacaaatcaatcaatgttattcataaaaaggcataaagcaattaattatttaactagttaataatcaattagtgaggtccattttgggtgcgaaattatggtacagttatccactgatgagtcagtcatgccaacattcatttgccattccgttagcctattacacactcaccccgcccacccactcaaagcatttaattttaaaaactgggaataaaaattggcgcgggagggcgggggggggcgtgcgcggcaaatcaaagcggactttggcgggcgatgctgagcaatggtaatggatatatgtgcttttacttatcccctgccgttttattacaaataatccgaccaccgtcgcctgttgaccccaccaacgaatctttgttttgggccctccgaaagacgaagggacggaacggaggagggat

SEQ ID NO: 2242 - DNA, 6680 bp, Heterodera glycines
  misc_feature (6625)..(6625): n is a, c, g, or t
taatatattagtatattggtttggttttcgctttatcttttattgttttttatgttattggttcggttgggcctctaaattaattaggaaatttcgttttattttcatttgatttcaatttcaatttattaatttaattattctttcctattttttattcccttcccataaccaccataaagtttatttgtttttaggtatttcatttgtcttccaacaataaatattatttttctgttgttcctttgcggacacaacattttattaaattaaattatttttattttagaatatatttcttttattttcgattttctttgctttttggttattattttgttatattatattgtcctttttatctcttatgcaatgtaatgaagagataaatattatttgactaaagttactaatatttgggcaaatattttaaggctacgaattgccaatatattttcatttttatcagattgttttgcggtatatttcaaatattttaataatttattccataattttcttatttatcatgttaaattactttacttggtaaaacaaattatttttgtttataatttatggttacattttaattactaataaaaattttaaatttttttattatttatattttactaatttactattttaaaaaataataataagtttaattttatggtggttttttattttatttgcttttttctttttgttgcgtgtttcaaatttaagaaccttggaacagaatttatggatttttgtgaatttaataaaaaaaattgtaataaataatttaaaaaatttcttctttttttggtatattctaaacatgaatttcctgactattttaacaaattgaatcaccatattcacaattataaaaatatttttatctaatctataataattaatataattataaaatttataaaatattaatacactttcttcgaaatagaaggatattaatgttaatttatcaaatgcctgatatgaaacttccttttacaagtaatattgttttaagtatttgaatttaactaataattatcagtagtaacacacccgggacctctgtggattgacactaattagaagtgacaggtggcggggggaggggtgtcaattagtcactaattgggggggggggggtactaattggtcagcagtcaagagggcactaattggtcagccgtagggtgtggggtggggtgtcaattaattaattaattggggggacccaaacctattgaacggtttcaaattgtcttgtactttttttgacataaaatttgattgatttaaaaagtgacagccgagggggagggggaatttgattggtcagcgaagtgacagatgagggatgaaattcaaatttctgatggggagggggatcggaaaattatgattgatcaacaatgtgacatttgcgggggcattcaaatttgcggggagcggggtgggatggtagagagggatatttctcatcttttctctgtccacccctgtccaaacagagcaatgcatatcgatttgacgggggaacgccgtcactttctcaccgctttactcattgccattaaatgaccaaacgaccttttccataattctcccctatttttaggtgtgttatttttccatatttttctcaacatttgttcaacaccaatggcgcccgggggcaaaacgtatgctcgacttaaaaatgtgagtaaatgaataaatttttgatttgtatttttcgtaagtaaatgactaaattttgttatgtcgttaacatgtttaggcatcaaagcccatcggctcgtcaagttcatcgtcagaggatgaacttcccagcaggaaaaaaaggccactaccaaccatgaaagcaccaatggtcagtttaagtgtttaaaatttttgaaattttttcaagtccttttccgccagtgaaaaggatggattttaatgagaaaaatttgtaccaaatgaaaaaaattttttttcttaatactttagaacgttgcgaatcgaaccggcctgggcaccgacactgcactggtccaacagccagcaccaaaaaaattgcccattacacgcaaaagcgtgggtttaaaaaattaattaattttatcaaaataataaatatccgtttttttttttaaaataatttcccgttaattttgtaggccaagggaaataccgccgcaccatcctcctcctccgtttccgtccgcaatccaacgcgccgcgctccttcaacccgtaaagctgttgcacaacaaccgcaacatcacaaattggaaaagcgaaaagcggtaaatttgcgctgaaattttttatgtgatttttcattaaaataaaaatgacaataattgtattaattttggattttttttttttgaatcaggcaacaccgcaactggacgacaattgcccgggggaccaccggcacccatcacagaccctgttggagcagcagaacaatgcgttgtaccggctcctcttcgatggcagcaacgagaactacttcacccatttggagcgagcccgtcacctcgtccacacatgcgccgtgtgtgagaagaagtacgagttcgtgttggtgcggttcccggacacaggagtcgagactccatggcatcctgtgttaccaacgcatcgcaacattcgtgatggttggacgttgctagacctagcaatgttggtaagcgaaatttgtttcaatttttgaaattggtcatcggaaaaaaaaaaatatttgaggagcccgacacaatttacgcttttgacgcagcatggcaacaatgtgttgcacctgatgatgcgattggagggaatgaaaatgatgatggtggcgatgatgagaacggcagaggaaacaacagcggaggaagaaacaagaagaagggcggaggaggtggacagaaagacggaggagggagcaaagacggagcaaatggaggaggaagagaagaggaggagcaaaacgacaacaatggaaagaggggagaaagagagagagaagaggaaagaagagaagaggaggaggaggaggagcaaaacggaaacaatgaagagaggggagaaaaaaagagaagggaagaagggagaggaaaagaaggaggagaacaagacagaagagaagatgaggaggacgaaggaagaggcgaagaagaaacaagagagagaggagacgaagaggaaacggaagaagcaagagaaaaattgaagagaggtgaagaaaaaggaggaggagagaaaggaggaggaaaagccaaagaaggacgaagcgaaggaggaggaaaagccaaagaaggacgaggaggaggagtaggcgagaagaaacagccgccgcccgggtcaaaaatggtgggacatttgttattttgtgaaatacgaaaacgcaaatgtgtattggccatcggaggtcaatcctttatgagtattggctaccgaagggccgggtccgtgggagtgttggtcgccggagggccgagtccttgggagtattggctactggagggccgagctcttcggagtattggctgccagtgggccgagctcttgggggttttggctaccggaggaccgaactcttagggatgctggctgttggtgggccgagctcatagaggctttgactgtcgaagggccgaactcttggggattttcacagattctaaggcgtaattttatctggccaatcaaaaatttcaatgttaaaatttagacccactcacagtggcgcagagtgatgcgcattaacaaaaagaaaggagtgaaggatggacgagccaacgcacatccgacaacaattttcaatgttttataattttttcgacaaattttcaatgttttatatattttttttttgtttaccaacaataacaacatttcttatctcccattcaaatctttagggatagtggatcaaaataacaaaagaaaagaaggaaagggggtttgggaggggggtccaaaacagatccacgctcattcattcattattcacatttattaaaaaaatggaaccaacaaatacaacttggatcattgagcaaaattgttcttgcaacaatgatttgcttcagtgcgtccggcccctgtactacaaatcacccgtattgtgtgtgcccattgaatttggcaccaattttgtgcaccatttgacccaattttcaaaacccccgtccctcaatgtcccacttgttgttatgatcttactgattctgctccaggtataaaccccctacaaattatttatgtttgtatgtgcaattaatattttacagttgtgtcaaatcatcctcactttgttctatggttatcgccgtcgtcgccgtcgaccacgtgtccgttttcctaccaatgtaagacccttcacaaattttggcaaaaatttttttcaatttttaaaggacactccgctctcgccattgcgccgctttcctccaccaccgccgccctcaattgcaattcgggcaacaacacagaaagtgtgtttaattttgtttctgtttgaacaatttgtattagcatttaacattttcaacaggatcagcaccacacggatgagcgcaaaaatgaacagttcaaaaagagggaggaaccgaagggggcggaggacggacggcgcaatttgcacaactcatcggtggttaaaaataaaaccattgttatatttctaataaaattaaagaagcccaggacgtttccgttcaacaacaaagcagtgatggatgggttgccaaacaacaagcgcaacaaggacaagccgttatacggtatttgtttttgttgaaaattaaaaaatatcacaatattattattattattcagctttggcaagcatcccggaggaggaggagacaaaaaagaatggacgtgaaaagacggcgctcgtgaaggatgacaaatatggggacaattattttgaggattgctattaccagtccacttgggtctaggcaataatttttcatatgcatttttttttttttgctaaattcaataaacatattgtttaattgtgccttcccagatttatttaaaaaataatcccatcaccaccaaaataattcccatcatcaataccgattcacaagcagtccttctcaatttgacgaacagttctttcgagctgctccttgactattccataaaggtgcgccgcttgcgggtcgggtagtccgtttgagcgctcttcgatttttgtgattgtgaaaatcagattcgtcatctgtttgtcgatttcttctttcagaaatgcacatcctaaaattattaaaaattacagtaagaactgaaaatgcatatcaaaaattgttctaccgaaggactttggtccatttattggtccaccaggcaggggtcttgccgattccgacatttccatactctgaaatgccacgcacatttcattgaaatggttttgttggtgccgctgctggcgatgtttttgacgcttcacaatatgaagccatttatattcggaattttttttctgggggcgagatttaaaacgacggcatggggacatttttgtggatttgggaatataattgaaatgagcagtttatgcggaatggcgtgaccaatggaagaggaggcgcgcgatcatgaaccctcccactccccacatctgcttctgcacttcaaatttaaaaatgtttattggtagtcaaaattatccaaataatgcgaaaaatttgatgaattatttggtggtttttggctttttcttttgatcagcaatcatgtcactgacacagcaattgattctggcacattcttcacacatctcgagtccaatcgccactcgcccgtcttccagccggcgtgccttgtctttgttgtgaaataaattgttccagtcctctgaaagctgtcaattaatttggtcgtcaaaaatttgattaacctgagcacagccgaatcgcaagcacaaattggccccgcgtgattttccaaagaaatcgctcatcaacgtgtggcttcttagctttcacttgttgctcctccgcagtttcgggttgtacaaattgttctgccatttgatgatgattttgcaagaatgatttgattgtgtgagaaaatctcggcttaaatagctttcaaaagtgggcgtggcctaattttctgggagtataaaagccccggcaatttgtcagctatgtctcatttgttctgctacaatggtccttgtcatcgaattttgtgcccaaattctcggctgttccccgaaatcactccgcgacaagctcaatcatcctgaggaccgagtgaaggcactgaaggagctggtcggaaaaaaggttcggacgacataccaggaccggaatggaatgcagaaaacattttttgtcgacggaatatcggaccatggagcggctttgaccccagcatacggcagacttcgacaaccatacaacattaacattgctgcccatttctacgctcggcaccgtatcaagctgcatctcccatacgtgccatgtgttgtggagaaatattctggatgtggcgaagacagatactacccaatggagctactcgaaattgtggacgaggactacaccatcaaagagcgatggcttggcaactgtttaccgaaatcgaggacgacttcattcctctcaancgctgtggtcgagttgacgaagacgaagaaattgacgctggtcgtttgaatgcag

SEQ ID NO: 2243 - DNA, 1431 bp, Heterodera glycines
  misc_feature (79)..(79): n is a, c, g, or t
  misc_feature (132)..(132): n is a, c, g, or t
tttttgtaaaatttttggagtaattcaaatcaaacccccgccccccgtcccgcgggggcgaattttcgtgcccccgtcnccgcccccgcgactctgaccaccgccatcccccgcccccgtgaaaagccaccnccgcccacggggtccgaaccctaataaaaattaaagagaaactaatatttataagaaatttattagcatacttaaatggaagctttttcaattcataaagaatagaattattcaattgaaattaaattaactaaaaatgaaaaaaatttttcttcaactcaatttacaattatttatgggaataaattaatagtgaaaacaaaaacaagcaataaaaatattataatatgaatataaataattcatttataaatatataataaagcaaaaatatttaattttgcgaggaatcaacatcatccgctatatcttggacccaacaagattgaaaatattaaggaaaaatttatttacgactcttaaaatataaaaataatcaaattaaaaataataaaataatttatcaagcatcaatttaattacaagaccgaaatcatgaatatattaaatataattattttaaaactgagtttaataaattaattataaacagttagttgaaaataaaaataaaaacgatatcttttttagaacatgccgccaaaaaaatgtcattgcgtcaaaaatgatcattttttattgcatttttgttaatgaatttctgaatttcataaaaaatttgcaaaatgccaatacatttataaaagattgacaaaatccccaaaatattcaaatacgaatattaactttattttaggtttcaaaaaacttcgaataaaaatttttatttgttgagcacgggaaatttaggctaattttggaaattcacaactcacttagggttgaataatgttagtgaaatgaagcttaaaaaacataaaaaactggaaggatgcgcaaaccgcgggccgatccgagtattttaaaaaaagttattcgtgatttgcgtcgaatctgctatttttctcttatagagtgaaccagggcccgaagggccctgctgaaagcgccggggccgctttcaacactgggcccagcaggggccattaggacgagaaaaagccaaaaaagcaaataaaaatgaattggcacagaaaattaaaatcataatatgaatatttaaaaaataaaaaataacataaaattatccataaaaataaattagtttcaaatttaattattaaaatcggcagatcaatttgacagaacaaaatatatatagcgttagcgtaatttaaatgaaaaccttaaaaaaattcaactgggtaaaatatttaactcaattgtttcttcaacaaaataaaaaatagatgagagggggagtaaaaaattggttttttcgttgcaaccctaattgat

SEQ ID NO: 2244 - DNA, 2093 bp, Heterodera glycines
  misc_feature (16)..(16): n is a, c, g, or t
  misc_feature (29)..(29): n is a, c, g, or t
  misc_feature (47)..(47): n is a, c, g, or t
  misc_feature (59)..(59): n is a, c, g, or t
  misc_feature (87)..(87): n is a, c, g, or t
aataatttacaaatgntgtcttccatgcnttaattatgcatgtattntataaaaacgcnaaataaaatgacaaaattacacaatttntggtataaaacatgaaaaacaaaggtggtacatgcgtgtgtatgggtatgtgtgtgtgtgtgtgtgaaagatacaatgaatggtgaacaaacaattacaaagtgtgtccaaaattaagcacattataattagagcccactatccctttgcctacatatgggcgataacatttttggagggggcctgaagtgacgtgtccgccacccctaatgtcgggtctcaaaaagttggggtacatcacatttattggctcatactctccggtttgggcatatcgcaacacttcttctttgaatgtgtcgtagcatagggattggttctgcatcacgtcgtagttcagtgtgatgcccctcagcttcagcacaaattcgtcctgcccattacgccggagtttgagtccatactgaaatgataaagtaaattattatgcactaaataaacggtaaattaacctgcttcgctccgccactacaatactccacaatttcatgcttggggtattcatcggtgaattgtcccaagtgtggtcctgtctccaacgggttcatgccgatcgggtggacgaaaatcagcgagtcggtgtccgtgtagaggaggcggcatccaggcgttctcatcaccttctgcatcgctttcaacagcagaaggcgggcctttgatgttgtccagagtgagatgactgaaaaatcccaaaaattaaacaaaatttctttaaaatctcaccaatgttggagcactcgtgctcctccacccactcctttttctggacgtagctgatcaattgatgtttttcgtccagctcatcaatggaaatgatgtcgattgagctgttttccacgtattcagtcaacactgaagggtcgtcggtgatcaacgtctgggcgagaccgaagttgcgcagagagaagcgcccccacaggttgttgagacacagctttgccaacgaccgcttgcccttgttgactttcatgttgtccttgtcgattgaaattccgaatttctccgcacattctgtgatgaactgctgctccaactccgtatttcccttgatgctggcgtcaaatccggaggcttcaattttctgcgacatgaactcggcgatgtatgggcggaaaagtttgtcgtcgccatgcctgtacttcagcacccggaacactttggtcacgcggtagccctcttctagtgctgcgtccaattcaattgatgtgcatgttgtcacccatccgcgttgttggtcgtcgtgttcacaatggtagtcaaaatcaacgcctcccttcgggtagtctagacaacactgcatgcacaacggaaaacagagccgtttgttgactttgacgggcagcactggcacatcacactttcgtggcggaatcacccacaccttgagcagagacaatttgtatgggttgtcccgtgcagttgtccattccacatcctcattcaagatgagcacttttgggtgttcaattgggtaagtggtggagaaactgaaaattaaaataattatgaattgtaaataatgatcgaaacaaaactcacattacgtacgggtagagggacgtgaagtcatagtatgagattttctcgccctctcccgccttgtggtacagcttcagtggtcctgttcttccacccatgaacgcctcgcgaatgttcagtggcccgtcatccacataatcaccaaaactttcgcgcatatacgggtcacggtgcagcattctttcaatttggcactcccagtacacgtccacacgagaaacttggctttcgatgaattccagccgcttctcatcccgctctcgcacctccccagcagtctttccgttcggcatcagcatgttgtcgttggggaagcagtccttgcagccgtgccatacacatccattgacttcgattgctcttctttcttcctccacccagccatccacggaatactgcccaattttcttctctccgcctgccgaatgcaccgtctgcaccacaacgccattctcctccgcgtacca

SEQ ID NO: 2245 - DNA, 2704 bp, Heterodera glycines
  misc_feature (2583)..(2583): n is a, c, g, or t
  misc_feature (2615)..(2615): n is a, c, g, or t
  misc_feature (2637)..(2637): n is a, c, g, or t
  misc_feature (2643)..(2643): n is a, c, g, or t
gtgaggtctagaatgagattatgagtgacaaaaaatatcagattctatatagagttttttgtttgtgtgagtgatagggagagttctttatagggagagggagtgagagagagagagcgagtgatgtgagtgatagtgagagtgagtgagagtgtgtgtgatagtgagagtgagagtgtgtgagtgagtgtgagtgatagtgagagtgagtgactgagagagtgagagtgagtgatagtgagagtgagtgagcgagtgagtgagagctagagctagagtgagagtgagtgagagtgtgagtgagagtgtgagtgagtgatagtgtgaatgaatgtgagagtgagagtgagtgagcgtgaatgagagtgagagtgagtgagagctagagctagagtgagagtgagtgagagtgtgagtgagagtgagtgagagtgtgagggagagtgagagtgagtgatagtgtgaatgaatgtgagagtgagagtgagtgagcgtgaatgagagtgagagtgagtgagagtgtgagtgagagtgagagtgagtgagtgagagcgagagtgagtgagtgtgaatgagagtgagagtgtgagcgagagtgagagtgagtgtgtgaacgagcgtttgatcgagcgtgcgttaagcgtatgagtgtgcgcgttatacatgtgcgcgtgtgcattaagcgcatgcgcctgtatggccgtgtatccgcgtttgaacttgtatgtgtgaaaatgagctgtccaaataaatcccccgcagcaagaaaataattttttataatttttctgccaatcaatattcttcgtgacagccgaaaaaatcggtgccacccaaaaaaatcaacgccagcagttaagaaaattaagagactcccatctctctaaattccatcacctaataccctcaaaaactgttgtaaacagcgaaccatttttattttatcgatcaatatgaaaatagtaatagaaaatgagacacatttgttttttaatattgtgatttgtgatcattatattatagatatgcacttagacatctcttctgtttaatgtccctattcttccctagaaatcccctttttttgttttcaacacatttttacacatattttcatattaaacggtaataccaacaaattaaatagtcgaaatgtcaacattaaatccgcgtccaaaattaccaatttttaaattttcttatcctcctggcattcttttacccgctgtcaccccttcccctgcttcccttagtacatcaataaaaattgtcgttcgcccagcggaaaatataggttggcgtcagccgttcatttaggatattgattatatcaacacaacgagaaattaactttttttcaccaaagatattttattatttaatagaaaagaataaacagaacatcggcaactaaattgcaagaaaaatcaaacaaaaaatttaaaatagtacataatatggtaaattaatcaaggatcgattaggttcaaaattatgctcaaccggctgatgggtgggattagtatttgtaaacaataaagtggaaagatcataagttgaagaggccctacaattataattaatacatcgatatctaatgccacgcctaattcccgtttctttctcgattaatccttcacttctaaaccaaatcccggacagtagtacatactttctcggtatgatgtcatcagattcggtgatagtcgggcgacagtttgggtagataggatcgaacccatgcccatagttcaatatgtttttatacttggtgttccataattctgctgctcgagcggtgtcaccatcttcacatttaagcacataaagttttgctagctcaaatgcctctataaatgcatatgtatagacgccagagcatggtttagaatcaattctatatggaatccagacggtggaccaacattgtacgcaacagcacaatttaatccctaatatatatcaaaaaattttggctcaaagtttttttttctcaccgttgaaaacccaaaatgcacagaacccgggagagttattataccctcaccagcacgctgaacctaataaaatataaacgttttttattataataaaattagggataatattttatatattaaactgatatggttataaaatttctttaaaaaaaataatttccaatcactatgataatgtttttttgctagtcacaagcttcgaaaaaatatacaaaaaaatgttttagataccaaaaattactaaacactatgtgaaaatatatttttcttaaaatcttatctttattgataactcacagttcggatacatcggatcccatttcacggatgatattagggttcaccaaaattgacttattccgcaaatattccggataatttgtgaattctttaacaaaaaaggttgagagcagatttttaaatttcaaaaaatctgccgccggaatcgaatacctgaaaatacattgtcataaaaagacccccccccccccactaaaagtaccatatagttatgccaacattgttagttccgcttgaagggcacaataaattcacactataaaggtcagaattctcagtgtgngcggtaaatatgagccggcttttcgtaaatanaatagggcgacgtaattccctncattgnaaacaccagaccacccattattgtcgataaaactgtagttctaagatggagccaaagatgg

SEQ ID NO: 2246 - DNA, 5094 bp, Heterodera glycines
gtttaaatgctaacctatatagctggggttgtcagttaaccaaacaaaaaaaggaattttaaaaaacttttttttttcaaactccacaaaaaagtgtccattgataattccctgcttaaaattataagttaacaaatagaccacacctttcatattgatcgatttccagacatggccactgtgcattttgcttgtaatcaacaatcgttttgtactcctctgataaaacgttttgatgataaaatccagaagcgcgcttttttaattggcattgacttaaaaaatataagaaattatttgatattaaaacaaatataagaaattatttggtaataaacaaacataaaaaaaatatttgatatttttaagacaaaccgaacaagaacacggtttcggttagtaattctgcatataggaagttgaaatgattccggtatgcgaaaacgaataacaccgataagtcgcgaccagacatttagcgatatgatgttatcaaaaaaataatcaatatttgagcccaaatcatcagagcttggggtgatcgtcttggcgccgacaatagagtcgtaatcacacatttcgagattctaggcgaaaaaaatacaaaaaaaagcaaacaataaattttaccagacaaaaaggaatataaatgaacacacagacccctgcccccaccagcccccagccccacgggcacctgcccgccagcagacccttaaccccatcagcccctagcccccacgggcacctgcccgccagcaaacccctaaccccaacagcccccagccccacgggcacctgcccgccagcagacccctgaccccaccagcccccagccccacgggcatctgcccgccagcagacccctgaccccaccagccctcaccgggttggaagacgccgaaaaatagcaaaatatgggtgttaaactaaaaaccccctaaatatatttatacgggcttaaaagttaatccaaatcaaaaaaaatttttgacgcaaaaagaatttttgggctcctttctcaatagtgtatgagcaaagaaaatatgtaaatccatgcaacgcacaactctcgcgattgttaatccatcaaaaagcgtatgagcaaagaaaatatgtaaatccatacaacgcacaactctcgcgattgttaatccatcaaaaagaagaacgaatttaatccaaatatctatcaattttaaatggtgcagaactaaaaataatcaagaagatattcaaatatttcaagaacaatacaattttagtatatttgaaaataacttaaatttcgagttagaaataattccccagggtttgatcggatctgaaaaacctaaaagtggtttataaagtttttgaagctctatcgactcaataataaaaatttcgaaaatttttaaaaattttcgagttttccttaaaacccctctaggattttcggaggcccctttggtcgaaaaaaccaggctaaaaaatgtttttcgggggtaatttaggtacctgattatgtttctgacctttatttttcatttgggaagctttgaaactgtttttcaaaaaattcgaaaaatctcaattttcggtccctgaaaatttgggcaaatgtttaaaaaaccgtaacttaggtttgacaaggtcatttcttgcatttaaatattcaaaaaaaatgtagaaaaatacagagatttttatgcacattatttgatgtttttatcttaaacaagaaaacaaatattcaaaactttctgaaaatttttcgatttttcagaaaaaaatcagaaatcctttcagaatagaaatactggattttttaaagattcaaaaaatccataatttttttctcttcaaaaaagtcatttacactttatagctgccatttctttaaaaaaatatataaaataaatagcgaatttgaatttccaaacaaaagggggacccttttggttttcaagtggaaaaaaaatttttttcaaaatagtagctaatcacattttaggggttaattgggtcgctgagtacgaatatcaacttaattttgggtttaaaagattccttctatcgaaaaagagagtttgaatacaccaagatttttgacctggtcagggtttgaatcctgttagcagcgaatgattttcaactcatttgttcgaggcggcaaagcggccgaggagatcgtgagagtagccggaggccgctccgagacccagagcggccgagggcgtatgggggaaggagccgaaaacccttcgggaacctatcggtttcggattcctttaacaacaaataatttttaaacacatattttacatattttttaattataacaacatccaagcagtttccaaggcccacggaaatctaggtagcgaagctctcgaagcgcgaagcgctttaaatcactaaagcacgcgcaagcacgcacccgctagttatacgtatttaatttaatttcttagttgtacatttacgtaattttataattttacataaattttatattttttttagatttaatcaagaatgtgtcttatatttagagccttaaatttgctatgatattctaagaaaaattgtgcaatttaatgagagagcgtcagcgctctctgcaattccgctgagagcgtcagcgctctcagtggagaatagcctattttttaatacaaaaatttttaattaaaatctgtaaaagccaaattatctttttataccatatatcgaataattcacgtacatattttagtttattacttaagccattttttacatactcctttcatatctctttaaataaaaaagatattttttttatttttgtaagcaacaataatctttaaacttttttttttagaatttatttgtatgaaataactttatgaccaaagattttcaattataaatactatccttcatggaatatcgaaacatttattgaattaaaaaatgtagcaacaccggatacatttaacaaaaaaattcatatgatgaaattaatcagctcccagccccatgggtacatatccatcaccagacccctagcccccagccccatgtgcacttgcccatcaccagacccatagcctcatcagcccccagccccatgggcacttacccgtcaccagacccctagccccatcagctcccagccccatgggcacatgcccatcaccagacccctagcccccagccccatgtgcacatgcccatcaccagacccctagccccatcagcccccagccccatgtgcacatgtccatcaccagaaccctagccccatcagcccccagccccatgggcacttacccatcaccagacccctagccccatcagcccccagccccattggcacttacccatcaccagacccctagccacatcagcccccagccctatgtgcacatgcccatcaccagacccctagccccatcggctcccaacctcatgggtatttttaataaatgttcggtggaaggttttattctgttttaaagtctgacatcataaggcaaattaataatacgatttgggttcaaaattatgtttggttaaaggactttttttcatttgttatgtgcattaagcaatattttcattttttcccgttacattttttatttttctattcattttttcttggaaatgaataagtactaaaattatagtaattaatccaatatcgtcaagtattattccatcaccaggaagcattataaatacattaaaaagagtgttggctgtgattttgttgagcggacttaacgggatacttattggtccattgagacaattacaataaaagtcgacagaaattttttccattttccaccctcgttttggcttgctaattcgtgcatcatttaacattttatttaagataagctcaaaatttgcataattgtcctcatcttctacaactctaaaatgaaagcttgtcgcatgttcttttatcccaaatttttcgttttctcttacacagcttccaatcggatcataaaaactaccaaatagtgacattattttattgtaattatcgaaaaaatgtatttataagtttatttgcacataagatcacttgagaggatatgcaaaagtggtcacgatcacagaaattctttcgtccataaggtttacgtcgccaaatgattgctgacgatgcataaattcgtttagcacaacatccgaagttacttgttgtagtggtctcactggtatcataacaggatcagacaaagcagcacaatataaattcagcgaaattctttccgtcttccatccttgtgcaggttctttttcctttgcctcgtgtattagtttatcgataattattctaaaattattttccgcatcttcatttggtgggcatttgaaataaaaactagttacgtgctcccttataccaaacttggctcgctcgttgacatggctctcaatcttttcgagacactttcccttgtcaggggttgccttgaaaaagtggcgggtgtttctcgcacgccgaacttcttttggcgtattttggaacgacattcttaaagtatttttaattgataaattctgccataaatagatgatgattgatacaattcatgccttaaataaagaatgatttactttttacaaggcggaggaataaaagcaaaagtttattcaaaaatatccaaaaggcaacacattaaagttttcatcaacaatccctttcctctgcacgggcccatattctttctttacatccttggagagtatcctgctatcccttgtcggcccaattcttttccggataacgaaccggtctattcactcgtttctggtaatccaacaccatctccttgagttattcataccgcgtgtagttgtacttatgcatcgaagtgacttgaacgtggtttgatgaaatgtctgcgaatctttgccccctgacctccaatttgtgcacgacgatatagcaaaaaaaatcacaccgagaaagccctgcgaagatcacattttggtcctccgaacgtacacccaccaaaaagcaaagtttttactatttttaatctgtcgatggcccagtgaaatagaatcgccagcctcccggggtcatttagacagtaatac

SEQ ID NO: 2247 - DNA, 1594 bp, Heterodera glycines
gctgacacatattccaaaatctcgctatcggaatattctcgagtcatctcccttaaaaccaaatttaaagagtttcaaaaatttttattttaccccaaaaatttcccctccttcaatggacaccgacccttccgatgagcaaaggccagagaatctaaatataaaattttatggaaattttttataataaaacacctgtatcacaatacagtggtttacatccctcctccctgtagacctgctccatatactcgtacaactttatccttgcagcgctcgtagtccacaaagataaaactatattcgacaccttatgctcctttatgaactcctcctttttacgatatacaacacgctctactccttcacatatttgtattggcgtcgaaacatcaagcgtattgtcttgtgacaatgcgacccaccgttccatgctgttaaaaatctcattcgtagaaagcgtgttgcgcatcgaaaacttcccccacaagctattcaaccccttaattttaattgttattgttattaataaacatttcgcaccaatttcgctatcattcgaagaccaggattaaacacaatcttgtcatgatcaaggcagatgtcgtatttcgccttgtacatatcggtgaatgcacttttttcctcctcactcttcacttccccgggccaccctgacgcctccacctttattttcaagaacatccgcacatatcctttgaacaattgattgtcaaattgttcaaagtgatatgcccgatataagccaacgatcctatatcccaactccaatgccttccgcagttcaatcgaagtgaacgtccccaaaaatgccctctgctctggccgatggttacattttttcacatccttcgtcgtaacaaactcattcttggcctttctcgcacaaatgccacaattgggaaagaggagcatgttgtcgatgtgcacggggaggagggggtacagcagttccttcggggggacgaccttcacctttagcagtccatcataaggaatatcgtcgggcactgtccaattcacattaaaatccctgctcactacaatttttgggacaccaacgggatatggagtgtcttaagtgaagggcaacattaaaaaaagcaagcggttttttaccataattcacataggggtacaaactgattatatcgaacatcgaaatctcaactgcttccgtagcctttgcatacaagcaaaaaggcattggtcgtcctcctgcgtaagcatccctcggattgattggtcccttgtccggcacactttcaaagaagatcttcatcgctctgttccgctttcattccgctttcacctccacattcctaaaatttgttcaatcaataatcaataactgttggaaattggcaaaccccaaacttcctccccccgagaagtttttaaacatttctctcaatgcttccatccgattctctggccttttgtaattcctttccatggctaaaccatccggtccaacagcccaggggataaaacaatttttgcccccatggaatgccccccccttaaagaaatcacatttaagggaggatttttattttttgaaaacctgaaa

SEQ ID NO: 2248 - DNA, 5564 bp, Heterodera glycines
  misc_feature (5211)..(5211): n is a, c, g, or t
cggtgttaagccccctttctgtcagcacacgaaggacgaaatgtgagtcgaaccgtccagcataatgagcaaaagcaaccgtttcaaattgtttgaagcccataatccaatcgataaatccgccaatagggtcctccacatctgctgccgaccaagtcagcatactcggttcctcacaaatctcacatttccttttctctccaacgcactcactgcatgtcaacgccgcgcaaacgagattcggtgcatggactccgttatacaatgtcgtctcaagatcatatgcaacaattctgtatttcctcgttgaacgaatttttaacttctggatgaaacagccccgcttcggatgatagattttacaaattcggcagaatttctccccacacgtgtgcttcgatcttgtttggtaagtctcatcacatttttcacattttttgtactccctacaagctgtcttcttatgcgattcaaaacagtcggtgttgtagaaatttcggttacatccctcacaatgaatctcctcacatacgtccgcacatggaaagccgaaccccatccgacagcacttcttacagcgctccttgcactccaatcgatgtctctccggcctttcgcaagtcacttcacagctgacacaataatttctaacacaaaagaactgcgtcactgatttgatcccatcccagtggtctccttcttttatcacgcatacttcgtttttacgaattccctctcccttgaaaattggtttgattcccgttctctggaaaataaaaattttttcaaagtatgtagtttttttaccatatcaaaggccacaatgcgaaacatgtcagggaattccttgtcccaaaagatttggatcatttcaagatgttggagaccaaaagttttttcctccgcatttatccccgccttttccatcagtttgaaagtcatttcactttgttttttctctgtttccataaaataacggaaagccttcctagagattccattatcgatcagttggtaattacgagataattcgagggcataaaaaaggcctaaaattcaagtaaaagatttgtaaatcttgtgctgaagttaaagggatctcaaactcacaaaattttcccttcataacggaaagacgtcccaattctttggtttcaacgagagggcaaaagcgagacatttttcgagaagaaagttgagcagaaaaaatgaaataaattcaataggagaaaaaaaagtcacgacgaaaaaggatagagataagaaaaattgaaaaaggaagaaattgaagtaataaaaaaggaataaattgaagtaataggagaaggtttgttgaaaagctgattattgagagaagagtgaatgaaaggacgccaattccggcaaaatgtgaaggggcggaacaattagcgaagcgtgatcgattttcagtgcggtatgtggcgaaagaagggagaagactagcgaaagaaccaatttgaatgacaacgagaagggaactggcacggagagaaccaaaatttgaattttggttggctacgaaatttgattgacaggtgggaaggggaatggcacgcagagaggggaagttttttggtgtatgatcagactagaagggaaaaggaagcctgtcccaaacgatggaaatttgattgacaggtgagagggaaaacggtatgctagagagtcaaatttaatttggtcggcgacgaatgcaaaaggaagccgtcacattatttaactgctgcgtactgcgtattttttttgctggcacgattttttttttggctggcacgggcgcaaaatgccgcttttgaaatgtgattgaaaaaactgacaaatcgcatcataacgcaacaataccagtcaccccatacctttacatcatgaaaattttacaccattttcatctgtttttcacattatttcgtttttttttggtctattttggcctttgaccttttttcaccttgttttcagctgttttacactggtatgcctgttcttcacctatttttttcacttgtttcacatttgttatgaattgtttcacctgttttatcaccattttcaccttttctgacttttttttcatctgtctgacctttttttttccacctgttatgacctattttttttcatctgatgcgactttgtttagatttcttatcccaattttttcacctgttctgagcttttttttcacctcctatgactattttttcacctgttctgccctttttcacctgctatgacaatatttttcacctgatcgggtattttttcacctcatatgactattttttcacctgttctgagcctttttttcacctgttatgagcgtttttttacacctcctatgtctatttttcacctgttctgttctttttccacctgctaggacaatatttttcaccttatgctttttttcttcacatatattttcacctgtttcacatatgttatgactattttcacctggtttatcacaattttttcgcctcccttgtgattttttttcacctgttatgccctattcttcatatgtttttatatttttaacattttaactttttcgcctggtaatcagtgcgcagttttaagagcaacatttctatttgattacattcaattttatccttaatcaatttgcgcaagcattgcgcataagcgcggcgaaagcgtggtgggggggggtggcggaagaccattggtgaatcgattaaatttagttgaacggaaatttcaggagggccaaggggggggggtcaaagagagaagccaatctacggtgagaggaggattatcattgatagattttgtttttataattaattaaattaatatgtaagttggcaaatgtagcaaaagaaaatacaaaaaaaatagaatctttagatggcatttaagttttagcatatttaatctttaaataagccttcgtaatttaatcattttgagcattcattccgctgaagcgcagaagggggattgaaaatttgcatcgattatgcgactcggggaacggaaagggaggggccaaagaatgcaacaaaagagcgtggagggagatattatcaacaaataaattgggttcaatatggataattttaagtgaaagagaatccctacaaaaagcaacaataaattcatttgaatgataaccgccaacaaaaataaattagcagtattttaatttacggtgtcaaaaataatactagagaaaaatttatcgaaaataaaaataaattcaattttaaaagtaaagggaaatttagggtttttgtcatcaaattaaaaggaaatatttgcaaaaaaaaaaaatgaaaattttgatggtaaaaatgaaaagcctttaaatggttacaaagaattcaattttgtttaaaaattagaaaaatttttggtagatattaattcgaaaaatactcattttcaatttatttttttcctaatcaatttgcgcaatcttttcatagaagtacagccagggcagcggcaggtgggggggggggggggaacattgacgaatccattaaaaggtgaacggaaatttagtcgggggtcaaatggtgaagcgaatgagtgggcaggggtcagcgaaagaaaaagcgggaaatggcggaggggggagggggttagcattgaaaatttggggccagatttgtggacttatactactaccgtatcggatttttggccataatcggaatcggcgatttaatcggaatcggattttgtctggctcggcacatccctgctgtgtatgtgtaaataaaaagttattgttgttgttttttacgtcaaccaattctttcacgcattccctttcgatctatgtaaatttgtaaatcgaagtcgaccgcaaaacagtaaatttagttagttttaccatttttgatagttttttgggaaaaacaaaattattacctcatttatttattattataatttccatattcaacaatttttattgccattttttcttagaaatttcaatgtcgagcaatttgctgggtcggtttaagctgatgttgagcacgggcgatggggcggacgttcactttttggttgggaaggaaaaggaggtgagttgaacacaaaaaatttaaaaaagagaaaaaagctccagtggtagcgcgcaacaattatttagatggtctaaaagtcgcaattatacataaatctactcttaagtcgataatttaagcactaagaacgggaaaaagaacgaatggcgttgttcaaatgctaatttataccgctggacacacataaagcgcgcgtcgctttttaaaaatttggaggtgtggccgcatggtcgaaaagtaccaaaaaatgatactttctgacagactgaaatgagtgaggcctctgaaatttatcttttgggtttaaaacttcaatgataaattcatttctattccgagttttttatttagcttttgaaagcacacaaatgcgtgatgatgttcgcttctgctgtgtttgggtcgatgttccgttttgatgacaaaaacgcaaagataaaaagttaaaaaaatcgaaatattttttaaaaatgtttttttttcatcattttttagcctctgccgactgtcctcacgtaattgaagtgaccgatgttgaagcagaagcattcaaagtgatgttgagcttcatttatgcggaagatttgagcgaattgaacggacaaaatgccatggcagtgctttacgcaggtgaaaaatttaaaaaataaataaataattatatttaaacatttttagccaataaatataacgtttctctgatggtcaaagccttgttggatgttccgattaatgaattgccaaatgttttccttgcttttgtcgaagctcgtcttctcaacgaacatgtcagaatctggctaataatgaagcttttccctatttttaacaataaattttaggtaccataggttttcagaccccctccaatttttttttcttatttcactttttattgattcattttaaggatttctctcgtcgctgcttggattacattgaccaaaatgccgaaactttattcgaatcagaagaatttttgcaaattggtcaaaatttgttgtgcaaaattttcggacgtgaccaattgaaaatcgacgacgaactcaccatttggaaagctgtactaattaattaattattcgattaaaatgctaatttttattaaaaaattattttntcaggcactccgttgggctgacgaacgctgtgctcaaatgctcattgattgttccgctaaaaatcgtcgagatgtccttggcccaacactattcaaaatacgtttcccactgatcacaaaaagagaattttcaaaaattattggtaaatttttttggtttaaatttttccataattttgtagggaaatttaaattaataaaaaagtctacaaatgttcttaaaaaatagctgacacagatccaatttctggtctatgttggctgctcggataaaacgcggagaacgggagttgataagaaaagctagggatttttagttgctaaaaatgctgaaataggtactaaaaattgga

SEQ ID NO: 2249 - DNA, 5314 bp, Heterodera glycines
ttttttaattctcataaaaatccataaaaaataccgaaaccaaatgcatttgttgcccgtagaacaacaattcgtcggacgacgcgagttttgcctttgttgcggaaagggcggacctatcaaagttaaaatcaaaattcaaaaaacggggatacttattcatcatacttaaatgtgacggtgcaagtgccgtgccatttcttcgggtgtttgggcaacgttgcgtacagcgacgtttcaagacgacgtttttcactcggaattcgacaattcagcaccttaataaaaaaaaaattaaaaaaattatttggcaacaaaaaaaaaagaattttgttgcccgatggccgccggggacgaggaatggaaaaatgttcgaataaattggatttatggtgttttgttttgaaaaaaagtctgggccagtgattcattcatgtttggcgccacgggtttggatttctggaaaaccccatgcctggagcagctcgtggtacttttcggttttggggcctggatttgaatttttttttttttttgatcacaatggtgcgcaaaattgcgcaaattgtggcaaatttccaacgaaaattttttaatgaattttttttaaattagaaaattagtacattttttttttcttcaagatacaacattcaaaaataaaaacctggccaaatttgctgaaaaaactgagcagttgactcttggtggcccgtgcggacacatttttgacaaaaattttgcgcaaatcctccgcaacggcagcggacgacgacgacaacgcattgttgttgttgggacgacggtcactgaatggtttcaagccgaaaaggccatctgttgactcgggcggcaaaggggggcaaaaatgggaaggcgcgagggagagagggcggggtgaataaggggggaataaataccgaataaataaaagaagttttatttggtaaatataataagatgtcagatgaaaagaatgtgttgaagcgaaaaacgtgcgtgtttaaatagagaggaaaagcggaggtggagcaatttagacagaacgatcaacaacaaaaaagagtgactaatactaagcacgaaaatcacattgaataggaaatatcacaatttagataataagaaaatcaatcacaaatattaaattattccaattaacacaattaattcttcttcctcaattctctctctctttttccattttccatcatttcttctttttctcctctttcttagtcgctttggcgacactcgccgccgaagatggttcagccacgattgtgccttcatcagacgaggcaaccgacaaagtttcgacgtcgggtggcgggtgcagtgctcggcgcaacgatcgtaactcaaccgcctggcgatcgacttcagcttgcagaagagtgacggcaatgaccaagccgtcactggtggagctggccaattcgttcacaccagcagctatcgagccgacactttcctggacgtcgtccagcgccgttctcaggcgtttgatgccgccgttgaactttttgagtgcatcgtgaacaggcacggcgacatctcgttttttcttctgcaaaaaatgcacggcctcctcacgttccattgcccacttattgacgtgaccatgcaaaaggtcggccatatcggagccaacaggtgatgggggtggtggaggcacgatgccgagcggcggatgggatggctgagtagtcggagcatcagaaagagctgccgccttaggtcccttttcctcgggctcgtcttgaggggcgggctcgtccgaactttggcacttctttggacgacggctcttcccttccggcacttctttcttagctgaggcgatcatctgttccagctccattttccttctttccaattcggcaagctcctgcgagagaagattaggtttggcgggcatggcacagaaggtgttgagaattgggtagtcggagggaaatgaatggtggcccgttcttgcgatccatggcttaaatagcggccaaatacgaactaggccagagagcaaaaatggcagaatggcagaacacagcggagagatgggtgagtcagctgcttcggcatagctttcagcgaagtgttcgctgccaggaagcggtgagtaagccaacgaagcaaatttgttcgtgatttgcacaaaatcaaacgcggaaggaccaaaaagcgacggaccaaggcaagaaaatttgtgcagccgtgaagagcaaagggcaaaagaatgagcagggcagagaccggcaatagatgattggccatcgacaagggcaacagagaatagggcaagaagaagggcaccagcatagattcgtagaacgagggggccagagatcgtgagttcgcggccaacaccgatgcggtattcctccgcggcacctcgactcgttgaatcaccatggggcataacgttgatcaccaattctcgggaccggggcggatgatcaattctgtcccagagcgcgaagtgagacgggcgagggcggggaagagggcgtgtggacaaaccccgtggtgtagaaacttggtcaggggccacgactcggatcatttcgatggggaaaaaatcatggtgtccattcccgccgggctccatcaggcatggggcagaggggtggcgaagagtgatgccatgtcgagagcggtacagctcggagacagttgggccacgggcacttccattgtaggcaccgagacgattcgcaccacttcggctcagctcagatccgtgaagtcgcacatttcgctcacgtgggtgcagatgcctcgtcttgagttcgtagccgcgttcatgcagtccctcaacgattgttcgggcctcgttccaacggctcagcgatgtggtcacggcaagaccaaagcgttccacctcgatgttcattgtgttggcgaggaaagagagcagtgtggccattggaaaaggagggaattgggcttgggtttgaatgtggaaggccgattcgggaatttgtaggaatggtgaatggactggcacagagacggcttttatagcgaagtccattggcgatttttggtttttggcgagatgaatggtcccgatttgtgcatcaaaaatgtcgagagtctcagtcacacgtcttgacaccgaagaatggccttcaaactgcagctttggtgctgaattttgaatgctgagtagatggctcagccctcccgctgcagaagaatcagtcgtaggccaaagagcaaggaacaaaaggacgactcggcttatggctctccaagatcgaagggcagggttgcaacgcaaaaggatatagacgatgaaaagggccagagtgatgatgccaacagttcgtagagcattttggaggccaaagaaataccaaaagacatcggaaaagtcgaagttccaatctgggcaccaaattaggcatgagttgctgggtttggccttcgaggcaaatgagcttccttcattaggtgcttggaagtgttttggcacatagcggagatgaccattaatcacgaatgggttccgtcctccactgcattcaatggtgcaattgatgtcgacctcggcacggttgaatgacaggctgacattcaaaacttctggtgttttgtggcagagggctgtgaattctgtgccatccgaacaacgaacgtagccaagtgcggagccaaagtcggtgtggcattgcaaatggagatgagctccagtgtggcacgaatagcatccgaaaagacccttggacatggcatggcattttgttaggtcctcttccgtagcgattcgaagcccctcgaattgaatggacaactgaatcggcgcgtaggtgatttcggcaaaaatgtcccgcctttcgttccggagaagcaagtttttgagctgaattggtaggcgcttctcaggatcggcgagtgctggttcgagtttgacatctcggcattggcagttgatttttgctgaatcgtggtcaggcaggcacatcggacatgagccccatctgagtgtgcagttgaggcgtttggcattggcacgactggggcattgaaggtcactttggatttcatcactgattgccatgttattgccatccgagaggaacttggttgccatgattggggccggaggaaccgaagaggcaataggtgtgatgctcaaatccttccaacggaaagtaatgccgggtgtgagcgacacggacggctctttcgtgaagtttgcgttgaccgacagtttgagtgaagtgcgcaagcggtattcccatgtgggacaggagatttgctcgtaaacaattggcgagttagcaatggcatgtggacggtagaagatgcagctggcaccggcatttaaacacccgcaccaccaaaaggagcaagatgctgagcatctgttgaatccgggatgcttggtccattcgctcagctcatgaacttctgtcttccttccgttgttgacgtcatcgcagaactcgcgtgtacaatttccacgactcgggcaccgttttaccgaaactgtctcaatgtgataggaccgaagccattgctcagattttggcaggcaatgcaaagtcagtgagcgcatgctgatttcaagcgtgccaaggactctctcgtcgggatgtcgaaggagtagacgtaccggcagacccgatgggagaagagtaactgttgtcgagctctcgagatggcacaccgagccgaagtcggacctttggcatttctcagcagaggcagtgattgagacaacttgtgccctggcacatgaagtaaaggcacagggggtcaataacaagagcgtcgtttgaagttttggaaaagggcgaaaacgactgcgactcatttggcgcctgcgcggagtaggcagactttggaaggcaaggagaggggattcttctctctgcggtgcattttggcttggccaaaaacaacacaataagcgaacgagcagggtgaaaagatgctgtaggatccaaaacatggtgacgtggcacatcagtggcagaatccagaaaaagaagaggaaagtgaagaagctcgctccaccaatgagtccgaaagtcacatctggacgacaatcaggatttgctagtcgttcgaggcatatccaacaatcgataagctcgcaagcatctcggcctggacattggatgcttccaattctcttgttgccccgtttcgtccagtacattgcttcgcaatcgtagtcgaaaagaagatgttccttgggcaaacgatgaaaggattaaggaacgcctgattgagtgatgcactgagtcccatcgtcgtgggcatagcaagaatttggcaatccccatttgggatcaaaatg

SEQ ID NO: 2250 - DNA, 5176 bp, Heterodera glycines
  misc_feature (9)..(9): n is a, c, g, or t
acagggttnggggaattgaactttagaagaagaaaaaagtatggaaggcacaaccaccaggccaccgacgctcacattggctttacattctttgaaaatgatattgaaaaggcaaaaaggaaaagcttcatatctcggccagaagcttcatttagcaaaaataaaaaaaaatttataatacaaagggggggtaatctacctaccctgaaagtttcattcggaagtcccatggtcacttgggtacctctcctttgtgagtcccatcggcacaacatagcaagaatttggcaatcccatttgggatcaaaatgtccacgccggtttttgtgcaggttagttcgcatccacgacaacgaattggatggccattcctacgctttggcttagtcgtgctactggcgttggtttgggaagcgccaatcagaaataggcacatcagaatgaacagaacggaggccagtgctttggtttttgagcgagtgatggcaaaatttgagggcaggtccggcggaaaattcttccatggccatcctacgctgtatcttccgtttgccaggcgcgtagtcgtctggtcgaagatttgttgtgccgtctcgtcatcgttttcgagtggatcatctctgatgccaatgttttgaaggtcccagaattgtcgtagcgagtcaagatcagagatggattcgtttctctgaattccgctgacagccgtattgggcatctcgtcttcattggcaggaacatggacagtgacgggcataacggacagtggatggtcggcagttgggcgggatggaatttcatcgcgtccgcagacagtggaaccgatcgaagtttggactttgaaaagttgcggagagactcgttggacaccgttgaaaaacttccaaaagtctgccattccaacgagaatgtccggttcttcatccacaggcactaacattccctggaggaatgtggcacggcgcactgatggcactatccaatccgtccgatgggcaaccagagtttcgtatccgccgtcctctcgttggacgcacaaaacgtgttgcggcgctttcatcttgatgggttgccgcgtgtggaaaggattcacctctagctgatcgtcttgtagtttcggaaggctcagttgccttatcaatggtgtcttgaccatagtgacttgcgcaccagggtcaaagaagaagagtgcgtcacggcgcttgttcggtgcggattctgagaacacaggagctcggagggccatgagcatgacgagatgaggaacggatggggagacaattgccatgattgtgttaacagttttcggctcagggattgagtcagcctcattggcaaccgcggatgacaccaatggccttgagttgcgctcatttccgaaactctgtttgttcctgggcgagggcttctgttgctttgaacgggcagaagatgtccctttggcactagggcagattgcagaatgatgccgttctttgcacactcggcatacttgctttgaccggcactccctcaattggtgacccttccgtaggcaattgaggcaccggttctgctgcaaaaggcaacgttttcgagtctctgcatctgtcactttgttgcactccgaggcccaatgctggccagggcagaacaggcaggacggaactcgcttgtcatcagaatttctgacggactgagcaacggaaaaactcgcgcattttcatgccgttctggtcgctgaggtcgatttggccttgcttcgtgccgaaatcgtgtttgtctgtcggcattggcttcgcgcaggcatcgttcgacctcttctctgactccgagaacttcggcaagtccagctctgagctgaggagtactccatggaatgcctgccgcacgttccattttgatgagttcggacagaacagtcgacggcaatttgctgcggatgatttggtacatgaatgggctgtcatccggcatgttgaggttcaaaagttggcggcacacacgctccaaagtctcgaggaagtgttgcagtgatccaacgctatcgtccacaggccggagattgatcagttcggactgaagtgcttcggcaattttccgtggatctccgaagagtcgcctgagtgcggcaacggcatgggcgtaattctcccctccacggtaggcggttacggcacgagcagccttaccgcgtaggcaaccgtgaagatagttgagtttgtcgacgggctcaagggcggcacggtcgacggcactctcgaaactctgccaaaatgctggccattccattggttcgcccgaaaaaatgggaagactgagctgtggaaggcgtgcagtagctaatggcacaggtgcggcattgattggcaccggtagtgccagattggcagggttggcaacagcaaatggctgttgaccatggacaccaccggcattgattggcatcggtggtggttgatttgcagcattggcaacagcagctggctgttgagcattggcaccgcctggaaatacggcattgttgacgaatggcacggctggcacgggtggattcacagcaacagctggttgctgtcctcccgccgcgatttgctggttgggctcatctgcgagttctgctgctatgtgagccagcatttcccgcgcatcttccaaccactccgtcaagtgccggtcatctcgaacaaaggcagtgaagagcgcttcctccgcctctctcgcagggccttgcagtccgttcatgatggcaccccacgcgtccagctcgacctccatccttgacaggatacgggtgatgtgcccccgttcctgttcaaggttttcggtcgtcttggcattgatcacgggctcgtccagcaaattttcggccgtagtgacatgttgccgaagtcggaacagcgcgggccccaaagccatccggcatcgagctgaagacatctttgtttgctagcggcaccacttgttggctcggacggcgagatggggacaaaaatgggaaggcgcgagggagagagggcggggtggaataagggggaaaataattcccaaataagaaagaagtttatttaataaatataatataaagatgaataagatgtcagatgaaaggaatgtgttgaagtgaaaaacgtgcgtgtttaaatagataggaaaagcggaggtggagcaattttaggcggaacgatcaacaacaaaaagagtgactaatattaaacacaaaaatcacattgaatgtaaaatatcacaatttagatagaaataataaaatcaatcacaaatattaaatattccaattaacataattaaattattcttcctcaattttcttccattttctttctctctctctctctttttccatttcccatcacttcttctttttctccactttcttagtcgctctcgcgacaactgccctgtggaacccccgagtaagttttaaagcttttggaaaagttttctccaattttaacttgatatgacctgcatatagaaaattttggagaaacttcaaaatttttccagagatacctatgttctgaagtttaacaattaacaaatttattggtaccgaatcaaatgctttttcaaaatctataaaaattatatcaatattttgtccattttctattgatttttaaaaataatccagggagaccaacaacagtgtggtagtagacctggttttcaaaaacccaaattgttcatctgttaaaatcttgttttttcaagatgtttaacaatattccatgctaatagtcgttcaaaaaccctacataaagtacatgtcagagagatgggacggtaattatttggattagatttgtctccttttttataaattagaatgataaaagatgtatgccataagtttgggatttccccataatctaagattattcggaagagttcacttataataggtgccaataaatctgcaatctgcgcattgcttattcaatatataaggtaacccgtctggggatgtcgagtttctgtttggtaacttcctaagtgctttccagaccaaggcagcatttaattcgatatctgtaatgctatttatcttattattaatgggataattcatattacaatttttttgcataaaattttgttgaaatattttaccaaaaagcatacatttttgcttatcctcagtatgaattctgccttggtcatcgaaaagcaatcttattctctatcagaattaaatttgttgccgatgtatttaaaaatagccaaattgcctttattaacaagttggctttccttcttatcattaatgttttttaattcactttttagattcctacttaaaattttgtattttatattgtccgtgatcagggtattttttaataagcctctgtatttttaatttttcggagtataatttttttattttttgtgggtaattggtttatataacttttttaatatttttttaggaaataattgatcaaaggaattataaagttcgccaacgagaaaattgctttttcgtcatctttaaataatttcggtaaatttagatcaatgcgtttttgctgaagctcatttctaagttttaaaaaatttttgttttaaactctctaataaaaaatttttcttttttggtgatcgaaaaactcccattaattttaaattctatcatgtggtgatctgatgttgaaaactttttgtaacatttgtgtcataaactaattgcttaggatttgaaagcactaaatctaaaatgttgtcaccacgtgttgtttgttttacatgttgaaccaattgtttttgtgcgacaaaatcaataaataattttgaatgattattgttctctattcggtaattaatccaatcaattcccggtaaattcagatcaccacagataagaatattattataattaagcccataatataatctaataatttttttaaatctggtgtagaacattgatgcggcttatacaatgcaaaaaggtggaccatttttgccaaacaaagtttaatgtgaataatttcttttggttgcttattttcaattacaaaatttaagtcttctcttcgactttactttgatcagttccgagtcgacgatggcattgttgaacattcgggcgatttgggatggaccaaattgcggaggacagccccaatgaatttttggtgcaactgtgggagtactgttgttgcgtccatta

SEQ ID NO: 2251 - DNA, 3752 bp, Heterodera glycines
agatacaatcatcattttcttgcttttcaagcttttgtttggtcattgacgcggacggtctgttcttcgtcaagaaatgttcgcagctgttcaaagggtgcacagacaaagtgatcattacgccaaaccacagaggcaaaacgcaccccaaaagcaaagcaaacaaaatgcatgtttcttaagattttgttcgggtttatacccaaatgttccctaaccagcagaagggagaggacacggacgaattgaaaattcaatgcgaaatggcggaacaattggcaaagatttggaagtgactgtgatgagaaagggtcggtggcacagaaacgcaaccgaaaaatatgaggtttggattcaataacaattgtcattggcactttaggagagagattgacatagtctccacagcggctaccgttacttgctgttggcggtggatgttctatcgaggcgaatgttcggcgcgcccgtaaagagtaagcgccctgtggacatgaaaagggcttttgaagagctatttgagcaaatgccaagggtgccagacacaatgtacaccgatcgagggctggagtttgtggcaaaaccgttgaaggagttttacgcggagaagggcattcaaaagtttgagaccagttcaaagaagaaggccgccgtggcggagcgtgccatccgcaccctaaagactcggctgtacaaatatttttccgccaacaacacttcggtttgggtggatgtgctgccaaagtttttgagtgccatcaacaactcggtgtgccgcgcgaccggccttaggcccaacgaaatcagcgacgccaatgcgagggaggtgtggaagagggtgtacggcgaaggactcgcacaattggacaagtcaccaaaaatcagagccggggaaacggtcagaattcccgagcctaagcacattttcgagaagggtactgtatttcacacattttttcggtcaatttattttaattttaggttatatacccaattactctgatcacgtttacacagtggatgaggcccgctcaaccaacccccagcattatttgctcaaagactattatggcacaaagttgaagagaaaattttatttgccagaattaacaaaagtacaagtggatgaaaacacaatgtatcgaattgaaaagaaatacaaagaacgagtgagagatggtaaaagagaaatgttggtgaaattcattggatttccggaaaaatattgggtcacaaatgaagaaataaatgaataaaaatattacaaatttaatgaaaattaaaaaataaaaacaattatggcataatgtcggggtcgttcagctcctcttctgtgaacatgttcacattgaggtctgggttgaacagacaggtgcaagcgccagggcagttccacttacaccactcttcgtcgctgtacccaaagggcaccaccttcaacccgtgatccctgaccacccccttattcacggtcgggttgaactgcttgaccaaggggacggtgaaaatctctcccttcttggtgatccgaaagttcttcgttgggtagttgaagcggacgttgttgtccggctgtcccagcttgttctgcaccatgtccttcatcttctcgaaggtgatgcgctcgcaggcatccgagtcgagcgtgatgccgcgcaccttcagcttgtactcgtcctcccccgttgcgttgttgcgcagccacaatccatatgccttgggtccggccggctaaacaaacattccatttattttgtttaatttttaatgagtcttaccacaaatgaattccataatcgtgtggttcgggtactcgtcggcgagctccccgagctgctcaccacccggaagtgggtcacccagctgcgtcaggtagtcgtagaagatgctgtccgtgtcctgattataaaaattacttcatattttcatttatttccaaatttttttaccatgtagagaatacgggtgtcgtaccgctcaacacccggagcaggcccatacaactttttcagcgattccagcagatggattcgcgcagcagaggtagtccataaggcaatggccacctgagaaaggcaaataaatttcaaattttcaaattttttcttacgttgctcgtgctgtgttccaccacatgctcatccttggccttgtagcagaccatccaaaacttttccgtcagctgatcgatgctgctgacctcaatcttcgagtcgttcagcagtttggccagctccgcatggcactcgacgatttcggttttggtgagccgatttctattgattttttttaattttttataaatttttctaaaaagttttaccgaagtgcgaaccggccccacagcgaattcaaacacagcttggacaggtagcggagtccggggttgtgtttgattcggtccgcctcaagagggacttgggccttttctttggccttgtcgatgtgttcctgctttctccgtgccgactcctcctcgctgatgcccgcctccgtacaagacgctggatatccgcttgcttaaaattttgtttgtttattttttttttttttttttttttattaagtttttcaaattttaccctcaaatttcattttgaggaacttcagcaggtacgagtggaacagcccattgctccaatcgcacgccagaggccagatataggcacggtacacatgcgtcaccttgtaccacgagcggagagcggcttccagctcaatgtgtgtgactgttgtcgaaaagcctattaagaaaaaatatttgcttaattacaagcttcaaactcacccctttcagagtcctcaaaatgatcgcaattgtactcggggtcgatcaagccgcgcgggtacatttcggaacacgtccggcagaggggaaacagcgtgcggttgttgagccggtacggaaggaccgggatatcgtagtggcagtggcggggcggcactacgaagcacttgatgattccctcaaggcggatgccgtcgtcgccaacaacgtcctcctgacgcctccattccacgtccttgtcaaactgcaccacggtcgggtggccaaccggataattggtgaacatattccttaaagtgccaaagatttttcaactattcatttttttttccgacatttcttaccgcgacggataaagactgttaaagtccttcactttgatcgtacggctcttccagtcgcccgtctcagggttgatcaccgaagcgcccaaatattcgggccctgttcgacctgtgcccaaaattattttgcaaatttaaacccaaaaataccgccaaagaaggcgtcgtggaagtcaattggtccggagtccgggcagttgtcgaagaacgccttcatggctgggctgtcctccagatattgcaatcgggtggctctcccaatcaactgcgacctcaatctcccgttgaatagtacggtgtttcttgctgtcttctcttgtgccttccatttgacagatgtctttgaatctgttctgcacagaatcgagttcgcattggcctttgggccaaaatttgtccaattgaacggcgtacgttctgatggtgtcgctgtgcctctgtgtcgagagcgatctcgcacaattggcaacagcggtggttgattcgcctgcccaccccgatgctttaggtaccgttatgaggccaatgaaatagctatctactcgacatcaaatcgggtataaacgaaaaaatttatctgattatatttaccccgaacttcaacttcttatttaaggaaa

SEQ ID NO: 2252 - DNA, 1956 bp, Heterodera glycines
gcgtagcacttgatgatcccctcgaggcggatgccgtcgtcgccaacaatgtccgctggactcctccattctacgtccttgtcaaactgcaccacggtcgggtggccaaccgggtaattggtgtacatattccttaaaaagccaaaatttttcaattattaattttttccggcatttcttaccgcgaaggataaagactgttaaagtccttcactttgattgtgcggcttttccagtcgcccgtctctgggttgatcactgaagcgcccaagtattcgggcccagttcgacctgtgccggaaaattagttaaaaattaaatggaaaaggtaccgccaaagaaggcatcgtggaagtcaattggtccagaatccggacaattgtcgaaatacgccttcatggctgggttgtcctccagcattgcgttcaagtggcactcccaaacgacttcgacctcaaactcccgcgcaatgtaccgggttcgttttgcgtcccgggccctccctgagggccccggccgtttctcctccgcccacaatcgccgcatcatcgggaaagcagctagggcatccatgccaatagcaactttttcaatggtaaattggtacattttatgaattctttccttacccgttgacctcaatggccaagtttttgtcctcatccggccgctccatcatcccgtccaagctgtagttgccgaacttgaactcccctccagggctttcgacatggcgcaggacccggccgttctcacgcaactcctcctcagcacgccactgagagatgggaaaatgtaaatttaaaatattttttggcacaccttcaaatatttcctggcgatggagctttgcttgccgcgcttctcgtatcccaagtgaggaataatggcgacgcgctctttgtcgtggtgtgccaactgcacccaatacttcatgcagccggatgggatggtaaccgaatccgtgatgtcatgccgagtctcggacaagaacatctgccgcatttttaccataccatgtgccaggatttgaacatcttcaaaatatttgttaaaatttttcttatttatatatttttttttaccagtcttgcagtagtccgcgatgacctcgctcagctcaaacccagtttctcggttctcttcgtaccactgctcaaactttgtgcgctctgccgggaagagtccacctgggtaataattctcaattggttgcagggtgtccaacacagtgccataattttccgcctaaatttttattaattttttatcaatttttcaataaattatccttaccttattgaatttgtgtggaaaatatttcttgttttccacgccctcaatttccaggccaaacgtctagacaaaatttgccaatttgatcggtatcagcttataactgaatgaataacaatttaaataatttaaatcttcgaatttttacctgtcccgaaacacggtgggtgtgtagactcctgttttgcgcgccttcatttccaggagatggttgccttggcggatgagttcggggcgggctcccatgcgcaacatttcaccataaatcagcacgtgatcatatcgagatccttcaatttattatgtttacaaaaattttattttcaaatataccggcgtgggcgtatgcgtacgttgtcaccgactccggcttctccccggcttcttcataccccagcatccagttgttctcggcgtcctcatctacggcatcctcttcttcttcgcattccatggcttcgccgttggtgttgtcaatgtttttcctctttctgcgcttcttcgctccgggctccatgccgagaacttccgtttcgaagttcagaagccatttggtgaaagcgggcagcgggtcttcgacgaccttgcggcattccacgtccgtgtgccagaattcaaagggcgaccaggcatatgtgcggaagcgaccgcagagcgcgc

SEQ ID NO: 2253 - DNA, 4788 bp, Heterodera glycines
cgcatgagttgcgggtccggctgaaaatccgttgtgcattcaaagtcaaagaagacaaagcgcttttccttcttgactttgggccggtattgaatgtagcagtcgcggggggcgtggaaaccaagacaaattttacaaaatttgtggccgcagacatgcccatttttcttgtcttgggcctgttttttttttgttttttttaatatttttaatgttaataaacaaaacattaccgccacgcgatatattataccggagtcaacacattttttggaacccatgcagattgatttttcagtattttcttgctcattgcctcgcttgaccctgcggtgtgagaatttggcatgatgatcataacaatcacggcttttgaatgtctaaagaaaaacaataataataataatatttatttattagcttttatttatttatttttactttgttacaggccaagcaagtctcaaaaaaaacatcattaacacattcacagtttcctcgaaaggctccaccaacacgctgacaattatggcacttccatttacattttgatgtgtgtagattctggtggttatatggcatttcacactataaaaaaaaatcattttattgtattttattttatttgatctattaccccaaagcaataatttttggtgctgaaaaattttccaatcgattttattgcgtcgtaatgccccacaccgccatcagcaccctcataaaaaaccacacagagctcatgcatgtattcattgatattcgctttccacgatggtttcatttttccaaatgtgtcaaagcaaaaaagtcgaaacattcctggatgaagcgcagcataatattccttaattaataacttaacttaataaaattttttatcaatgcctgaatcctttctccgtattcctcaatggaataaaagggctgattcacgtcaatgtcgcatccacggcactatgcataaacaccctcaagctgctttctctcatccctcttgtattccgaaaatcgctgttgcgcgaggacaaatttcatccgtagcatttcaaacgaccggaagagacagagattgtcgttgttcagaagctcatacgttgcaccatcggcgatacggtaatcgatattgaggtcgttacgcccctttccagccattttcggtttggcgcacttgctctcgatcgccgtgatgtcaattacaaaaggctcctcgaggagcgacggcctttccttagctttgttgctttggtcgaccatttcgaagcgagttagaatcctctcagttgccgtgttgtcgatttttttaaagtgtacagccacttcgtagtcaaggtgttttgacgtcaggaggaaaatgaagtggtccgccgtgatcttcattgactcagctccttcaatcgcataggcaaggcacatggtaaacaggttgcgcaatatgtcctctgggaaaacagcgccgaacgaaatgctcatcaaaaattggccaataaaccgaaacgctaaacggtgtattaaaaatatttcgttcaaaatggacaataattgaatttgaaaaaataattttacaaatcttaattgaaaattcattaataaaattggaaattttaaaattaaaaaaggttgggattacaaccacacctttgaaccgtccagcttccgcctgtgcggcagagagacaagcaaatccgtcaccgttgaacaactccgcgtccagctcgcgggtaatcgatggctcccttcgggccttgcactcattctcttccgacggcacaacctgaaaacgtctcgcataattagcaatgaattttagaaaaacattaagccaaaacttacggtattaggcatgtgtttgatgatgtcttctagaggcggcgctttatccatcagttcggtaccatcatccccaacaggggaatagggcccataaagcattgggggctgggaagtatcagaaaattgactcattgtttttttttcttaaattgactttgattatttcattaaaaaacagaaaacaaatgaaattgataaaaaaatacaaagaaaatggccactcaataaaaaatcgggcatgacccctctcctgagcaatgatttgggccatttttggagggttaaaaacgcgcataggtcaccccctacacgtgtttttttaaccttccggcccaagccatcacattggagggcatgcccaccaactatgactatcatagcgagcgattatggaaccgctcatggaactcaaagtgtgtggcactaccatcccaaagtgcaaggtttggtataggcctccctatgttgggtaattactcccttcataaggcacttgcgccaacgcccacagcacatatgagttccgtcaacgcggcttttaatccggggtgttgagtttgagcagctgcgcattcgacactgctcagtgactcgcggtcctccgggccagccagtcccggttattctctcgctgtaccaatgcagcccgtaggcagggcacattagggctaggaaccgccacccccgctgctaggaacaggcacaccttcaccctcaaggccagtgagtgaagggcccccgtccacaccagaccgactatctggttgggcttaaacatcgctgtgacacccggcgggctatgacggaaactgagtttcggtcagtcactgccgcagccctggataccagcgggataagccccgtggacagtgaacgcccgtgccagcccctctgggaagtaacccagtaccggggcagggctcctcggtttaaggatggcccccaggatatttgaaaaggcttaacaaatatcctaaaggggtttagtaccgagtaaaccaacaaaatgaaaaaatggggagagaaaggacagtacaaagtacttgtgatcaaagaaaatgaaaaaaacaagggaaaaatgaagaaaaagataaatttggcaataataaaattaattttaaaagaggaaaagaaaaaatttatagaaaaaatagccaaaattggaaataatttgaagttaaaaattttaaataggacaaacataatgccaagagtcgaaataaatttttaaatttaaaaaaaaacagaatgccaagagtgaaaataatttttaaatttgaaaaaaacagaatgccaagggttaaaataatttttaaatttgaaaaaaaaaaaaaatgcaaagggttgaaataatttttaaatttgaaaaaacagaatgccataatttaattttgaaaaaaaacagaacgccaagattttaaatattttttaaacgagaaaatggggaaaacaaatgcaagaaattggccagaaataaataaggaaatttggcacaaaaatgtgcaaaaatttggcaagaaataaatagggaaatttggcacaaaaatgtgcaaaaattggcaaaagaaagggttaaaaattgtggcaaaagaatgccaaaaattggcaagaaataaatagggaaatttggcacaaaaatgtgcaaaattagcaaaataaagggttaaaaatttgggcaaaacaatgccaaaaattgacaagaaataaattgggaaataagggggcaaaacaatgccaaaagattgcggcaaaatggcacaaaaaacggtgccatagtaataataatgccaatctggcacataaataataaatggcaaaaaaacaaatgccaaagaaggaaaaattaatgcataaataaatgataatggattattgattggcttttccttccgtaaagtgaattaaatgaaatgaaaatgaccaaatggacaaaaaatcaattaataaattgtttattgtctgaaggtatcaaattacataatgggcatgcgggagtgtgggcggcactacaaagtacgcgaccaattaaaaaatttgatttgtttatttggcaccgttccaacaaccccgcccccttcataattgatttgtttatttgaccccctccccccttctcgccgcccgctcttgccccccctcccgccgctggtgacgtcaatttttccctttatgagagcaaattaatgtttatcatcaattgccaatgtggccgagtggttagtgcgtcagtctggccgcccccctggggttcggatccgcttggtgcggggaatttttggagaattttaaatgaatttaaattcaacgtctttgacctttaagacgtttaaaataatataaaattaaataaatttaattaaaagaatttgcataaagtcgcgcagtcaaaaaagtcgcgcacccccctgcaataggtttgggtttgcaagaaaaaagtcgcgcaataggtttgggtttgtaagaaaaactcgcgcaataggtttgggtttgcaaaaaaagtcgcgcaataggtttgggtttgcaaaaaaagtcgcgcaataggttttggcttcagtactgaaaagtctggcgctcagatggcccgcgctcacttggcggcgctcaaatggctggcgctcagttggccatgcacccctcccacacctatggggggctaccgtaatccggtgaaaatggagtctctaactactattaaaatttcagggaattccattccattccacagagtgattaaggcaattttcaaaatacagcaactataataattttggtcattaaactaatgtaacatttatgtattccatctaataggccctaaaacccgaacaatgcccaaatatacactgcaaaaatggcttttaactagagcccggaaatttcaaatttgcggatcccgctgcgggattggtactgaaaattctttgcgggacgggatcccgcgggattaatcccgca

SEQ ID NO: 2254 - DNA, 3788 bp, Heterodera glycines
ttcggcatgctccaaaatgtgtccatttggcattttgttagtctttgtcaaatcacattgatcgatcagaatcattgccggcgaacgtttgagcctgaacatcgggcagaatgaaattcagggttacacctcgttcaagacactcgaaacagaaataatatatccaggtccaattagaaagtattcgatccattgaatcaattgtgatttctttaattgcctcccctctcctagaacacaccgatgggaagcagtagctgcaccaccaccaccattctgctcctccccctggtcgtgttcagcagcggttgtcgttgccgttggcaaagtgtgccattggggcggtggcaagtcattttgttgcacaatgtttgtggcatgtttgtgctggttcagctgctgcagttgctgttgcaaatggaacgcagcgcttaaaggttttgctgccggttccgtggaagaaacggacggcgacgacgacgataaagtgatgccgacagctgatgccggtgccacttgtgattggtaattgcgatcaaactgtcaattagcggaatggtaacaagatgaatgtggcataaagccatgttcaattagggatatttggaagccatgatttgggaatggaaagactaattaggaggttcaatgagttatactttcggaagtttagagtatgggtcaaattggaactagaaagacctctctggatcgagatgtatgaaccacctagaatggcattcttggcaataattgttaatgagaaaagaaaaaataattagttccaacattccctgaaataacggtgtcaaacttctgatgccttcatatactgtagttgggtgctaggtcgtttcgtaaatacgccaagggattaaaaacaaaaaatgtaagacatagctattgaatgataccatgaaaattaatttgcttgcatttgagcttagttatgaatttatacgtgtcagtcacatctttcgtttttatacattttggcggatttacgaaacgactcacaaatgtgcaggataaagttgtaccaaatgatgaatgcgaaattagtaaaataagaaattggattggtcaagatttgatggcattggccccgagagattttgtctgatgaaaaaaaaaatcaaaatttgtcacctttccaagcagctgccgcctgcctcgtacagaatcgggcggaggcggcgccgcccggacgggcgtcaaatgcgtcagatgtaccgacgcggcgactgtgtcgtggtattgttgaacctcctccgccatggactgtgccgccgttgatgtggtcggtgccgccgaaacaatggcatcaaatgttggcgtttcggtgcgcgaggggcccgccgttgtcgacctgtgccaatgtgacgggaaaataattaaattaatttgtgcatttccctcgtaattatcgacatttgggtttaattaatgacccacccacctgccactgttgcttccggccgactttcggcgcgaagcaattgcctccggcgtaaacagtggcggcactgtgtccgaatgtaacggttttcgctcaatgcgttcagcatggtaaatgccctccaaataaaggagcaaattaattttaaaaaaatgaaacataaagcaataaaaattgtttaatttttattaaaatttaacaaatttacttcacgattaagcactgtctgctcctcctccgtgtcctcaattgtatacactgaaaacacattaattaattataatgatatttattaattagtgaattattattctttgacattggcgcgtcgtcctgggcgtataataaaagttttggctgtagtagtgttccaattcctcctgagagttgtcatcggcatccaacacctgaacatatttacgcgttgcttaatttcggctttttggcacatgggccaaagtgttttttgctaaaaatatatggaatagtcatctaaaccctttttgttttgtgtttttaaaacatctatatgacatattcatctaatccctggtacgaaattcctatttatggagtctgaataccgatgtccgaataatttttgggcctcggaatgccatcactggtacgtactcgtcgctccccccccccccccccggaccgtccctggttagggccaagagaaaagattagaaaaataggataatatgaatatttaggtttgagaccctagatttcctgagagaaagaaaccgataaatttctccatttaaacaagagccgagactctcgaaccgccataataatttttcgaaattattggcatttagggagttattcaatggtggcatttaccacttgtcgcacaacaatgccgccctcatggccctctccgctctgttcgtcctcctcctcctcctcgtccccgtcgttgtgcagcgtgccgttctcatcgcttaggaacgggttcgtcatctgctgctgttgctgatttcgataaacaatggttgttgatctgctgctgctgccggacgcttcttcgcaagcgccgccaccgtcccgttgctgctgaacttctccgctttgtgcagccgactgatcagtgccggagcatcttctggcaatgccgattgactttgccgatgctgcttcttcttctgcttcgggcggtgaataaacattagcttggtcctccaagaaaaagttgtcccgctgctctgttggctgatgcatttggttgtcgtcaacggaaatctgtgagtcatttttttcagaaaactcgagaagaacaaagagcgagaattaaccgccgagactgaaccattaattgagttaagccaagactgagaatcccgagtagcccctgctttatacccactttggtcttcggcttggcccattggacgtcgaattcgtcgtcggccgcctcgccaaatgcttggatttgctgcagcacttgggcagccattttttgctgctccatctcctgctgttcctgcagttgtgcgatggttgcggcagacacagtgggcacctgtaattatacttaattaatttaattttcctttttttaaattatttctattttttgaattcgaaaattattcaaagcgatactttatgttttaatgattttatcggggtcagaatcaagggaattttaaatattatattgttatacatctcctattatctttttcgaaaaaacccaaaatcagtcagaaaaggtgcaaattttcaaaaaagaaaatagtcgagactctcgaaagtttacacgctaataaacaaattgaattctgaatttattaaatagcactgatcgaacccaaaaattggtctagacataattggtgtgccatataatttttccaattcaccggctgcacagtgtccggataatcgccgtcctcctcttcctcggacgagctggaactgggccgccggtggtgctcgtccgccgtttccacctcctcttcctcctccgagccctcggcattggccctgtcatccgttgtcgttacggtaatgatcggtggcaccgggtggggggccaaagatgctgaaaatgatcgactgatcagtcagtggcctttttttaaatggctctaattttggtgaaaaattatcattgttagaataattgtcttaggttgattatgcgccaataatgataagatcaacgactaatactttttgtgctttttgcgtctgctgcaccgccgtcatccatcagcagcgaattgggcggtgcgcaaagtgacggagaccagggatcttccatttcaatctgtaacaaataccaaaatgatcatggtaaaactgatcagga

SEQ ID NO: 2255 - DNA, 4388 bp, Heterodera glycines
tctgcccgaaaatcggttgtgtaaatgcttctggccactctggtcagctcgtcctcctccatcatcatctgttggccttccttccgcttatcaatctgatcagtgtttattcttgccctgccaaactgattagcgattctgtcgtcgccgttgctccgctcccaacacccgcgcactgtttccatgctgatttgctccaacagttcgtcctcctccgtctcctccgcatttggtgctgctactgctccgtcagcttgtagcacattcggctgttggtgttgttgatgctgttgctgctgatcagtgtcctcagtgaacaccgtagtccacagctgtttgcgcggtgttactgtgttcatgggcatgtcgtcccattggtcaagcggtgcctttgaatttgaaatttaattacgcgagaatagaaatctaattttaaattagagaaatatcgcaaaattgtgcattccgcgactcggcagagattttcaaattaaatttcagtctcaaaagtaatttaaatcccaaaaaaatcattaaaattttgttgcagaaccaatctgagtccaaaaggccagtaaccgaggcttggggatttctcggattaaggggtcagtcacaagttgtgccataagtccctaaaaactgatgccgaaataaatatttaccgtgaatttctgggttggcggttgcatccatggctcatcgtcctcttcgatgttgtgccgcttttggtcctcaaccgtttgatcttgtcccttttccgctgcactttgctcagtttctgtttggaacagaccaagcggatggccatatcgggcaaggtcaagctgaactgcagcagcagcagaagtgtcgatgaacgcagccgtgccaagtccgttgttaccctccgcctcgtcagcacgtacttctacggccaattcaattgctgtttctgctccagcattgccttgatgctgttgatcagcaaatgctgcacttgatgatgggggaacagcagtttgttccgcctgagacggttcaaatttggccaatggctgcgacataatgccaaaagcggtgatggtagtgacatcatccgtagctttgtgccgcagcgcactcggtactgtttgtggaagtggtggtgctgcttgtaccgcttgcgctcgttccgcatccatttgggcgtcaagttcggcacattgcatcactgaaatgatgcacaactgttcctcctccgacagatggtcaaagccgggcggaagcgcaacatcgtacagggaggcggatttgttcagcgaagcgctaccaccgccagtgcccggggcgatttgctggtctccgccagcggggcccgcggcggacagtcccaacgaggaatggggccgttgcggcaccgtttccggttgcagctggacagtttgcggttgttggtcatcctgttgagacgaagccggaatggtggtggtctgggaagtgggcgtgaaattttgcacgtagaaaaacataagccagtacaacaatatcaaatagtttaatccattagccctggtctggcaagcggttaggctttgccggacttgacaaccatttaatgatgtgatgacccccggggggagcttttttttattagttgtcaaccgaccatggccgtttccagcgtttggcccgcctgtgccatcgccgtcaccgccatttccttggcctgcttggcacccttcagcgtttcggaggcaaatttgccaaatttgttgccaaagccggcaaatgccgtcgacgtggctgttgctggtttttgggcgcttgagaagaacattttgccaatatttaaggatggtgccgattgttcggcagatgatgatgcaatggcaacaccaaaagtagaagatggtttgggtggaagcggcggtggtggcggacgaggcacggcaggacgagctaatcaaaaaatatgattttttaagcgaaaaattatttaaggtttattttttttgattttttaaataaaattcttgtaaattgcttttccttgagtgagaattttttaaagaatttgaaaatttgattcatgacaattgaaaaaatttcttaggctaaggaagtgagacagataaataaaaagttctcgaatcaaaaaccgagtccttcttcacccacatatcactgaacaatcagcctaaaaaaaaattgcaaaaaaccgatgaaattttgaatcccaaccaaattcccgttcaatcccaaaataatccggcattttccgcgccaaatttcatagtttttcatttgttttcatttatttccttgcttacctcccgccgctgctgcttttgcaattggcactgcttcttgtacagtatgcttctgcttctgttgctcgtcttcaccttcttcgtcccctacaaatggtttcggcactctcttcccatctttttgaccaccaacaaattggtggtgccgttgttgttgatgatggtaattagtgccgatggcagtggttgttgttgttgtttttgatgtggtggtatttgtggacaaattgttctgctgcggttgtccctcttctgtccaaaaagcatcgccaatttcttgcgctacgcttaatgacctaaaattaaaaaacaattataaaaataataataataaattaaaaatattaatttaagggaacggtttggttgatcaatattattatacttaaatttttaattttaagggcattaaacattcattgaaaagtaattaagtctaaaaatggcacttttattgcctcggcaatcttctcgaaaaaataaaaacaaataaatattttaaaaccaggtaaaaaattttataaataaaaatttgtttttattcgtaaaattattttaaaataaattattgtattgcctaaaatgaatttatatttttaataattaaatgaatttacctatacaaatgagacagactttttcaaaatggcataaataaaaagaattatttaaacccataaaacttcttttcgaaatgatgccaaaaatggcattaataagaacaagcaaagactgactaacaataagcataccattcatatatttactttcaaattggccttccattttcttatgcccccccccctacacaatacaaatgcatggtttacttttgctctttcgtgcttccgccgtgttgttgtccatcggctgactctgtgccgtgttcagtttcggcattttgccgttgctgctgatgctgtttctgttcttggcttacaattggcaccgctgctgctgaacaatgggaagaaatagaagaagaagaagaagcatccgccggcggcacaatgaaaggaaagggaaaagcaacggcggcggcagcggcggcgttttgctttgttttttgattttcttcttcccctttctgctgctgctggtgcactattgacgccgcggggcaaggaaattggggtaatgagaatgggttagcatcagcaagcggcggtgccaccaccgccgccgatgccgtagacgtcgtcgtctttgccggggacgagggggacagctctaaaccacgggaagcgatgacagagagggacgcgtgcacgggttggccactgctggccatgacatcgacatttgcaaagcttctcacacgctcgtcgtcttcccattctgtggtctcaccaatgcttctcacattctcatctctcagtctctctctagcattggcaaagcttcctactatttcgtcaccctctttttctctggcatcacccgtgcttcccactttctcgtcatccgctttttctttggcatcggcaatgcactttccacctctctcatcgtcctctctttctctagcatctgtaatgcttcccattctctcgtcgtcgtcctctttttccatctgccacgccggtggcacaatttgtccatcaaaaccaccatcaccggctaaacaaatgcctctttcgctgtattcgcatggcgttggcattatttgaggggaagcacagttgggacggacgacggcactgccgctggcgttgaaagaatatgccaatatgtcgtccccgttttcttcgtcttgccgctccattggctgtgccaatgtcaccgcaagcggtgcggcatcattgtcgctcaattttccctcgtcggactctgcttctgtccccatgtcattctcagcgatgcttgttctctcactctttttctctttttcctctgtccccctcaggggtttttctccactttctctgcctctctccattctttcgttcctttctttctcttcctctgctggttccacactctctctttcttcctcttcttcctcatcactctcatcatcttcttcttctttttcttccgtttgtttctcctcttccagctcttcctcctctatgtttttctcagtccgtgaagcat

SEQ ID NO: 2256 - DNA, 1078 bp, Heterodera glycines
cggctccgtttcgctgtccatccgctccagttgctccatgtacatgttcagttcgttggacacaaaacgtgccgtctgctcaatcactgattgtcgatgctccttctgtcgttgttgttcttcgtgccaagaaccgggaaatatgatgctgttgttcaccagattctcttctctatcaaaaatttcggaaatgattaattatgccaatttggccaaacattgagtcgcccagcccactgctgcttgaatggcttccatcgaaaagaaattgaaaaccgtttttggcaccaacagtgccgtcaaatgattgttccacagtgtcttgaggggctgaccaaaaatcgggcgtacttggatcgacagacgaggaaatcggtggtttcgaggtacaattcccgttgttgatcgcttgtttttggctgctatgatctgctgtttaatattaaattagtcggtcaattttaaatgtataatgctgatcaatcaaaggactatttgtgcttcgatcaactcagaaaccaaaatcaacaatttgtttgtaaaaaatgaatccttccaattaaaaatgttcgatcagtctcagaaatgaatgtcggcttccccttttcgatctcatcatgtattcaaattgtttctcatttcttaccaacattctcctcgccctccttcgtgtccctgagccatttaaactgatcagacaacgaatggaggtcaacattgcgcttgatcagccccattttagtcgaaatgctggtgggcattgaagtgccaatttgtttggccctcttctcaacgctggcggtgaacatgttcagccatccccctcctgcttcctcgtccgtcgacttggccatttcttttggctgatccgacccaattggcacaatgctaaggcgttcgtcggttgtttccgctccatttgaaatttgacacaatgccattgatgacaagtcatgccgtccttcgggcttgaacgaagaagcttcatagagttgtgcttcagccgctttcaccccttcatcacgttcttctccaatcgacacagcctgtacttcctgagcttcttggactggctgct

SEQ ID NO: 2257 - DNA, 1878 bp, Heterodera glycines
cgcgcagaatgtgctcccgctcttccgtgctgagcccggccagcgcactctcaggcaactcttccgtcaccgccgccgcgccatcctctggcgatccgccgttggatgtcctccgcaacagttccatgatgtcgccaccaccgccagcggctgtttcgcctgccgccgctccgccaatggacaaacgtttggtggtggtgttgctgctgccgcttgtggcggtggttgtggttgtactgatcgaaaatgtggttgcccgtggggccaaaaaaggtgtcaatttggcggaccagggacgagcactacttgatgactagaaaatgggcgaaactataactttaaattttaaatgtgaaaataataaaaaattaattgtacacattcctaattgatcgggaaaaatgtattattttgatcaaaattgtatgttgtcattgattgttgaaatcaccaaatcaccgcgcaacacggcacttttttttattgaattcccataggcccaccgggataggttataagtttttggtgataccagaaaaccaaggagtcttatttagataatcatggcatttaactcccgaaaacaatgtcgagactcagtttcgagctatcaaagtttcaatttcccagaatgtccagaatgacattgcgcatgctcaccgctgtcgttgttgcggttgaactgcgtcgcattaggccagcgaacacgttcagtccgctgatcagctcctgcttgaagccggcacgtgccgctgcttctgctggctgctcctcctgctgctgctgttcgcccatttcgtggtgcacttcatacaacaatagctcctcctcctctttgttggcatggtgatgttctgccgttgcttgccaacatgacatttcggcaccgtccctttaattgttttatgggcatgatcatatgaaacgtggtcaatgagttggcattgattgattggcatacggagcttatttaacctaattaagcagataatccaactaacaatgagaaatgaaaaacactggctgattggttgtaaggcgtcgctagtgatcaaaatttaaaattgatcaaaaggacaataataaaattaatagccgcaaagataatgccagaattcgaaatgcgaaaaattccggctccaaagggtgccgaaatgcggttaaaccatggttcatagaatcgactggaaaactacagtacaccccaacgtataaaatactgtactgaccatccgtcggagtcaggcgatgagcacatttgttgcggttgttgctcatgcgaatgttgtggcccatctttgagcagttcacagtatttgtcatcaaagtaaagggcccttggattttgttggatgtgaattctgaaagaggcacaatgtgaaatttgaaaaatattgtatttttcacacaacacattccaaataagcaaattagagtcggtttctttggttaatcaaaattccgagagggttgacgaaaccgagacccaaattcaaaatcccaagattaaaaattgaacttggacaacaattcgtgcccaaggcgtagacaaaccctaataggcgctgacagaatttttgaaaaattttgactaaaaatgactggcaaattttaaggatttggggctgaatttaaaaaagatatttaagtaaattttgtggcgccgccggaaggattttaacgatttgttaagaagaacaatatgaagtgctttttcaacactcaatttatttattaaaaaaattttcatttttcgtttcggggggggggggggggcttttccccttccccggctaagccccatgggcatgtctcggcataatttgtgctcacatatttgttatgtcccgtgccgcttcttccgccaatttgctcaga

SEQ ID NO: 2258 - DNA, 3166 bp, Heterodera glycines
ggttaatcaaaattccgagagggttgaagaatttcgagtctccaaattcaaaatcccaatattaaacattgaccttggccaactatgtcgtgccctaggcgtagacttcccctacataggcgctcacagaatttttgaaaaatcttgactaaaaacgactggcaaattttaaggatctggggctgaatttaaaaaagatatttcagcgaattttatggcgccgtcggaaggattttaacgatttgttaagaagaacgatatgaagtgctttttcaaaactcaatttatttatttaaaaaattttcatttttcgtttcggggggggggcttttccccttccccggctaagccccatgggcatgtctcggcataatttgtgctcacatatttgttatgtcccgtgccgcttcttccgcaatttgctcagaaagtcgctgagcgaagaaattcaactgaaaaaatacatttttacggcattcttggtaagcctttttggtaaaaaaaatccctggatcaggttgatcaattttagtcccagtgatcctggtcccgcccggtccagctccagtgcccggcttaaacagcccaattttttggacccgggtaatttggaggacactttgtgggaaatctgatttaaggagtcaaacgacataatttttaattgtgattggcgataaacgaaaaattaacgtgttttctgaaatttgtcgttcgtattatgattggccaccgggccatccactgattaaactggctcttactctcgaaaagccagatcattttcaatttccatgtggcgcttttcaaaatgccgggatctcgtcattaaaactaaaaaaacaaaatgccgcttactttatacatgaagtcgacatcgttcgcccagtccgtctgttgttgctccgcccattgtttgttggcttccgtgtctgtttcgtcatccttctccacacttcccccattttcggtcatgcttttctctccaaatgccattcgatttgttctctgtaaaacaatgctgttcctgttgtccgtgccaatgttgacagtatcgacggcaccgtgccgacggtactgctcaccctcggcttcgtgctgcttttcactatcatccgcctgatcgtcgcaaaatgatcgacgcaagcattcgtcagtgaacatgatgttcacgttgctggatgtgcagctactgcttctgcttcggctgttcgtcgcctttgtactgctgctgttccgcttgaactgttgctgatgctctaccaccgctggttcagctacatcagcaacaatattcttggcattatcaccgtaaagttttgccgtctgtagaaatggtaatgacgggagcggcgtcagtatattgtctccaccgtcgaagctgtctgccatcatgccggagacggtgccgagggacaaccaccgttgttgatgccgaccagacagcaacatgacagtgcaactggcatcaccaccaccagattggcgccgcttatgactcattccaacaaggttattttcatagtcagtttccattggcacgtttggaaattctgcaaatggcaataccaatggttgagttggcaactgttccggcggcattgagtcattcccttcttgcgacaacggcacatcgaactcagacggacactcgttgtacaatggcactcggctttgtgccaaagttttctcagattgtgacatcgttgtttcggcactcaaatccggttcaactttttgtggcagattttgtcggtgttgagcagcatcaagtggttccatgtcattgtcagaaagcagcaacggagttgatggctcgtagagttgagaatgttcggcagaagaacggatggaatcggcaccggaagttgaaggagatgaagaaggagctggagagggacatgcagcatccacaggtggttgttgttgctgttgttggacagactgaacttcatgaacaatttcatgggggtcatgccgagagtcaggcggaaaagcatttgtcgaaagatgtcgaaaatcttgtcgaacaaagtgatcaccatgaaattctttaattgaatgcaaatccgttgatgaatccaacggggaaggattggagtcagctggagaagtagaagatgaaatcatttcatgttcatcatcatcggtgcgattgaattttttaattgcatcatcggtaagttttagcacctttcgttcctcttcttgtgcccttctctggactgcttcaattcgtgccatctcttcttcttgtgcccttctctgaacggattgaatttgtgccatttcttcatctgtcagttctggcatctttggttccccttcttttgcccatctctgaactgcttcaattcgtgccatttcttcttcttgtggccttctctgagctgctgcaattcgtgccatctcgtcttcttcagcccttctctgaacggattgaatttgtgccatttcttcatctgtcagttctggcatctttggttccccttcttttgcccatctctgaactgcttcaattcgtgccatttcttcttcttgtgcccttctctgaacggattgaatttgtgccatttcttcatctgtcagttctggcatctttggttccccttcttttgcccatctctgaactgcttcaattcgtgccatttcttcttcttgtgcccttctctgagctgcttcaatttgggccatctcttcttcttgtacccttctttgagctgctgcaattcgtgccatctcgtcttcttcagcccttctctgaacggattgaatttgtgccatttcttcatctgtcagttctggcatctttggttccccttcttttgtccatctctgaactgcttcaatttgtgccatctcttcttcttgtgctcttctctgagctgcttcaattcgtgccatctcttcttcttgtgcccttctctggactgcttcaattcgtgccatctcttcttcttgtgcccttctctgaacggattgaatttgtgccatttcttcatctgtcagttctggcatctttggttccccttcttttgtccatctctgaactgcttcaatttgtgccatctcttcttcttgtgctcttctctgagctgcttcaattcgtgccatctcttcttcttgtgcccttctctggactgcttcaattcgtgccatctcttct

SEQ ID NO: 2259 - DNA, 1592 bp, Heterodera glycines
tttgttgaatgctcaagcggttggaaacacccgcccgctttcgttttcagtctcgagtgtcgattttcagaaaattccgattgtacttatgggttatgttccccaccccggtacacccccaaaactctgccgagacacaactcatctgatacaaaattgtcaaactttgaatttttcaagaaaaaatctcacaaattttcttcgaaaattcgaagaaaatttatttttaaaatttccagctactttttgaaaaattttgaaaaaaacctccaaacgcgacttgcgcgcaatcatccgagcggcggtggtggtcatcggttttgcaaatttaaacattttcaccaaaattaaatgctgaaaaaatgcggatattattgttgattaaaataagacaaaaaaaaaatcgttttaaacatttatgtgtggaaaatatttttctgagcgcttttgatgtcgctgattacgaatatggcatcatttggacttattccgagtctcgcgacccaaattcaaacaataagtcgatagataggacatattacgattgacccctttcttttttttgaaattttcgaaataaaatttatgtattttgaaggttatcggggccagagggaagggatcttttcgacttcttgttcaagttcggttccgcgattcggaataggtcaaaatgacagcgagcaaccccaaaaactattgaaacatattttcacgactttttaaaacaccaaaaagttttctgctaaaaaaggaggtaatagtttagatggtagccccccattttcaaaaaataaaattttttaattttttttttcgagaaaagattattttaggggtttaacgggttgtagaatccgaatctgacattaatttccacttatgtcgaaccccgataacgaattcgaacaataaagcctaaattcacattttccaattccgaattgttgatctaactccggcatatttgatgtgttgttatcgtttggcgaaatcgtacgatccctaagatttttttgaaaagcgaaacttctgactcaaaacactcaaaccctatagaagtgtcgttcaagctacgccatttttgctatggtgcgctcttttgccgaaaacgtacgatcctaacgagctttttgaaaagcgaaacttctgactcaaaacacctcaaaccctagagaagtgtcgttcaacctccgccctttttgctgtggtgcactattttgccgaaaaaggacgatcccaacgagctttttgaaaagcgaaacttctgactcaaaacacctcaaaccctagagaagtgtcgttcaaactacgccatttttgctatggtgcgctcttttgccgaaaacgtacgatcctaacgagctttttgaaaagcgaaacttctgactcaaaacacctcaaaccctagagaagtgtcgttcaaactccgccatttttgctatggtgcgctcttttgccgaaaacgtacgatcctaacgagctttttgaaaagcgaaacttctgactcaaaacacctcaaaccctagagaagtgtcgttcaaactacgccatttttgctatggagctcttttgccgaaaacgtacgatcc

SEQ ID NO: 2260 - DNA, 2471 bp, Heterodera glycines
tgttcgaattcggtttcggggctctaaaaggtcgaaattaatgtcagattcggattctccaacccatcaaacccctaaaataatcttttctcgaaaaaaaccaaaaattttattttttaaaaaaaggggggctaccatctaaactattaccaaaaaggacttcagtttattagttgaacgaatagaaaaacggagaaaagaaatgaaaatgaccaacagattggaaatggaaaacgaacaaaaaataaaaatatataaaacgccataaaaattttaacactatttttgaattttattcaaaggataatactcaacttttgccagtgcaatttgaatttaataaaaaaaacatgccaaaatcacgcgatgcccactgccatactttttttcagattcaggataaaatttaaggactaatttagcgagtttgagcatttaaaaaatttttggtttccggtgccgaaaggcaccgcatggaaacttctttgaaaaaatttgaccaaaatatgggacccaaactccattagtacccttttttgaaatttttacaacatacctattgcctttttacacatttatcggagactccaaaattcggacgacatcagacatatttttgaggaataataccaatttttacaacggaaaattcttgcaaattttttcaaattttgatacatcacttttaaacagcgttcagtaattacataaaactcaaaatagtaattttgcgccacggaaaagccaattttatttacttgaaggtagtaacaaaagcttaaaacaaaatgtaaaatttacgatggaaaaaagacaattattcatgattgccgatgcagtggatgaatacataggtaagtaaaaatatcgtttagaaaaagagaggcgaggaacaaataaaatggacccaaaaatgaatgacgaagaggtggcgagggagggacccgttgtcttaaaaagggaataattttgtattttttccaggactttcattccaattgtaaggacaggccaatccataaattattttcgaatttattttcaaggatattttttaaacattttccctgaatttcgtataaaaaattgcagggttgtgggccagaggaggacctttgtaacaatccaatggaattcttgaaaaaaggacccgttgctcttgtccatgtgcccttcaaaataagggcaaattaagtgcacatagggaggagccctgacttggctctatttttttcgtataaaatgcggaatgaaaaattgtttcgattggatgcatttatttgtatggcgaataataaatgtgtcatgaaacagcggccgattgttctgagtccgacggcgcggcgacgaccgtttgctgttggtgcaacattttgtacgccgatttgtgtttttcattgatcccttcgatgttccgtgccccttcaattgcaatgaaaatcaccttaaaacgtgaacgttgtttaaacatacatataacgatttgagtaaacgttgattttaatagagaccaccgaataaaagtggggggggggggttcagtcggaatttcaaaaaaaaaaaaaaattttggatgttttttcggttaaaaactgactctgctgttggtctctgaatttaaacaaatgtaacataaataagtttcaaaaactccctattttgtgcttaacagaatccaaaattaaggagacctttcagtttgggaaccaatttgatgggcaaatttttacactattccagttttcgcatccaaaaaaagttattcgtaaataaacttctaaaagtggtgagtttaaagtttttctgtgtattaatgtcagcatttgtccttttcgttaatttataaattctagagtttgccggtttattaatgaaaaaaatacagttctgagccgcagccacaaaaaaaaaaaattttttttacattttatttgaaaacaaatccgtggttcggaattgatgccaaaaagttttgcaatattccaaccaccgaaaacaaattaaaatgccagccagcagcatttaaatgccaaaatttcatttccccaacggcaaaaagtgccgtgccgaaaacaaaacgaacaaaaaaccttgttggtgatgattgtgttcggctcgtcataaattccgtccgcgcgtatccttagcattgtgccaaagttgtaatcgtccaccgttttttcgaacgcttcacagaacaaccgccacttttctttgttttcgtttttcaattcattttcgtccacctaaaaaaatttgggggaaaaatagggtaaaaaaccatccaaattttttgtccctataattcgacagctaaaatttttcgattgtaacagtttattgatttttttgtgtcaattctctacatttcagatcttggtcatcatccctaaatatatgcaatttgtcgacaaatcggtactaattaagttaagctacacctaacagtgctcgtagggaacctaccaaag

SEQ ID NO: 2261 - DNA, 1595 bp, Heterodera glycines
agtgattgaaatgatggtgggttttagtcccagtgattggaatactgtttgggttgagtaccagtgattgaaatgttggtggattgagtcccagcgattgaaatgctggtgggttgagtcccagtgattgaaatgctggtgggttgagtgccagtgattgaaatgctggtgggttgagtcccagtgattgaaatgctggtgggttgagtcccagtgattgaaatgctggtgggttgagtgccagtgattgaaatgcagaattgagtcccagtgattgaaatgcgggagggtggagtcccgttgattggaccgacaaatcattccgtattgttttataatgtcattttgcccacataaatcatcttttcttggttttggttaccccacatttgcgcctatgttcaaaatcgagttcaaacttacatttttcaatccccggatgacttaaacagttttaaataaacgataggaagtgattgtacccaatggtcgtcagcaaattattgaagaaaaaataaattttccggacacggcttggtttcaagtttttgtaatacttggtacgaattttaaggccattctccctcatcattttctaactcaatgacaattcgtatcataaccatttttcgaaattaatgcctagcctaagctagtctcaaatgcttttgtcccaaaatgaccgacttttgtacgattttgccaatgacacccatttcatttgctcactttaaaaacatcaagatccggaaacagttgtctgaaccgtgtgtacacttcgtcctggtgtttgttcaacttcagctttgttgagtcaacagccagcagaatgttcatctgcagtaaatggcaaaaaaaaacactcattttttggaaccatttttggcatttctcacatgaattgaggcactttcggccgctttaatcgcccacataatttcgacgtttgcatcattttcatacttttcgacattgtcgtttaattgcgagcacaaatcgaccattgaccaccaaaatttgtgatgtaattgagaaaaaaaaaagctaaatgatatgcactaatttttatatgtaatccatccaaatgcaatgaataaataggaaaatgcgaatttttaaagaaaagcatacgtaaaattaacaacatttgcactggaatttaaaccattaatttatcgtcatatttgaatttgccatcatcgatggagaaatgttggcttacatgatccatgggtacttatatggttcgtaggccacaaatttaaaattttttaaaatctgcttaggttgcttagaagaccactaatcgcataagcggacacacatgagccactcagtcaaacaaggtaactgttcgtcatcaatgacttcaaacacaacacgcaaggatgggcttgccgaaaaataaaaaagaaggcaaggaagttcacaactctttccggtgtgcccgtcgttgaaccgctcgatcccgaattgctcgaaatgcccgtcgatgaatgcaaacgcatgcaggaacgcaaaagagtgacttcgacatcctgaccgaacgcgatgaactttgccggaccgaccataccctccaacttgactccacg

SEQ ID NO: 2262 - DNA, 2186 bp, Heterodera glycines
ttttcattgtattttcaaatctctagacatatgtactcagaacttatgagacacatttatgataataacattatccaccggacactatcctattttcctaatactgccccgatatgctggaaatggatagtgtgtctccttaatattgaattacataaatgtgtcttggcggcgcgaattcagtgctgaaaagtgaaaatttacgattttcgactttttgttcgaatccgggtccggggttcgaaattggtcgaaatgaatgtcatattcgtgatcagcggccccgaaaacccccggaaatgtattttcatgactttttttaaaaattttcaaaaaggccaacttttacactagcgccaaaaagtttaatgaactaacaattcgctgtgtttttttttctctcaacattttaaatccacaccaaaatgaggtcacttcaagaggtttttcaaaaaaccaacttaggtatgtataccataatttttggtaaatggagctcattttcgagatgacgtttcggagatgaaatcataacaacaataggcaacaatggaaaaaacaagaaagtaaatacaatattgaatacgcaaattgtctctttcaagcattttagtcatctcatccaatttgtttagtgactcctcgaaagatttgcgtgagcgctgcaatcgcgcctaaaaaaatgaagaaaataaggcgtactattttataaaccctttcaatttttggcctcaaaattgaaaaagctgtagctcagtggtttttgtgagaaagtgagaagaggggtggtggaggttcgagcccgccccacgaaattaataaatttaatattttttttgataaaaaattatgttttgatattatttttttttgtacaaaccaagatttctccgtatgggtcatgtaaatttttatttgttgacttattgtacctccaatgattccaaatctgatgcctctcgtgaaaaaaatcggttggaattgcattggactgacaactgacgacgtccaacggcacttttaaaatcggatggcattttcttcggattgaactaaaaattggcattttcagaacagtgccaacacattttctcctcatggtaataaaaccttttgcaaatcttttccggtcgccaaaaagtgaaacgaacgagaaaaggacgacaatttagaaaaagagcagcgattagcaagcgtattcatattgcagaaaaaatgctgaaaaatttttaaattcaaacttaaaacaatataaagtcgggaatttggattggcctgagaccgagataagattacgggggattgaaactccatttttccggaatttgagccctaccccgggactcaaatcctgcttttgctggggtcccggtcctgagccgtttttaaaagccgggatatgggcccagaaaatcctgcgggatccaggtcccatcccggctctaattagcaaatgattattgaaaacaaaaaaggtcgaaaaaaagttgaaaattttaaataagtttaaaataaaacgccataaatttgatttcccaacgcaattttcaaattgtaattgaaactaacaaacccaaaatttggccattttttgtctaataaaattaaaaacaaccaaatacgcccgcttttgactttcattgcataagcaaatctgtgccatttgctttttgccttctctaatccaaaatttcttcattgattcttcatcatccccaactctctctcttttttggtcatttctttatcaaattatcatcatcatcattggtaatcatgtactttattggtccctaaaaaaaatttaaaaataaagggttttatgcgattctgagtagtactgggggtttttgagggcgctgatcacgaatatgacatccattgcgacctatttcgaaccccaacccgaattcgaacatttttttataaaaatattttttaattgttaaaaacgcctttcctgttcttttcggggtcgctaatcatgaatataactgcaattttggtcaacgccgaaccccagacccgaattcaaaaaaaggagaaaattaatttttctccaaattttacatttattttcccaaatctatttaaatggacggaatataatagaaaataaagattcacggccatttagtgcattgaatcaaggtttggacaatatgagaattttggtgaaatattaa

SEQ ID NO: 2263 - DNA, 5752 bp, Heterodera glycines
ttgttcgaattcggttgttcgaaataggtcgaaatggatgtcatattcgtgatcagcgccctcaaaaacccccagtactactcagaatcgcataaaaccctttattcttttcttttttagggaccaataaagtacatgattaccatcatcatttccatcgcttggcccttatcagcaaaaagtgcgtgcgcataatgaaacatttgcattggactttaaatgtaattgaaaatatttctttattgtcatcatttaaatttgccgtccgtcatcaatggaagaaaatgattaacataaaacataccatgctcaaaaaatgatagatgaactagcaatttgctacgttttacatactttttttctactggataatgggtcgaagattataagataccaaacataggaaacaacgaaaaaacaaaaaaagcaaaagccacatacaagaataacagtgtttcgtacgactctttttgctttttgtttctgctcgtcagctttgcgtgcgcgctgcaaatccgcctaaaaaattaagaaaattaggcatatggttttacacatcctttcatttttggcctccaaattttcaaggtcggagaacccgatttcaacatccatttcggcccattacgaacccatgacaagtggattatagcaaaaatttgaaatttaattttcgtcaaaaattcaaaatacgcaacaaaaccgtgaagcctaagcttgggcctaagcgtaagcctatgccaaagtcagtgtaatttttagtttcgaattttgttcaagttcggatcaggggttcggtattcttctgaaaaattaaggtaatactcgttgatcagcgccacaaattaccatagaaaagagaattttatttaaaaatttgaataccaaggaaccactggcatatttccaaagaacaagtttttggtcgagcgcttccaaatccgcagcgatttttttgagttcctcgaatcttttgatttcttcttcgccaagtttgcgattgcgttgcaattccaactaaaaaattgaaaaaataaggtacacgaatttatttttactagaaaacccggtgatattgtcgatggtagccccattttcgtaaaaaagaaaaatttaaaaaaaaaatttcgagactgttttttgggttttgaatttttgttcgatttcaggattcgaaatggattgtcagccatgggttctgcgaccctgaaaaccaaaaatttttttcttttttagacaaacaaatttttgatcgagcgcttccaaatccgcagcggtttttttgagttcctcgaattttttgagtttctcttcgtaagctttgcgtacgcgctgcaaatccgcctaaaaattaagaaaataaggtgacttttactttacttaaacatagagttgagcgggaccgggaattttgggcaaacccggaaccggggacctattcgggttgaaaaaccgggaaaacaccgggactagtcccggtcaaaatcgggacttcggtactcagttgtccgtgttcaggtcccggtcccgctcaattctacttaaacattcaattttggccacaaaattcagaaagctgtagctcagtgggttttgcaagaaagtgggaagagggggtggcggaggttcgagcccgcctcaccacaacatcaatattttttatgccctggggcataataattcaaaaaagttgaattgtgtatgtacctcagtaaaaagttcgtcaaatgatttcaaatttgatgcctctcgtgaaatggaattgctttggactgacagctgacgacgtccaacggcacttttaaagtcggatggcattttcatcggattgaactaaaaattggcattttcagaacagtgccaacacattttctccacattgtaataaaaccttttgcaaatcttttgccgtcgccaaaaagtgaaacgaacgagaaaagaaggacaaattagaaaaagagcagcgattagcaagcgtattcatattgcagaaaaaatgctgaaaaatttttaaattcaaacttaaaataatataaagtcgggaatttggattggcctcagaccgggataagattacgggggattgaaactccattttgccggaatttgagccctaccccgggactcaaatcctgcttttgctggggtcccggtcctgagcgccgggatagggaccaaggaaatcctggcggaacccaggtccaatcccggctctaatttaagcaaatcatattattgcaaaataaaatgatcaaatcaggaataaattaaaaataaaacgccagaaaatgcaaaaatttttatctttcgatatgcaaaatttggtgcaaattgtattttagttatttgttcaaaaataaaacaaaatacaggtacaacatgcacaggattcgaacccaggacccctttttgtttaccttctcgttaccactgacaagggaacattccgagctgtaactcggaaaacatttatttttgcttattttcactaaagaaaaattatcatatatttttttagtctaaaaaatcattttttaaatgatttaattatattatatcttaattaaaatttatttatttttatgttggatttgaacccgagctccaaaaatgcgaatttaaccaactgaaaaccaattttagtgaaaacacagccaaaatttcgatttttgaggcctcataacttttttatttttgatctcacaccgctaatattaaaaattcacaacagcagaagtcgaccctgctctatccaatgataccaaatttatacctactttttaactaacagttcgcgaggttcccttgtaagccaatccttaggaaactgataaattttacaccgtttggatggtcatattagtattttttttgatgttgtcaattatctgtgctcctctatctttgtgtttgtaccttattttcttgtctcgattctcggaaaaaaaatatttctcgcaatgccctacttattttttgtaaattcttaaattttttttgatttaaaaagatattttcattacacacctacatatttacccatttaaaaaaatcaatcatatccacgtatttatattatatggccctattcgaatttctgtttttttgccaattcataaagacatttatcaataataaaagcatattttaatattatatttcatattataatttgtctattatatattaggattttatatgtaatattaaaaagaaaatttaaaaaaaattgaaatttatcccattttcgcaaaaataaattttaattacctaatttaaaaatatacaggtgaaattttataaaatattcattgaatgtctactttcattatacctttgcttctgtttataattattgaattcagcagttccgtctgctccgaaattggttaaaatattattaaaaaataaaataaataatttttttaaaaaatttagcattgagcgtggaagaattggacaatttttatgcaaaatttctcattttatgcgcagaagaaaataatgcagcaatcttaaatattaaaattagacaacaaataaaactgcgtttaactgcttcacatttttgcaccgaaattcttttttataagtataatgttttgtcgacgaaaaataagaaaaaaattgcaaaatttggccaattaggaggagaggcgctcacaaaaatggacaaattttcacacataaacaactgcaaaatgttgaaatttcgcggggaagtcatccagtttatgggtgggttttcatcttaaacatacattttattaaattttttataattaaaaattttattttttttgattgaaatttcaaaaattttcaaaaaaaaaatttcttttggtgtgggtcagaggtggggcgcggacagaaaagtcccgcagtcgcggatcgctctgcgcggattaaaattgccgcagtcgcagatcgatcttcgcggactcaaattgccgcggtcgcggatcgatcttcgaggaacataattgccccagtcgcggatttcgccaaagcggtcgcgaatcgcggattcaaattgcttcggtcgcggatcgcgccaaagaatcccgcggtcgcgaatcgcggccgcgtcccacccctgctgatatagttataaagtcaaatcttttttatgatattaattatctcccaaattaaagtggaaaatcaattgatggatgaagatgattctttgtacacgaagcggaacctattgtcaatggcaaattgtgccaaaattggcaaatttctggaagaaaatgaacctaacaaaagcaataaaaataatgccgtgccaccggaagtagcggagtatttgaatgaagtgaaagaggcacattacaaagtttttttcagccttttattttccgattcaatttggtaataattttgcttttttttaattttctgtatgtttacctttttttttatttaaaaaaaatatcatttttttacaaatttattattttattatttaaaatttaaattattgaaaaatggttttggttttttgaatttattatttcaagtggccagtgactttttttgaagttttcaaaaaatgattaaataaattttaaaaaataattgaactcgaaaatttttacagttcgacttatgctcgagtttttgaaaagcttcggtctatttattgaataatataaataaataaataatttttatattattaatttattacggatttgttattattaaaatttcattttcagtgatttttcacaatattttgactcgaaaagaatggaaaacgaaaaaaactttgcgtttagcatgcgaatgcttcggttggaaaacttggagtcaaatgaaaaaattgccaaaattaaaactaatattgaacaagcattttttgacactgaattaatgcgccaaattgaattaaaatttccgttttacatggcaataggtttgttgaatcaaataaatttaatgacctttttattaataattttgtgtttcaataaattttcttcatcttattaattattttacataaattcttaataataaatttagcttttaattttcgttgctattttaattttctgaaaattatttaatttattgttattttttatattaatattttgcgattctataagaattatgtaaaaattttaaaattttgaaattttttcattaatttttttgttaattatcccatcagatatcattaatgatcacagcttagctgagacatatgctaatattttgtcaagagacgaaacaacacggcataatgctgaacatttgttggccattcgaatttgttccgcacgaatttggcaaatttttcagcaaattcatttggcactcaagcagcagcataatggcaaaaaagccaaattaaaggatgccaaaacaaatgaaattttggcacaaattcaatcaaattggcgtcgcttttggaaaacacggcacgcaacttacaaatatatgccaaatgatttgtatgcacattgggttgcagtgcaagatcaatggcaagatttgacatttttggcgtgccaattagtccaacaattagcgaccgataaagataatgttgctaaatattttcaacacataaagcaattgttgccagagcggaatctgttttatcagttggctgaggagcatgccaaaaacataaccaggtgaagggagaacctttgatcactgatcagatatcacttatctcaaatggaagttttaggccactactgtagtttgctgtatccctcttaaaacgaaa

SEQ ID NO: 2264 - DNA, 1864 bp, Heterodera glycines
ggccggtttcctcccaccggccggtttcaccgctcggggccacgcattcggctccgcggctcgcacgtcagtcgcccggggcatttttccgctcgccggtaacatttcgcggacgcgccgacgcatttccgacggctccgcacggctccggagcagggcgaaccagtaaccccagcccggaaaacgccaatgggcattcaaaatgcaaatgcaaaaaaaaaaactaggaaaaatccaaaatgtgccaaaacgactcgggtaattaagaaaatagaagaaacctaaaccggccacaaaagtacaaaagtaatgggaccggcttggcctccgagaaaacaaataatatttttcgaaaatataaaacaaacgatgaaatttcctgaaaaaattctctaataaaaactgaaatcataaaagcgtaattttttcaacaaacacctaacataactaaataactcggtttaaaattgaaaaaattaattttgaatcatttttttttggggggggggggggcggagagagaagtttatcaattttaaaaaattttaaaatttttaaaattctttttttttcaaaattgatcaaaaaatcgtaggctatcatagataaaaaaaaatcaagcaaaaaaatattatacttttcatttgaggcgcataattttgaaaaaaaatcttcgaattactcgccccgaaaattttttttctggtttttctgataataggtctgagcttgcatccaaatcgaaccgaaagcctataaattttggatttgcttcatccgtggatttttcagcagcgacagacctccccacgctgcgtcgggcacggcacactctgcttcgttgcacatggaggacttaaaaaacagattgtgtgttaatattcaataaatggtgactaaatttcacggctttttgatggtcgagagtattgaatttcgattttcttttcttaattgaataatttttttacgagtttgaaatttcggttttattttttttagtgaaatattttttgagaatttaatcccttttaagttttcaaaaaatgatcagaagcgcaaaatttttcaaagagctgcactattaaaaaagctaatgaaatgctaactaaccatatagatagtggggaaaaacattaacaaaatccttaaaaaatttttttaaataaaatgttaaggaaaaaaatgttgaataatttttctatggttttttcaaaaagaactaaaaaaaattaattcagtctctttctttttataaaatttaatcaaataaatggttcgagtcgagagtctcgagacaataatttagcaaccaaaatttgatcgttgccaccccatgccacaacttttgccgcccacctcaaagtgactgcccggacagctgccgcggtggcacgcccgagtccgacgccggacgccgttgccgcaggacacggagcacgggccccactcgccccacacactgttttttttggaggatggaaaatcagtaaaaaacaaacatcttttaataaaatacagtttcgagagtctcgttctcgacctctcaagatcaaatgctatgagcggggggaaatttaaaaaactcaactaaaaaaatttttccagtgatatttctaaaatttttcatttttgggaaagataaaaaattgaacagatttttattgtcagatttaacgccgaaaatgaaatttttttttttttttgaattttgggccagattttgtaaaaaattcaattgaagcggcaggtgctctggagatttttttataaattatagccaaatcagggtttattgatctgctgacggaaaagaaaatgcccaaaattcattaattgtggaactaagtctcgcacatcccta

SEQ ID NO: 2265 - DNA, 1741 bp, Heterodera glycines
ataaggaatagttttcaggaaatatttcgaaatccagacagaaaaattctcgaattttttccatttaacagttagtttttcttaaagggcaaatatttttttttggctttacctccaaagtggcgcttggctgtcaagcggcaggtcacaaggctgctcattgcatgactgctgctcaatgccaagcccaggacaggccgagccggcaggacatgtgctggaaaatgtatggaattcaaggactcagtctcggcatttttaaggatgccaatcatggcaaaatgggtgtgtgccaaattttggattcttatgaacaccgtagtcaatgattacggtttaacacaaattaacaggctgattttgttcccccccgcagggcagagacgccgttcccgtaagcaagtgcaataacgggccaacgcacagccgtgagggagcaagctccctacaacgaccacttcccaaaagttaaaaacactggggagtaaggactccgaccaagtgtacaaaactatagccaaaaggccgagaagcgataatcatgtagcaaaaataggttttcaaatggaatgattaagaaatgaaagtgtataggatgaacatatttgtgcacgggagggagcagagatattgatgtaaagaggggaaatagtgtgagtgagcggagaggaaaagaagcatgagatgaggaaggggacgaaagagtgtgtgagcacggtaggggtcagttgcgtctggccagttacgtctgagccaagcataaagcaccataacttttttctttgtttgtcaaattttataaatttggcatcattcgaaagctctacatgtttagaagcttttgataagatattgctaagcgattgaacaacttataaaaaagttgcaacatgaacactaccaaaaagtcagaatttttgcatattttaatttataacttttttatatgtcggtacgtctttgtgatttttggatagccgatagagcttgttaagagctttcgaatgataccaacattgttggatttggtcaacaaagaaaaaagttatgatgctctaaacttggctcagacgcaactggcccgtttcgtgtgagcaagacgaaaaagaatcataatatgcaacagtatgcgcttgcgcggcagaatgctgggtcgtttcgtaaaaagcgccaaatttatagatttttcaagaaaaagtcgacattatctttgtgtcattcgatagctcttggattgttctatagcatgaaaagtttcagaaaatttcattgaattttcagaaagttatggcaattttttgaataattttggtcattaactttctgaaaaatcaaataaaattttttgaaatttttcatgctaatagagcacaatcgaaaagctattagtttggttgttttaagatatgttatgaaactttttctcaaaaaaattttctgtaaatttggcacttttacgaaacgcccgccccatcaattgacccatcagaaaatgcaccactcaccgactcctcgatcgcattcctttgccgcacaacaatgagcaatcactccatgccccctggccaattaatgagcaatttaattaatcaattaggtagttaattgcccctaattagcgcgtagattggcagtacctggccccaaaaatgtgaacttacccactgactccatgtggcacaatccttcagattacaggccaacttttgctgcgacatgccatcacatggttcctaaaatg

SEQ ID NO: 2266 - DNA, 1071 bp, Heterodera glycines
ttggccatatttgcgtcgttgttgttgttgctcacacggcacctcttcacacttgcgcatttcaattgatttgcctttaaaattataaacaatattttaaccatttttctgccgtaatcggtaaattgttggtacggtaatggattctaattggtttaatccggttctttaattaattatatataattcgtctatattcaattgatttccatgtctttaattacggaatcacgtcttttgattgatttgtctaattattttcacgaaattaacacccgtgattgtcacttctttaattgatttgtctatgtctcgtaattaattgataatttgtccatcctctacctggtgagcatgtataggacacggtgtgctgtgtgagtgttgagggtgttgttgtgcatcgacggtaacgcgcttggctgccacgaccgcagctgacggaacaccgtgtccacggggactgaaatgggcgtcggagtaaaaattaaaatttattattttaaaaactgacccattccgaccatttgacagcatcaccagccaaaggtgctggacatgctgaaataaagacaaaaaaataaaaataataatttatgaatttttagctcattcctacgggttctattcatttttgtgtcaatctatgtccttgaaatgtccttgccaaggttaagatgaaatccaaattttgtatatgtggcgcttgatcaacaaaataaaaattttcatcgaaaatatttttaaaaaatcgaattttcgtaagaaaatctggccatttctctcccaaataaggacagtcctagaaaataaggacaaattttgagccatccctctcactgacagatccgattgcacggctgactctcgctgctcggcccgccatcgcaccgaccgcccgcggggcacacgcgagaacggaactgaacgccagcacttccgcacgatgccgtacatggggaccatgaagacctcaaagttggcacaaaactggactcaatgatcaaaaaatgaaaatcggaattttgatcgatcggataatgtgatcagattgatagtggtcgagtgatt

SEQ ID NO: 2267 - DNA, 5286 bp, Heterodera glycines
taatcaaaacattgatcaaccgatcagttagcttcagagctcccaagtgatcggagaaatacagttagatgtatacactataccattgctcccactgcccaatggcgaaatgccgtggcatgttcaactgtgccgccgtttttggctcgtcgacggcacttgtcgggcaccgttcttccttggccggacaatgctcaccgtattcaccgattagcaacagcgaactatcacagctgagcgccttcacaaaaacaattgactttgatcagtgatcaatagggaccggatttgtatggattatttttgtacacttatttcggcaaggaaaagatcttttttgcttgatttatccatattttatatcgatgtttcggcattttcacaaaaaaaaaaacgaaaaatacacccctattaatatgaaaaattttggaaaaaataacaatgaattttttgcaaaatttactaatttttgcaatcttttttctttgttcaatatttttcgtaagtctcagttaacaaattctataattcatgtattaaatgatttttttttcctcttgacaaaaaattttgtgggtttagattttacaaaaattcagataattttcagaaatttttgtccatattttcgtattttttgtccatataaattcggtccctaatgattaaaacagatcagagatcacagagtttataagcaaaatgccaagaaataaaaaatgttattacaaaaacaaaaaatagagtgtttccgtcacaagcaacaaaagtcccccgtattctgttgaataagtgtaataagtgtgtggtgttagctaattgtttgtgagtagatcaagttgaagccattttctgtcctccaacaccaaaaggtcacgccaacgctttggtccaacgagcacgcccgagggaatgccagagtcgccggcgtcgttcggcgactcactcaaaactcgccgatcgctgccgcccggagactcgccgccgctaaaaatctttcggtcgctgtcgctcgacgactcgccgtcgctcaaaactcgccgatcactgccgcccggagactcgccgccgctcaaaatttttcggtctctgtcgctcggcgactcgtcgtcgctcaaaactcgccgatcgctgcctcccggagactcaccgccgctcaaaatctttcggtcgctgtcgctcgacgactcgccgtcgctcaaaactcgccggtcgctgtcgcttggcgacttttcaccacttgtaactcgccggaatggtgcgggtgtggcgacagtgctggtcggcgtcattattgtttgttgccgaaggcaatcgcgccaaaagtatttgtggacaatctactgatggatgagagaatgtttttgttatggaaacgaaaaaggcaaaaggtatatggtagcgactcgttactgtatacagtatatatatatataatatatgcatatattattttatatatattatatggtaattaaagcaaaattgttattgaaaacttaaagggagaagggcaaaagcatgggaggggagcaaattaattgataaattaaaaaacgaagtacagtaaccggcgatagggtaccataccgtaagccaaacccaatgattttgtaacaaaaaagtgtgagtcccgttgaatgttattggtttaagtggcatgtttagtgccaaaaataatggatgaaaatgttaataaagaataaatgtgtaaaaacaaaatgaaaatgaaaaaattgtatttcaaaggcacttaccgtacactcgccgttcagacagtaacgattccaaccgcagggagctgtcaatttgtaaaattacaatccatagtcattattaaggattctttttttaggcacaaaaaatcgcgaaataggcacctaaaaaggcacaaaaaaatcgcaaaataggcattaaataggcacaaaaatcctcaaataggcactaaaataggcaaataggtagcaaaacacataaaaacttcaattgcataaactttttttcaaataaggatacatttttagagcaaaatttttattaaaaaaaaataaataaattttggtgatcaatttttaaaaatattttttcaattcttaggggatgtaatttctgaaattttttcgggccttttcttaggggtgaatttttcgtttttattgcatttttgttaaggattttttcgaaaatccttaaataggcactttaggcacaaaaaccccgaaataggcaaaaacaggcattataaaagtcattgtagacgacaccccaaaccaagcggaaaacgcgttttttgtgcttatctgagcgtatcaagtgcgcaaaaattttaggcatttgcctaaaaaaagaatccctagtcattatttaaatgaaaaacaaaatgacgaaaattaatgaacaaatgtgcaaaaaaaaaagttccaaaaaaggacttccgcgagtcgaaaaaaaatattggattggaattcgggtcgagacgaccaaaaaacttggttgcgagaaaaatgtcgggtttcgagatttgagggtctaacctggcccaggcccaaaaaattaacttttgggaattttcaaaacttataattaaatttgtttactcaaataatgaaaaaataatttttttttggggtagtaaaaaaattttggtgggcactccctttagttttattccaacccctaaccgaaaagtgcgtaggaaaaccagtttattgattagaaaaaaaatttcaagaaattcctaaggcttaggcctctctcacccccgtccggcaagtcgtccccgtaaaagcggtagttgcgcggcgctccgccttcatttttgacgtcacaaaacactttgcatgccctctggggaaagcgggtcagctgactgccggtgccggtcagctcggggtcctggcgaacgcgttggtgctccgtgcattttgccgaaatgtactggacagttgttgtttgttatcattagtaattagccaatttgctaatgacccacacttttcataatgagccaactcgctaatgacccaaacatttataataagtcaattcgctaatggcccaaatatttattatgagccatttgttaataaataacccacacattccctaatgaatcaattggctaatgagccatttgctatgagccaggctaatgaccactaatgatcggaccgttaatggaataaactcgctaattaaccaatttacaaaatgacccaatcgtgctaatggatgaagagacttatcacgaataaattaatccgttaattgataaattttcttgctttcccaaaggactaaactcatttatgacctgtctcatcaatggcatttcaaatatccattattaaattcagtgatatagccgaaaaagtatttcggcaatttcacgagtggcgtcattgaccctaattggtccacctggttgaccgactggcgctcctgcgggcatttgcgcgaacagacggcggcacgatgcgcaggcccactgcactcggcacctccgttctgtggtgccggattggagcagttccgttcggaaagtgtctgtgccaaaggacaaaaaagttattttaaaaatccgcatgcatcccgaaataaaaggatttttattgtgataaatttgaaaatcctaagcaattaataattttggcggggatcgtatcccaattatttgtttttaatcttcgaaatttttaaaaaaatcttaggaacttttctttataaaaattttaaaagtttttttaaaaaacttccaaatttgaaaatttttattcggccggaggggaggggaactgatccgatggaaatgccgtaaggggtgtaccttttagaagtcaaaaaaatgccaaaatgccccagatcatggaaactttcatattttttcaagggtgtggccccggaatctgggccagaattcttgggggctcgggaatgtgcccaaagttgggaattcgggggcattagtgttccaagtaattcatgatgtctgaaatctcaagaattttggattaaccggcaaaaaaacccacaactccaatggcaccgctgatgtccgagcagaagcattgatggcactcgaacggtgaccagtcggaccattggccgtcaacttgggactgaaaaggacagggatcaattggaaaaaagattgaatttaatttttaatcgcaaaatttccgccgcgtgcaaattttcgcatttaattaaattgtgcaaatgaaaggggcgaaagggcggagccaaaaacatcgccggaggggaaagtaaggcaaaaaaaatagtgcaaattttaaaatttgacgagcgccacactttgaaacggagcgagagataggcaaaaaaaaaaagtgggaaaattacaacaagaaaatacaggtaattatgagggaaagagcggaaaattgcgagaaaaaaaaattcaaggtcaaacggatacaataaaaaagagagaaaggctaaagatcaaagggagacgaacaatcatagattaaagatcaaagatcatcaaaagatcaaagagcaaagatcactttgaaaagacaaacaaaggtcacttatgtggacaaaattaaatttcctttaaaatttaattaaaatttttaatcaattcgtaactaaaggttgggcagcagggagttaaaaaatggtttgtaaacgtaattaattaggaaaagtggtacataattagttaattagtttatccaaaaaaataattaaatttgacaattgttgtgaatagtgcaccgaaatgagtggggctcgttttggaccatcgttttttggcgccagcccgggtttttgggttgtaactttttttttcttttatcaaccaaatccaacaatcttggtatgtatcaaccgaaagcttagtgcatgtttagaagctgtttgtatgctattgcttggagattcgacaattcccaaaaaagttataacacaaaaattgcaaaaaagtcaaaattattgaaattttttcgaaacctcttttttataagctagaaaacacttttgtgatttttctaattgtaaggctaatagagccttttaagagatcgaataataccaagatttttgatctggttgacaatgaaaaaaagttaaagttaaaaaacttgggttggcgccaaaatgactcaaaaaacatgaaaaaaagtgctttggtgttcagctgatcaattgagcgtgtcattttaagcaatatgtaaaaagaaaaggccaaaaaataacataaataaataaatatatacaaaaatgattaaacattttgaggggattaaaatgaaa

SEQ ID NO: 2268 - DNA, 3195 bp, Heterodera glycines
  misc_feature (121)..(121): n is a, c, g, or t
  misc_feature (3127)..(3127): n is a, c, g, or t
catagtcggcccgctcgcgctccgtccgcgctcgccactcggccagcgtacgcatgtatttggcacggatttcctcctgccgcgcgttccatgccgcattagaactgaccgtcgttgctgngcatgactgttgtcagcattggcacggtggccaccggttgcggttggagtggcggtcgcggtgccaacggcgacgccagagccaccgctgctgccccatggcatgcaacggccaagcgaacacctgcgcagggggaaaagcgcggactgagtgccgaaagggcaacaaaacaacggcatttcttacattccttcccccctagcatgaattattttttaaataaattttccaagaattttttctgatatgaaaattttatgctttttgagaattttgtaattttgtttgcaaaatattaaaacatttgaaaatttctttatttattttttcattgctaaaaaataatttcgtcatggtgacagtaatactatatctgtacggtatttgccatatttttagagtcggtgccattttttcaaaactcatatttttgtatttgccatatttttacgccttttgaaaatatcggaacgattttttttctggtaaaaaatcccatttaaaattcaaaaaaaaaaaaatttaaaatcgacttatgcaaaatgccaaaaacggaccattgatttgtgccacaaacagtgccctccaaagcgggatgagaagtgatgatgcgtccgtagttgctctgaccgcaccacatcatgtgacagacgccatcttgggtaaaatttgggtaatttaaattcggcgtaaggaaaattcttttttggcattctgctttaccgtaatggtcatgccgtggcgacacttgcacatacgatggtccatgcatcagccggcactgctctgaaagaagaaacacttaaatttggttatctgacaatttgtacattttaataataaaaaaaaattaaatttaaaaatttattgtacgaattgccaacaaaattcaatgtttgatcagtgtttaatcagaaaaagcgatcaaaaattttgtaaaatccagaaaaaagggattatgagcccgctttggagtccttaaatataaaatattcttaaaattttgaccgtgggcatcgtaaacttggccaggcttcagcgattcggtgattggaagctgttcacgcagcagtgagcttcgcatgcagttgttttgacgtgcactgtaaacatggggagaaatggcaatttgagcaagggcgtaggcagggcggggggggggggctgagggcggtaggggtcaactccgtctcagcaatgttcaaaaagctataacttttttctttgttggccaaacttcacaatcatggtatcattcgaaagccctagatgtttagaagatatttataagctatttctcagtgattaatcagctctcaaaaaagttgtcagtttaaaaccgcaaaaaaggcagaattttcaaagttttttatttctatctttttttatagttcgaaattttctgtaatttttagtaggctaatagagcctgtgaagagctttccaatgatatcaagattgtttgattcggtcaataacttcaagagttatattgactcaaagttggctcagacggagttggccagacggagttggcccgttccggctgagggggctaaggcccccccccgaaacccaaaaagtaaaaattttcagtaaatttttttgaaattttaaaatcgagcttcagctccctccgaagccaagggtctggctacgcccttgaatttgaggggtgacctaatgccatttttgaaatttaaactgccctttttcgtggtgatcagtcccaagaccggccccgattttcttcgtgcttactgatcagtcccaaactttgtccctatttttcatggtgattactgatcagtcccaaactcttcccctatttttcttggtaaccagtcccaaacgttgtccaatttttcatggtgatcaatcccaggccctgtccctattttttatggcgattatttctctttgtgatcagccctaaatcctgtccgatttcttggtgatcaatgaattccacccagcagggcaacccactcgaggcgttggatgaacatctgataatcacgtgttgaacagcttgaccatgtcactttgccggggccaagtgatgcgctcattatgtgcgtgccgggacagtagggctcatcatggcgcatgccgaccgcgtggccaagctcatgtgtgccgatgaaagccgatgtgaagtccaggccttcggcaagcgtactgaattttaaatttgtgccctcgtgggactcatttggccgtgttttaatttaccaagaattccatgaatcgcacattccatctaaagggagaatggtgccaatatacatatgagtgccataatttaattattcggtggaatactcagccccgagagcgggggacggaggggggtaattagacgagaaaattgggtaccgaaaattcggcaccaaataatttttagatgaaccatatggaagagggcaaaaatattgtttattcgtaaaaataaaaaagtcatcagaaaggcgaaaaccacttactctgacgactgttaaatttgggtggaaaatttaaagtttttataatttcgcaacatcctgaactacttaccaagcctggcaatgccggaaattgatgtggcaccgtagccccggtggatgtcaaaaccggtcaacatcagcgcatggtcccactctcgggcacccaaattgcgctgatggcgacaaaacaggtccaggtagcgttgggcattgccctgatcagaaaaaagagaaaaattgatcactgatcagcgagcgagcagtctcacattttcgtgcaaatatgaggcgatggcactctgaaaagattgggataattctaaatgtgccaataatgaaaactgaagaaaggcactaaccggctgagtctggtacacttcgtagcgaacaatcctggtggaaaaatgtgtggaaatgattaaaaataattccaagagccagaaattgtgactcaaatttaaagggttttaaatgaaagggttttttcaaattttccttgccctctcagaggatggacggnccaaacactaagaatggagaggcctgtggaggcgaaagttttacgttttcgggtcgaaaaatttcgct

SEQ ID NO: 2269 - DNA, 5574 bp, Heterodera glycines
ttgatcataattgttttttgactctaaactttcgtcttttcattccacaatcatcatcatcacccaattctgtataattatttatccttcatcaattgttaatggtcattaaagacatcattttgtgtgtaaatgctgccaattcattcacatgtattctctcctctcctctctctttcatttcatgtaaaagatgcaatttgtctttgagagaatcgtcgcattacattcatttgcttttgcattggtcatcagggatattgtcgtaataaagactttttttgctttaaaaccaaaacttgaagaattggagcttttggagtccccaattctttacgtaaacaatgaatgggtcagcggtagagttgcacgggaccgggtcgggaaatcctggttttttcaggtcccggccccgatttttggaaaaacagaaatcccggtcccgggtttgccagtcccggcgggactaaataaacactggtaagaatggggtctgggtgagaaaagagaagggaattggtggagaaagagaaacttttgagtaaaaaaaattaacttatttattacatttacatcagttgttcaaattctaatgtggactagtggctgaccttctgactttcagcatttgtcacttcggatcaattccacaatgtaatatatactttttcctattttctttactaagtacattatttcaattgaaatttaattaataaatgatatttctacttaaaaattattagtttttctttttttaaacagcctagaaccacaaattaaccaaatatttagtcatttttaggcaaatatttttttgaatataagcaatttttcataacaaagtgcactcaaattttcaaatttttttcaaaaaaattttctcttgcgaaaagtcccggttattcccggtcccggtttttctcgcggtcccggacgaaaatcgaggtcccggtcccgacttttctggtcccggcaagtcccggtttttgtcaaaattcccggtcccgtgcaactctagtcagcggtattcgaggaacaaaaatgaaataaatcactgtggacggaaatgattaattttaattgccaccaacagacaaaagaattattgactcattaatcaggtaattaggagttgagcatttcgtaaagcgacactgtgaatgagtatttacttttgagtgtaatgttttcgctccaacggaactgaaaagggatgcgtagttattattgtttgacgcgcctctttcaattagtgggccattagtgttaattaattaattactcaccactctaccaattattattaatcgtcatttattagaagaaaaaaagcgcagtttttatttttctgaactaacttcctattaaatacgtaccattttttaaacaattaaaaaccgtatcaaattttatacagtacatttcttggttaattaaagcggtcattagagctcattaatttgactgacaatgcttttgccatcgtttaaccgtgccggattcgttggcctccttttgctttgccaattggccttggctccgtttgccacggcatttccattggcgacggatgcgcagcgaatggccacagaagaaagtgccgtcgttaaaactcaacgaaggcatgaacaaagcaattaaaagggggccaattatcggcttcttttggtttagccatcgttcgccgggcctttggaagaatgtggcggtgggtgccgcgatcggagttggcggcgcgttgctttaccacgcgtacaaaaagagcaaaagcgggcagacggcggcggcaccgacggagggcaaataatttaaataaatcgcaaaaatccaatgaatggcactgattaatgatgaagccttattcagatgcaggcacagaaactgaacagcccgcaaatttgagaagaggctaaaggcgcagaagaagaaaaaaggggggggcaatttggcgaaaggaaaactcattaagaaataattaattaataatctacgacggcattcttttaactgtgagtgttttatcggtttttactttgcataaatacataatgtatcatttcaagtttaattgttgggaaaaagagacactgaacggtgccgggcattatcggctctttcccaacggcactcgttttttgccgagcaaataacttccaacttctcactcgttgacaatagtgctgcgcgagacagaaaatttcccggaacagagacttgacctcgagaccgagaccaaaaaaaacccgatacttttctcgagagcgagactctcgagcagcactcctgacatataattttgaaatttgcgcaaataaatgatattttaagtttctttgcctttttcattttcaattcttcccaaaattgggcaaacaaagcgaataatattaaaaaaagaatggacaaaaaataatttccggttgaagtggcacttttaatgtgagtgcccaacacaaagagagattatttatgtgctgttgccgtccgtccgttctttctcacggccttttttcgtgccgtcgtcgaatgccccggggagggggggggggggggcgcaatttgccaccgattttcccaaaatgctcacatttcagcagcaattggaactcatggggctgttcgagagcattgagtagaaaaatttcccaggctttttttggggtctcgagcctgattaaaatattaggctttgaaacagccttaaaatgttgtaaaacccagaagaattcactatactattttgttgtctctctctcttttctcctctaaccatttatcacagtctctccaatgtctgaccatttagtgagtgtctactatgtactatctcttctttcctttcttctctcctcctcatattctccttccttttttatcttttccttgcaactgtatatcattccaatggtcatacacacaaaacataaataggtaaatggtgtttgattttgtagttctcgaggtaaagtccgacctcgagactgaccgatgaaacggtgagtcattcgtctcattctcaaataaccctaattaaatcaaatacatttataaaaaaaattattaattttttagaacatcaattatcttgacaaattgactcccctccgaattctttgcaaattactccttttctccccaaaatatggactttaacctgaaaagattggccggggaggcgtccgggatgttcagccgagccaaacaagtgccaaaaatattgaaaaatgtccatttttgaaaattaaatttcagctaaccgaggaaaagctattgaacgcggagaagacggaacttggtaaaagtggaaatggaaaattaaaattgcaaaatggcattggcattttcagaccctcatttcgagcaattgctcgccaaggcggataaaacggaggaacagtcgaagaaactgttgtccgccatggaggcgtatctgcagccgaacccaggccagtgccaatgatggcgggcacttttgttgcaaaattactgttttttccgattttagccctccgaatgggcgacctgttctatgaaaagatggaaatcacttcgcccgcccccaatcgctcaaacactttggaataccttagcgaggcgatgcaggtgaaaagcgattgttggaaaactgtgatagaaattaaattaaaatgtcgcaatttttaggaggctgcccaatcctttggcaccgaaacgccattcggaggtacaaaaaatgggaatgattttgggatcggcgggagagaaagaaactagcagtttttaagtgcagttttttagatttttttgtccaaaatgaccaatttgggattttttagattctaaaacgacccaaattagtggtttttagtcaattttgttgtaattaaggtgctttgcaaaaaattgcgcagacggaagctaaattgggcgctgccgaaagggaaatggtacaaacgacggccgggcaaacgctggtgccaatcaaacgctttttggagggcgaaatgcgaaacattcaggcaaaatgccaaaggatttaagggccaaatgccaaaatatacgcaatttgcagagagagcgccgcgttttgcagaagaaacggttggatttggacgcggccaaaagtcggctgaaaagggcgcggactttggagggacaagcgaccgtaaaactaataaataattaataaaattaaatggaaaataaaatttaaaaatgaaatgtttaaagaggacagagaccaattatttgtttgttgaacaggtgggcaaatgcaaaaacagtgaatcttttgtgaatgtttcgtcttacattttgaaaatgtttttcttttttgtgttgtcatttgtatgtatttttggttgtttttttttttgctctctgtgaattgccggagggataaaacttcattttactttaaattttctaaaattttctttttttaaattttttagtcctaactttttaattggtcatttaatttttcatcaagagctaaaacttattgtcctttcgccccattaaattcgaaattattttcaaataaattatagtaataggcacccaattcgggcatttttttcatttttccattcgaattcatagatattttttcaattttcaatttgcttccgttttccaggccgaggccgaccttcgcgttgctcaggccgagtttgacaaacaattggagattttgcgcattttgttggagtcactgcaaacggcacaagtcagaattggcattttcgatcatcactttcccatcatcaatggcattttgatgccttttcagaaccaacagtcgaagcatttgttggaatttgtggaggcccaggcccaattcttttccgcctgccaacagcacatggccgacctgaagcgcgagatcaattcggccagcggggaacggtaaaagggtggaaaggaaaggatggcattccgtgccaaataatgaaatttccttttttcagcttcagatccaacggaattaatggcggcggtggcatttgaggggaacgaccgacggacagcgaaagaacggccgagggaaatgccgcaaagcgaagaatcccccaaaaaacgcattattttaccaataatataaatgagaaaatgaatttatttaaattatgctttcatttcattttatacactgactgctaattgcatataaacgaacgaatcctttaaatgaataaatattctatttcaaataaatttattaaaaatgaaaatgttcagttaaatttcatggattgggctatgtaaatgtttaattattaaaataaatttaaaaataaagttcgtttcaaaattgcatttaatttgggtgtttaatagccgattttcccgcaggggtgggataagcgttaattgaccaattatcgacggattggcggattatttacattttcccatgtttaaatacctatatgatcttttcaacgctcacaaatgaatattttgttagtttgattaaataaaatattttgttttatttttaaaaatatttccgcattttgcctgagtaattaattataaattaaaattatggctaattaatttcatttttgggtttcccaaaatgac

SEQ ID NO: 2270 - DNA, 1491 bp, Heterodera glycines
cacaaaagcaaaagcgttggggggcggcgggctgaccggcctcggggcgacgatcatttacaacgcgttcaaaaagaaaaaacatgaagcagaaaattgaacttttcttgatcatgttgatttatttgaatgaagaattgtgccaatttccatgaccaatcgcaacaaattaaacaattaattaattagtcaattatcaattataattgaaatattttgcgaggtgaaagttggtgaggaggggctaactgttgtccttctctgctcaaggcgaagttcgtggctctctcccccccccccccccattttggcccaacaataaataataaatcactgtttaataaactttccccgccctaattgttccctcccgtcaaatcaaaacccaacctgtttcttcttccttctttccttcctaaataattgttgatgggtaacggagacgaattgtccttttcagtcattttaaataaaaaaaatgacaaaattttgccgaaaaaataaactgaattaaattggatttatttttgaagctcttagtttgccatgaaaaagcttcttctctgtgtgtttctgctgcttcagtttctgctcgccaccgatgcgatttcagtgcaaagcgaagttggccaaccattttttgaccaacagagcgaatttggcacagtgccattgagcgaaatggaaaagtgacaaagaaaaataaataaataaataaaaatttaaaaatttagacgtcgccgtaggcgcttttccaaactaaaagccgccgccttgggagcagctgccggattgggagccgccgtcattgccaaacacgcgggatgaagcggaacgacggaagggagtaaaagaaaggagccgaagatcaaaaaaataaattttattttgtaaattagatggatttgtaaatttgtttaaaattgcttaaatgagaatcttgagaattaacttcctcatttttggggtgctctcgtctcgcgtagtcaattaattctcgaactcaatcttgacttggtttgctttttgcctatgactccctctcgccgttttccgtaacccttcgttagcaaatgatccaatcttttgcggaattgtcgtcctcgtgtttcttgctcatctaattgctttgtttaattgctctaattaattaattgactatgaaaattgcgttaacaaaagttgaacccgcccattaaaaaaagtaaattgtttaaggaattaacaaaaaatgagctcatcattcatttatttattcattaactgcaaaaatagatgactcacaccaaatttctccactataaaatgcttttattttcccacaattttcaatcattttataattttattgcttaattaatttatttaattttcccgacgcttgccttaccatgaaagaatacaaccaaaattgtccttaatttaacccggttggcaattggcattcgcaacccgagaaactccgtccctctccccctttcccattcactt

SEQ ID NO: 2271 - DNA, 1779 bp, Heterodera glycines
ctttttttatattatatattattaccaattgaaaattgaaggcaaaaatgcgtttgttcattctgactttgctgcttgcccaactcttttccgcggtttttgttcacggcacttccgtgccaatccaaacccaattgatgctgggcggggggccggcagcggcgcagggactgccgccaacgcaaacgaaagcgtaaggaaaagggagctgcccaatattctcggccatggtctcgaaccaagaaatttctcgagtttttcgtaattcaatttcgaaataggaggcattttcagtaccgagtctcggaaaattcgtctcttaagatgacataggccaaacgaatggaataaaagcaaaattcagaattcgacgacgaaaacggggcattaaaacgtccggactgatcgccggggcactgatcggcacgggggcagccgttggagcgaacgcatacaaaaaatacaaagcgaataagggttaagggagcggaggacagacaaagagagagaaagggacaaatggaagcgacggagaattaattggaagtgatcaattaacactaatatgcatcattaaaagaccaattagcacacaattgacatttattatgaaccacatttaaaatcattttaaagagaaccatcacagtacaatattagtttctttgaacgtacaatgaaatataacttactgtaccgtaagttagtgacttaaagaaatatttaaatttgaagacattatgccaaaataaaaagaaaataatttttaatttacctagtttcgattttgtaatttttattaaacttttaaaagattggttggcttcaatttttgatattctgcaagttgagtttggtaaataaattaattgaaagggaggatcacaaatgttggctgggattttcttgcggaatcccacgccgttcccgtaaaatccctttatgacaaaaggagcacattgcagttgcatttttaatgcttatgtcatttttaattttcactcttcagctaaaatgaaacgtaaacgtacttctaatacttcgagtcgcccaattaagcaacagtccgttgcccgttcttcgggttccttttttacgccttgggggcagaggaaaagtgcgcgctttttgaagatgggcaggcgaatgtgggaatttgttttattttttccgtcccgtggttggttcactgtttttcttcagttacctctgcaatgatgttttgtacgacgttttcgccgacattgacattgttcggcttggccttggcattgcccccgtctccgctcacttcgatgctttggtggacggttgtttcaaggttctcgtaattaatgccattccatatttttaataaaaaatggtgtaaggctggagaatctgggctccaaaaaaacattttctatagtaaaaggccagctcgccggaggtttccggggctttgatcacgaattgatttcagaatttcgacatttttaattttagaacatagatttcctgaatttccgcccgtgtttttagaccaaaaagcgcaaattgcgacgcctttggatccgtcaggccattctcaccatgcgaaggtcgatccagcgcaaaactgacaaggccgaattggtcaattatgagggcaaacaattgccatttgccaaggcgccgcctccgaatggaattgtcggcttcaaatccatcagcataaggcaaggaaattggtcaacaaacagcaaaaaacgcatttattgtgaaaaagcacaaaaatatgcacaaacgaccgataaaata

SEQ ID NO: 2272 - DNA, 2125 bp, Heterodera glycines
atatggacaaacgaccgataaaatctttttttcctttaattcattcaaaaattaatgaaaaaattcataacataacccgaataaggagtggtgggccaagggggaaagtgccaaacaaaggttccccttttcaattacctcgatgctgatgccatgtcatttttggagcacagtcagcccctcttcgaccgcgtggacatctttttcaaatgcgacggagccatcaaagggcgtgggaaggaatttgtccaaatttggccccttttccgtgccaacatcgtcaaaatggctctcagccaacgtttgttggttcgcctgcgccgtctctgtggcccggccgttctctgcgcctgtgccaaccttcgcttcgtcaacgtcgatgatgaaaactttgccatgaaatctccggcggacgacgccgccggcgcttcgccgggccaagcgctgctcaaatggctctacacaccacgggaggacgggcagccgaaagtgttgacgatgaaggagaagccgaaaaagatgatggacgacatcgcaaaggcaaaaaagggtctcaaaaagcgaccaaatccattgggttttaatgccttttaggactgaattcatacatgaaaaaaagggggagggtgagggtcaacacgccaattttgcgaatgcgtccggccatgtatcgaagaagttttttttatccttttaaaaacgctttttacggcgccctattttccaaaaaaacttttggggaaaggggtctgtaggcgctgttggaatttttttttttgaaaagttgactgattttttaacaaattttatccaaaaaatgacccatttttgcgatttgaaacatttttcgcgcaaacatttccatggtaacacttatttccatgtccctcctttaaggaattctccactgccaccactcccgtcagtttcattgtccgctttcgcaaatcgtcctgggatgcctacgatgacgcggccctcaagccgtttgagctgtccaacgaattgacgggtgagcgactgacacttcgccatgtcatcgaccagcagagaaacgacctcggccttcctgctccgcctccaccacgcccttctaacaataagaagatgatcacctattcttctgttgtgtctcgccgttccaagttcgacatttggctgttggagcgcactccgagcgaaagggacgaaaagcaatggacgcattgggctaatgaggggccattcgacacgtgctattgggaggaggacaacgtggtttatgtgaactttgacgagcgacgccaactcgggtgggttcggattcggaaaaggaagggcacaaatgctgtgatggcatagtccgtcttgatctattggggccactggaattgggtcagacaaacagtttattgttttgtagttgagtcttggctatggtcccaaaggggggatattaccatggtgtgaccggggctggctgtcaaaacatttcgggcacccgaaaagcgtggaactgggtcgcctccgattaaacaaacgtcgattacacgctaattataatagacttttatacccgttttacgaaaaggtcttttgtcagttgagttatcttttccaggccattatggaagcatttgacaattcacttttgacgtttccaggccgagaatggtccgacgaatgatgtgctgctgttatcgacgggtgcccaatgcgccgggggtggcgcccatttaaccgacaagagcttacgcggcattctgatcccttatcaaagtataaattgatgactcttttatgtgagccttctcattcctcaattgtctagtaaatgtattttatgcttttggtgccaatgcatccgcaattatcatttgataaaaacaaatttatttgttttgtaaatattttcaatttgtctcttttcctccgttttaccatccgaactctcatccccccccccctcactttccaatttccaccgcattttccgtcccattgatcatttgatatatttatttatgcaaatttggtacatgattttggtgtccccccccccccaataagcaaaaactgttcctcctccgcccgccggttccatcccccgcggcgatttatcccccaattccttcgaccaatttgg

SEQ ID NO: 2273 - DNA, 1431 bp, Heterodera glycines
tttagtggtggtagccgatcgacagcgacaaatccgagtaaagcggcgctcaacagccgatccctccccccatcccatccgatcacttagctcttctttcccccacccgatcactattacccccccccctttccccgtcccgtccgactgatcactcactctttgtccacccatcccttcgtttttcgcctgtccattcgatttgtcatcgcttcgcgcggcgcatcgttcaaatgggcgggcagcggttttttgaacgattgatcacttcttttacccattttaggctccttttgtttttttccaattaataagccgcaaaaggaaaagcagcaaattgcagcaaaaataatttaaaaaggggaaaaagacgaaaaaatgaaacgccactgaagccgaccccgaaaaagtttatttcgttcgtccaattgaacacactttctgaacagagacagaacaagcaaaaagctgacaaaacaatgggacagaaattgcaaatggagggaaatgtgtggaaaatttgatgattaattaattaattaattgcttaaagggtaattaacggcaattagcggggcgaggcgaaagcaaatgacagaaacgggggggggggagagagcagctcaaagcaaatcgttcggtgaattttcaatttattccctccaatttgttttcttctgataatgtttgtcctccctccctttgtcggcaattgtgtcgttgctgtgacacaacaaacaccgactgatcagcgggcaacacactcacaactgatcgcaatcactgattgagttgagttgagttggtccctcccccacccattttcccctttttctccccaaaaaataacttttcccatccttttctctcctttttatccctcttccctccaacagtgacattctccccccccctctccaattttctctcttttcccccatttttctccaaaaatgtctttccccccccccccttctttctccctgctgaacttcgctcttcttccaattgacgcgacctttcaaatttcattatttgtaacttaaattgatgcgcagagtttgtgctgtccgtccgtccgtcttttccccccccccccccaatttttgttttgtgcgtcgtccgttcgcatcctccgctgcttctgctgcgggggcattggcatccgaccgcgcggggtagggggcacgggggatggatgacctccacccacccaacccttttcattactcccacacacacgcggggatgaacaggggggggggggggaatcagcggcacggggacgcgagagtgagcaaaatattgaagcgagagaggaaagaaaaggggataaatttggaggggtgggcgattggaaatgagggtaacctcgagagtatccatgccccaatgctctcggtccccctttctcccctccccctctcccct

SEQ ID NO: 2274 - DNA, 1266 bp, Heterodera glycines
  misc_feature (31)..(31): n is a, c, g, or t
  misc_feature (39)..(39): n is a, c, g, or t
  misc_feature (1058)..(1058): n is a, c, g, or t
ttgttgtgtctttgtaaaaacttatttcacnacacacanaataataaatgaaaaggaaataagaagtggtgagagaagtcggaagaggaatgagtttgaataatgaatggaagaagagagagggagaggagaagcgaaaagtatttatgcacttggtctgtgggagggcattattgattgggtacagagtacaatgtttggaagagaaaaatgaatgcataaaaatataaataaataataggtcagtgattgccctacacaacacctccctctcttaaaagtctgatcactggcgaatattgtgccgttgtcccgtcatgcttggactcaggaaacggacacgttttggaactctttctgatcgtcgaagcactggtgtttgctgttggttccgttcttgttcttcgttctgttcaaattgatcatggtttctttcggctggtggtgttggtgtgacattttgctgaatttgtggtgctcgaacgggtgatctgttcttcttgggctcttcatcaaaatttggccatgtttgatcagtgcccaatgcttgtgtgagtcgcatggcatttgcatggcgagtgacaattctgtttgcgatttgtggggaacgaatgccaaaaattaacccttttttggtgacaacctccccaaataaccacaatgtttttccatcacggtaattcacaaattgcaccttgtcgccgatgttaaactctaccctttttgctccatgcttcttatcaaactgttgtgccatgcgttgctgatacgggcctcggaagaatggactcggccgttccggtttcataagagaaagtttggtccggagtggtcggccgaggaacaattctgctggtgaccgattgtttaagactgcaattgggatggagcgataagacaaaagtgattgcttcaaccaatttttatccccactgcatttcttcaactgtcttttgaagaaatcaacaaacttttcggctgctccgtttgactgtgcgtggtatggtggcgaaaagaggtgacaaatgccgttactgtcacaaaaatctttaaaatgngatgaactgaattgaggaccattatccgaaactagtgttttcggaatgccaaatcggtcaaaaagccattgtaattgttcaataacatgtgtgatgacgtgtggctaagcataaacacttcgggccaccgcgaaaatgagtctacaattaccaaatacgtgtttccatcactacaaggtcttgccaagtcaatgtgaacacgttggaa

SEQ ID NO: 2275 - DNA, 2596 bp, Heterodera glycines
acttgaaaaaatcgatttttttgttttcggggcagtccccccgaaccgatgcgcccagatttatggggagaccgaatccttcgggaatagcttccctatagcctgtactttaattctgcgttggatttttactccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatgggtgttgtgtctttgtaaacactttattttcacacacaacaaataataatgaaaaggaaataagaagtgatgagagaagtcggaagaggaaagagtttgaataatgaatgggagaagagacgagggagaggagaagtgacgggtatttatgcacttggtctgtgggagggcattattgattggtacagagtacaatgtttggaagagaaaaatgaatgcataaaaatataaataaataataggtccatgattgcccacacaacacctccctctcttaaaagtctgatcactggcgaatattgtgccgttgtcccgtcatgcttggactcaggaaacggacacgttttggaactctttctgatcgccgaagcactggtgtttgctgttggttctgttcttcttcgttctgttcaaattgatcatggtttctttcggctggtggtgttggtgtgacatttcgctgaatttgtggtgctcgaacgggtgatttgttcttcttgggctcttcatcaaaatttggccatgtttgatcagtgcccaatgcttgtgtgagtcgcatggcgtttgcatggcgagtgacaattctgtttgcgatttgtggggaacgaatgccaaaaattaacccttttttggtgacaacttccccaaataaccataatgtttttccatcacggtaattcacaaattgcaccttgtcgccgatgttaaactctaccctttttgctccatgcttcttatcaaactgttgtgccatgcgttgctgatacgggcctcggaagaatggactcggccgttccggtttcataagagaaagtttggtccggagtggtcggccgaggaacaattctgctggtgaccgattgtttaagactgcaattgggatggagcgataagataaaagtgattgcttcaaccaatttttatccccagtgcatttcttcaactgtcttttgaagaaatcaacaaacttttcggctgctccgtttgactgtgcgtggtatggtggcgaaaaaaggtgacaaatgccgttactgtcacaaaaatctttaaaatgggatgaactgaattgaggaccattatccgaaactagcgttttcggaatgccaaatcggtcaaaaagccattgtaattgttcaataacatgttgtgatgacgtgtggcgaagcataaacacttcgggccaccgcgaaaatgagtctacaattaccaaatacgtgtttccatcactacaaggtcctgccaagtcaatgtgaacacgttggaaaacttgtgttgttgttggccatggttgtagcggttgtttttgcggttgttttgctgcttcttgacattggcggcattttcgcacgatttcttcgatgtcggaatcgatcgaaggccagtacacaagagttcgcgcgagatttttcatgcgaacgattcctggatgtgccaagtgaagtgccttcaaaacgcggtgcctgagtgatgggggtataaccgatcgaccattaaacaccaaacatcctgaaacaattgatagtttgtgccttcccgagaaaaatggtttgatttcgggattaatgccatggtttggccatttgttttgagtaaatttgatcacttcctttatcaattcgtcgtcctattgtgctgtttgaatttcgtctactgtcacctgagcaatgaccatgtcttcgcttgctgcggaattgcgctgttcactgatcaaacgactcagtgcatccgcctgtccagtgttgtcggtgcgaacgaattccaagctgaagtcataattcagtagaatcagtgcccatctctgtagacgagacgctgaaaaaatcgggattccgtttttggacccaaaaatccccaacaatggacggtgatcagtgcgtaaaatgaattttcgaccaaaaatgtattggtgaaatttttgaattgcgaaaatgagtcccagtccttcattctcaatttgcgaataattctgttccgtctttgacaatgttcgggcagcatgttgaaaaactttttcttttccgtcaggaaaacggtgagaaattgttgcgccgattccaatgttgctggcgtcagctgtgacaataattggcaaatgcgggtcataatgcgttaatgctaaatcggataaaaggattgcttttgcttgatcgaaagcttcacggtgcttttattattttattttaattatgcattactggataat

SEQ ID NO: 2276 - DNA, 4197 bp, Heterodera glycines
  misc_feature (79)..(79): n is a, c, g, or t
  misc_feature (82)..(82): n is a, c, g, or t
cgcttgctgcagaattgcgctgttcgctgatcaaacgactcagtacatccgcctgtccagtgttgtcggtgcgacgaanttncaagctgaagtcgtaattcagtagaatcagtgcccatctctgtagacgagacgctgaaaaaatcgggattccgtttttggacccaaaaatccccagcagtggacggtgatcagtgcgtaaaatgaattttcgaccaaaaatgtattggtgaaatttttgaattgcgaaaatgagtccaagtccttctttctcaatttgcgaataattctgttccgtctttgacaatgttcgggcagcatgttgaaaaactttttcttttccgtccggaaaacggtgagaaattgttgcgccgattcctttgttgctggcgtcagctgtgacaataattggcaaatttgggtcgtaatgcgttaaggctaaatcggacaaaagaattgatttcgcttgttcaaaagcttcgcggtgcttttcattccattgccattccactccctgtttgagcaattcatccagtggtgctctgatttgatggatgtttttgatgtactttccatagtaattgattgccccgaggaatgatcggagtgttgtgatgtccgtcggtgctggcatttcctgcagtgctcgtgttctgttttgatcaggacggataccatcggacgaaacaatttgacccaaaaatttgatttccttaactaaaaatttgcatttgtccatttgaattcggaacccgaattcttgaattcgcttaaaaaatttaaaaattgttgaaaaatgctcgttcgctgtgcttgaagcaatgatgaagtcgtccatatagccaacaacaccaggaattccggctgccaattggtccattgtccattgaaaaatgcctggtgcgcttttgattccgaatgccaggcgttggcattgataaagtcccttgtgagtgttaacgcctaagagttgacgcgactgttcatcaacgctaatttgcaaataagcgtccttaaaatcaatttgggaaaatatttttgcgccgtttaatttggcaaaaagtttctcaggccgtgggagcgggtgatgatgtggttcgagtgccgcgttgagtccagtgctaaagtcgaaacatatgcgcactttcccatttgctttgcgcactgccacaattggtgcggcccatctgctgtagtcaacttttttgagaacacccaactcgatcaatctgtccaattcggtgtcaacatcattttgaacacccaagggtaccggacgtgccccacagaaaaccggagttgaacttcccttgagtttgagttgtgcctgaactttggtacacaaccccaaaccattggcgaacacactgggaaattgtgcttgcaatttgtctttgagctgttctgacgtgagctcacagttgttgatgtgttgaatgttgttcgttgtatggtcgaatggcagtgttgttgcaacggggcggttgtactctcgctcgaatgcacggatccaaccaactccgagcaaatccagggagcctttgtccgtcacataaaagtccaaaaatagttggcatccaccgcttaaagcaacataagcttggcctttgcctataaattggaaaatgtcgcccgtatatgatcgaccacacaaatttgttttgaataacttcggctttcccagcttatgccatgttacctttgtcaaaattgtcaactttgacccggtgtccgcaaccatttttacgctctttgtcccaaatttcacttcctgttcaatgtaaggctcgtgttcgactcgtggtgttgaccatgagcattgccgttcagttggcgtaatgtgcagacactcaactacattggtgtttttgccaaaattatttgatttgggtttccgagcccggcaaatggttgaaatgtgcccggtcttaccacaaatgtgacacttaaccgaaatcggataccggcagtccgaattccaatgttgaccaccacatcgtgtgcatggactgcttggaaatgtccttgattgacgcgttccaccatgcggggtgtttgagttgttgtttggttgactggaccacgagcgtgtgcgcgacggtgtgcgtgtgtgcgacggcttccttttctttggaaaatcctgaattttatgtggacgaatttggattgcattggaattgaaatcctgtttgctggaaagtgcggccgaactttggcgaagggcaatgacttccttgcactcggacaggagttggtcgaatgtcgcgttgttgtccaacaatttgatacaccgatgtcgcaactccatgttgtgatctcccaaacctgtgacaaaaatgagggatttgatttggtctttagtcaggtccagtttcgatctttcggccatggcattcactgttgagccaaatgcgagaacgtcttgattttgtccacacttaagctgaaaacattcgaagcgcttaataaaaattgatttgatttcgggaaaaatttgtcgcaactttgctaacgtctcattcaaaccgacttgatccggtgtttttggttgtatgacttccgtgtagcggcggtactcgtcagggcccaacttactcacaatgagtctcgctttactctggtccggcatgtgctttccctcctgttcgacaaaaggaccgaatcgctcgtaccattcctcgaacgtgtggttgtcgtctggactgtaaaggaattccgaaatttggccactcaatttacaaaacaagtccatatcagaggactgtgcttgattgtgctgtccttggccggtgtttaattgcatgttttgtagcaatttgacaaattgattttgttggtcagccaaaatggcttttaattgttccgaggtgattgacatgacagagagaatttgaaattaaatgagagtgatttggccgtcagagatttaaatttgatttgtggttaattggcaggcaagttcggtgataaggatgacggtgattgatatgtgaataggaaaaagacaagcccttgaattgggaagttgcgaatttgagctgcacacagcggtcgctttgacttgtgtgttcccaattccgactttacttccaagagtgatcacagaggctttttacggcttgcgatttcaagaaagccttctccttaactgtttacgtaagcggtctacttgtcgacttaacgatcagtaaggatgtgttacgggaaaaggaagggcgaaatgagtgttcgaataaaattagaattacagaatattcgacttgctgccaattgctttttgatgatattaaaaacctaggctgactgcgccattttgttgtgtctttgtaaacactttattttcacacacaacaaataataatgaaaaggaaataagaagtgatgagagaagtcggaagaggaaagagtttgaataatgaatgggagaagagacgagggagaggagaagtgacgggtatttatgcacttggtctgtgggagggcattattgattggtacagagtacaatgtttggaagagaaaaatgaatgcataaaaatataaataaataataggtccatgattgcccacacaacaatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttc

SEQ ID NO: 2277 - DNA, 6710 bp, Heterodera glycines
  misc_feature (19)..(19): n is a, c, g, or t
taaaatcaaacgattgttntggattattttcccaaaaatattttccttaaactcttgaacatttcccgcccaatttactctctactcatttgcccgttatcatttcatttgggagtgatctctcgttgtccattcccacccaattcattcaacaaacaatcgcccttccctacggtgctgttggaattggagtcgcaatttgaacaaattgtcacccaactaaaaaaccacaaaagaccattaggaacaatcaaacactaattgccatgtccatgacgagaaatttgaaatggtccttaatcattccccggtcgaccaaagcgcagaaatggcccaacttcgctttgttggccgccctcagcacaacgtaatcctttgagaacattcggtgggaaaaggattaatgaatgggacgaaaaagtcacgacaaatggccaccatgttcagcgcgttcaatgccgccattccgcacacctccaatttggcgagcgaacatctctgtgttaatatgtgactaatgctttgtaattgccctaatttggtcattttcttcccttttccactaactattcccatttttgcccggcacaaaataccccaaaagatttctcactcacttccgtccctcgtccgcaacacctaaatttaacattggcaagtccgtgcccatttccattgttggcatttcaaagtttagtcttcctctcccatttttgtgttttaaatttgatgaaaatgaatgttttaaatacataaaaaagggagaacaatttgcccaatcatttttaacttcaaaacatcaaaatttgtgaacaacaaacaaataaagttgatataatgtcaataacaatgataaatggtcaatttcgtccctctcttcctctcgccgtcttcttttctaaaagtccatcgccccctctttttctcgccgtctccactacccgatcatgtctctcttgcgccccctgcgccgaacttcgtccaatttgagcagcaccggtttggcattcgttccgtcctcgtcccctccgcccccttctgttttgtatgcgtccaaaatggcatccatcattttgcccatgccaatgtgcgcactgcgattgttttctttgtccatttgctcaccaacattgtttgtaatactcacctccgaattgccctctccagcacatacaaatccaccgctttgtcctccggctttgacgagaattgggccaacccaaagtcaatcagtgccaattcgactggtccccgttgagtcaggacgagcacattggacgtggtcaggtccccgtggatgagattggcgtcgtgcattgtcctcagaattcttccaaattcatgtccaaattccgccaattgagccttagggagggagaaaatgaatggcaccaacacacagatttttatgtaattattataatcataggaacgtgggaataacccttcccaaaattaaaaagaaaaatcggactaaagtttgacagctgcgtaaatccaaataacaaaatgtttgttaacatagccccgtccttttgtcatggcattagtgcttcttctttcactactcactgcaaattgttcggcattgttcgacgccgattcgtcccgctgcaatttgtccagaaaatgttttgcggtcggtgctctgtcgctgctgccagacgagcaaattagttcgaaaattatccgatttttgagcgggtccacgaagaaaacggatggcacgcgaatgccaatctgagagaaaagcagcggcaaagttatgacaaagcgaacaaagtggaaaagttcaagcagtcccccccccccccgccaaggcacctcttggcatttgaggatggccttcagttcggcccgcgtcctctccttcgccagccgcgcgtccaattccgcgtgtctgtaccgcttcacaaaccgctctttcatcactgcccgacgacggaggaaagtgcacgcgaacagtcgcgcctcggccccctggcaaaagggcgtcgtttcccattcgtaaagctcacaatcagtttgggacacaatggcatccaccgtttctgtcttctgtagcgcaacggaagcaccttcggagtcggaagagacttcagcctcaatgcctaaaatgggttttgtgtgaatttcagggatatcgcccagccgaagaaaaatgcaataaaccccaaattatccaacccttaaaaccaaataaatattttaattttgccctatttacgattcggtcggtccgtactttctttccccactttttcattttccgtcccttctccgttttcctcatcttcggcttcttcgtcttcttctgatgacgaagtgggatatttgactgtcctttctttgctccgtttggcttccgcctcaattttttccatgaattggcgttgacatcgaatcacttcgtcgcccgatgagcactgaaattgtttttccgataaaacttaagaggtcccaaaacattaactttgcgtaagcggataacacttcggcattcagagccaaaaagtttgggccccatttgaagggtgccaacacgcatttggccgcttcttccaagccgacaatgaaaagggcagcggcgaatgcttccacacaactcaacttgaacggcatggcgtagttgaccgggttggcagccaacaaaaagggcagtaaacgatgttcagacccctgaaaacagaaacttggccaaaaccgtgtggactaacaaagcaccttcgccttgtgcattggcgttgtgtccaggcgattccacgaacagtcgaccacggcgaggcctttggccatgaccaatggtcggtcgacgggtgaaatggtgacggatgcggctggagtgagcaaaaggccgggaaaacgatggctgaaccgttgcacggagacgagcccaacgcggcacagcttgcggcccgaacagcgcttggggtcgcattggccaaagtcgaacatggccaaccgacgggggaaaagggcgggcagagactgagggtgaagaaagaccaagaaataaacaacgcaaagcaactgacgaaaaaacggaaaagtaggcgccttggccctggctaccccctttcagacatatggactcgagctgaaatttgccagtttcgggttggcttttcgaaaaatatcaggactgagaatcccggcaattgcgattacgtcagtctcgttcacccatccttaaactctccctccctttgcccaccttttggtgctcctccatctcttcgcaactttctccccccatttcttccgtcgtccgttcgcttcgcttttcttcgtcgctgtccccccgctgtgctttttccgtccctttgctgctcccctcgaactgctcgccgtcgtcgtcggtcgacaattgcctcatttcctcgaccattcgttgtcgtccatgtcgcttatttgccttccctttcattttggtctaataaaaataaatatatgcaagaaatgctttttttaatatcaaattgacaagtttcaaatattttttaattaaaatttcaccctttccaataaaataatttatgcatcaataaaaaactattatttatagaaacaaaaaacatttcgcttttttccctcagtctttttccggcgttctccgttcagttttcatcgttctgagcatttctttgtcccgtcgatttggcgagcgacggcgttgctccttctccaaagaatcctaaaatattgcgccggtctaagaatttgctgattggtcagaataaatcaaagtgaagttggactcgagttttgtcccagaaaaagccttttatagacatttattaggggtaatgaattgttttttattgaaaaaagtgtggaccccaatgccaccaaacaaaagtcccacgactgactgcttgactcttttcaccttttctcgttcgctgctccgtctctccgttttgacgtcctttcggctcggcgaccgatggtggcccgaggaggacgaatgctttttgtccttctttttcttcccctctttgtctctgtgactgctccgctcctttcgcttctcatccttttctttgtgccttaaataaccaactctttgggtttgtccctttaaatgagtccattggtcaccgcaccttcgacccggcgacggactgcgacttttggagcgcgagcggcgcttcttccgacgcggcgagtcattgtcactgaaaaccaaagagcattaagtggtagaaaacaacgaatagatttacgattcagggcttcggtccttgaaaaaggggcgtccgccacctctgaaccggtcggagtggtggaaacgaccggcaaaaccgccgccgcctccgggaccgccgaagggattgcggaaggaatggaaaagcggcgcaggacgaatgccacccatttgctgttgcgagggatgatggttaaacgaaatgccgggaggaccgaaggacgccgaggacggcggaggaccggcggaagacatcgaagagggaccaagagaaaattggctgaagttaaggcataataacagtgagtaaaagaaaggagttggacaacttggtggacgaaggctgaccaaagttcatccgagagggcggaagagcgtcggaaatgccgggaggaccctcaacaccgggcggtccttcggcatcctcaacacccggcggcaagtccatttcaagcgctgaatttaagcataaagggcctatgaattcttgggtatttctatgctatacggacctgctgatggcctagtagccaattgcggaggcatttgcaccgctggcactcccaccggtgccgccgcttgcgtcgattgcggtggtggaagggtttggctcggctgcggttgttgcatttgtcgtggcggttgttgctgttgctgcggttggggttggccaggcggtggcgcactgacaatcggcggcggaattgcggggtcaaaattgggcggaggcttcgagaaatccatcggaagctgagtgagcggtggtggaccggccgaagaaccaatgacactgatgttttggatgggcggcggcggggcggtggacgcgggcggaccggaggtgcccggaggcggcgtttccgaggcgggcggcgggggcagcgaatggccgatggaaataggcggctgaccaacgacacctatcatcgatgaagagcccaacgaagtgatcggctgagggagggcaccgtcggcagtcgtctgttggcccatagacgaggacaactgaacgaaatcaaattgaaaaagacgatgtcttctaattgtaactctgataaattaatcggtttacctcagaggatgattcctgccgagtgatgatgcccgatccgctgatcacggtccgactgatcaaagacactgactgggactgatcagaaagcgatggaggtggtttgctcaaatccaacacaattttctgcactttgttttgttgctgctgtttgctctcctgcccaccgaccaaactgacgagttgtcgcccgccggcaaaggtttgaagtccgacttggacagggccgctgatttggatgttcgaaagaatagctttgttgatcgccgcctgatcagtgccgaattcggcacgaaactttcgttgacgctcgcaatattgattccaagtatctgaacgaacaaaactcagtcgtagttgaacaaagaggagaacattgacgagttcgaagaatacagtttacctaatccccccccctactttatccaccttcgttgaagccataattgaaatagtcagtaatgtccgctcccggcttcctccatggcttgtcctccatggttgccaaatcgatgtcataaatttgcgaaccatctttcagtgtcgggttggcgtccaagtcaatggtggcacccccaacggtgcccgctctttgctgcttttggaacacattcgttttgatttcgccaattgtcacaacaaaatcgtcctcatcactctcatcatcgttcaaaaaggccggtcgatcatcttaattatttttcatttaaatgaaaatggcagacataaaaaactattcttaaacaattaagttatttaaaattcatttacagccgaacaccaggcccaaactaaaacaaagaaatgctaaaagtttgaagcttcgccaagcaaagctattaatactttgaaactttaccagttgaaccctttccgggcgccgaatcatttgcttgttctgctgcatttggttggtcgccattttcaacattcaaattaggcgattcggccaacacttcctcttgttgttgttgttgttgctcactcatttattatgagtatttctcaaaaaataaaattaatactattaatacccctataaaaatggaaactccaaaagaaacaaactaagaaatagataaatgatcagcagatttttaaaattcgtaatagtcccatattttacttcctctatgaggtaatgctttgcttatatggcaaatgcttttcaactcgagatcggctcttgcatttttacaagagaaaaccccccaaaaaaattttataattatgccaggttttggcgttctgattactgaataaaaataatctttataatttctctcactttgacgtatactatttcttatttttaaaattaaaaacatttaatttttatgtgtagcatttttcccctatgttaaatctgcaccaaattacataccctttgagaaaaaattctttttttaagttgtacatcccggttttgta

SEQ ID NO: 2278 - DNA, 4315 bp, Heterodera glycines
  misc_feature (105)..(105): n is a, c, g, or t
  misc_feature (2719)..(2720): n is a, c, g, or t
  misc_feature (2727)..(2727): n is a, c, g, or t
  misc_feature (2775)..(2777): n is a, c, g, or t
cattggaatgccatcactgcgtttgccatcatcgggagtttcgatgtaagtatctgtacataaatggttcgttgggcggctcgtcaccaaactgacccccttcangcgacatttgctccgttctctccaatgcggctgtaaactgcttggggctgtgtcggatccgctggtccaatcgcgcgtgtgcctttttcgcgctttgtttaattgcgccgtaggcagccatcagtttttccgtgtacaaattgaaacgaagtgagtacattgcggcgatacaaccgctgccataagaaaatatgaggatccgtttcccgttcgatttatcggaaagttcagtgctaaaacggatagaaaaattagttcgctaatgacctttgcttgctgttcctcctcctccccccactcacttcagaaagacgttgatcagctgagcatataccgacggcgtgtacatgttcccaatgcgtcgactaaactccaaaaatggattcagtttggcatccgctgtccgcgaactcatccgcaaaattttgtcagtaaatcgatcgccgtccgagcgagtttttgtgcgttccaccgcaaaaatctcatggagtgatttcgatttgtatgcgctgagttgatcccaatcagacacatcatcatcatcagctgtgacaccatcgtccatcattccccgtttaaagtcgacgaaggacagccaagaaaaggctttttgggtgagacgagcgtacggcgagtggaaaatgacagcgacaaaatccgaaagagagcaaggggctgaaataactaattgaaatgtaataaatcattaagtgagatgattgagtgtccaatcgtttgtaaaacagttgcattagtcacgcaaatcgaaaataacagaaaaagtttatttcaaattaatttataaccaatatttcgcaatcccttttttagttgatagaacaaaatacgatgaatgacttacgccctgtgcagaatttcttgttccatttctcacaaaatcgcccgtaacacatgtcaacggcgttcaaataggtctccacactgtttggcccgtccactcgtgggaattgcgtgctaacgcctccaattggcttgtaaaagtcgtaaacattttgagaatggcatgccctaaggccacgttcaagtgcaatcggtgcatttggtcctgaaatagaaaatgaaagaataaatgcctaaattggcgcaacaaaatccaaccaatcagaaaggccactgcaccggcaccgcccgtacatcgggcgggcccagccgaataaactgccacatcagcacagacaacgatggcaaggcgttctgaaaattaaaaacatgccaaatgaaaaagcgaagtgagaatgactgaactgataacctaacgattgcgcaattaaatgtttccacaactctttgaaaagaaggttttaggaccaattgctcactttctgttgcgtaattagcgtacatccaatcgacggcatgaaacaacgcctgggtcccaccgaaacacgcgtttttctcgtcggcgccctccaagtccatgttgcccgaatcggcaaacaaatccattaacactgacttcacacttttgcttttgtcgaccaatgtttcggtgccaaccgcgagaaagccaatgtcctttggattgaccttaaattggaaatttaattgcccttaatgccaaaataaaataataattggctaaattatgccttgtaattgtccatcagtgcagctgcaacagtcagcgaaagtgaacaaacatcttcattctcatggcaaaagcacatttcttgttggccaagtcccagcacgtatttatttgatgtaacattgtcaaactgaaaggtaaaggtaattgccaagcaaagaacgtaaaaattcccaactcactttttcaaggtcttcttggttcacgtaggattttggaaagtaaagttcgatgccaataataccaacgtctttaatggactcagaaaagtcatcagcttaattgatgaatgagggaaagaaacaattaaattgagtgaattcaccgaaatgtgtcccattggtcaagccaaagccatttccatttacagttggatgatggttattcattggtaaaatttatttaagaaactgctaaaaaatggaaaattaaaatataaaaacagaaattatggaagaaaaggtgaatgaacatttatttataaacaaacaaatgcgtacaaagtccaaatcggcagaagcaaattgaaaaggaatgggaaaacaacggaaaatgtaacagcgacggatgaaagggaagcgacggcgggaaagaaaaatttaattgaatgtaagggacagccaaagtgactgctttttctcaatggccacctcttcccgtccctccccccccccccgcgttttaatgtattttctgccattatttctctttcgttccacgagttcggccaatcactacgacacatacatacaaagtatgtacacaaaaaattaaaatgaagattgtatctgcaaagaatgcatcagcaaaacagaaaaagaagaggaaattacctagtctgttcctatcaagctgaaattttaccaaccattagcttccccaaaatattatgaagcatacaaattcatagtgaggaaacatttttcgtgtatctctttctgtccatcacattcgtttcccacgaaaaaaattttccaaatctaggaattttttttcaaaatttcnncaattcnaagtcatttggtggcggtaggggtcagttacgcaactggccgttcgtnnntggtggtgcaattaactttgatcgttgtgccaatttttgtgaaaaaaaatcaaataaaaaaaattatttttttacacttttaggtttttgtggtcaatgggaagaggttgaaatgacaaaaattttgattccattttttcttgacccctttcatttttggttaaatcatccattacagtctttaattaacatgaaaatgcaataaataataatacctgttgttgtttgatttaagttttttatgatttgcttaatcacttaataatacatatatagacccccctaaatgctatgaatcgcaaaacgcaaaagcacttgaggaagacaaccgagcaattgtcctttagaagcgatgttccgggaggaagaaaaagtgggatttgtgttggaatgcttcaggacgcgtaaaatgtcggaattagaaacggccgaaacatcctccttgcttttttctttgccttcctcaaccctttaattaaccaccactaaatttttcgtcttaaaaaattgcatatgaaccaaataaagaagtggaactctccggcgtttaattatatccatctgctggcggttgattaatgtgcagttcaaagtagggcatcagacaaataggtaagtagtagcacgaacgatgattaatggaactcgttcatttaatagcgattaaaatgcatttgagccgattaaactattagctaaattttgaaaaatttaataattcaatgcctcggaatgtgtgaatactttattcgatttaacccgataagatgaacgtttaaattaaatagcaaaatgagcaagaaaagagaaaattgttcaacttggaaagaactattgataatgatgaatgtgaggcttaaaatacaacaacaaaaagccaaataaatttgggtaacaaagtgtaaaaacaaatggttcttgctaacgcatgaacagccgcccttttctctgatgatgctcagacgaccctcacaaaatgagcattctcagcagaaacatcacaatggcactcataacaccggcgattggcagggtaacctttaattaaaatgaattttgaaatttttaatttatgctctgtgcttcttcaatagtaattttctaacgcctcaccagccaagagagagagatattcctgaacacagtccaatggaccaccggatgtgcttggaccagtccgacggccaccacactcccaacctagacaaaacaaagcgatcatcttctctcatcaaatcgtcaccttgcactgagtggaacttatcggtagacccaatttgctggcgaaaagaactgtgagagcggcgccaaattcgatggaaaagccgctgggaggagttatcctggtcagattttcgccgaccgtgtagatcactcggtggccgagcagccaaagcccaacgcacattccggcagcaccgtaaagcagcaaatatacggaagtctcgcccttctgatggacactgccttcatcgtaaatggtgtacagtgacacgagcggagcaatggcattgcttaagggaggggggggggggggg

SEQ ID NO: 2279 - DNA, 1154 bp, Heterodera glycines
caattcagactttagttacctgacatcgtttccaccgtgtgcaaatccggaaaaacaggctgtgagcacctgcagaaaagtgaacagtttcgaggcgtacggatcctccggttttgaggaacggaagaaactgagcacagatgaagccgggcgaattgaagaggaacctgcgggaaacatggcaatgtccaatgaatttcgattttgtggtaccaaatttgttttgggccacctctgcccctcctccgcctccattttccgccattttcacttttgtcgatggttcgtctccattctgttccgtctttccttcttcgagtagcgccattttgccctccgtcaaactttttgcgcttttgttagtcaccactccgtttaagctttttcccagcccattttgttgctgtccttcgcatgtttccggccctattgtgtgctctatccaaatatgaaatgataatccacaaaaaaaaaacaaaaataccgtacccaaaatgtatcgtttcaatctgctgaccacgaaaaatcgggtcacaaccatcgtaaccaatccggacacaacactaagtgcgaccacagcccacaaaggccatttgtccaagccaatatctgacaattaatattagagcggaaatgagtaattgcaaagcaaaagttggctattttacagtgcgatccttggtaagtgatggcgaacatattcacagaaacacagacaaagtaaaggaaagggagcaacagaaggccacaatggaggggcctatcctaaaagaaacaatcgaaagaaataatttgggaggaaaaacagtcgaaaatcgaaagttatggggcaaaagacgggacaaacgaacccttcggaggacggaatggtcaatgaagagaaaaatgagaatggaaacacagccggacagaatgggggagacgaaccaagaagcaactgaaaaagagaaaattaatccatcattcgaatttggcaattcattccgaaaaattaaaaaattactcacaaattttagtcactttgacccatcggatgccttctgtaccatggagaagcattgaataactgaaaacaaattaatgtgtgagtcggtgtaattacgggcaaattcaataattaaaaataaaaacaaacccaatggtggccccaacaa

SEQ ID NO: 2280 - DNA, 2036 bp, Heterodera glycines
ctaaaagaaacaatacgaaagaatataatttgggaggaaaaacagtcgaaaatcgaaagttatggggcaaaagacgggacaaacgaacccttcggaggacggaatggtcaatgaagagaaaaatgagaatggaaacacagccggacagaatgggggagacgaaccaagaagcaactgaaaaagagaatgaaaaagagaaaattaatccatcattcgaatttggcaattcattccgaaaaattaaaaaattactcacaaattttagtcactttgacccatcgtatgccttctgtaccatggagaagcattgaataactgaaaacaaattaatgtgtgagtcggtgtaattacgggcaaattcaataattaaaaataaaaacaaacccaatggtggccccaacaatggagtctgacaattatttaatcaaaatcacacatgacaaaagtgccaaaattgaaacattcacttacgcgtggtggagacgggcattttaaagaaagtggcaatgagcagccaagcaccacaaccggtctaattgaagaagaggggatgaaaaaatgaagacattcgaaacggaatggcattaccaacacggcgatctgtcccaacatcagttccttctcgcgtccctcgtaaatgttaaggtcaatcactcccttgcgcattgtgtccgtcacttgataccctaaaaacaacgagtacaattgtttattcccatttgaattaaaagggataaaaaatcacccaaaagggcagcgcccatcgtttcgaaaatggaggcgagtaaatacgcttgttggagggtgagcacgcgggagccgacactcgtgccgaaggaatttgccgtgtcattggctgaataatggcaattcattagcgacttttgcgtttatttgctttttcgcttacctccaattgcaaaagccaaaacaaatgcgataagaaagcccaatatctgtgaaaaatatttttgttaatactgcaaaaatatgagcaaaataaacaaataaataaataatttaatttacaattgtccaaaaaaggtccaattggaagacggccaaatcagcaacgaccatttggggagtaaagtcgaagagagactcagtgagaggcgaacaaatggacgaaaggcgtctctttctgttgccggtcttttttatttgttaaaattactttcggcaaaggaatgggaaagcgattggagaagataagatcagcagatgaaggggaaggacaaagttggggctgtttgctctcttctctctctcagacgtcttttggctgaaagtttacctttgaactttagattttttcctttggggaagagcatggaaaaaaggaggggagaaaaagcacaaagcgaatgaaagaacagcgagacaaaactaatggatggataattagcaaaacaaacaaaaatgagagagagggaagagaagggagagaattttgaatttgagaagggaaatggccatgtgagttaaggcactttccttctttagtataaaaaagcaaaatgcgataagaagaatgattaactgatgattatcagctgaccatcggacctggaaagaacggcatttatgtacaataatttaatatcaaaattttgtatttaaaatttcttttaatattaattcataaattatgtctggtgtgagaagctgaacaaaaaggcaaaagagactttagaagatatgagttgtcgtctttcagttttaaaatggtataattaaattcaataatatgacgattcataaaatgattctatcggaaggggaaaagttatttattattggattgattttgattagttatggggggaggaggacagagttggaatggatgcaaccaaacggaggacagagcagccgaaggagcgggaaaagggtggacgaagacggacgacggacggagcggagaaaacggagcaaaagaaagcgcaattggctcatgtcacggcaaaacacacacttttcgaagacaattctggtgaaagttagtaaaatgaaggaaaactatgaaaatgtaa

SEQ ID NO: 2281 - DNA, 1449 bp, Heterodera glycines
aataaaaagttaaagagtttatttatgaaatttcttttactttaaattattcttttatttatggttttttattaaaatatttgttttagctaaataaaaaatttggggctgaataatccctcctgaagtgtgagtggttttttcaagaacttgaccaattccaggggccataagtttgtagcaaaaagcctaatcaattggtcgaatgttggggctaatataggagtatatttggataaaatcattccggggaaaatagaattatgtgtacttgggtttcacaaattgcccacgttatgttcttggaaagtgacttggtacgagccgagccctgggctaaagtcttacctctgtgaaccccttatcccactttcaatcacagatctgcttccttctagcattgcaataattttgtccttttcttatagccaaatgataattgaaacgaattttatgaaatcaaaaagccggaaattttgaggaaaagcttagaacctggattttacgaaaaactggctcaagagcccaaaatatgagcaatttttaaatcctttttttataattttaagtgtatttttaaagttggtttaagcaaatattgagaaaatttaccgcgctactgttatttatttaaaataaattatttattttaaattttaaatctgtgctcaacccccaccaccataaaacaactcaatgagctgataaaataatgaaacgatgaacaattaatttacttaaatttaaatacttctgagcaaaacatcaccagtttctctctcagttttttacatatttggatagcgttgatcaaaatgattaaaaagtgttaagagtagtgaaattttaaactgtacccattttgccactatttacttttattttgcttttatagtccatttcttcgacaaaaaatggtttttcttggctgctatacgtcaccacataggaaaataagtgccacaaaattgccaatatgccataatttttgaccagagactaaataaagaattttacaattttttggaaaaaaactaatatccaattaatgcccgtttttgcttgattcatcacttctcttctttgtttgccattgacccaatttaaatgcatttggcattccttcccactttctccatcattctccgccgtttgtccgccccctcggggggggggggggagcggaaggcgaacctcggcaattaggcgcgcgtgttgatctagtcgagaaaataggagaaaatataaaattattaacccctcccgcccttttatattcaaatttcaatctcgaaatggctaatgaagctaaattttaaaattttaaagctgaaaaatgtactatttaacagtgaatttcgcctttttttttcattttaaaatgattgcttacgccaaagcaatcgatatttttaacaagattcacattatcgcaccaacaaatacaaa

SEQ ID NO: 2282 - DNA, 600 bp, Heterodera glycines
gcattgggtgagcaaacgaagcagatcgtttcccccccataattttcaattttttccaaacagaaatttttcaagaaaaactcttagaaaatttataaaaaaaattcttgaaaataaaaaatgtaaaaaattttccagcgttttttggaaaaataaaataaatcgctgaataagaatttttttttgaaatttcggttcgtttttgttttggtgttgtcaaatttaatttgtcacatttaattcaggccattgtctccaccagcggcgggtcaaagcaacgtaaacggtggtcgtctgacaatgtgtgccgggcccagtggaagaaaattgaatgaatgaattatttgagaaatgatcgatcattttgaatagctagtaatttgatgctgtattttctgttttctgaactgctcctcatatattatttatttgttggttatgaaaacattttaatgttttggtttttttgcggagccccgggcttaatggcaacttattgtaactcgatgatagtggagaatctgggctccactaaaaaaaaaaaaattttttttttctgctatgaaaagatcaacccggggggtgtggacgcgtctgata

SEQ ID NO: 2283 - DNA, 1830 bp, Heterodera glycines
ctcccggcccctgtcccgttttttgctcagaccactgggaatcccgatctcgggatcccgccccggttcattttccaattcagggccccggtcccggcaatcgaaaaattccgatttctactatttactatttttccgccgccccctcaaaggggagcaccattggaacaggaatgaatactgtaattgagggtggggtaattcaatagatacggtaattgatatttagctgaaaaatttctaaatcatttaaaattgtaaaaattttcttcgattttttgaagatgatgcgctgtttttggggcatatgccctctgccctcgtcattctccgatttgtgggaccgtgccgccggcggcagttgcgccacccatttgcatgccaacatggcccaactgtttggctttttcgtttgggcccacgcacttttccattgtgagtgagcaaatggaaaacaaaaagctcaccgaaaattgaactttgaaaaattaccaaaaaaagaattttcctaataaacttaacaaatcaaaaaaaaggaatgaaattttaaaaaatgaatttagaattttttgtatttcttattttcttttttcatccatctctcccaccattagagcacgggaagggattttttaaagtataattcattttatagttgtccgaattggaccataattattatattattatttatgtgaattttttgaaaaaatttaaatgataatttatttttaaaacattaaagttttattgaaagttagctgatgaatatttggaaatgaatttgaggcatacttttgaaattttccgtcaaaagaaatagggctgttatggtgccttttacactttgtccctgctcttcccaccagacattttgaatgtgcacaaaaatggttcaaaattaaaccagggatttcatgccaggtttaagaccggctggtcgacgagtacaatgaaacagtgtgagaaagagtattttttgagtaaaattttaattccttagcggttttttcaattttattttactgtattttaccaattcctccaaatttatccttttcactcatttttagtggcaatcaaatggtgcgcgagagcaaaagccgcctgaagaggctgaactggtcaaatcgacgctcgctctgctgctgatgcgtcggtttggcaatgagctagctgtgtgtgccgcgttaaaaattgtcaattaaacccatccaaatattgttttttaattaatttgagtggccgaccgaattaattttttttttaatttggcatttttgttttcttagtccattaatatgtacagtattccttgtatttatgaaatcacaagaaggaatgcatttctgattaggagcttttcaggggggggaatgattaatcattgaaaaacatccccctgagcgaatttaagaaaataggcaaaaaaaaagaaagaaaaaagagtggagaagccaaaacatggggaaatgatgacgaatattgcgtaaaacgacacgaacgaatattcttcatttctccatttttgtcctctccatttaccgtttaaaacattttgaaaaatatttgtttttttttgatcgccaatttttttttgccgacaaataaatggctgtgggtaacctaggtcagtctcaaaataataaaataaacggttttattacggcatttgaggcaaagggtgctagggcgttttgtaaaatccgccatttttgcaattttttcgacaaaacatggtataactttgcttaaaagcaaccaaattttaatatcttggtatcattcaatagcccagctttttctctattagcctgcaaaatttcaaac

SEQ ID NO: 2284 - DNA, 2940 bp, Heterodera glycines
tttatagattctaaccatttttagttactttatatttcaattaattgaccatctcgagaaattatcatttaattcttttaaaaatgattatttcataatttttttaaaataacacaaattattaatttaggtttttagcaacttaaattaattttcacatgatttttaaataaatatggatattttaaaaatttactgacggattgtccacttactgacggattgtccatttactgacggattgtccacttactgacggattgtccatttactgacggattgtccacttactgacggattgtccatttactgacggattgtccacttactgacggattgtccatttactgacggattgtccacttactgacggaatgtccatttactgacggattgtccatttactgacggaatgtccatttactgacggattgtccacttactgacggaatgtccatttactgacggattgtccatttactgacggattgtccactgacggattgtccgggagcccccgctgaatacatgcctgatcctgttatgaaaaacagggcaaacaaaggaatttttagaatttttggtgcttgattcttcttttcaaaaaattttacccgttttttcttgaaaaattttaaatttttcatttcgctggccacaggcctgtgtgtatgagcactttaatctttcaaattttaaaatgtttgccacatttttcactgcattcaaatagcacaaattgttgtttgttttcttttttgatggcactgaaaattccgtccttttgtgtccgccgcactttcctttccttttccggttttgccgccgccgttccgctcctcgattcactgttctgctgactgatctgatttcgccagagcattcattcaccaaacagcaaacaaattcctaccctaaattttttgtacacattttattggcatatgggacgggggggagagattaagagaaaaacaggcatttcttggacaaaatccgtcagtggttggataagagcacacttttgctgggttcttttaagaaagggggctttcattttttgcagcagaatgagcccgaacgccgagaaaaaaaaatgccgactattttaatgagtaaataaaaggaaaaatgatttaaatctgaaaaatttttggcatttgtctcagcatactttaatcacccaccaccggtcacctaatttacataatactgatctgattatgctacgatgattcgtgatttatttgtaattttaattaattccttaccgtcggttcatttttgctgcaattagcacacttagcactttttctaattgatttgtgtgtcagagaaagcacaaatatctaaggtgggaaaaaacctgtcatttttgacaggttcctcatgcggcagagaagcgaaataaattgcaggtaattgcgctgacccacaaattgtccaagccacgaattgtccaagccacgaattgtccaagccacgaattgtccaagccacgaattgtccaagccatgaattgtccaagccacgaattgtccaaaagagtaaaaacccacgaattgtccaaagtctaaaaagctcataaaaagccggaaaatgggtctaaattaaggtgttcggggtcgctgactacgaatacgacatttatataacccatttcctaaccccagacacaatataaacataaaatagcaaaaaaaaaaatcgaagctcctaaaaagagtgctgatcaaaattcgaacaagttttagggctcctatgtgatccgaattccctctatagacccaccctcagcttcacacattgaaaaaaaataattttattaaacattcaataaaattcattacgggacatggacaattgaagtgtcaagccgatatatgttcgagagaagtaaaggaagaacattggcattccaggagaagacggccaagataattgagaaaaactcgatttgtgcatcttcagcgatttcctgagtggtgtgtgaatctaaatcctgaatagtttggaaataaattttttgcggcgcttcaaacatactacctttcaaccatagacaatctcacccaggtcatagttgaaagttcagcctcgttcaaagtctgttgttcaacattgtcggaagttatcacggcatgcagttcgtcaatctccactccaaaatttacggcctcctcagttgggtttgaaatgcttacaaacaaagcttcttccgaattttttgtagactttcagtttattacgaatcatttgttcaattaatgaatagcaaaatctgaagacaaaaaaagcacatatttttaatcaaatttggagatttttcttattcggtgggtctagggttaggcaaggggctatataaatgtcgtattggtattcagcgaccccgaaaaccctaaaatagacccattttccggctttttatgagctttttagactttggacaattcgtgggtttttactcttttggacaattcgtggcttggacaattcgtggcttggacactttgtggcttggacactttgtgggggcgccggtaattgcagaaacctgtcatcattacgccagaaatctcgttacctcaccaaatctctacattgttgtgcgatcattaatgaaataagttggcttagactgaatggtcttttagcttcgtcctgccatcgatgagacattctctcctgaaacaacggcagaaacaaattacggacatttttcaatgctagaaaagtactggtacgacgagaagctaaataggaggacatatatttcctacatcacacgacgattgagcagagggatatagccccccccccccgaacatgacgcggattattcgatttttaagacccgaatgccttcagaatccgataaaagaattgcgcacgaaatgagccatgattttgggaaaaaggccaacacctaatgcaatg

SEQ ID NO: 2285 - DNA, 2582 bp, Heterodera glycines
gttatggcagaaatagtacttattttcatacaactttttcttaagttgaccaatttttttttaatttggcaggctaatagagaaaaagctgggctttgaatgataccaagaatgtaaatttggttgattttaagcaaagttataccatgttttgtcggaaaaattgcaaaaatggcggattttacgaaacgtcccagcacggagaaaaggaaaagcaaagtccttttcaataccaattgaatcgaagaaaatttggaaattgatttaaattttaaatcgtttggccctaattttaacaattttattcagcgccgaaccaagcaacaaacaaaacggagaacggagttgcgcacggggatgaaaaaaagaatacgagtattttagaagaaaatgcttaatataatataatttaattattttaatttaaaataaaataaatataaatttgttaataaactttgaataaatataatcattttaaaaaaaaatcaattttaatacgaaaaaatttcgtactctccaattaaataaaatcaaactgataaaaaatgattatttttaggggccaggttatatgcacattcgctgtttttaaattttttaaaatattttttgaaaaatttcttgttttttaaatttgcattagatttttgttgtgatatgcaaaaaaatatcttcaattgacactttgaaaacttaaaattttttgtatgccctgataaatgaacggagctgctaaaatgtaatttttgcgcaaattaaattttttggtctttaaattccttattaaacaaatttgctgaaaactttattaaaataatattcaaaatttatgtatataaataaaaaccattattattagtatttaaatgaaatgaaataccatatattaaattgttaaataatattttctttttccagtttttgtccttacaatcatttttgggccactgttagccgttgcattagctctgctgtgtggcatcgggatcaaagtcttagtgaaaagaggtacagttagattttaaaccaaaccacattaatagcttataaggggtgggaccggtgagtcgggggtcgttctagcgtcaaaaatacgaaatcgcatacatcatggctaatactagagttgagcgggaccggaatttttggcaaaaccgggaaaacccgggaatttcccggtcccaatcaaaactggtcaaaaccgggacttggtactcagttgtccgtcttcaggtcccggtcccgcttaactctagctaatactatagatggtaggggcccttttaggaagaaaaaattttttttttaaatcgtgaaaacatgtttatgggggttttctgggccggataacccgaacccaacattcattttgactaatttcgaattccggacccgaatttgaacaaaaaatctagaattcaaaattttcaaaattctcacttttgttcctaaattgaccataacaagctaaatttagtctaaacccatcgaaacatcaaaaatggtcattctgtacaggtatgaacataaaagtgaattttgaaaatttgaatgtttatctttttagaaaaaaaataattttcttccgaaaagggggacattgcatctatagtattacgcacatgactgtatgccacaaatcttgtattttttgggatttctggcgtaatgatgacaagttctgcttttgaaagtcaggtttctgcggtcagacgctaactgcatgaacctgtcaaaaatgacaggttttttccggtcggggtcgttttcgcgtgagggccattttcgcgcaccccccccccctaataaatgaaaaattttctcaaaaattcgactccaaattcttttacatacttgatatgaaatattttagcctaattcacacaaaatttgaagcgaatttaattcttaatggaatcgcccgttgaaaaaaagaaaaaaatttcctccgccgacaattgcttaatttcttctgccacagttagtgaaaatcagcagcaatcgccgggttcatttacgatgacagcatttggagaacaaatgaagaaaatgaacaagcgaactttgaagaaaatgtgagccaaacaatggcattgacaatctttgttttttgggggaatttcgaccaatttccgcattaaatctaaacagggaagtgaattttcgactttttgttcgaattcggtacaggggttcgaaattggtcgaaattaatgccggattcgtgattaataatctccaaaaattatgtaaactcaacactctttcagctggatttgtagcgaggttttgatggacattcttccgttttttgaccgccctcaactcggcctcaaattggcattactttcgccccgtttcaatgcgctggtggacacgcatttcgatgacaaaacgacggaattaacaatttggaaattgataaaaattaatggaccaaagccgcaactatctgttctaattgatggcaaatttgtgggttttccattgcccgaccgtccgctgcccaacaaaattcgatttaatcaacttcggattgagtaagtttaaaattttgggtactagtaggttatctgtgt

SEQ ID NO: 2286 - DNA, 3640 bp, Heterodera glycines
cacctgtttggtacggcaattgcccggcgcgcatcggcaccccgggaaacggttgccacagtcgacgcagccacaatatttcggtgcacaaattgttcaccttgaggagggcggtgattagaatacattcaactgccaacacatgaaagcaggcgaaagctgtctgatttgttcatggctcataaaataatttatggccgaacagatctgaatgcctttgaaatactcaaaccttttgaacgctttaacatttattttatttttttctcttttttcccttttatagactgaattcgaaatataaaattggcaaaaaatttataccgtttgcagggcgggtaactaaattttggaaccaactcgataaaaggcttattgaaataaagtcattaaatcaatttaaaaataaaatgaaaactaattatattcctacatataaaatacagcggaaaaattaaagccaaaattttaattcattaaaactaaaagtgatttgatcattactttgactcattttaattaattttataccgatttttgggcataggcgcaaattacgggtaaaaaccgggaaaatataaaatggtttaaattcacagaaaattacgccttttccgacaaaccttcacacaatggcaggcggacgagcggcagtcacacttcgctttgcatggaatgaatcggccgtggttttccacggttccatttgtgtttgcccatttgatggcacgaaattgtcggtggttgtcctttttacggcatctggcataaaaagaatacaggaagaaaataccaaaattactcggggcaaattttatttaaacacacacagaaaataatttttaagagaaaatttggtaattttaaaatgattaacacaattccgataatttctttctggtataactatgacataagccctccctgaataacatttgacagacaccagccacacacacacaacgaacttggcatttttgacgggcgacgacgactccccatttgtcgactgtggccccgcccggcacgcgtattcgtacacttcttggcaggtccttttgcgcgccgtctcgcccaggctcaagttgagcattctcaaaaaaacaattgtgtaagaaaattaggttggatgaaaaactcttgaaaaaattttcctcacatggcaattcggcagaactcctcctccccggtgctgcgcaacacattgaaaatggcctcttcgtggggtgtccatttggcactgtccgccggtgccgtgccaccgatggcgatgctcggctgctgttgctgtggacgagaagctattgaattctgaaaaagtccatttatttaagataatttattcagcatttccggcaaattacccccccccccccctccgccctacgtttcctctcgccagaaattctaatttttgaaaacaaagaaaaattcctagtaatgttaaaccaaaaatattctagaaattagtaaatttatatacttttcgggttttcaagtttttttttcaaaaatttaaaatttctataattttttcatgggagcggagaaatgaaaggggaaatatttttctgtagtcaaactgccattaatcccgacggggataattagacaaaaccaactttttgctgcaatttgttgctgccctttttcccaccgcccgtggcatggccgccattgccggttgtgctgctccgctcgaattgctcagcaggtagcagttggccgagcatgaccgcctcagcttcgagcagttctctttgcccccgctgtgacggcttacgccgctgctgctttggcgttttgtgcgcaacttttttgagttgccataaccattcgatgttgcggctaaaacattttggagaatgttggaaacgaaaaaggacatattaagtactttgagatttttggtttgattttgaattatgtccggtgatcccaaagtgtgccacgggaaaaagaaaatggaaaaaattataattttttaaaaatttatgactattcttgaaaaaattggttttttatttaaggtagaagggtctgccccaaaccgatattgcgtcccttttttcccaccattgtgcataatgcaatcgtagctgaaacatttgtggcacaacagcagttcgtagctgttcagcagacggtcatttttgaatttttccaccaactcgccctgctcgttggtgaagcgctgcttgtcaattgtctcgggctgaaaacggcgctgcaaatcggggtaactgaaaaaggagaaaaatgaaaagttcaaaaaatttaaaaaatattacagggctcgcagttcgtggaaggaggctttgttaggaaactgctggtggaccaccctgaacatgttgtccatgtctgaaacaacagaggccgttaattgtatggtgattgtgtcgttctcggcattttcttgtccaatttaaaatttgaatttataccgatggaaggttggcaatcggacgacaatttttagaaattaatcaaaattcgcatttaaacaataaaatattcttgcccgtgtgtgggagttgttcactcagttgcctcagtgtgtagtataaaatgtagtcgttgatataccgaaaaatttcgcactttatttacagacaaattggtgggccaacgaactctccgcagcctttgaccgtgccgtggatgccgtcctgaaaggtcttcatcagttcggcacagaatgaggtgtcgtcctcggcatcgcccagaaaagggatgtgggaaagagtgaactcgtcttcggcctgaaaatgtacaaaaatgagacaaataattttttttgttggcaatggaccattcaaattaatttttaaaactttccgggacaaattttaaaggcaaaaaatgttaaatatgtcgtcccctattttatggacacaatttttgccgtacgaaaatcgtatgaattcccaaatttcaaaacagtgatcgggaatcgataatttatgggccactaaacgttggacaggcgcagaacggacagatcggtgaacgatggatgcacacaatgttagaaaaacaggccaatcgcctacacacgaaacacaatcatttgttataagcaatgataattttgataaattttcaagttccagttccgtcacacgcacgttgatgttcacttccgtgtgcgtccaaaattgcatgggcggcgtcgcctccaaatgttggagcggaatgatcggacatttgctgatcaccacgccgttgtccgcccgtttcagcgcagccatcggcctccctttgatcggtttcaattcgcgcagaatgagcggtgccacctcaaacggttggaaaggcgtcggctttttgcgcgcttcgtcccgcgccttcttgaacgctttctgaaaagttggaccatgccaaaacaagaaaaagcagtgttcaaggaaaatttttttgctcttatcagattctttggcttactcagaataaacgaagaatttctgggattttgtactgatatagaaaacaggaaaacggaacacacaatgcaacattttattttgatggaaatcagttagaactcttttatcttaagggaatagttagtttttaggttgtaaaacccccaaaaaaagtggtaaaaatgagaaaataagcgccaaacatttccgaa

SEQ ID NO: 2287 - DNA, 3266 bp, Heterodera glycines
  misc_feature (3155)..(3155): n is a, c, g, or t
tgctgctgaattgcacaatcaaaggcgaagaagaaaaagccgtgggaattgccgatggaagtgaaatggacgaaggacggagtgccaattgacttttatggaagcaaaagtgagaacgaacgaatggggaggaggaagaaaggccgagcaatgccatcccaaacattgggtggacaattcattttttgtcagtcggtcccttcccgcgggcactttgccgcccccccccctcccccaatgacactaaaaaacagagtaaaacaatcaaatcacatcagtcgagtcactccaattgagtcgagaatattcccaagaatttccgctgataattccttttcctttagagtattcctccgaacgacacgtgtccaacaacggcgcttcggtgcttttcagtcttcgcatacgaacagcggcgccgggggacagcggaatttacgcgtgcgatggcctccgtttggtccgatccgcacaaacgattaatttggtgccaccattggcttcttcgacttttttacgcttatatttgtcccgcttggccatattttcgaatttattcattcttatccgcatttctacctcttaattccataaatcttttcattttttgtttgttttatttaaacattttttttttgctttctctgcaaatcattttttacctcttaaaattcaattataaaagttagggttcggaccccgtgggcgggagtggcttttcgcgggggcgggggtcagagtcgcgggggcggagacgggggcacgaaaattccgcccccgcgggggcgggcgcggggctttgatttgaattaattccaaaaaatttcacaaaaaattaatttttatgaatggtgtgttggctccacattcctttagtcaatgtttcgcctcgattcaattcctttggcataaagtacacagattttgtctaaagaattaccaaatttagggattttgggcgaattttttaagaaaaaataggtattcaccaaaaattaagatttttccgataaatttttgtttttttttcatgttttgctcaagcaaaattggaactcagattttaatattttttttcttgcggcacatttttgcaaaaaaaaacttggtgaatgtgcgagggtggaggtgcggcggtgccgttaggcgccgccgggaaaattttttttagaaaatttgaatgaaatttgttcccagattttcaccaaaaaatgaccaattttttagttttgagataattttctatgaaagaaataagtttttgggggccggtggtgccgataggcgccgccgggggaatgtttttttatgaattttgttagaaattagtcaaatttttcagaaatttccctcttttgggtgaaaatacgcacccaaatcagaacatatcttaaaaataagaatataaataaaccatgtattaatcagataaaaagaaattaaatagaaaacgtcaaccgtcatcgaactcataacaaagaatactgttagctgtgaagcactaaccaccaaaccaaaatatcttggaaattcaaagcaaaatttctttatttcataaaaatttgtcaaagatggtttttgggggttttcgtcagttcgtaaaatgcgaacatctaaaagagaaatcaatttaaaatgatgcttaaacaaaaatattgaaaaaatcttacctaacgcccccagcacaaatgcggccgcatgagagacaaaagtttccatacgggaaaaagggaagagctttttaaacagagattctgtggggacggggaaaggggggtcggggtcacttcggcgcggaccatttcggcgccgcaaattttgaaatgctataacttttttatttgtcagttagctttagccaatctggcatcatttgaaagctctatgtgtgcggttcccgggaaaggggggagggagaaattagtcggaaacgaaagtgacatgtaattaagcaaatgacgtgttaaaaaattggtacttgcctgttatgggtctacaagccaaaattttaaaaattcaacaaaaggggcgcatttcctttatccaactaacacccaatgaagattcagctgcaaaatttctgcaacaaaaagaaataattcatcaattaagtgtagcgcgtcctttgctgatctttaaaattttcgcttgtatgtagtcccataacaggaaagtaccaaagaatttcagcaaaatttagtcgttacgaatgtgaaaaggaagggaaaggcttctgcttttatacccaatgaatcgagaatgagatttaaagaagttatctcccaatttgatcgattgtatgggggagggggtataaacggcggaaccgctcagttgggcgcgcacggttgggcgccaatattccaacaattttttaattttttttattaaaaatgttttattgcgactataaattctaattttaaaatttaatagatataaatattattccgtacgtatgcaacagcactatgggtcaagcccagtgttagacaattactcataacgccaaatagcgtaattggcgtaattttttgagcgctaattcaaaaaatacactggccaatgctttttttgtttgatagccataactttcttcatctccaactaaactgaataaaattggtatctaaaaattgtttttgaaaagaaaatttttttttctaagcgaatgctaagcaatttatctcaaatgaaaaaagttatgagtctttcaatttttatcacgttataactcaagtcctaacagttgatttcaaccaaaatgcaaaaactaatctttttctattgattataaatatccaaagtggtttagtacttttcttcccgaacattttcagagtcaaaaatcacagtcaatttcaactatgggcacaatttgctgttgcgggactaatccgtggaatctcgtcccggaaaaaatgggtttaaattccgcatcgagatccgcaaatctcaaacttccgtttctaactcttataccaaaacgctcgtgcaccacgttaaatatggatagatggcattatgtataatcatcatcatttggggtcaaaaaccaaaatttggaaaattttatttcaaataaaaaatgtttttttttgcagctcgcgttttccaaaaaatttttgggaacaatggaccaaaatatggactanaactgataaaaattaaatttaaaacccctcaaattccaaaaatatttcatatttgcttaacaaactaaaaaatacactaactacaaaaaatggatttaagttttaaaatgc

SEQ ID NO: 2288 - DNA, 3822 bp, Heterodera glycines
taaatttgtcaaaatttcgaaaaaatctcttttttcggaggtgtgttttttaattttctaaaaagtcgaatttattggtgtattttcgcttttttgcatttttcttgtgaaatttccaaaaaatggccaaaatatggaccaaaaacgcaaaaatggcgaaatatggatttattcccgaaaacccccaaaatatggatatatatggactaaaaaccttcaccaaatcaaaaacttttaatgtataaatgctatttttgagcccttttcttgatagcatatgcgcagaaaaatatgttaatccatacaatttcgagccctagtaatatgttaacagattttcaccaaaaagatcaatttttgtgaatttaagccaatttattactaaaaaaataagttttggaggcccggcagtgccaataggcgccgccggggaaattttagaaaattttgacccaatttcttagcaaactttacctaaaaaatgatcaagttattatataaaacaatatgaaattctgaaatgtgaaattcacggtaaccgtgaccgtgaatcacggcaaactctagcaatttgatcagtataataagactaaggcccttttttgaaaaaaaagatttcgtaaattttgttgtcataaaaaaacaaaaattttcaggaccaataatcttacaattgccaatttcacttcgtttccagtatttaaacaaagttttaacaaaaaaaatgatccgaaaaacttgagtttttgacttttgttcgaattcgggatttttttattgacaaattgcgaccttttcaaggttttgcttctgtgttagaattctcgggttcttttaatgtctatccgttttttttgaattattttctttccatttaaaaaaattgcattatccaattaattttcggtgttcaacagttgctgttcttttctcacacaatttgcccctttcccgaactaattaataagtaaatgagattgaaaaagtatttgtgattgattgggtgaatgagaccaattttcatcatttattgctgataaaatggttcgattactgcacaaacatttttttaaattgatttatttaaatatttttttggtcatttttatacatataaattatcaatagggtttgtaattatatggatataaaaacgcgaaatatggccataaaatatggacaaaaatcgcgaaatatggacataaatggcaaaaatatggacataaatttttccaattgagggtataatttcacaaaatttatttaattcaccaaatgtaaagtgaaactttcataaatgattaaatatggcattaataaatcattttagaaaaaaacacacgataaagctaaaatttactcattttaacgaaaaccatcccgaataacgaatttttcgcttttttgcttaaatttttgacataaattaaccattttttgagaaatttaaattttcaatattttcgtgaaaatcttactaaaaaattattttttggaaaattttctggtctttagggcgtcaaaaggctaatttagctgctggggccgttctaatagaggttttttggaaaattgccaaaatatggacaaatatggaaatatggacataaatcgcgaaatatggaaaaaatggataagaaatccaccctagaagcttctaatcaagctaaaaacatgtttttcgtgcgtttcagacctcccaaagtccagaaaaaaaggatttccatacaattctattccctaatttacaaataaaattttgtcaaaaatatatatttttttatatgtcagcgaaaaataatgccatcaaaaaagtgcacaaaatgtgcgattgccatcaatgacttgaacataaaagagtcgcaggaaatttcgtcttctgtcgattcggtgccgaaattgctaccgtttttctacggcactctgctggcacttttcatgacccaattgggcgcaattttattcaaccattcccatttgggcggactgtcaatgttcgacaccatttttttgctaatcgcacgtgctgacattgcccaagtgcacaaatggatgtttgttgtgagctttttgttgcgctttcttcttcagtcatctggagtgcatttccaaggacaattaattggctaattgccattctccagggctaatcatcgttaattagttgtgccattgtcacagagccatcatcattgcatctccacggctgacctggtgccctttctacgcatcgtcagtttcattgcttaccaagtaatgcctgtgtcagaataccaatcaagtattttggataaaatgcaaatgcttcagacagcaaattgcacttaattggattatggattttcccatttgctaataaccgaaggccctgctgttcgtcacgttcactcatggcattgaagccataacgtgtgccgatgccgattcgttctcctatttttcgactccctttctgtgtacggtggtgctcaaccttgtggccaaatcacctctgctgttttggtccaacaaattgtctgtgtccgacatttccccggctcgtcggtgttttttgcactttggcgccccattaattaccgtagcattggcggctgccgaccaatggtcaaggtacagtagtaggtagttccatatccaaagcaaacaaataccgtataaattcgacagtcctccagacagtaacaacgcattgatcactcttcttgacccgtatttggctgtggggatgtgcatgtcattgtgtttcacagttctaccaatttgtaataatgtgattgattttgcagtttaatcatttgggataatataaaccccaaaaacctaaacactaaattttcaattttttttttcgttttttggtgaaaaagcctggaatttctcccctcacgcattacggagataattagggctgctaattttatgcaaatgcatatttttttcctggtttctccatttagtaggaaaaacactttcttttttgtgcttgcgaacaaaagttgggacttttatttacatatttttacatattttcggatttttctacatattacatatgtacatatttttatacatattttggactttttcgtacatatttcgcaatttttcgtacatatttttcattttttttacatattttgaggatttttgagaatttatagaaattttttgtaaaaaatttaaaaatgttttttttgaaaatatatccctaaaaaatcaaaaaatgatatatcaaaaattaatttgtaaaatattcaaatgtgattctaagcctattttgatcatttttatggcattttgtgcctaccgtatatgctctaattatagcccatgggggattatttttcaacctcttcagaatacaggggataattagagactgcgtgattaatagagactgtgggattatttttcgactgatttgtttagtgaaaaatttttgaatttttttttgaacatgtcgccaaaaatgtcagctcggcaaaaaataattatttttaatgcatttttgttacagaatttctgtattttacatgaaaaatttgaaaaattccatatatttagcaatggagtctttttgctgtgcttgtaaagcaatttatggaggaagccacagctgttccgtctgcaaaatagagaccggacgggatcgggatcccgcgggatttcttcgggatcccgcgggattaaattcgggatcccgacctcgggatccgtcccgagcaattttttaaattcatctggattgatcgggatcgggatttcatcgggatcccgaatcgggatccctcccgaccattttaccaatcccgcgggatcccg

SEQ ID NO: 2289 - DNA, 1330 bp, Heterodera glycines
gttttgcaaaatttttattgtgatagtcataaaaatttattctctggggtttttggggtccccgatcacgaatccttcaattattttgatcaattccgatttcctaatctaaatttgaacaaaaaatcataattttaaaaattcaaaatttcgatttttattcgagttcgggtagggattagaaattagtcaaaatacatgtcagattcgtgattagcgacctttaaaaccccggataaaaaattatcatggttttttatcttaaaaaaattttgcaaaacaaaaggggtccccccttttgtttcaaaaactgtcactttccatatagtgccgaaatcattatcaatgaatgacttttgattgataaacctaatgaatgcaaattcagcgcggacaacaggtggaggcgcattgcttcatctttcgccagaagaagcactttatttggtattgtcactgcttttccaattcaaacaaaaataggtatgttaatttttttgagagccacgacctcaaagtgctgacactttcttcgcaacagaatgacgtaatggaagattcgggggagcgacctttaatttattattcccacaaacttaagaaggcaacattagctgattactctcccgagcaattcttcgctgatttgtgcgctttccatcccaattttgcttctattctctaccgttatttagtttataggtgattcttgtgaccattttttattagctagataagtgattgcttttttttgactttacagatacttccgtcggctttgttgggtcgttagagatggcatttcgtttggcgtcgacttctgttagcttaatttatgagcataatgccctaaatttcctgtcctagtgctctacaaatgttctgtggatgagtaccattccagcgcgggcgtacgcatcgttcactccgcacatgaaccaattgcgacagaaacttcaattggggcgcttcagcgcgaattggccaactgtaagaaacgtttactgctcgcgaacgttgtcggacttccgggaaaactgcagaacttgcgcctaacgcagttgggagtggccaatggttcaggtggaaaaacaaaaatattggggctggtcctcacatgggaaataataattttacaggtgctttctatgtcgatttggaatgcgaacagaagtcgtatttctgatttggatgggcaggaattgcaggcggatgagtgatacttttgtcttttttttgtctcacaattagtctattcattttatccggtctttttcaaactaatttacatgaaaaatttaatcaattttatgtgcttatttatatttat

SEQ ID NO: 2290 - DNA, 6844 bp, Heterodera glycines
  misc_feature (6780)..(6780): n is a, c, g, or t
  misc_feature (6795)..(6795): n is a, c, g, or t
  misc_feature (6823)..(6824): n is a, c, g, or t
aatttaatcaattttatgtgcttatttatatttatgacttttgttggttggtaaaaaattcaaattgatagggcaatgggaaaggtgtaataaattttgaacctgtaatttgttatagactgtagtaaaaactctataaagtttattctgttatgcgagcatataatgcttctgaatatattgtcaactgaagaaacggataaactaaagaagaaaacagcaacaaaaatagatgaggtttgacaccaaaagcataacaaaacaatgctaacaaatgacgaacaaaagagaggggacacctgaacaacattctgataatgcgtaagccctaagaaaaatggttgctttgatcagcagcattcaattgcaatttgtgctcttacgccgcctccctcctcagtttattggaaatccatccgttcagattgtccttcatccgccaatatcccacaaccattcggtcccacattgtgctggcatcgcgaattgccggtcgaacgtccaaatgggcaaacaatttcgtttcggggttcacatgtccgacgtcgtaataatcgatgatataaggaacctaaggaaaaagggaaatgtaagacaaataatggcataaaacatcggctctattgcaattttggcgtccaatcaatgaccattccaatttcttaggccacaactttttccttatttaatcaaagcaatatatttttagtattggatttttaactaaattctgtgttcaatttaacttctttaagctttcctttgataccaggaatgtagggatttattaagtaaataaaagttatggccaagaaaccgaggatgaccaatttctgacatcagattgtcatataaatcatctatctttgatttttcatcgtgatttttcgacaaaaatttttttttgatggattttcacttttttaccgttgttcaccgactaaaaaaactttcatctaatatactgttttgtttatacttttaatgtacttgaatatgcataaaattaattgacaacataaaatttgtcaaaaatgttttcatgtaaagttggatttttgacttatgtcttcgtctcgaacaactattccagctatagattgatggaatttattttagtgaatgagaataacagtaaaaaagtgaaaatccatcaaaaaaaatttttgacgttaaattacttgatgaaaaatcatagattaaatgatttgtatgacaatctgatgtcagattcgtgatcagcgccatcgataacccccgagtagttcttagaatcgaaaaaagcaaccttttttgcctttttttatgggaccaatgatgtgaacgattaccaaatatagctcaatatttcgcaaataagtataaaaggccggctaaaaagaattcttttcgggagtaatcaagcacatcccctgcacttcaaactatccgtaaatatttcaagtttctattcccacttcgcgtccgcatcggtcgaccagccaattgtgtctgtcgaacggcaattgataaccaagccatgaacggaagcgcgctcgaggcgacaaattttttgcgtctccatgaaagcttttcagcttcggcatatcgcactcactttaattgggaattgtcaaaattaatgcattcaaaattctttggccatacggatgcaaggaggtgttcccatttaagcacttcttgccaagccaattcgttgttagcattgtgtattctgatgatgttgtccatgtcgcgctggtccaactgatcgtcgcgccaacgccaccctaaaatttaaagcgatgtgtggaaaatatcttgaaaattttcaatggaataacccttcttaagcattgcattccaaaacatctgagccgaaggatattcccaagtttccaattggccatcgaccatcactttcgcttttggaatggttgacttttgacggtttgttgaaagaacgaagggctgatcaggggctggcttctgatttggtggtggcatctaaacacacttagcttttcttaaaccaaaccaaacagtcacaaacatacagcatttgatgggtcaatttggtcgccgccattcgacataggacacccattaacgctagcaccgcccgcaagaggacaaccgcccgacattttcctgctcgtgagacagaaatataaaacctataaatgtgtaaaagcatgtgttcgattataaatatgtattaaaagctgttgcaaattgtcgcgtgttaaagaaaatgggaagaaattattttattgacaaattgtggaataggtatttgatcattgaggcccaaaaatgttttgttttccatccatccagccaactgtgatgagacgaatgaaaaccggaccagcaaagcgacaaacaacagccaaatcggtggaaggggagaggcagaagtttatggagttgataactgataacctacaagttcaattaacacctggaaacccacaccgtattagtaagcaaacgtttgtaagcagaaaaagccaaagttccgaagcaaaagaagaaaccgacaatcccagccatcagagcagttcaacgacgacggttagtctggcgcaaaccggacgacggagcgagtgtggtttcgccgcgtatttttcgaaccaaggcgatgtcttttggcattatcgtgactcgcccggcatgcagggcgcacatattgacatcctcgaacatattaacgagatggcactcggtcatggtctgcagtgccaatagggccttgccctgccagcgcattccatcggcgaacttcatggtcacctcgcggacaacacgaaagaacgtgctgcgcggtataagcagattgacgctttcttggaatttgcggatctcctggagagcgagcgctccacgctttttaaagcgtttttgttgtaatggttcttcgggtggtggtagcaaatgcgatgcttggtaccgtgggcggcgattcggggcacttttcgttgccaattgtcgcttagcacgatggcccatgtcagatcccgcttttttgactgcttgggtgggcaaattttgcttagaaaccaaagcatcctgttcagtcgctttcttttcactcattctcttcttcgcaatttgcttggttcttgccatttgtttttatttttgggttcacttcaaacaagcggtaattatttaaagtaattagatatttatgtaatcaaatatgaattttatccttaaattcgttagagttttcaagaactgaactggaaaacaatgaaattcaacaactttcgagaattatttcaatcgtttaagagttggcacacggagatggacaactcttttcctaaattccaattccgaatcgaaaatttatagtttaaagttggcatacggaggtgtacaactttgaactttctcttttgtacgagtcgtttaatttgtttatatacaattttagctaaataattcgtttggtctttgaatagttatatgtatgttgcttttggtatttgtttagtattgtacgaatgtacgaaagaacaaatcaatatattggaatttgtagagaaaataaaaaagaaaagcaatgaaagtgaaaagaaaaggaaaagaattcaattcacgtgtgtatagaatttcaaaattccttctgggcaaaggagagagaaaaagaaaaaagaacgccatacactaactaaccaaaatcattgaatcattaggcccagataacaaataatgttacctaattaggcccagaagaaattaaatatttattactttacatttcattttccattggacgtgcatttccaattttatttctattttattgtcctaattgtttaggattgctctattatacagtcaggtgttgtaaaagtattgccaaaagtacgacagcatggaaaaagcgaccaaaatttcgttcagcgtcacccgacgcgaaacgacccgtgtcacgatgaaatgcaatacttttaaggaagggaaagaacaaaacagcggcgacgaggaggcggaagaagcggacgaacaccggacaaagaaaaggggcatcctcagcttggaagacggcatcatcgtcgagtcagtgaattgtttaaaccaacattagtttggctttttcctgcggttgtgcaaaatattcaaaaagttttagtgccgaaccgcttgccaagcgggagaagaagcagttggtcatccccgtcctccaagtgtccagcagagcacaaatttctcgcattcagaagctggtggacgagggaacagccacagaaacagacttagcacgactgtcgctgttaatcgacagtttggacgacgagcaaagggttggtggtggaatgtcaaaacaaattgcaatggaatgtgctttcaatttgcttttgaagaaaactaccacattgccattggacgcgcgccaccaaaccgtgccgaccgttgcggtggcggacgacgacgacccggactacgcgagtgtgccggtgggcgagttcggactggcttttttgcgaggctgtggctggaaggacgagaagtcgtgcatcggcaagtcaaatccgcaggtggtaccactgcgcgtcatcgaaccaaggccaaaggtgaaaaaacgggagattatttattgcatttcttaaattagttgtagaataaattctctaaaattggcggttgtattttgagaatataaacattgccaataaatggttactaagttttgcttcatttccttgcttaacctaaatggtattcttcaaaaaacgttttattttacggggcatttccaatgcattttaattatattccgtttgattaagtggttggtcgtttgcttatagaaagttcaatgcctttcgcattttgcaaaattcaagtggtaattgcgtaatggcaggatccagcagtgttggacgcatttcccttgtccaagtacatcctagagttctgccgaaaaagaccagtggatgtttgagaggagagcaccgcaaaattcgttagtgccaatctttaggtttccactcacaaaccaatgaatttttactttttccttagtttttatcttaaattcggttactaatctgttgaattttttagggactcggacttggcgctgtccttccgacaatggcaccgccgacggccaacgcgctaaaggcggcagaaaacggtgacgaagaagcgacaacacttggcaaacactcctacgtcagatgcttatgtatgtggaacattgaacaatttttaaatgcaattgtcattccttggaaagggggtttgggttaacttatgaaaaatagtcaaatttgcccacttagattttcatatttattacctaacaaatatttcagccggtctgaacaaaggctcttatggccaagtgatgtcaatggacgaggagaatgccagcattttcgtcgagttggcatggccccccgccaacgttggcaaaacggtgcgtgtcagccaatgggcggtggaagtggtgagacggaaagagtatcgcgagtgcgtaaagggcggcagcggaggaggaggaacagcggagaacggacggaggctcgaaagggtccgagtctgatggaattggcagcaccaacccgtccaaataccctccataatcggccacaactttcgccatcacacggtcgacacgtcgtacgatttctctgtctcctctcggcacaaattttaatcgttcgatttgttatgctcctggtcaaaaggatattcgatgctgaattttatgttgccattcttttctaaagaaatataaaatcgaatatccttaacgacccaaagtgatcgattcatttcttttttaactgaaaggaggaaattgcacatatttcagcactttgataaagagtacctcctaatttggtccaatttaataataatgctttatcggagtgtatgaaaatctttaataactataaaaataattaaataggaatgtgtaataaatagggtgctaaaattattacaatatctgatgaaagtaaaaattgatggcaattattagacgatttgcatttgtggcaaatattgtgccggattgatggtccgcaaataaggcagaaactccggtcggtagtcactgtaaagcacggcgcttgaactggtgccgaggaatttatcgaacattggtcgattaagcagttggagtctggaattaaaagagggttaagggtctccggttttgcaaaattgtgttcatttccgtttcacctgttcccagttactgagcaaaggaatttgtagtaattttgcctcaaagcgtgtggttccagcaccgcaaggccgagcaaataggaggagaggacggagaagagaagggcatcggcccacggcaaaacgggcaaagtgccggcatcggccaaccgaaaaaaagcaaactgaaataggacaatgaataaagaacaatactttttattggcaggcaaaacaaacctcaaccgttttccaaaacgcgtacagtgccaaagtgttgttgggccacagaaatgccattgcaacagttgcgctgattccgacgccaattggccgacaaatggtggcactttttgttgggaagaagtgggcacaaaagcactgggaaaactgtaaaacgggggaaggtgaatggattctttttgggttggagcaaaacagctcggcctcctgttttcggcaacttcgagtataacttttacctgacaaagcaacggcaaagcgccgatgaaagttggcactcggagaagttcaaacagttttctgatgcttttatttgaagagacagcctttggagttttggtgtttgatctgctgagagangtgaacactttgagncaagtgaaagcggcaacggaaagggaannagtctcagactgagctaaat

SEQ ID NO: 2291 - DNA, 3602 bp, Heterodera glycines
cactttgtcagtcgtttcgcgtcttccatatttggagatcaatttgccacccgaacgaatcgcatttttgatggacgtgaaattggaatgtgactcgcgcaaaacggacgatgagtgaatgagcgctgaggttgtctgttccgactgttcaacctgcgaatgagagaagttaatgacaattccaccgaaattatgcaaatctgtgtatgggtattattcattcggaatttgattttttcgaatacaatgaacggtgtcagttaactaccacaagctttttaattgaaatccctcccgaattggctctcatccacccacctgttgacccattcggttgaccaatgtgctgagcatttccgtggtgcgttccccctgcgcgcgcagtgtgtccgaacggcggtcaaacgcagtgcgacgcgccgtcgcgacagtgcgacgaaagagttggtcgcgcaaacgccgctcgcgttcggtggccgtcgctgaaccaccgccgacattttttcttttcatagcaaatttttgctcggaaaaaataaaaaaattttccaaagaaaatcagaggtaaaatgtcaaatgacaatttatgaaaaaaattttttaaaaaattattgaaatttttgaattaaaatacaaaatgctaacaataagaaatttaatttttggttagtaaattcaatttcttcgccaatcgctttgaagcgccggtcaacggacaccggcgcagttgttcaaacattgtgacgatttggcctcggaattcgtccgtcccgtcaaattgaagtgcaaaaacgcgcagagacacatcgacaagtcgagagacgacattgtgagttctgattaagaaaagggacataaataatacaatcacattttgtcgtcataattgtaagcaattttggtgtattaataatattaattaatagagctcgacattttggaaaatgcctgtacctgtatctgaatctattgcccgtcccacctcctagttcgggatttccacaaaaaaacacacccccaaaaatcgcttttttgaattaaaccgcccccgaatccaacggtatgagctaagccaccccaaaatgacctgcccattgttgagctgaattttgtgccgtcagcgtccttctcggcccgaatcactgcctctaataatgggcagagaacctgaggaaaattgcaaaaaaaatagtaccaaactcaaaattaatcgatggaaatggccaaaggattcgaaaattgatactatcatccattgaattaccttgcaacaattgagcagtccgtcccgcgtcataagcggcgaagtgccgtccgaagttgtgccatcgttggacggacaaaggacgggaaaatggaaataggctggcgaagggagcaaagagagaggacagggcgaacgaatctgtaagaaaacaactaacaataagttaaaataaatcaaaaaaatgcggcaaaataaacaattactctcttaaaatgttaaatgaccgctccatcgcttaccgttgcctctccgttttcaaatgaaatgtccaaagtgcgctcgggccacaatttgttgttgctgttcgcttcatcgccgaagacagtgacaaattgggacaaggaatcaagcaatttggtactaaaagaaattgaaaacaatttaattggattctaaatgtgccaaacaaaaaacgaaccgaccgattttctggcttccgttgaccttccatcagttgcaaaaacgcatcgaatatttcgcgatttttccgacacaactgtacatatttgcgcaataaaagtgataaaatgtcgaagcacagtgatcgaacagacgaacgaacatcggaaatccctgaaaattttggatttgctaaaacactttcaaattgtgccgttttccgttattcattttgtgtgtaaaaagaaaaaagcatggccatttaccggtgagaacgaagccacaaaaaaggacgaaatgggaactgatcacttcctcgggcacttcacagaccatttcgatcagcagcttcaactgattgcgagttgcggtcgattttagctgaaatttccaaatagtttttgagttattagcaatgttttttttcgtttcaaaattcgtttgtcatttaaattcgaactaccctacccgtcccctttttttccctctcacctcgcgaataattacagaaccgatggccgggattattctgcgcaaatgcctcctcaactgatcaggcgagtttttgaacagaaggcgaacaccttgacaagggatccaaaacggatgtaaatttccgaaagttgtgcattttgccaccttattccgcatgtttcccctccatgctcaccatggatcgcatctcggcaaatgttttcgttgtaatggcccagctgtgccaccaattcgtcgatgcccttttgcgggtgccgagtttcgacttccttcgccggagtgccctcgtcgccttctctcagctgctccaaaatgccaatctttttcacacttacgcgcgtgtcggtgccattctcatgtcgcaatgtgcggccaacctttagcttctttttctgaaatgtcttcgcatttcgcacggacggattgaagcgctttttggcagccataacaatcttaaaattataaccaaaaaaattattttcaaaagattttccaataaattgtttgaagagcaacaattgttaaatttaaaaaatattataatttatgcatttttggatgaaaaaaatataatgccgtagagagaatttggacaattaagttgtttaaaaataaaataaattataataagaacaaagtgagaattttggtaatacttaaagtaataatatgatatgaaagggttgcaaaaatcacatcggtaatcataatgaaacaaataaacgaaaaacggatcaatttaagttcgtgggaaaatgtaaaaaaaagctcattaagaacaaaaatcaaggcaagtgaatgatgttcgggttgggcggctcctcctcaccaatttgtgtcaatgtatgaacgggcggggccgggcgtgacaaatctaaaatcaaaatttcacattgtattttcgtgaaattctaaatttttgatagggaaaggagtgggttttatcagcactgtccaactcggcacgaaaattagattttattcaattgtctttggaaaatgacggcgtattgcaatgagccgggcaatttctatgtaaaaagtccgagcattccacccaccaaactcgggaccaattctgactcgtccgctgcttctgctgttctccgccgcttctccgctgtcccctgcctcttcctcctcccctccgcgtcctgctccaatttgttgctgttgttgtgcagagcgttggcccaaccgacgaatgtccatgaaaaataggacgaccaaaattgcacaaacacagccaccgggcacaaacgcaatcacatcacggtagaaattggcacaagccaatgtgtgctccgccccgctcgtcctgcacgagggattgttcagctccaacagccaaacaatcgccccgttgctcagcttgtccaaaaagctcatggcaccgtaaacgaacgcagcactctcctggcaaaatgtttattttaggaaa

SEQ ID NO: 2292 - DNA, 183 bp, Heterodera glycines
tataataacgctgcggacatctacatttttgaattgaaaaaaaattggtaattactctttctttttctccatattgaccatcatactcatactccccccacccttttcttcttccgccacccacctcccccgctacgcgccgctcggggatcgatccccgatctagtaacatagatgacaccg

SEQ ID NO: 2293 - DNA, 195 bp, Heterodera glycines
  misc_feature (8)..(8): n is a, c, g, or t
  misc_feature (10)..(10): n is a, c, g, or t
tcctctanantctataataacgctgcggacatctacatttttgaattgaaaaaaaattggtaattactctttctttttctccatattgaccatcatactcatactccccccacccttttcttcttccgccacccacctcccccgctacgcgccgctcggggatcgatccccgatctagtaacatagatgacaccg

SEQ ID NO: 2294 - DNA, 1590 bp, Heterodera glycines
  misc_feature (1539)..(1539): n is a, c, g, or t
atccctcattcaaaatccacttttttccagcggcgcctcatttgcaccagtcggctccaaaaattccttagacttttataaaattaataaatccagaaaatgggtaattattggaagaatctattaataaatctggcaaaatttgatgtccctgtcccaattttggtctctcacaaatcatttccaaaaaaatcttttcgaattaattttgttccattcttttcctggataatttttgttcctttttgctttattttttttttcttccgcattttctttattccttttcttcccatttttctccagaaatttcatcaaatgccttttaaatttcatcaaatgccttttaaatttcatcaaatgcctttttttgtagttctttcatttctgatttaattcgactaattagagcatttaatattaaaattaaacagaataaaagtaataaattcatttttcaaagtattctcgaaatgtatttttttaataatatcgaaaacgattaaattttacttatccaaatctataataaattcttaattcttttttaattgtgaataaatggaaaatgaaattgaatttttttaacaaataaaacaaatttacttggttttctgctttaagaatctttaaattattctttttttaaaatttatttcgaaattgcagatggaaagccaaatttggagaccgaattttatttaaaaaacaattggattttctcatgaaaacattgcttgcaaatttccagaaaatttcatttagtgacaaattttacttgaattactttgttgtaattagcgtacaattttttgtttcttctaaatttttaatcaatttaaaaataggaattaaattttatgaaaattaggttaaaaaatgagctttatctcttaaaattcacattgtttatctttaaaaaaatgattagttttaacaaaagccacacgtcacgggacattgaatctgcatacgattcgagtacaatgtgcaataatttttttcatgtttttctgcgcagctcatcgaaccggagtatgaaatccaatctttgcaacctgtaaaagaaagaattaaattatttttataattacttttcgatattttataatttaatcgctataagcccaaacaataaacaaaaaatttcgttcgttctgttttaagaattaaaaaaaaattcttttcaaaaactaaaaattcttttcttgttttaaaattgatgaaaatgaaatttttgcaattttgcaggtcaataaagaaccaattaataatttttcgggccggggtagagttaataatgctgataaatgaacaccatctccttattgaatgctttcgaatgatatcgaaaatgagagatttccttggcaaaaaaatttttgccaaccaatttcacatttttcgtatcattcgaaagcactcaattatgagaagttttctaagcatatgttaaacaattgggcgcattggaaaaaagaaatcaagctggcctataatctgctgcaaagttacctcgtccaccgccaatatggttgngggaaggcccaactccgtttgtgtacgccggcctcctgctgccacctctgc

SEQ ID NO: 2295 - DNA, 3515 bp, Heterodera glycines
attcacagaaacattttaatgtaattaataaatggatttgaaatttatttttcaaaaaatgggaaagaattaaaaagttttcatggaaaactttttagtgattaaaaataatttaaaagactaaaatttcatcctcatccttaaaaaaagttttacaataaattttaattggccaaaattaatttatgaagttatcataaattgaatgtaaatttattgtttaattttatttttttaattttcttaaaattaatttaaatttataatttttttaatttgatttaatttttcaaatttcttaccccggcacccctgcggaaaagttgttggcggttccgttgcgaacgtcctgtaaattaatgccatgccaaattccgagtcctccttgcagcacaagtgcaccgaagcgtaataagtgagcggcggatccgtcggagggcaaagattctgtctcgactcatagacaaagtctaaaaaacatatataatatttttaaatatattaatggcttaatgttgttgcatttttggtggaaaattactggaaaagaaatccagcaatttttcattttttccacctttgaattttttgaagttttgacaaatttattgttttaaaacattggtaatttggactgaatttttttttcaccgtaaaatctggtcaatttgtccatattttgaatatttcaataattaaattaaaatttcttagacttacgagtacaataatacattgcttcaacagccacgtaaataactgcaaaaaaattgaccaaaaataattttaacgaaatttttcccatttttaattcgaattggaattaagctattttttcaattcttttaataagaaatgtttccattattccattttgactaacaattttgtgttgctttatttgaatagttgtagtgttaatttaataacatttttgcttttgtttaacgcaaatttcgaaataattatcaaaatggaacgacaaaggaatacaattaattaatcatttattcattaatcatttaattactcatcaaaagctgaaataacaaaagcacaaatacccaaaattaaattctgcagtgaacaaaaatttggtaataacaaaaagagaatttcaaattatatcatagttgggcactttataatatttgtgatacggtataaaacgattgattatggccaaatatggatttattccattcgacagaaatattataaattttaggtggggacttttcgacaataaataataattaagtttcaaatttaggggtgtaaaatcgtaaaatttatccaaaaagcaacaaaattaagttaattaattgttgaaaacataatttttaaaacaaaagattcttgtcaagaaaagaaataaataaataagcttgggcattagatgggggtataaaaccaaggagtttcaaaatgttaaaccgctttaaaaccggaaaaaccgttttggcacttttcaaattaaaccggtttaagaatttttttctcggcattaacaaagcttggccaaaaacttttggtgtcattttatagaggacatataggggtatttaaaaaacataaaagcagatttttctccaaccaaaaatttttcaatattcgtgtaaaaatgacaaaacggcaagtttttatgcaacgacctagtaggatatattttctgaaattttttttggacgattcttagggggttatttttcgtttttattacatttttattcataagttttgggcaaaacgcaaaaaaaaatcaaggggtataattttttaaattggtgtttttatatgaaaataatttcaaattaaggcaaacaattttattaattgattacaattgcaaataattaaatattcgaaattttgaatacatttttctaaaattaataaaatttgaaaacccagtatttggtcaagaaagaaaataaattacaaaaatttttgccgagataaaaaaaaacaaatttagtggaagaatttttgaaaatttttaaccaagtcgccaaaaaatgtgatcgcgtcaaaaaaattttttatttttcattgtatttttgttaaaaaatttgagaattttacaggaaaaatttttaaaaattgcgaaataagaacgaaaataagcataaaacgctaaataagtgcaaaaacttattttaagggcgaacctctaaaatatgcatttttaagcacgaaacgccaaaataagcctaaggtcgaataagtgcgttaaaacaagaatttccgagctaaaaatgtgtttttcgtgcatttctcatcgagttaaagccgcagaaaaaataagcaaaaacttattccctactaatgacttgaaaaataccttaacaaccacaaaaaaaacaacatgtttttcgtgcgtttccacaagtgccattttcccttttttcgaattggaggagtgaaactttgaaacttaaaaccaaaatgccgaaaaataaaggttcaatcggtgaaaagacaattgaaatccgtcagaaattttgcgtacttcttgagaagacctaggggaagagaattgaaacaataactcaaggcacgactaggctgtatgacatttcgcctgctaagcaaaaatcggcgtttagcctactaagtcaaaataataaagtgctgatcacgaaccaaagcttagctttgcaaaatcagtgttttttgtccatgattttttataaagtatcgtaaaaaattaatccgcagccaagcggattcgaatccctgaccatcgtcataagggccagtaattaaattttcaaaaaatcgtaaaaaaaaaatttgaaacttatcttcttcaaacattcaatagatcatgcaaaagctctttttaagctctataagaaatatgtatgtatgaattttttacgcccgtttaattttcataaaattttttgaaaaaaatcaagtactcgatgaaaaatcatagacaaaatcattgctattgcaaattctgagcacgggttcgtcgtaatcagcacattttttatcctagtagaaacaaaaaccaaaactttatttatttttcgtcgggaccgcaattctgcagtattaccgactttagtgctttactgctggaggtgttctgctcgtccgatttccagcttgcggtgactttttgacttttgcagaactcttatttttagttttgatagacgaatagaaattcaaaaagcttgcctcaataaaatgcaaagaatgataatttggtgaaaacttctcttttaaactccttttcaatcatttctttgtgaattaattgcaattcatttcatattttttattttccaatgattcattcattttagtctctaattcatgaaaatataacttaacgcctttttaaactagttggcacaacgcccggttggcgaaacgtccgaatttgggttggttgtcgaaatgtcatattttgggtgagttgacgaaacgtccgaatttggcttagttagcgaaatatctgttggcgagatgtccagctggcgaaatgtccgtacacc

SEQ ID NO: 2296 - DNA, 1383 bp, Heterodera glycines
catgtttttcgtgcgtttccacaagtgccattttcccttttttcgaattggaggagtgaaactttgacacttaaaaccaaaatgccgaaaaataaaggttcaatcggtgaaaagacaattgaaatccgtcagaaattttgcgtacttcttgagaagacctaggggaagagaattgaaacaataactcaaggcacgactaggctgtatgacatttcgcctgctaacaaaggaaggtccccaggtgtccgtgggatttccgaatgaaacttggtgggtgcatagagcacccatgggttcttaagaaaaatggtttcaatttctgccaaataggtacgagtgccgagttatgacgtgccaaactttttttaatcccaataaattgaataatcaaatgctctgttctgtgctgttcagtggcgcagaggttgtgctctcgcatttcctttttccccccacaagttcgaatccctcttaagtaaattaatttttttaattttgcccttgaatacccttttagaaatgtaattattttcatttattttttaatttcataattaaaactaaaatttatgcattttcgcaccatgtggtaatcatgaaaaacaatgagcaaaacataagaaaatctcacaataaccgcaacgaagtaaaatagtattttcacaatttattttttggcaagtatctttatcttttggcacttcaaaacaaaatttgaccggatgacaaaactctgattggtagtcgtgatcaaagtaaccggcttttctccacgaaaagcgtaaccaattggtaaacctttctgcttggaattgattatgtattaaagattgcaattttagaatattgtccctgtggtggagattgatgttaatgtcataaactagcacaaattgggtaatttttctcgtgaattctttccacattctataaattttgtacgattcttgaaaattattattattttaccgaaacacataaacatccaaaggttggcaaattccagttgcgtgtttcggaatttgtttaacgttaagttggacattctctggtggtttaaaatcattccaccctgtccaactgtcaaccatattcaagggcaaaattaaaaaaaattaatttacttaagagggattcgaacttgtggggggaaaaagtaaaggtgagagcacaacctctgcaccactaaacagcacaaaacagtgcaatagattattcaatttattgggataaaaaaagtttggcacgtcataactcggcactcgtacttatttggcagaaattgaaaccatttttcttaagaacccatgggtgctctatgcacccacaaagtttcattcggaaatcccacggacacctggggaccttcctttgtcagcattt

SEQ ID NO: 2297 - DNA, 4696 bp, Heterodera glycines
taactaattaaatatggggaaataaatgcaactaattaattgcgttaatagaacccccccccccccccccattatgcagctttcacaatatacacctccaaaaagcttgatttttccgcatcttattgctgcaatcaactcattcgttgtgtttaaattctgagcaaattgaaactaaaaatgcttctctacggctacgatgcttagttttggctccaattaaaaaaacaattatcgagcatcgttttcttggccaagactagtcagtgctgtgctctccggtccaattgtccccgatttggcactcctcaccttcctcgccgtctttgccgtcttcatctttgtcctccttatcatctccgtcttcgttctcttttgcttcatcttcggctccatcctcgtctgctttttcttcatcctcaccaccttcggcgtcttcttgggcaccctcggcatcatctccacccccctcttcaccttcacctgctccatcttcgtcttcgcgcttctttctcaacagcaacgcgtcgcctccgttcaaagtcgccttattttttattcacaatacagttatgtattttaatgaatttaaaatcggattaaaaattataccggaatggcattggccaacccattttcattgggcatgaaatgaagtaaaattatcatgtaaaccgtgacattgacaagcagcagaagcgagtgcattttttaaattacttctatactaaaattcatttattaatttatttaaagaaaatttagttaagtgacgaatcattatttttcaattttaatggtgtatttttattaaacatatttaataaatgaatgtgagactgatgcatttctcttattttggcattccttttatattgacttaaaatgtagtgaaaatgcgaattagttattattttatttacgtaataattttctattttctgtaaattcataatttaaatgttttcatagctgttcgtttaaatgaacaaaaaaaaagaaattagtaattgctcaaatatccacaaattttattgctttttttgtttatagagaaagtttttttccatttttggctttttatttgctcaaacataatgaaatttattatggtgactgattgagtacagtcaaatcaaaaattaaaaatgagcttaattgtttaattgatttaaaatttgcagaaaattgacaatttggggtttcggaatgccactttataaaatgccaaattggacgcactttacttgctcaaaaatcaccaatacagtatgtatggaattgtttaattttagtataaaaatttaattcaaaaacaaatgattatgctgtattcattaataatctttatataattaattgaagtaaattgtgttaattttaaactgacgaattgtgtaagtgtaagttttaagtcagcataaatgttatacttataaataatagtagaattataaatttggcatccttcgaaagctctacatgtttagaagcttttgacaagctatttctaagcgattgaacagcttataaaaaaattgaaacatgaatactaccaaaaagtcagaatttttgcatatttttacttatagcttttttatatgtcggtatatctttgtattttttggacagccaatagagcttgttaaaagtattcgaatgataccaagtttattggatttggtcaacaaataaaaaagtttttgcttaaaaccaaaaaaaaaaattatagaaattccctcgcaattgggagcagcttaataagaaattaataaagagaaaaaaacaaaaataaaatctcatagtatcctcgattaattagcatcatttagcacatggaacgcgaccccaaatggcatttagtttattacggagatgaaatttttacaatttgccgtttttagtcatgtttttaatttttaaattctctcttaaagaattttacgcatcttcccgcgtcccgtttgtttcttcgttgcaccaatttcgactggcacattgccaatgtatccttttttacgccaccccttaattgagcatttggcgtactggctcgtgtacactttgttgcaacagtttttgtaagtgcaactgtagcatttttttgagcatacggtactcgcaggagttgagccagaaacgtctctacagactccgtttggttggcattcgatgcccgcttcggtcaaatcctataaagtgggtgacaaatcatcgaaagaaattatagttctttttttattgtcacaaaattctttttttgggcagaaattgtcacatcacttttttgtgggtaaagaaaaaaaatgcatttttggcattttagccctgaatgttcttattagcctgcaaagtaaaaaattgcgtttgatttaatatagaaaattattgttttgtgatacttgacaaaaatcttttatttgcaggctaacagagaattttagggctatgtcaagaatgccatatttttctttctttaaataaaaatcattttttattcttatttttgtttaaatgtttgatttttcaaaattaaaaaaaatagattatcgaaggtgcaaaaattatgtttaaaacaaattaaactaaaattttcaccaaataaaattgcaggaaaattaagattgcagcaaggttcacgaagaacatgaataaatttaattttggtttgactattacaattttgtttgaaaaaatttaaaatttgttgacatttcttttgtatgtaattcttacgataatttaaaagcaataataatactaactaatatttttttaaataatttctattcatttaaaatattttatgatttatatttgtatatactaaaactctgctcgcttaaatagtggacaaattaagattaacataaacaaacaaatggccaaaactgtttacattaacaaatcggtgaaccgcatttcatttatttttttgttcgttcgttttgccttttttccattgtcattttccatatttattactaattttatatttcttcacttttcatatgattccatcactttgcttttacttttgattctttgagaattaaccatactaattcaatgtgtatgtcacgcagtttatgctgttttttgaaaaatttatcgacacgaaagctttcctttccactttttttttgttttgctgctttcgaccggtgttgaatgaatattaacgaatcaaaaaacacataaacaaaatgttgcaatcgatttacctatttgtcacctcaagtaattctttcgttttttcattttgattttattttcggctctttgttcaaccagctcttattttttgggttgtgacatgtttttcgttgtcatcaaattcaataaacttggtaccattcgaaagctctaagaaagctttattaaccttcaagaaccgaaaagccgcaacacttaaaaaagatagagaaaaatcttcaaaaatgttgtcttagataagaacatttggcatttttaaagtagggggggggcgatgcatacaatgagggggacattttttttatcaaacgaacaaagggagagtaaaaagaattcaggggttttcatgttcgctgattacgtaaaatgagatccatttcgactaattccgaaccccagatccgaatttgaaccaaaagtgaacaaaaatcaatttttcaaatttgtttttgacttctgttttagtcgattttgggtcagggattcgaaattagttgaagtagttgttatattcgaaagattatttttcgaagcgaaagtctttgaaaaaagaaagtaaaaaatgaggtatttatgtaaacaaaaaaacacaggagatagtgttgagaaaaagataaacaaaaagagaaaaagaaagagaactaaaggaagaaagaaagggagggaagttggggtgaaaggaaggaagcgagagaatttaatgaaaagagagagagaaagagggagaaaagagagaaacagggagagagtagagaaagagagaatggtagagcgaagagatgtttagtaaatgatgacatagagacaaaagaaagagacaggaagagaaaaggagacaaagaggagagaaacttaacttggatgaaaaacaaatttattaattaaacctctatcaaaatttgtttaaattatctaaaaaaccccgaacagttggcgccgcgaagcggcgcctatcgctcgtctagatatactaagtcggtgctgtacataaagctttttgaataagatttttattgacacgaaaacttacaaataaaaaaaaaaagaaaattgctgaaaagaatatttatagaatcgtttacttccgaatttagtttttgcactgtatattactaaataatttttattgttatttttatttaatctaaaattattatttttttctttaaaatattactttgatatgaccatgagagatcaaagataagtaagtgggagagagagaaagcaaaaaaaaagggaatgaaagtgagaaagatagagaaatggagagagacagagagagagagagagacaaaggcaaagaaaaagagataaatacaaaaaagaaacataagaaagaggaaaagaaagagagatagaagtagatagagacatagagagaagagagataagggaagcgggatgtgggagaagagaaaaaagaaaaagcgaggagaagataagagcaagactgtgagtgagaaagagatagagagaa

SEQ ID NO: 2298 - DNA, 2076 bp, Heterodera glycines
aaaaaaatttttttttttgagtttttggtcgacaatttttaaaagggtcaaagttttatagaattttgcatgctaatggattttcgctcccacccagcgccggaaaccggcttaattttgccctaattgtaaaatcctgcccaaactgaacatgtctaaaccggttttttccccaagaaatgtcagaccggttttcatccaatatttgctactaccctaatttttcaaaaaaaaaaaaaattctgacaccaagttgcatttttcttatacatataaccgaccagcggtgctcgactactggtgctgttcgcttcctttgtgtcagcatttttgttgttgatggtaaaattgccaaatttggagattttgctaacaattcgttggcccctcattcaaacggtgttttgtccaataatttgtagagtcaatttttataattttaatgggggaaaatctaatggaaaaattgaaaaattaatacaagtgcaacaaccaatcccaacaagccaagccaagctcggctctgacggtaaaaaaaaaagaaagaaaaaaagcgccaaaaaatcattgatttaataaacaaatgccaaattcaaatataaaacaaagtgtcttaacagtaatcaaaattcatatttaaagatcaaagccccccccccccccttaaaacatttcgcagcagttaaaacaaatattttcacatcgagtttaccgtattatctctaattatcaccccggggggattattgttcaacctcctcagaaaggggggattattagatacggggggataaatggagacgggggggattatttttcaactgattttttagtgaaaaatttttgaaatttttttaaatatgtcgccaaaaaatgtaatcgcgtcaaaaaacaatcattttttgttgcatttttgttaacaaatttctgaattttgcgggaaaaatttgaaaaattgcaaaaatatttacaaaacattgacaaaaccccccaaaatattcaaatacgaatatgaacctttcagaaaattctgaattgttaaatttttcattttttgagccagggaaatttatgctaatttttagaaattaataagaattttatttgtttatttgatttttcgagaaatagatgaaaaaaattaaaccagaaattatgaattttcaattttcagaaaaaattcagcactccattctgaaaaggagttttcataaattaaaaaagaaagaaaaatctgtaatttttgcaaatgaatttcgattttgaattaattaatttttataaattttaaaaataaattatttcaaaaagttccatttatcccccggggggataaatggagacttattgttcaacctcctcagaaagggggggataaatggagatggggggggggattaatggagacggggcgataattagagataatacggtatttgagttacaattgacctacatataatatttatatgaaatttttagcatattttaaacatgctttttcaaggtcagacatgaaaaaaagtaaacaaaatttattggcgatttgaaattggggaaaattttcttgagtttgacatttgaacaaagcctgagccttgataccataggttgacctgtaggcccacaaaaaatccaggccttgtttcaggtccaggttgaactctattgtattatttatttacagttttacacccaaataaaggggtgggattaaatgtttttgaaaaaaaacaatcgcataaaattttaaagacataaagcaattataaaaaatggcaaataaattgaaaactgtaaaaaaaacttaatattaacaaccatgacgtagggattggcatttacagccagcagcgacagatttactcacacttcatcaacaaaaagggaaattgaactatgtatataaatgcgagaaaattggcggggggggggggggagtgaattttcgggggtgggcgatggtctcacaagggtttgggaacgccgggggggggatgttttgggaatttgggcaacgggggggggggggtataggtagagtggggtaagtgatttgtgagtaatggtgatggg

SEQ ID NO: 2299 - DNA, 4831 bp, Heterodera glycines
cttcgccccccccctattcaaagatggctgcggttcggggatgggtgggatatgtgtgcaccgtccgtcgttgatgagtgtgtgtgtgtggatgtgagtaaaatgacaaaaaattcaaattcggtttttggcgccatccaacaatcgtgccattggatgaagggggagagaaagtggaaaaagaaagcagagaaagaagaaaagggcgcgcagacaaaaagcttcggcagaggatttgagattgagcgcatcaatttattggatgggaaaagaaaaaaattagactttgaaattgaaaaaaaaaatcccaaaaatttcaaaagcatttttccacacttttgttgaccagtacaacctcaaaaaacattaaaaatggcaaaaattttgttaaaaaaaatcccacgagggcatggaaaatcttttagatgaactccgattctcagtctcgggctcaggttcatttgtcgggcttggtttaaaatattctcgcactttcctatgccctgggaattttactcaattttaaaaatttaaaaaaataataataatttgtgaaccccagggaacaaaagtccattccccctccccaacctttgcccttggtgaccccatacgcaatggtacgttccattgaaaatttaatgtccatttgatttataataataaattttgaaaaaaatttttctttactttcccatcaaatgtcattaagtatcaattgctccatcagttccatcaaaacagtgtcataatttgttttattttcttcaaattttgaccttccatcatccatccatcaattccatcataaatttgggcgcccaattcattcattcgttacggtctttagcccccccccccccccatagataagaaagaggaaaaggaaaaggaagcaatgaaaatttgtttgttttcgcccaaattatttacaaacagttaattcaaatgattttctttttaattatgccttaattgagaatcaataaaacctaatcggattagctaaattaattatgcattgatttgtttttcaaaaaatatatatatttttgtttatctgtccacctcctgaaaaagtaccaactgaaaattttcaaaatcagtatttgctcgacaaaaaaccagcgtttggggttaaaaatcactattttagaaagttttattcaaaatgaaaaaaaccatgaaaaatattttttttttctgcggcgagctttttttggaacagtgggccggcgccgcctcgaaaaatttttattttgaaagatagggtaaggtgaccggaaaattctgaaattttgcccgattttttaaacaaatttttcaaaaatgtgattttggatcaattttgaaaatgttaaggaaattttgggccagaatgtgccgaaaggcgcagccgggggaattttgagatttttaatgaaatttcttaagaaaatagtataattttttggaaaattttcccattttaattaaaaaagctacagaattaatatacaaaaccatattaaaaattattgaaatgcgaaaaatatttatttacctatatatttgttgttaaatttgttgttaaaaaaattaaatgcaagccgcaggattcgaacctgcgccctccgaagaggactgcgacctgaacgcagcgccttagaccactcggccagacttgctgatgaaaattacgaattacccttcattaaaaggcaattatttaattcatcaagataattaaatcagcagagcataatgaatgaataatgataaataagaagcatataaagaaaacaacttaatttgccaattagtggaagaaaaattgtaccagaatttagtaaggcataatttcctgggaataatgttttaaattttttataaaattttaaaatctcagaaagtttaaaaaatactcggaccatcggacaaatcggacatcccttaagaaaaagaatctaaattttttattatttttgatgattttgcataaattagaaaattaaaattattttaaattgtaattttttatggtacacaacaagaatttttaaatatttctcaattaggtaagttgtttaattataaataatagaaaagtatttaaataaattttggcagaaaatgaaaaaaattgattttccaaagcaaatcccgataatcccgagtttttaaattgtcaaaacaacaaaaaataaaattcgttcacagaaaaaaaagtggctcaagtacagtttatgcgtccattcaattttttatgcgtccaatcaaaatttttatcaggtggctatgtttcgggtagctctatttccgttgacctgcactttaactcaacatgtgggatgccagggcttaatcattgacaaaatgggatatttaagatcgaagccttggcatttttgcggatgctctaacacaacaaaaactgcgataaagatggttgtattaacgaatttagctacatatgaaaaggaaaacaatttccgtgaatataactagtaattctgagaaaatattcaaaattttttaaaattctagcaaatcttggtgtgatacaattcgaagtattgattggacgcataaaagtcgattggacgcacaaactgtacttgagccaaaaaagtacttaatcatcgaaataattgaaggatatcgacaaaaataataaatttaaaattttgaaaattggaaatctatcgaaattttgaaaatttcttttaattttctttaatcggattaaatttgcgtattgtagtgacggctatcttcaaaattgcagcaattatgggatcagtgaactttgttggaatttgctctttcatttgataatattttgtcagaatttccatttttggacatttgtataaaatttttgccctgtaaataaacaaatcattttgaaatggtaaaatatacataataaaaagagcccggatttttaggttttaaccttttttcacgaaaaaacacattttctctgaataattaaaattttttaaattaatttacacccctaattttcaagttttttttgtgcatatttggtgcatagcaggggtgggacaactctcgcctctcgtctctcgcctctcgccaactctcgccatttttggtacgctcgcctctcgtctctcgcctctcgttttttgggacgagaggcgagagttgaaaatacacccctaaagattgaacttttgagcagccagaaaaattttcaaatttacgcgaaaaaaaatcttaaatctctttctttccttccttaatgttttctctatttttggatagctccaattcaaatatggtctgctggctaaaccttctgcctttcattatttttctcttgggttcaattccccaacggtacagaattttttaaataatttctttaaattattttcaattgaaattttaattaataaaaaatatttcaatttaaaaattattattttttctttttttaaacagcctaaaactgcaaatttaaccaaaactttgatcattttttgacaagttctgttaatatattacactcaaaattttagaatttttccggcggcgcctatcggcggtgccgattcggcaccgccggaccccgcacccaatgttccaaaaaatttttttttggaaaaacagcgccacaaaaaaagcgacttaaaaacaaaaaatttaaaaaacaagttttggtcattttttgaataaaatctgttaacaaatccgaagacaattttcaaaattttttcggcggcgcctaccggcaccgcccgaccccaactgtccccgaagttttaaaaaacgcaccgcaaaaaaaaggtggaaaaaatggacaaataataaagtttgtttctaaaataaatatatttcatgaaaatattttttaattttcatgaaaaaattttaaagatttttgtttggatttttcatgacttggactcggtttaaaaactaggactctgacccggctttctgtacccggcaataccctgacccggtatttgcccaaatacccaggcccgtacccctaatttaatatacgattttgaagttttttaaattaaaaataaggctacagaaaaaattgaaaaactctcgcctctcgtcctctcgcctctcgccaactctcgtgtttttggggactctcgcctctcgccaaactctcgctctcgtctttttggggactctcgcctctcgccaaactctcgctctcgtcttttctgagacaagtcacacccctggtatgaagtgagtacgcccccaacgccaatttggtgtgccacaaatgcaatgggagcggcacaaattgccgcaacaatggcacccgctttttcatgtgcgcgcaacacggtgccaacccgtgggtcctggggggggggggggtggaaaaaaaaattgaagaaaattaaatccattaatttggtaggctttttctcattttacggggccaaaaccattgacaaatggtaattgtttcccggtgatctgctgaaaaagaaaatttgaatcgacgacaaatttatcgaattaaaaaagtataaaaaatgagaaattcatacaatggtaaattttttgagttcgaaattaaaaaagcattaaaaaaaacaagaactcgtttgcacgagagcggactcgaactttagcttttaaacagtggactcaaacgcagtgactaccgaaccacgacaccagttataatagaccaacaaaattcataattaaaataatttttgctgatcaattaaaaagctaaatagacagacaaacgcattcacaaattagcactttcattttattagccctttatttattggttttgatttctgaaaaacaaatctcttacagcggccaa

SEQ ID NO: 2300 - DNA, 1768 bp, Heterodera glycines
ttttggcagccctttttgcattttttggtcattatttagttaattatttctggattttttatcactaaaaatcccatccctagtttataaatgatgaatgtattttttgtgattctttttcatatttttgcacatattttgaatgcacatacataactttttttagaagcaaccaaattaaacattcttggtatcattcggtagctcttagtaacctctgttatcctgcaaaatttcaagaaaattcgttatgtttcaaaaaatttatggccaaaaaattaaaaaaaaattgcttttctaaacaattttagccatagcttttttgaaacccaacaaaattttttaaaattttgcatgctaatagagaacgcgtagaactatcgaatggtactaagtgcttctttaaaaaattatggtttccactaaagttgcaaaaaaaaatttatggttgtgtcttttttttatggtcgtgtgaactgcaatagagccaaattcggctaaattcccaaattttcaaccaaaaaacccaattcaagtattgctgatctgatcacgaatacatgatatccattcaggttaattctaaatcacgaacgtgaaaacaaacaaaacttgaaaattcaacaaaaaaatttcaattgtatgcctagataagcgaaataaaattttttatttttttccgcatttttttttttgttgatttcgagttcaggattcggaagttgttctgggtgtgtgtcatattcgtcagtaccgaaatgacccagaaattcttgtttttcgaggcctctaccccttgaacttatgtatttagcagtcatttacataaaattaagattaaatacgtaactattatgaacgccaataccaacaacaacaaatccttgaaaaatggcggtcgttacggtgccacggcaaatgccaacaacaaaaaaggtagaaaaaaattgaatatccaccgaggggagaaggtgaaggagggcaagtgatccaacatctattttttgattttttggattattgatctccaaaaaaaaattttttttttaccgaatttgggctccataaccgattttgaaaaaaagttatggatttaagctctgtaatggtatgtatattttcaaaagtaaccaatttttcaacaccttttcagcgacaacaattctaaccaggcccgtaacgagaaaaattttcgtttttttcggcgccatggaaaaaaaatgaaattttagccatttttttccaaatggccattttgagaccaaattttggggaaaaatgaaaaaaaaaattgggttcatcagtgccgttaggtgtcgccggtgaaaatttcgtaaaatttagcatcaaatgcccatttttcttgaaaaatttttaaatttcatttcatgggggtaagcacgtcccccctcccccctcgccacggatatgtgcatggacttagcatttacttactaaaaaaaaaaaattctaatccccccaaatttagccacgccccatggtacgcctcccaaattcgtgtactcccctggtaggaagggcaatcgccgtttccgtataacatttgtgtgccaaattgattcggatgccggcctggagcagtacagaaaggacaacgcactgataaagaagccgttgaagaatggccgaatttatttgtcatgttcacggaagggatgcccgtacaaaatgactgccatcaaaaatggtcggtttttttcgaattttttttaaattttccacttttttttatttgtcagtttttaga

SEQ ID NO: 2301 - DNA, 1957 bp, Heterodera glycines
  misc_feature (1935)..(1935): n is a, c, g, or t
cggagcaggacaaaactccgccggccgaaactctgccaaaaaatttttttttaatttttcaaacttagaaattttttcttagaaatttggaagaaaaaaatttctaaaaaatttccagcgattttttcaagacttaatgatgaaaaactaagttttttcaaaaaattttgaaaaaaaaatcgctggaaaattcttagaaaatatttttgtcttcgtattttctaagaaaaatttttctaagatttttttttcatgaaaaatttataagtttgaaaattttttgcctcggcgggttatgtctcggcggagtttcggcgccggagttttggggtgcaccaaaaaatttcatcatttaaatttaaaaaaaaagttggaaattcctatttttcagggcaaattgctggcccaaaaaggacgacaaaatgctgctgccgcagaaattgaaacaataccagcaaggagttgttgttgttcaacctctgctgctgctggtggcgccaaaattcaaaattccgctgaaccgaagctgcccccgccggcggctaaattgttcgaattggcacactttgagcaagaaataaggcaaattgcgacaaaatggaatttgaactttagcgaaaaacggtaattaatagagaaaaaaaaattaattaattaattgggaggtaatgttctaactgtctgtcctctgccttttccacactctttcgctgtctctctcactttctctcttcattttatggagaaaccaccattctctcattggtcctctaactgtctatttttttttatttttctaactcatttctctctctacacttgcggtcggccaaattatactctcgtcgattctctatgtcctcttattttccacattctttcgctgtctctcttatgctctcgtcaattacactaactgtctgtccttttctttttcacactctcttgtcgtctctccttttttactctcttcatttgtcaccctctcattaatatgacagtatcggtattcctaccatatttagtggttcctatttgtttcttccaccgaaggacaccaaggcgttcaaggacggcgttctgttgtcgctcactgaccgtggcgatcacattcgtgtgagttttcttatttttccaaattttaagaaattttcaaaaattcgcccattttttaaattgagagggaatgcttggttttgccagaaatttcatttttttgattgaaatttccataatttttcatacagatggatgagttccactctgcacgttcacaggtggataaaattcagcgttggccaaaagagcgtggccatgcgactgtcatgcgtctggccagtgatcagtgtgccaagatgtttgccaactcttcctgatcgtgtgccatggattattattgttgatgaaatgattaagcgacgaaattttgatcaaaatccaaataacattttagtgttacttttttccttgtttttgattttttttttcctttacgtatcacttttttttttaataattgaacctttttttgtcgttgataaacatttggcaataatactgttctttttctcccccacccccatttttcgaaaaaaaaacaaataaaaatttttataaggtcgtaaaacgcatttcctagggtttccgtggggcggggacacctgatcacgaatctaagatccatttgtactaaatcgaattagaattcaaatcgaaaattcaaatttttcaattctcacatttttgctcaaaattggttccaattatcttttatagaagcattgttgctaccttcctgttctgtgtaatttataattattaaaatagaaaattttttcgattgaaattcaatggaaaatcaaataatactttaaaaaatttcaaaaaacaaaaaattcaagagttcttaaaactttaaaaataagttttccaaanttaattgacaattttaatttct

SEQ ID NO: 2302 - DNA, 985 bp, Heterodera glycines
  misc_feature (965)..(965): n is a, c, g, or t
tatatattaattataggctgtgttttaattaggattattattagtagggctgcgacttttagttttctgattttccggaacacccatcaaatcacggacaattatatataaaaaagctgataaattaatgacaatcagcaataattgaccatataaaatatgctgtaaaaaagctgtaaaaataatttaaactaatgcacctgaattttctgacgaacaaacaaaattttttctgaccggaaatccgcgccaaaaagctaattaagcctattagattttaattatttttcaacagaacagcagtcaaataacaggtgcttttaaaagcatcaattaaggcttgtacgaaataattttctaaaataaagtatactgaaattaattaagcgtcagattacaatttatttaattcattttttttttgtaacgtttctttttcccatgtattgtaaattgaggaaattggttaattaaattggaacaatgtgaaatcattttctgtgaaaacctattgaaattaattttaaaaaattcagaaaattcatttaataacctttttaaataaatttttgacgcattagcaaagtatttgagcagttgtcatttagccaagtttgaaaaaattgtttcattctattaatttttttccataagccaacattattattaatttaattagggttttaatgaaattattttaatttcaattaggtttttaatgaaataattttgtttcatgaatttcgatccaattattatttttttgacatgaaagtttggccaatttttttgggcattgccaattttagtgatgccatcaattttattgtttgcccattcatttatgtcatcatttaatattctacattttttgccttttatggtaaatttattttggtaactttacaaatttgcccttttattttcctcttttatgaaatttatcctttatccatttttcattnaattttgggacaaatttatg

SEQ ID NO: 2303 - DNA, 1662 bp, Heterodera glycines
aggattattattagtatggctgcgacttttagttttctgattttccggaacacccatcaaatcacggacaattatatataaaaaagctgataaattaatgacaatcagcaataattgaccatataaaaatttactttaggctgaattttaattaagcttttgattagttaaaggttaatttttttttgtagtttatggtccttagattttaaaggattcccatcatgccgagaatattatgctgtaaaaaagctaaaaaaataatttcaactaatgcacctgaattttctgacgaacaaacaaattttattttcctcttttatgaaatttatcctttatccatttttcaattaattttgggacaaatttatgaccaatttcattgcttttaatttaacaattttgaaaatgcttttgtttaaagattgccattttttcctaattcttagatatttcttttagtgtttttcaaatttatttttgatttttatttataaatttttttaaattttacatagcaccttttaatataattgaaaaattcccggcatttttcaacactatgttaactttttaaacattcactcaccaattaccaattgagctgttgtttgacaatttccgttgttctccttacctcgtcgccctatgagaagcatcggacggcagaggagtgccgtgcttaaagatgccgtcatttaaaatgcttttgttttgccgcccgagacgacttttgaacctttgtgccatccggcaaaaagcccggaaaagccccccttaaagggcagggcgaggcggggggggggagtaaaagaattagcctcttaaaaaaaatgccggaattttaaattgtgccatgccacccagctacccacccatccctccccggagggcatttttccattgtcaattttgccaaaatttttggtttggtgttgagataagagaagagacggacagagaccaaccggtgatgaaagcaatgcctttttgttgttgtgccgtcctccttcccatgtcgtcgcctccggcgccctttttgaattgaattttgtctcccccgcatatttccttccgcattttatgccattttttgttttgttatttatttctatgtaaagtgagacataacacatataaggaaaattatagaataaattggggctaatttttgatgttcttgcgataaaacccaatgaaacattagaggatttagtctatgaatttatttttctattttaacaaaaatttatattttttaaataaaaataaaatgattcgttaaaaaattaaattttatgccaaattatgaggtcaaaggctatcatttcgtcatctttattcaggaaaatccatatatattaaaattaacttttaaacatatttttcttatttttttttgtttattatatttaattcgcaattttatttggaaattttaagctattcaaatgactactaatacaactgacagcaactggaattcttcatttgttctaatgaagatggacgacaacgaccaatccgagcgcgattgcgttgagattaaagtaagtttttatattttggaatatgaatttataaattttatattttatttcgattataaaatgtgaatgtcctttaattagaagcttgtgagttgaatatgaattaattatg

SEQ ID NO: 2304 - DNA, 1575 bp, Heterodera glycines
  misc_feature (33)..(33): n is a, c, g, or t
  misc_feature (42)..(42): n is a, c, g, or t
  misc_feature (1554)..(1554): n is a, c, g, or t
aaaatcattttgaaaaaaaaacaaataaaaatnaggggtttnttggaaaaaatattaatattcataaatttctttttttgagaaaaaaattcatcccacaaataaaatttatttatatgtccaattttttttcttaatttaaaaattaattccaaataaactcttaagaatttaaatattttaaaagttaagccaaataaattcaacggcatgaattttaatgaatttaaattattttaaatttaatccaaattttagggtgtaagcctttgcttctccacgttgactctaagcgcaatctcaattgaccgttttcggcttattgtgacgccacttcgacaatcaattcagaagcgttgtgcatgccgtattgtggcacttaacactgccatttcactgatcatatcgtatgataattaaaaaaaaagtacggtatttttaatttatttattttttcttagacttccgatgctgttcacacaaaaattggacacctatcatcgtttttgtggccaattttgcagcgaatattggggcagcgaactcggcgcaatggcccgaagtgcatacggtaatatattcggcggatttttgtacttaccgtaactcagcagacaaaacattaaaatctttactattaatttcaaatgtcgctaaaataaatgaaaaattaagcatttggatttatgataattatggaacccttaaatactgtaagaaaataccgtataacttttaaaccttttatcgtatttttgacataaatttcccaaatagcgaaatctaaaaaaaattatattcaaaattattgaaattaattcttaaggaacgtttgtgttttttgctcaatttgtgatcccgtttctgatcatttccacttgctacgtgatgatttcaattaaaataaacacggtaattttttttaataaattaattattttcataattttaaatttataaataaattatttccataattaagggtgttctgacaaagcgcacatcaaccgacataacaaaattcaatgacatgagcacaagcggcagcaaaatgacaaatttgagtgaaatgaggtggtaaagaaaattattgcatcaaaaatattataaaaaaataaaaaaaatttttgttttaattaggcatttgaaatttatttttaaaaaaaaatcaattttaattaaaaaacaattaagaaccggtgcacggctttcatcagttggcaatgaggaatgcacaatgctgttgactattaatggcacaaatagtgccaatgacgcactacaaatagccatggagcagaagaaagccatactgaacagacggcttaggaccaaccgaatgctaataggtagctgattttaattaattaaatgaaatcagattcaaaagctaattaaaaatattaaaataagtttagagttttttaaacatttttaaaaggtttacaccaataaattgtactaaaaaatattctacataaaagaccaaagctataatttttccacaaatctctattaacggcctccgtcagaaaaatggcctttttgaccccntaagataggaaattctcgggg

SEQ ID NO: 2305 - DNA, 1824 bp, Heterodera glycines
  misc_feature (1735)..(1735): n is a, c, g, or t
  misc_feature (1760)..(1760): n is a, c, g, or t
  misc_feature (1767)..(1767): n is a, c, g, or t
atcacttaattatcaaattatcagtgaccagagtcattttacattaaatatagacataatatcgttattcctcgtgatttaaattgtttaggcaattaccaaggctattttgtcaccatgaaacatcccatttggcaaattggcctatacaaactgatggccaatgacaaaacgctggtggaatgtttggactgcaaggagcgaaggcttaaatcagtgcttaaattgtccaatcgaagcatcaaaggcctaaaagtgcatttgttcggcaaacacaaagggtcaatttatgccgacaaatatgccaacattggcagaggcaagttgcaaaaattaaataattatatctaagaaaattctgtaagtttcattcatttgctcaatttaaacgtaattaaattgttttattaattttaacagaaaaaatttaagccttttagctttttagtcgtttttattttaatttaaaaagtttattagaaattaaataaagatgttcttttaatttaatttttttaaaattaatatttattttacattcaatgcactttttttatatcaaaaatgccaaaacggaataaaaaaaaattcctcaaaataagcatgaagccattttcttttttaactcaaagtacgggctttttaaattaaatttttaaattttattattattgaataaaaaaaatatttgatttttacttaaaatgaatgttctacttttattttgtcccacatttttaattttgtatttaattttcgaattctctactattaacatatttttattcatattttaaattaatacctaattttattttcacatatttttccaaccattttaacaatatttattttatttcattttgtatttgccaaatttaaaaaaaaaaccattttcatttaaaacgagtagttggcaccgcttcgcggtgcccaactactcttcttttttttcttactgtacctttgtatgtactccttttttcaatctttttttttattatacaataataaataataaattgtgaaaaaattcatagaattaattaatagattccatcatggaatagctttaaaataatttctttaaattattttccaattgttgggtattcaaggttattcaaatgactgttaattgtcttttcttcgtgcacttcaatggtattttcatcataaacaatgagtgtgactacaccaacttaaaaattaaaaatctatgtatttatgaaattaggtagctattttcacccaaaaatttcactatttaaaatttaccttcgtttacttcaacgtttgtcattttcaaagcaatttcctgtccaattttgagtttgacactgttcggaaaaatgagttgagctttattttcttggtcaatgaccattgttccgtcttgtttttttgacaaattgattggagcctgttttcttgaaacactgagtcgcaaattgcctataaaaacatttttaatactaaatttctattttatctagttacattcacataatctgcgagtgaaatcactcaatttcaatgccagtttttccggtttctttttttcaacaaaaccaatccgtgactcatttgtaaagacaaaagaaacgtcttgattttgagatgtttgctttgtgagcaaaccacgaagttttaacgtagttcccttgataaagaaaaagtttaaaatattttgtcatttttacagttagggggaacgatgcttacagttgaaggnggacgattttttgccagattatcanagaatgngaaagcaaaagcgagtttttggagctttcggggtcgctgatcatgaatatggcatac

SEQ ID NO: 2306 - DNA, 1197 bp, Heterodera glycines
taacatgtaaattttaaaagaaatagagtacaaaatcccaccccgggcacagttaatcccccaacttttttaacgtcagttcctctatggggtttaaaggtcactgatctgcccatataaaccacgaaagcgaagaaataccgaaaattcaaaatttgtagtaattgcccaaatcaatccaatacacaaaatggtcattcactggtgtcgtttttcaattaaatttaaaaagcttccagctttgccaatttcgctgaatcttaccgtcttttgaaattttcaatatttgattcgaattcggctactataaagttcacgtcaataattttttagctaagcactacgaaacccctaaacttgtttaaaacatctttttaaaacacgaaaattttcagaaaaattgataacgtaaaattaaagtttccgagaccggaatggataccgaattcctgatcagcagccccaaaaacctataaattgacatttttgtggtgaatctgtataactctcaaaaataaagcattgtgaagtatggtggtctcgattttttttgagcaaatttatctttttatactgaaaattggtattcgggggttttcaaaggtgccgatcacgaatctgaactcaaatttcttatactcatttaattaaaatttcatcaaagttttggtcctactttaaatcatgtataaatttttaaagattgataaaaatatattttttgaggttttcggggtcgctgattacgaatatgccatcatttaacttctgccaaaatctaagctcttattttctataaaatataagaaattaaatttgcaggctttggtaatttaaagggctttttcgaaatgacatgaatggctcgcttaaaaacccacctttgcagatcatctcttacctattcctaattttagcgctgatttcgaatcaagcattaaatttttgatgtgacatctttatcacgtgagattttacgtgaaaacaacgcggatcaaaaaaataacaccggatacgcaatcagcgctaaaataggcctataaaaaaattttgtaaaaaaaattcaggtaggaggggggtgacaaaaagtaaataccgagaaatagttaaaattatatgaaaaaaaaagcatacacttgatgaaaagtcatattaaagggagtcagatgtcaaatctgacgtcatttttgtgatcag

SEQ ID NO: 2307 - DNA, 4688 bp, Heterodera glycines
cctgatttatatataggattattatttatcttttataaatttaaaaaatatagctaaattttttaaatgatttttttttgtcttttcgcccgcttaatttcttatgtttattaaatcagttcctattcaatcagcatcaacgcttactataattaaattctgtttttttttcacttgtctgtagaaaacaaccaccctttttgccaaatgcaatttgtaatttttccgtttttctggcattttttaatggcacatcggctgggccgaaaaaattctttttccttcattaataatgtgtgtctctctctctctcttctggtgagagtggtcgtatattattaacatggataatgtggactcaagcaaaataagaaaagtgcatcaacatttccatgtccattaacgagttttccgagcaaatattttcattttttttcttcaaattcaataaaatttttctattttatttttaaaatgcattaaatttttgaggaatttccaaaattttgaactttttgctattattttcaggaatttaaattaaaaaaaaatgaccttttaatgatgaatttcacctattgaagcattgagtttaaaaagtttcaattcatccattttgagaatttaaaatttaaaagattggtctgttatttcttttttcagctaattttctttttatgatttttttttgcccaaataaattaaaactaattaatgaacttcacgaactaagaaaataattgtatatttttaaattttactaatttttaaattttgtctcaattttatattttctattttgtgtttaaagatggcgaaataattgtgtgttttttcattccatctccctcataaaatcaaaataaattggtctctctctctctttggcggcagcaataaaaacaagaaatgatcaaaataaagtgattcaatttccccattaatgggacgatataaaagagtccccattttggaccgtaatgttgttcttcattttattttttcatgcaaaaaactatattaatcaaaacaaaatctttttcttttattaataaaaataaaattattttaatttataaatcattttaataatattttaattaaattttttagtcctaattttttcaaataaacattaaattaccatatttcctataatatagcctcctcccctgaaataaagcccccgttttgaggaggggggttgaaaaatagaccccgacccccaaggggctctatttcaacccttggggctctatttcaagaaactcagtacatttatctttattgtctgaaaatattatacattttttggaaatttaattcttttaaatttcattaattttcaagttcaaaatattttattaaaaaaataattgttcagccaaaagccctaaaatgagtacacgtgaagaaattcaagcagtttgtgtgcagtccttaaaacagttgaaaatcggtgtgggtgaagaggagttgcagaatgggaaggacttttacaaattgtaaaaattaaattttcaaaaaaattttttgaaactttgaaattttagttttttcaccaactatccaaccccttcgcgtgtattttaagggagcagaaaaatacgaagcggaggatgtgcaaaagtcggaacgttttgaaagtaaaaaataagttaaataaagaaataatattcatttgttaaaattgcataattaatttactattaatttttcaaatttaataattaaaattaaaaaattgaaattattttaaaaattgcggaatctaaaaatattaacaaatcttaatatataaattaattatatttaaatatttcaaaattacataatctaaacaatattaaataaaaaatattttataaaaatatttgcagaatctaaaaatattaactaataatatttatcttaataatagtaaatttaattatatttaattatttcaaaattacataatctaaacaatattaataaaatatttacatttataatgtttaacaaaaatattgtacttctattttgcagaacaaggacaacgtattcttgttgccatgcatttgattgccaatgtctacagcaatgaggcaattaatttattcttgacataataataaatttttccatttttataaattaattatttcatttttttggttcggctctattagtgtgagcgccctcaaattttacgtttcacaattttacagatgcttttcaatgcgtatgtgcgcgagaccgtgaatcgtcatcgccagttcaaaatggagccatcattatggaaggcaagttggcccaaaaatttgtaattattaatttattaaatgacataattatggtttcattcctatcactttaatatgacaattagtgaaaaaactgggggcaatttgtgaaaaaagccattaactttaattatttttgtctcacagatatgagtcccttaatatgctcttattgtctttgtttaaagaatatcaaagtcaattaatttgtttttctagtcacaccctaattttaaattaaattttgccaaaaattttttaggcattttggacagtttggaccggctttctggaaacaaaagttgatctgacggaacaggccaagtcggcctggatgtcattgggtgaggattttgccaaggaagcgcttgcacatttgaaacgccttggcatcccgcattgattcaacaaattaatgaactccgaataatgtcccaccaattattaaacaatttaaaaaattgacatggctttttgactgtaatggattattatttggtgaataaaacaccacaaaaattaatactatcagaaaatcaaaaaacaaaaaaaaaattattgttaaaataagtaatacttatttattcataaaaatcatctattacagatgttgttattcaaaatattaagagataaaatttatgataaattgcttatactcactttttccgtaatcagtaaaaattttttattataatttaattagcatttatgcttaatgttcagttaaaggcacgagaagcaattaaatgcagggttaattaatattaatgtaattttcatctgcccctaattagtttagcactgttatgaattttttaaatgaacatcaaatctcgattttgtttttttcggattttagaggtaaccatcacgaatagggaatccatttctgccaattccgaaccccgcacccgaattcgaacaaaaagccaaaagtccaaattttcgaaatttataatttttgtttcaaaaaaggcgtaaatgatctcttattaaagtattgtggatttcagttagtttccgtgtatttaattaaaccgattttgaaccaaaaatgctaatttcgaaatgaactttcgactttttgttctggtgcacggttaggaattcagaacatttgttcttatagaattttacttttagattacagtatcaatgctacagtactttatttaaaatatttgtatcactgacgcattctcaaatgacgcattttccgttcaccgttcatggttatttgaaattaaaaaatattcttcatgaaaatcttcaactaattaattttgtctcattaaacttatgacgcttttccattttttgtagcaaaaaaaaaaattttaaattaatttcttgagaaaagtctagtgcaaaaatgtgaatgtacctaatgttatactggtcttacaaaaatcttacgcacacgaaaaaaaaatcccaccattatacagactaatttttaattgcccaaataaagtgcctaattaaaaaataaattaattcgtggaataaaacatgcagcacttgtgttcacatttcacgctgtgtgtgtgtgtaaaaattactaataattatcattaatttcgatgtacatcatgccaaattctcactcaaaaatttttgccaatttcccacaaaaaatcagtacaggaacaaaacatttttggcattatgtagcgatggaaacgtaagtgccaaccaatatatatattagaatagaaccagaatttttaaaatttggcccaacaaaccaattattcaatttttacttgccaaaaaattaatttgcggccacaccaaaaatggcaacaaatttgaccgttactggcaccgttattgtcgatttgatcagcaccgggctgatcaatgccggcttcaagcagtttaccttcgtttgcaagctgatcaccgcccttctgatcacgcgtctgttgctgctcgcccgcttccgtcccgccgttctacgcgtgccggaactgtcccgcgcattgcgcacctttttgtgctttcacttggccggtgccattgtcacaatgccgtacaatgcttatgtgccaattgcgtattatacgtcattagagaatgaagatgtttgaatttttttcagaaaaattcttgattttcattaaattaaaatcaccggctccaaaaactgtaaaattgcttttgggacaaaattttcctgctaaatttggccaaaatttttataacttttccacgtagctccaacatcattgatttaactcgaaagcgctaaaggtcctctattagtctgcaaaatttcgaaaaatttctttaatgttcaaaaaagttacggccaaaaatgactaaaaacttgctcctggtttccgatgtactgctggccataactttgttccgacttaacgaattttttcaaaattt

SEQ ID NO: 2308 - DNA, 597 bp, Heterodera glycines
ttttatccccccccccccataattaacgggtgacgaaataatatttttggcacatacagaaaaatgttgtgccaaattgcgtttaaactcatttgatttgtcaaattaaataaaattcaattaaggaatttaatttaattgccggcacttttgaattttatcccccacccgcttaaagatttgttttttttcattttgtttccaggaaatggaaaatatggcactaaaatttcacatagaagcctaattttaaaaaaaaatgaaaactgtcattggcaatttataaaataaaaaacaatgctactataaaaaaacaagcaaataaaatagaaaaattaggggtgagtgtccccacaaaacggaaaaactttaaaattttatgagaaaaatactagcaattttgaaattttaagcaattttcttaatcaccgccgaattttggaaaatagcaccaccgggtttttgggccgaaatgcaaaaaagaaaaaagtcgttagattgtgcctcatggcttgcccatcccctcccctcctctaaatttttctcattatgggcctggatggtggtcccattattccccccccccctcccaccgcc

SEQ ID NO: 2309 - DNA, 4730 bp, Heterodera glycines
  misc_feature (811)..(811): n is a, c, g, or t
  misc_feature (855)..(855): n is a, c, g, or t
cgtcagatttgccggcatttttttcttagaaaataaacttttttaaatttaccctcataattttattttattttttcaatttttaatcccccggagggtttaacagcatcaacgaggacgacgatacaattttgtgttgtgtttgatgataaatatgtggtaatgtgttttaaataccacaaaagtgtcgagactcccgacaaaatattctctttctcttcttcagcccattttcatggtatctcctttttcgcattattataatgtattatgcaaattcgaagagagaaataaaaaatcaaaaataattttaattaattaattttttttgtttattaaattcaaaaattttatcaaaattataaattgataaataaatattctgttttttttatctatgaatttttttttggaatatttttatttattttttctaagaaaataattttttttttaatataaaataatttttattaattctaaatttaaatttataaaaataaagcggaaaagcaaaattcaagacaatttttcttttgtgattgcccattttggctcttttttatttaacaaatttatttatttaaacaaatatgatataacagtggcagccaggtgtttttatttatttatttattttaccactattttaatcctccccattaagtgccaattatttcatttttcttcctgcatgtcaagcagttgtttttttaatattttgtctgacagaaatttttgttccaacaaaatcttattttattttattatccgaattccgattttttttttttggttaatttttttccanccggtgaaatgatgccaaaaatgttgcatcgcccgcaaatttcncaaatttatgggcctatgaacatgtcacgctaatcaaattaacccattccaaaaaatggcatttaaattttgtgaaagtttaatttgatgataaatgaatgaatgaatgacttttgcgcctgcagcagaactcaaaaattttgcagcgcaattaagtaaatttgacaaaatgcgtgaaagtgagaccaagggttgctgttgcacaacatttcgcgtgtgggcgagagagtgtgagtttgatcattctggtcagtgtcgaggacggtcctccgatcacatgcaaatgtgatcagaacgtgatgaccttatacacaccaaaatgggagagagagagagaaagagagagagagagagagtacggtataagcgtgagaatggagcgagatttatttctgatcaaaatcctcctctctctgctgatctgagttccgacaaagtagtcctggtcacactcaacaccctctaatggagagcgagagagagagaaagagagagaaagagagaaagagagagagagaaagagagagagagagagagaaagaaaaatactgcaagcaaaaaatgatactttctgatgaacattaattaatctgaaaattttaaaaaaatgattcattcaatttaattccaaaaggccaattttttcaatactaattgctaatttgccaatttgtgaatcacatttcaacaaaaaaagttgacaaaacattctcactttttcaaaaacaattttgatgacgacaacatttcaattattttatttttttgctgcgaaacatttcgccaaattttttggcgatggcaccaaaaataatttttgtcgttccattttccacctccattctgctgaacgccgctcggcggcgccgtttctgtgcccttttaccgccgtccgcccccgcggcgtccccccccaggggttttagtgattggattgggccgaccattgctggttgctggcccctgtgctgattatgtcatgattacagcctccctcaccaggcccatttcattattggggtgatttattgcccagtccggcgacggcggtcggtaaaaaaattgataaaatttatcaacaccaaaaaaatggctggccctccccgcccccgagagggggggggggacgaaaagaggcaacaaaatgttgcccggggggattataaaaatgattcgttgaaaaatgggtttgttgatcagagagaattggggctggggagacacatacaaatagatagggagggccaccaaaatttgggggatggaaatgggtcccaaaaattcataggtattttattgcaagccccctccccccgaggggtgagcaaaatttaacgggggaacggggcgaaaatggaggaatttttgatcaaaaaagcggttgaaaggaatcttatcaccaccaccaccaccaattggtggactgactaatttgataaagcgctaaaagtgcaaccactaaatgccctggggtgacaaaaaaatgtctgtttctgtgtgcgccccttccaaaaaacgcttctgtgacggacagcagcacagatcggatgggccgggcgacaacaacagttgggcggtggtggactttctccacccgacttaatttggccctaattagtaccccacatatctaataattaattattgttgatatacactgtggtgttcatgtgttgctaatggcctggaatttattgtccgtgctgaaattgatacactcttcccgctccttcccccctcattaattaatttattgtcactaattaactaattagctacgctttttcaatgcattttttggaaatgggtattttttttttaatttttgccaactttaacaaatgttgctaaatttccccacttattggcgcccgttttttgggatcacgcataaaattacagtatgccggttttagctttcctctttttttgtttactgtaactgtttttaattgaaaccgctatcgcccaccagccctttttaattcattaaaatttacacaaatttttttatttaggcggagtggaattttgcaaaaaaaactaaattagggagtaaaattatatggaaatccatattttttttcctggactctgggaggcctgaaacgtacgaaaaacatgtttttagcttggtttgaagcttctaggatggatttctatatccatattttccaaatttttccatatttagcgatttatgtccatatttccatatttgtccatattttggcatttttacccatattttatgtccatattttggcatttttccaaaaaacctctattagaacttcccccaacagataaattggctttttgacccagaaaaaccggaaaatttttcaaaaaatcagtttttagcaaaatttttttgaaaaattgttaaatttatatcaaaaataagcaaaaaatgtaaactttcggttttttggttgatgttctctttaaaattgctttttttcttctaaaacgagttcttataccatattcagccattttagatgtattttacttgaatttaatgaatttgaagaatttaaaaatttccacactcaaattggaaaaatttatgtccatattggccatatttcgtgattttatgtccatataattttattccctactaatcatatttgaataattttttaatcaaaaaatatttaaagaaataacatttttttgggtgttaatatcctgatttttcgctacaatttccgtatttcggattaatatttcgggtttcatattttttttttttgattggtgtccaccctccaccacctctcacctgctcgatctgtgcaggcgctcgtgacctatcaaatacagtaaccctgatcaatcgccgaggtgaccttctcccacttctccattttttccttcgccacaaaatttgaaaattgtcgctataaatggaaaaaaaatcagcctaaacaaatgtcaaatttaattaattttactccccaaaatcacaacaaaaaagaaacatttgaaaataggggaaatggggaaaaatagaaaaattggacaaaatttcaaaaattaaaaatttcctccgaatatattttgtagcgaaccaataaaattatgaaaaccattcgctataaaataggaaaatacgtcattcaaaaattaaaaaaatgggaccaaaatttcaattttcaaaaatttactccccaaaatttacacagcaaaaaatcaaattaagaaatttaaatttttgcttattgcctgcttttgttctacattttgctgcttcatccctctcaatccatccgccaatggactttgttaatgatgattttaatgatgatgatgagttgactctttactgccccaacttttcttcctcttccgattcctcttcctcctcctcctcgtcatgtgaagatccaaattttgccaacaattatcaccagcttttcacgggcttttcctcagcatcatcaccatcattatcagcacaatcatttcctctaccactactaccagcagcagaagcagcagcagtacaaccagaagccgccgccatgatgatgatgatgatagtgccacgggtccaatttttgtctcttctttttttagattcaatgccactttttctgtatgggttttgacattttttaaatttgtagttatactatattgggtaagagtgatatctcgctactgagacttgagattgagtttttggttcgtcacatttaaaaaattagggtcatatggaaatatgttttgcctgatttgagcaaagcattatgaacggattatgcgtgcttataaatgctttttactaattagggtcattagcatctctctctctctctctgttttctactccccaaaattattgggttattccgaccacttaa

SEQ ID NO: 2310 - DNA, 2410 bp, Heterodera glycines
acagcaaaaaatcaaattaagaaatttaaatttttgcttattgcctgcttttgttctacattttgctgcttcatccctctcaatccatccgccaatggactttgttaatgatgattttaatgaggatgatgagttgactctttactgccccaacttttcttcctcttccgattcctcttcctcctcctcctcgtcatgtgaagatccaaattttgccaacaattatcaccagcttttcacgggcttttcctcagcatcatcaccatcattatcagcacaatcatttcctctaccactactaccagcagcagaagcagcagcagtacaaccagaagccgccgccatgatgatgatgatgatgatagtgccacgggtccaatttttgtctcttctttttttagattcaatgccactttttctgtatgggttttggcatttttttaaatttgtggttaactatattgggataaggctatgtatttaatgatcaagagtgatatctcgctaccgagacttgagattgagtttttggttcgtcacatttaaaaaattagggtcataaaaattgggtggatatgttttgcctgatttgaacaaagcattatgaacggattatgcgtgcttataaatgctttttactaattagggtcattagcatctctctctgttttcgactcaccaaaattattgggttattccgaccacttaagtaagttgagaaatttctcggctttctctaatctgacggatgggtctctggcgcgggggatagtgtatttttgtagggaagtgttcaaatattaagtaggatttggcatatatttttgctgactcttcctaacccaacggaggaatttaatgggtgcacttcattttcacgtcgaaaatcttttttaaaaaataataaatttttttcaaataccgaattttaatattttttggaaaaattctaagaaattcaagttaaaaaaaattaaaagattcgtagaaattaaaaatcattttaaatttttatacttttcttggtctttttttctttatgttttttgaaaaattaaaaaaaatttcggcaaatgagcgaggagagagtggcaatttgctcccaattacgttttttcactaattgatttcttaatatattaaaaatcgtaaaaaataaaattaattaactaaattggcccccatcattttcaggaaggtgttattgagcaacaccaacagcaacaactgcagttccagtcgtcctctctgttgtcctgctccacaacaacaccaattagcaacaacaacacgagcaacgagagcattagcagcagcggcagtggcggtgccggcggcggttgtgccgaaacatgcgtaatgccatcctccgcccgcgacgcacaatgccaacaatttgtgatgcaacagcagcaacagcatcaaatgcagcagcaaagctcgcctccggcactgttgcatgagcagcgcaggcaagctgtggtgatggtggtggtggttcaatcggggcagctttttctggcattccgttcccaatctctcgctctctctcttccccggtccctcttttttcccctccctctctctcctctctcttccccgtctctctttcttcccctccctctctctccctttctatccctattttcttttttctctctttccccgtctctcttctttctttccctccctctccctctcaatctctttatcctctctctcttctccgctttacacttttcaatcccggttctcgaccgaattatgcgtccagttttgtggtctgaattctcgacattgatcctgactcccggcttaaccattcttttcactttctggctctcttttcctcctcagtttcggcacttttttctctctctctctctctctctctatctctctccatttgacactgatcactcccatttttgacttttagacaagccgcatcaatgctcgtggaagacctgaacacgctgatggagtgtgatgatgagggcggccccggtgatcagcgccagaagaagtgccgcgtgtgcggcgactcggccaccggctacaatttcaacgtgatcaggtaggacagaaagacggacaattttgtttgtggtgggagaaaatttagtgatcagctgatcagaggaaggaggaaggagctacgctaacaggaacgatcccaatgattttggcttggagagattttttttctttggtttttacgccacttttttgcggtttttttcaaaaagctttcgggagggtgcttggaggtggtatcaataaggaaaatcggttgatcctaacaatattcttttttccttaaatcatgaatttctgtaattacagtatacttcctcaaagaaatgccacccccatattctgccaaaatttgagcccctccccatcaaaa

SEQ ID NO: 2311 - DNA, 4108 bp, Heterodera glycines
  misc_feature (1861)..(1861): n is a, c, g, or t
ttttccttaaatcatgaatttctgtaattacagtatacttcctcaaaagaaatgccaccccccatattctgccaaaaatttgagcccctccccatcaaaaaagtcacccttttgggagccaaaaatcccattagaccttttttttaaattaattttttttaatttccaatatttttttatagctgcgagtcgtgcaaggcattcttccgccggaacgcgttgcgcccaaaggagttcaaatgcccgtactcaaatgagtgcgagatcaccgcgctcagccggcggtgtgtttttttgttttttctatatttaaaaaattaatttaaaaaaataaatttttaaagtttttgtcaaaaatgtcgtctccgcaaatgctttgaagtcggcatgaaaaaggagtggattctgagtgatgagcagctgaaacggcgcaaaaatgcccgcattaagtgccaacaacagcagcagcacccaaacggtggcggaattgccagggagcaccagcacaaccgccacaacaaccaacatcagcatcatcaacaggtagagagagagagtacagtaagaaatggtacatataacgatggggggaaatggcaaaaatttggcaccactggcgagtaaaaatgtgccatttaaaatggcaatggcattattttgtcccagcggtgagtaaaaatggcactatcttccccaccgtgtaaaaatggcacatttttcccaccgtgtaaaaatgcggcacattttgcccactggaacattcttcaaagacgcgaagccatcccttattagcgcatggcatcaattaataataaaacaattaaaatctttctgtgccgaaacgttggcaccaaatttgggcggttccgattttgtctttttttggcacattttttttggcaaattccacctatattatcactccaattacaaccaatagaatcatcacttggccattgatcagcaacagttgacgcccaccacaacaccggtcagcagtgtggcatcatccggtgccacgggcggtgccgtgcacacgcccggctcagtgggcagtgccattggcggcgttggtggtggtagtacaccgaactgcttcgacttggcgacttccatttctcagccgccgttgcccacggcgacgaccacggctggtgccaacaatagcagcaacaacaactcgttctcgccaccacaaaatgtgaggaattagaataaagtaaagcttggcattttgaaaaaagcctggacctggacttggatttctggacaaaaatccaggtccaggattgcaaaaattggccaggacttggacatctggatccagcaaaagtccaggcctagatccaggcccagaccaagtcctaaaatacaaacgcagagagtataaagtattgttttgttagagtctagtctagcgtattttgggcccattaataggcttctaatatcacacactggctgattagcacgatgatttaggaagctgaacatttaaaaaccgggttgtgcattacagtaatttaccgtcaattacagtataggtttttgatacggtataactcattgcccgacggacgagtcacacctttccccaaaattccagttgttctatcacaacaaccataacaacaatgttgtggggatgccgggcagcggaatggcacaaccgcagcagcacagtccgtcgttggcatcaatgcttaaccacaacagcaacagcagcgccggcgcgtcgccgttggcactcgccgcgctcagcgctctgatggccggcgcgtcgccggccggcggtggccagctgagcacggccgacaacagcccgctgggcagcgctctcgccgccattggcaacagtccngcggggcggtggcaccgccagcgcaatgggatgctttgacgcgaataaagtgggttggatgggtagtattagcataaaccaaaaccaaagtcgaggactgaatggaacagagagagagtgagagagatacaagaaaattgaaaaaaaattttaaattattggaaatgaaaaacgaaaatttttacttaggggggaatgcgctgaaaaaagggcacgaaacgaaatttttgcgcatcattggattgagaaatgatggggataataataaatgggcaaaactttcggcattgggtagaggaattgaacccgctcgtctacccaatccgtgggcaactcttccattgagctaccgagtcacgcccgaactttttttttaataaaatcttatcaaccccccacttcccgtgttttaagcgccagccaaggtccttccttacaggatcatgtttgggtatatctctcaaaaaatcgaatttttattactagagcataagtcttatatgttgtgtgcctttcgtttcggatataaccgttttaactcgaaaatcaaaatccgaccgaaattgatcaaagccgagaatttgattctcctcggaaaccgagatttagctttttcattttgagagtcggaaatattctctcgtcaatcaaatcaaaagtctttcctgatcatgatcacttattgttcggcaggtttcgccatgttccattgtggtccaatcgccgccgccaatattgccgatcattgacccaaatcagcaacgaggggttagttgttctatcattaattatgcaatagatcaatttataaaataaatcactttcaacgatcatgattttatcgattttccttcaaaaaaatcaataaatctgctaatttaaacggaagaaaacttttgctgtatcgctcttctaatttgatttatcgattaaaactcacatcagcatcctgatcagtacatcaatttttgatgcaattttaagtgatcagtagcaattcaggccaccatttttcagtttttgactcaacaacagcaacagttactgctccaaacggtgttcagcggagcggccgctgccgcggctgcggcccaggcgacaacgggcggcggcaccaacgcgtcaacgctggccaatgcggcgattgcattggcacggggcgggcacacgcagcaggctgttgctgcgctgcaacagctccaacagcaacaacaaggtggcatagtgtaaaaaacctatttttaaattcttaatttcaattttttattttattttttgaatttttaaaacttaattttatttaattagatgggaaaaacctacaaaaaacagctttttcagattagtttaaaacgagatttaatttggatcagtgtaggtctagaattgggacagggtttaaggtcttctgaatagtcagtcatccattcagtctattatatgtctgatcatcactgggtctaatattggataaataataatgatcattactgaaacactggaccaattagttgtctgtcagtctgccactaaaaatgattacattactctcagtcaattagtgactgatcaatcatgttaagcatcttatactgatcaaaataattatgaatatgtatgtgtctgtccgtctgccactatcattgatcattaatgatcagcagtgatcaaaacaataactgactgactctgtgtctaacaataaccaataattgtctgtctgtctaacatggcattgaccaacctctgataagcagtgattaaatcgataaatgactgtatcccttccattcagttgccgcacaacagcagaacaacaacagtaacaccagcagttctggcctgtccccactgatcattgaccagtgccatcggctaatgatgcttggccaacaacaacaccatcaaccatataatgccgctgcaacgatcagcaagggatcgcccccgacggcatcgttgatcaaagctggtccaacagtggtgactacagtacccggcagtggtggtggcggcggcacatttaaccatcaccagcaggttaaatgcttgatttttccgtctcaaaaaaaaatttggcactaattttaaaaaaataaataaattttttcaaatgttttttaattttttcgcctcgaggttggggtcccaaggtttttcacattcctgagcatttggtataaattttttatcccaccaccatttcacagcagcagcgccaacagatcagtccaacctccgctgcta

SEQ ID NO: 2312 - DNA, 1001 bp, Heterodera glycines
actctgatcatctattctattatcggcacgactattgtttaatcaattgaatttattgggataaaaatgcactctggtcattagaagagccaagttggctaattaccgcaaaatttgctaaattatcgtcatccctctactaaatttgctagcgccgccgtctctaacgcttaattagctaattatcattgcatcttctatttttatttaaataacactttcgggagcagctcttcccccctggattagtttaccaatgtcgtttccaccgatttttttttaatttcaaagttagaatttcaaaaaaattttcgaaattttttttttaaatttcaagaacaaaatgatttggttcaggtcctccaatttgaaattactgattgatttggttcgggtcttccagtttgatcaattattgattgatgatcattgtcttacgcatcattaatccgctttttcctaggatgagttgaacatgtcccggtcaccgcccgccgactcgtcgccgtcttcgcgcagtacgcccaccagcggtggtggcacaatgccattgccatcgttcaccccggctgctgtcatcaatgaccatcactatccagccacggctaacagtaccactgcatttggcaatcacacagccggcacgggcggctccgttgtgcaaacctcgtccattgcttcatccccagagcaacccggtgccacaaccgccgccacaaccccaaccaccgtaaatgccgtgccgtccatagtgttcaaggacttgcgcgctttccaactcaattcgttggagctccgtgacgtggaaacagtgaaagcggctttttcattgtaaacgatttgaatttttcaaatttcaacgagccattttaaacgctttgctttgtctcagaatggaggaagaattgcgcaagagtgctgccaacaacatggcgggaccttgcaagaacatcgcggaactgatgctgctccttggtgagtttattggatgtcatgacaac

SEQ ID NO: 2313 - DNA, 8668 bp, Heterodera glycines
ccaaaaccatttccatttttgttgataagaacccggagaattgaaacaatccgcccaacttatcagattgtttcaggaaaattttgctttaacccacccattctctttactttttccttcccctagtaatcagttagtcaattcagaggctttccacatctccttccaaattcattccgggagaaaggctaaattttcaggactttttgtatttttcgtgacttttctgtgcattacttaataggcacaaaaataggcatttcggcattagatacaaacattcaaaccttttgcacaaaaatactataagaaatggtacaaaaaattagaaaagcaaaaccccttggtaccgtatgggcaaatttcatattattatttaaaaaattttacaaaaatttatgggacaattttaaattaaaagatgtattatttttattttacaattatcttttgattaagctgcttgctattcattattttttgcaagagttttaaatcgagcatagaatttgtcccaaattcacaaatccaagcaaatatttttaaggcccaacttcagttaagcctgccaaaaactgtgaaagcgtctccaaaacaaggctttcacattaaggttaacacaaaaataaattcaatacttccttaattatgtgaaaaaattattgactacaatttcaatttttcatagtttcccactaaaatttcgtcatcgaaacacaaataaagataatttatggtaagaaatgtgcccaactgtggaataataacaaataggataaatgatgcaaattgaagcgatcattgatcattccggatccatctgaagaccgccccatttgtcgtggtgccaatgctaccgccaaatttgaatgcttctggcgcgttaggcaacggagaaacaaattgaaaggttccctcaccggatgcttcttctgatggcattttgacaaaatgtgcaattaactcatcactgaaattaattttactagagaccgaaccagtgaattcgtatgggtcaggacaaaacattttttaatttgtgttattttgttattctacgtttggtcacccgctctctgggagagaaaagtcgttgaggaaattcccagataaaatatcggggatggctggaaaaatttaaaaatgcaggggagcaaatctggataaaaaatagaacagaaattcttttaaaacaaaatgtcttagaaacagtggtgttacgatgttactcaaaaaccagcaaaacaaaaaaatttgcctataatttttcataaaagcaaccaaatttttaattcttgacatcatttgataatcctaagttttttatatttgcctattcacaaaaaatttctttaaggttcgaaaaagttatcatcaataatgttcgaagcccttgttttgagttcttctgtcattacttttttgaactttacgaaattctttgaattttgtaggcctataaaaacacttgggctatgatttgtttgtttctctatttaaaacgtattaaaaaattttttttaactccttagcaaatttaaatattaataaaaatgaattcacatcgtaaaattgcaagaaatgataaggaaataatgcagcagctgagatgcttctaaaataaagcgataaaatattcaaaaaatttctgacacctttttgaacgaaaaacattttgccaatattaagacaatagttttccatgaatttttgtcgattttcggtaagtgaaattgcgtcaaaagtgccctgaaaattaaaaaatattatatactgtatatcttaatttaattaattaaattaataattattttataaatttacatcagaagcattttttgagagggcagaagggacctccccccctcccttcccatccaacagcaatcccatgatcggcattggcatcagcggcactcgtcggcacaatggcgtcgctagtcagccgatttgtacaaggaaattggatcatcagacactcaggcattggcaaattttcatgtgatttggcccagcagtatgcgcaattatgctctgacggaagcaaacgaaaatatttgggaagaaaccaaataaataaaaaatgtacagcgaaatagcagtaaaatgaggagggagatagagaggagaaagaaatagtgtgtgtgagagagaagcgagagacagcgagttaaaaagagagagagagtgagaaaaaaagagaaaaagagggtaagcataaaaatcattcataattgtttttttctataaaataaaagtgcaacaaaattaaaagtgcaaaaattggtcaacaacgaaaacccagcggaaatcggtggaaatttaataaattttgggagggaagttgcgaaaatgaaaatgttcacatgaattccccaagctcagctgatttttgctgagccaagacaatataaaaggaggaaattctgaaggaaaatcacttcaaaaattaatttactaaaacaaaataaaatcgaaaatggcaccactttttattttgctgttcgttttgctggcagttgaagaaagcgtcggcccattgtcaccaaattgcagtaatttgattgcttttaaactatttaaatataattaattgcttttcatcagtgcatttgccgcccatttattccgttggaagtgccaatgtttcgcaacaaaatgtttctgttccacaaagcccgaagctaaaaatatcagcagggcaccaattattagcaaatggccaatttggtaaaatccattaattattatttttatttcaccgattttgctttttttagcattgccaaaaaaatcggaaagccaacggaaagtttctgttatttctgcgcagcaaattgtttctgacgagcaaaacgtttcatcttctgaggtcgacaaagtgccgggggattttctcgaattttctctgcccattgaaaagcaccaaaattcgcttggccaatatttggcggaactttcaaattattatcattctgcgcaactccatgttccgccgagtacaattgcgagggttttgttacggatgcaaaatgaaatgaattttcatcgtctcaaaacttcggccacccaactaccgtaccccctaaccctggaaaactttcgttccgaaaaagaagcggattccaacggaatgggcggagacattcgcatcactttcattgatcagtgccaaatttgcagccaaaacgaattgacaatgagcaaattgatcacaatgagcccacagcaaatttcggtgccaaagatttcaattttatttttaaaaattatttcaaaggaaatgagactaaactccgaccaatcggacatcgcttggtttttgggaagtgtcattcatttgttggctttccaaacgtatccgcttgaggaatggcacattcgggacaaaatattggccaaccaatgccaattgggtggcactttcaaaatgccgcaggttttattttatgttttattttattattttgaatattcatttcagacttctgaatcgttttgcatgtttctgctccaaaacagcgtcaacaaaatgctattttctgctgaaaagctccaaattcgcactgattttcctcgtggtttcgagaaacagtacgccattcttggccaaataatgagggtattaatttattaattaattaattaattcaaaaactaaaattcttccggttttcatttatttttagaatgctctccacgtcgattccgaaaagagaacttttgacggaaatggacaattgctgaaattggctgccaacttaatctcccattaattaacaataaatattgcttttatagtaacttagtcatcataatttgtttagacaatttaattctgaagaaatgttcgtgtttaatgcaaatatttatccatccttcaaaaaaaacgaaataaattcaatgtattcaaataaaattgtaaaaatatgcattttagttttgtttccaatcacttctttttcctttcatttcacttcttttgtgcaacaattaacctgagcagctgacacctgcaattcaattctgtcttaattaccctaattagcgaaaaaacttgccgttgctttgcttcttgtagtaagcttggatcagtgttcctgaagtttccagtaggaggacgaaccgacctaaacaaaatttacaaatatttggggtgtttccattttgaggaatgcaatttgtcaacacagtctcggccattggtggcgtaagtaaaggttcggtcggtgaaaaggcaaatgaaatctgccaaaaacattccattattgttgataagagcccgagaattgaaacaatcgcccaacttatcagattgtttcaggaaaatattgctttaacccacccattctcttaactttttccttcccctagtaatcagttagtcaattcagaggcttttccacatctccttccaaattcattccgggataaaggctaaattttcaggactttttgtatttttcgtgacttttctgtgcattacttaataggcacaaaaataggcatttcggcattagatacaaacattcaaaccttttgcacaaaaatactataagaaatggtacaaaaaattagaaaagcaaaaccccttggtaccgtatgggcaaatttcatattattatttaaaaaattttacaaaaatttatgggacaattataaattaaaagatgtattatttttattttctaattatcttttgattaagctgctattcattattttttgcaagagttttaaatcgaacatagaatttgtcccaaattcacaaatccaagcaaatatttttaaggcccaacttcagttaagcctgccaaaaactgtgaaagcgtctccaaaacaaggctttcacattaaggttaacacaaaaaaaagtcaatacttccttaattatgtgaaaaaattattgactatttaatatgggatagaagcaagacaaaagatcacaatttcaaagttgcgcattttttacttttgaatgttaccttttggcccttaattatacagtaagaacggaggaaatcatttaggccacaaattgctaaaaaacattgcaacaatttcaatttttcatagtttcccactaaaatttcgtcaccgaaacacaaataaagataatttatggtaagaaatgtgcccaactgtggaataataacaaataggataaatgatgcaaattgaagcgatcattgatcattccggatccatctgaagaccgccccatttgtcgtggtgccaatgctaccgccaaatttgaatgcttctggcgcgttaggcaacggagaaacaaattgaaaggttccctcaccggatgcttcttctgatggcattttgacaaaatgtgcaattaactcatcactgaaattaattttactacagaccgaaccagtgaattcgtatgggtcaggacaaaacattttttaatttgtgttattttgttattctacgtttggtcacccgctctctgggagagaaaagtcgttgaggaaattcccagataaaatatcggggatggctggaaaaatttaaaaatgcaggggagcaaatctggataaaaaatagaacagaaattcttttaaaacaaaatgtcttagaaacagtggtgttacgatgttactcaaaaaccagcaaaacaaaaaaatttgcctataatttttcataaaagcaaccaaatttttaattcttgacatcatttgataatcctaagttttttatatttgcctattcacaaaaaatttctttaaggttcgaaaaagttatcatcaataatgttcgaagcccttgttttgagttcttctgtcattacttttttgaactttacgaaattctttgaattttgtaggcctataaaaacacttgggctatgatttgtttgtttctctatttaaaacgtattaaaatttttttttaactccttagcaaatttaaatattaataaaaaatgaattcacatcgtaaaattgcaagaaatgataaggaaataatgcagcagctgagatgcttctaaaataaagcgataaaatattcaaaaaatttctgacacctttttgaacgaaaaacattttgccaatattaagacaatagttttccatgaatttttgtcgattttcggtaagtgaaattgcgtcaaaagtgccctgaaaattaaaaaatattatatactgtaaattatgcaaataaaaatgagactttatcgatgagaatgtcgaatttatggcaaaatttattgtccaactgatcagaagccaaatcaacaacctttggaggaaaaataaaatcaaaaaataatattcaaatatttttaacaactttattttcttttatttggaaagtttcgaattttaaagtttaaatttcatttttttcttttttcggtctatgctacttcccaaggtgctatgtcgtttcctaaaaaaactaaaaccaaacttttgatctttttgtatgattttttattaattatatatcaaccctaacaaatataagttaaattaatatattagaatggaaatcattaggaatccttcattttttaccagtagggctgtgaatttaagtcaaattacttcttttttttgctgatacgaaatgacttggcttttaaataatgtgccttttttcaagtatacgcaaaattagttgtttttataatttttcgtaactttcttgtattcttttttaatttttatttgcccttaagctaaattatcgctttatcagttgtcattttattaatcgttaattttggaatttttcttttttgatttgctaaatatgaattaaaaataatcctacctcaaatttaatatttaattagaaaatttttctcagtgatgtaaattttaattaatttagcagttaattgtttataaatcacataaaaaatcaaatgattgatttttgcacttttttaagaatgcccatttttgcactttttaggaatcgaccaaccaagctccctatataaaatgccaaaaatagaaagacttgattttgaattttgttgagaccaaccccaaattcgatgggcattgactgatggtcattgcatgaggaagcctgcttcttggccaattcaattgcatttgttgaatagtcgagaccgacaagagaaatgaagccacgagagcgctaaaatttccaaggtaagtcaagaaattgaaatttccgggtttaaatattcgggatttacctgagcggatcccaggtcgactcccggacaatctgtcagtggacaatccgtcagaaaaatttattttcataacacaaaattttgtaaataatgtgaaaatgaatttaaattttaaaaaagcaaactaataatttgtgaaattttataaaagtgatgaataaatcagtttaatgacgattgaatgcggacggattgtccactgacgacccccaggtccaggcaatttacagcggcataaaatttcctgggccataattttattatgtccagaaatttcttaccatgataaaggaaatatctctggaattttgaaaattaaaaatttcatttaaaaaactccgtcatgagggacgggacaacggaggcctcccggatccaacccagacacaggttcaggacgggattttcttcataatgtcgattaaaaaatttccatgccaattttcgtagcagtgacccgttgcccgtgcctaagtcacaaattttggcagaaatgggcaaattttgctgttcgatgaatttcaaaatgcgcaactccgcggaacggccgaaccaaatctgaaaatataaaaactaattacaaaaattaatgatttttttaaacttcgccttcgtcgccattttcagcaaaatttgtcaattccaagtcgtacaaactgtcccaactaaatgaattcattttgtcattttggcaaattgtcaataaatccgggaaaatttttaaacttcataatatttgttctagagaattaggctggaattcttaactgattacgtactttaccaaaaaatggtcattttccctctcggaacccattttttgaaataaatttatggattttgatggaaaaaaatcaggaattccagtcaaaaaagctaaaatttcgaaaattttttttgaaaatgaacattttaattttaactcattaaatcgaattgatgaaaacggaaaataaattttttaaaaataaacaatttgaaaattcaggcacagatagagcttttcataaatatgttccaaagtttataggttccaaattaaagcccaagcaactttttattaattattgtcaaaaaattgttgcttaaaaatgcttaatgtctgtctcactattctttggtgccaagtttggagctctcaaagtcggaatcttccgcttcagccattgcaacctttgtaaaagaaataaagaaacaaaaaaaacaattaaatattaaaatttaatggaaaaataacgaaaaatgctttggtcacaaagagaattaataatatcacatttattcattggctccttaaaacaaaatgaaagagcaatttcaaacaaaaagagtgaaataataataatatgcttgaaagagaattgatgagaaggattcgaatttgaaaaataataatcatatcaattaaataaaacgataaatttgtaataaaaaattcggagaaatttggcgaagtttttttgaaaatttggtagt

SEQ ID NO: 2314 - DNA, 2617 bp, Heterodera glycines
  misc_feature (2588)..(2588): n is a, c, g, or t
ataaaaaagttatagccaaaaacctaaacttttttgaatctttgtacacagataatacataagtaccaaatctggaatttagtcagtttttttattcttattctttttgttagattgacgtcccaaatgagcgaaagttggagcgcgcgcgacgctttgcggatgacgaacaacgaacacaacgaagtcgaccaatgccgtccagcagacgacaaccgttcagcaagtggacataaatagaacacaataaaatatatttttttttaaatctcataattttccgcaaatcttggtcattcctttaaaatagggttgtgtagctagtgttcatcttttaaccgaacagaaaacttgttttttggtgccaaaaaacaatgtgtaccagcagcctctatcaataactgaccgtgcacaaagccttcttaaaattttaaaccaatgagtggcatttgattcattaaatttagaaaaaaaactattttaatttaaaaatccttcgttaaataatttatttaaaagattttccgctgatgctatgcagtcaatgtttctcggtggcgacggtgaattggtcgttaatccaaactttgcttcattgaacattgttggcacttgtactgacattggttggttttattgaattttttaaaataaaattaaataataatttatttgttttgttttttttcagagaaatctttcttccgtctcacagctgcgcctgatccgagtcagattaggccacaagatgtgctgaaggtggcgctggagaatgtcaaggagaagtacaaacaaaacaacggttatcgttatgtgagtgatttcatagtttgatgatcccgcatatgtttacaaaaaaaattcaagaaaacgaggcacaaaatgaaaaaacactgcattcctgtttttctgcccggcgcagaaaatttgcaaataacactgccccccccccaccccttcccgaaatttttcttgctacagcggcctgtagttagctgaaaattttttcttttattttcaggcttctgatcagctgaaaagcattcgtcaagatctgatgatacagaacatacgcaacaatttcactgtttcggtgtacgagacgaatgcacgggttgcgctcgaaaaccgagaccgcgagtgagtaaatttaattgcatctattttttagggaaaaaaaacggatgcggggctggaatcccgattttaaaaacttggggcctcgaaacgtcatccattccaacaaatcctcttttttcagagagttcaatcaatgccagaatcagctgaaacagttgtacaaacaggtgtcttccgggtgcccaaatcggtgggagttcaccagctaccgactactctattacatttacatgcgagaaacacttggttgatattttatatttattttgtttttaaattgaaattttgtctgttttaagatgttgcatatttgctggacgaacttgtgcccgaggcaattgccgacgaatgtatgggttttgcactgatggtaattaatatctggatttaacattgaaaaataaattatttttacatgattataggtatgggacgcttggagcatggacaactacatcaagctgttcagactgtattcaaaggcacccaaaatgacgggtactccaccaacccacccctaatattatcaaatttttattctaattttttcttgccttaaggctatgtaatggacatgttcattgaccgggagcgtaccgaatttctcatcaccgtgctcaaagcgtaaatttgaaaataaaattaataattattattatcccatatacaattaattgattacaaatatttcttacagatttcgtcctgacgtttctgttgctgtgctgctgaattggctccagtttgacactgaaaaggcgctcaacgactttctggtccaacggggcatcgaagtggaggagggcggcacattggactgtcgaaaatatgccaatcacaaattttaaaacatttgctattttttgtcgcggagaaaagccaaccatattcagtgacgaattatcaatcagccaaattgaaggaagggcattgtagcacattttcatttcctccaggtcattattatgttgcaacaaattactgattttatttgccaattgaaattccatgttgtgattttcttcatattgattttgctctgttttgtttttgctttttttctctaatattattaatggaaaatgtttccctttttttctttgaaattgttgttgttctcattctaatacaatttttcaccaattttattttacacgcaattcatcagcaaacattgattgatatgtgttatgtaacaagcatttacttattcttcgttttattgtgaaaaaattgttcaattttaaaatctgttgaataacaaaacaataatttgcgatataaattccttaaatttaccagaaactggaacacaggttccggcttcgacaagcttggttgtttttcctggatctggattttttccaagaaaacccatgattaaattatggaaattaaaacattaattttcttcatttttgctgcccgatgagcattatttcgttgtncaatattccaacatcaatttgctttccaa

SEQ ID NO: 2315 - DNA, 916 bp, Heterodera glycines
cggtaacaaaaattgttgttgttcgtccgagttgttttcgccaccgacacttaaaaattggcatttcaaacaattttgcctcagtctgctgttcttcctctgacttaaagaaaaatttaacatttgtttgaattgttagtttgaattgttagtttctctgctgacactccaacaatcgatcacaaccaaaaatcagaaaaccacctccccaaagaaaaacggaatattaattaaaattttaattggccctcgacactccgcaatcgatcacaaccaaatcagaaaagccccctcccccccttaccctcctctacagtaatcgtttacaaaaattgtacataatggaatcggagaattcgggaaattttgtctccccgaacctcacaattgccaaaatcatttcattaattgccttcttttttgtgaccaccaccaattgttgttgttgttgccgctgctgctgttggcctcgtcgttgcagtttgactttgctttttggcataaaaacaagcacatacccccggcgggcgcctttagcgcgaaataatttgacactttccctctgaattttacacagttttattaaaaaatttttccattttttacgcatttttctttgtccacggctttcgctcgtttgatcaatgactgatggtaatcatgcattttgacttttcttggccgaaaatcggagctttcaaacaacataatatttttggcattgcctttatcgtcgagtgttgttgttgttgttcctcctcaaataattggcaaaaaataaaggaaaacgaaaattttgtgtgaaaaatagagtgcagcggggccgggacctgaacacggacaactgagtacaactgagtaccaaggtcccggttttgatcagttttgaccgggaccgggaaattcccggcttttt

SEQ ID NO: 2316 - DNA, 6027 bp, Heterodera glycines
cgagcactggcagcaacacaggaaattcgcaggacttttaaaatttattttattaaattttattttttattattaaaaaaacaatttttgtgacggtttggcaggcgatgatcatccataaaaatttgtaaaataagcagaaaaagccaacaatggtgaacagagtctgtgaaaagagaagaacaaataataaactctaattttttggattaattaaaatattttaattttcgaatataataaatttaaaattattttttaattcaaaattacgcacatataaaacagcgatgaaagcaacaaaaattgcgatttttgtccacaacccaaaaattgcaacggaatgaatggacacaaaaataattatggccaaatttttaagtcgccaattttggtgttctttaaagagaaaacgaaaattgagaatggcagaaaagcaaaaaaagagccaacagagaatctaaaattggaaaaaatggaaattaaatttaaaaaaaaaaattgacaattttaaagggacaatgccaagcgatggacggataacgccaccagtgccgtgacttttgaagattcagcgaacgacgaaaaaaggcaaaaaactgcaaaataaattgaataaattttcaatttcttaaagttctattaaaaaaaaattaaataaaaatcaaaaactttttttagattatttgaaaaactcttaagaatgtagtaaattgataaaaaacattttcttttaacttttccgcgtaggggcggggaatgaaaagaaggcacccttaaggaatttttcaaaattggcaccattttgcatttcttccgccttccactctccatccatcgcatgtaccgctccaactccctttcgtcctcgtccttttcctcctcctcccccgagggtttgctgtttttctgtgcgttcgttttgctgctgctgcttttgttgttgttccacaccaattcagcagcttggagagtcttttttatggaatttttttttaaatgggtgcacaattttttggcccccttttttcgtcactttttcccgcattttttgtctccgttccatttgttcaatgaatgacgactgttggtagaaggattttgttgacatttttttaatttaattttgtttgtaattaatttgcataaattggccgaagaatggaaatattaaaacacgacacccaaattttatgagaatttggttcccatggcaattcatcgtcacatatgtacataatagagatcgacattttgaaaaaagcctggacctggaccttgatttcctggacaaaaatccaggtccatgaaaaatccaggctcctcgagacctggatccaggaaaaatccaggcctggatccaggtccaggtcgatctttagaaatttattttaaaaatcaaaaaaatgtttgaaaaaattatttatttgagtagaagcatctaaaaatatctaataaataataataataataatgtgtttttaaatttatttaatctgtttttgaaaacttgaaaaaacatcggtcacttgaaaaaataaattctaaattttgtccaggaaaatccaggttttttcctaaaaattttcaaaaaatgcactccacccttaaatccagaaaatttcgaaatgtacttcatttctaactacaatccgtgaataaaattatttgccttaattttaactaatttacatagagaaaatatcaattttaataaatttcacccgtacatttgaaactttttcgcccctattttgcgaattttttgttcttatttaggtctctaaattagaattttttccccctaaaaatcccatccctaattatcagtcattagaaatcccgaccccgatcggggttcggggttgtcggggtatgaagcgtcggggttcggggtcggggttttccccgaaaatggccaaaaatgtcggggttcggggtcggggcggggtcggggttgcaaccctatttttttttgttagaaataagcattttttgggattctgaacatgaaaaacgaagttgatttttttgcggcgcttttcccaaaacttttgggccgcaaggggggccggcggtgccgataggcgccgccgggaaaaattttgtaattttctttaaattgccaaacattatgccaatttatcaaaatttaaaagattctgaggattttccccaaaagcctcaaaaatcctcaaaatttctcaaaaagccacaatttttgctcaatttttggctgaaaattatgtcactatttcggactttttgtcactattttggcatttttcgtcactaaaagttgcttccctaagtcaccaaaatttttcctaaaattttctacacattgaaaaaacgaattttgcctattttttttttgcttacaatgtttattcacacacacatagcatatacatacatacattcacacacgcaaatattgaaatgacaacagtttttgggggagttcatcatgtgaaatgggggtttacaatacaatacaatacaatacaacaatggggggtcagatgatccgatttctccacacgcatcgctctccgggcagttccaccattcttctgtgtgcagttagtgtgtgtgcgcgttctgtccgtccgtctcgtcgtcctcaggcaggcgggaagcgcgtgattgtgtggctcaggtccggcgcgatcagcagcgtggcgcccgtgttgttcttgccggtgtagcggggggccgagaacagggtgatcaggtggcgattcgcgaagtattccacgccgtccatgacgagctgaaaaagaagggaaggggaaaattattaaagcaaaagtgaaatgaaaagccaaaaaaaactcacttgatgcgctcgaacgatgtagtcgatgccgagcaggttgcgcacgctctcgaccacgtccgcgccgaacatgacgccggctcctctgttgttcggggcgacgcctgtgatgctcgtcgacgggtcggcccagaggaggtcaatttccagcgaacgaagcagtggctcggtctgcgggcgaagcaagttgctgagctggtccaggctgcggatctgattggagatgccaccgtgcatgcctgaaaatcagttggaaacagttattgaaccccaaaaattgccctcccccaaaacttacagaggatcttctcgccgaccagtccgacgaatggcatccaggcgaagacttgattgaagaggtcgaagagtcgacgagcgcccggtcgcgggtaacggcggtcgatctcatcgtagaagccatacctgaaaatggggggggggaatgattaatcacaaaaaaacacacaaaaaactttttcacttacactctgttgatgttggcgcactcgtggttcccgcgcagcagcatgaagttggacgggtacttcacctgaaaaatgggggaaatgaatttcattttttgggggttccctccccccatcccccaaaaaccacaccttgtagcagaagaggaggatgatcgtctccatcgattggggccctctgtcgacgtagtcgcccaggaagacgtactgctgctccggcggcaggccatgcgttgagaaaatcttcttcaggtccgcgaattgtccatggatgtcgcccacgatgacggccggcgggtggattctgacgagcgtcggctgcattcggaagacgtccgtggccgctttgcagagctggcggatttcatcgtcactgatctgttggggaaaaaaggggggaaaattaatttttgaaaaactcaaaaatttttctacctcatccgtgaagcgctgaggaggcgagcggttgaccttcgtgatgatcgcgtccaggaagccggttgacaggccgtctccttgcacaaggtccgatgccgctcccgattgacgccgagactgctccgccgctgctgctgccgttgcgtcgaaacagtaatcctccattgaagttgttgcgccgggcacgtccgcttcgtgtgtgatgaagtgttgtagacgatggacgatgataataataataatataatataatatgagggcgatgaagtgaattgtgaggaaaagtgaggaaatgtcgcccttttatacaactttttttcccttaatttcgaaatttttttgcttgtctatataaaggcgagcattgcaaaattttctctcattcatcgcgtccgttcacatttttaaattcttctattatgcggacgatcgtctacttcaaactgttgcaaattgtgctcagtttggccttcgtgtggcaacttctttcacttcaccaattctgcggcacatttgtctgtccgaaggtgtgctgctgctttttgttgtttttgccaattttcattttcaatttttttgtttaacgctgtttccatgcttttcaggccttcctccatgacatctctgttggccactgcaaacgctttacgctgatcggaaaggactcaaagacgggcgaattcggcgctgtgttggacgagcggaaatggcacaaccaactgttcatgagcagcaccaacggtctcccaatcaaagaacagcagcagcaattcatggacgaattggccgccaaattgccgtgccctggacgccactgtattccgattacgacggtgagcaaaatgccatcagaaatatcgaaataaaatgccattttgttttttcagccttcgttttttttctggactgagaagaacagaaatctcctcgacactgttgtggactccttttccggccaactgttgctcgcattgtgctcgcttctcaccattggcattggcttcgcccggatgttacgccctgcggcagaatatgaagtgagttcaatgcgtgaacacagacagcacatcagcccgacaaaaacgcgaacaaattgcttttcagttgaaatccggtggaattttgaccaaattgtgatcagttttgcttttgtcgggttacgagttgcaaaaatttgcttgttttccattgagtcggttactaattttgtttttcatttttaagtgcttcgactattgcatggccctctattctgtcttttgctggtgttgctctgcttgggcctcatcgtgtttgctgctctattggacaccttattggtcttgcatgaacttccgtgcggatgacacaaatgtgccgttggtcacttttgtgagttttgccgcccatttgattctgcattttccaattctggatttttcaggtgttcgacatcgtcatggtgtgttcgttcgtcttcgagatgttcttcaacaattcgctggtgaaaaaacggcccgagaatgcttcagtcgctgccgctaatcgcaaattgcgcaacgatgtcgccacggaatgtgccaatgtcgccattcatcgccagcagcagcagaagaacggaagtgccatcatcatgcaaacttaagcagaggacggacgagtgggatgaagaatgatgctggtaccaacaaacaatgcgatgaaacgatataaagcataatatgtatttctcagctgtattccattgtattgtatattccattatatcgcctatatgcgtatgcatggtctcaaataaactcacctagaattcggatttaagaaaatgcaatagacaaaaaaattatgctcggaaaagttgaatttcgtttttttcattgtaatttcttttgggacgcataatatgacatgggacgcataaaaccgactagaaccattatatttttgaacatcatttttgcaaataatttaataaattttggggaaggacccggagtctggttgggagccaacccggagtgactcaaacacggaaacttccaaacatttttgcacaatttatcatttcatattcgtctttgaattaaccgacggagaaatgtcttttaatgtttttgtcgaagattatgtatggaatagttcatagatggagcccctagaccagcgggaccgagacttctacgagattttacgggattcccgctcctgcttgaaatttcaaatttcctactttgttcgaatcgggtccggagctcgaaataagttgaaatggatgtcaaattt

SEQ ID NO: 2317 - DNA, 1908 bp, Heterodera glycines
tgatttatacccttttcgtgctgtaggtgatcagtgatcagtgatcactcatcaatccatccgaaatctcttcagctcaaataataaagctgcgtttctgaattgtgactccctttctttagaggaaaaattcagctttttaggattttcgcacatcaaaaaaataaaagcaaatcgtggaaacttctgattattttcggtttttatgcttaatttgctattttagtgcttaattcatgcttaaatttaggtttttttggatgcttacaaattagttaagtgctttaccattttttaaaattagaatatattcatttttaatgtttttccatttatgcttttaaaatattttatcggtttaaaaaaatgaaaaaatattattaaaattaaaaaaaacgcatttctgcattaaaaattttcgattttgatgtcattatcggtcactagaaatcactattttggagttttcactattttggcgttttgtcactattttttcactatgtcaaaaatgcaaatacacccctaagaatcgagctaaaatttttcaaaatatactcctatgaaatgaaaaaattttctaaaaaatttactttcttggcaaaaatttttaattttaaaaattttttaggtaactattttgggttttttggtcttaaaaatccctgtcctactcatttgcaactgcaatcagtgaataaaattatttttgctcaatttttggctgaaaattatgtcactatttcggactttttgtcactatttcttcactattttggcatttttactcactatttatgttaactattttttgaaaaaacgaattttgcctatttttttttttttgcttacaatgtttattcacacacacatagcatatacatacatacattcacacacgcaaatattgaaatgacaacagtgttttggggggttgatcatgtgaaatgggggtttacaataaatggggggggggggggtcagatgatccgatttctccacacgcatcgttcttcgggcagttccaccatccttctgtgtgcagttagtgtgtgtgcgcgttctgtccgtccgtctcgtcgtcctcaggcaggcgggaagcgcgtgattgtgtggctcaggtccggcgcgatcagcagcgtggcgcccgtgttgttcttgccggtgtagcggggggccgagaacagggtgatcaggtggcgattcgcgaagtattccacgccgtccatgacgagctgaaaaagaagggaaggggaaaattattaaagcaaaagtgaaatgaaaagccaaaaaaaaaataaactcacttgatgcgctcgaacgatgtagtcgatgccgagcaggttgcgcacgctctcgaccacgtccgcgccgaacatgacgccggctcctctgttgttcggggcgacgcctgtgatgctcgtcgacgggtcggcccagaggaggtcaatttccagcgaacgaagcagtggctcggtctgcgggcgaagcaagttgctgagctggtccaggctgcggatctgattggagatgccaccgtgcatgcctgaaaatcagttggaaaacagttattgaaccccaaaaattgccctcccccaaaacttacagaggatcttctcaccgaccagtccgacgaatggcatccaggcgaagacttgattgaagaggtcgaagagtcgacgagcgcccggtcgcgggtaacggcggtcgatctcatcgtagaagccatacctgaaaatggggggggggggggaatgattaatcacaaaaaaacacacaaaaaactttttcacttacactctgttgatgttggcgcactcgtggttcccgcgcagcagcatgaagttggacgggtacttcacctgaaaaatggggggaaatgaattttgggggttccctcccccatcc

SEQ ID NO: 2318 - DNA, 9122 bp, Heterodera glycines
caattgtacgcttggtgtagcatgattgagcagtggccttggtatatttaatatatccagattaatcccccccaaatgtcttttcaggcgcatgtgttgggtcattgacattgcactgagtctccaggttggcccaactttttggctttattttcaattattgtttgcctttgtcaaaggacgagtcaatgcccatccacgaattgtacacgcaaatcagaaatcgcataaccgtggcttcgggaatggaggatttggaccggaatggacaggagtttgagccactttttcgtaaaatgtgtgcctcccgcactgaccaggcccgtttcccccatggtcaaatcacgaaaaccataatattcgttagttgttcagctcctggtcgcgcatgtgaaggcgtttgcgccttgcacctccaatttggacccgtacttgcgcaaaacgattcgcgagcagcgcggcggtgaaccgatcattgacctttccgtgtcgcaggaggacgacgacgtagcacagcagcaggatccatttggaccactgaaagagaccatcggcccagaggcggaatttgtgtttcaggacccgatggtgtgggcatcggtgcggaaagctttggccaaaatgtccgtcgctgaaattgtggcactcatacgacacttgggcattgttaaggtcggcacattagcaacgtttcgcttaattattcattcgaaaattccttttaatgcaaattgtttaacaaattaaggagagggaggcgcagctcgtcaatgctttttatgagaacaatttgaatgggctcgtccttcacatttgcgatctcaacgaactgaagcaaatattgaaagtgattgatttctaaatatgccaatttgttttgttcattcgttgtccattttgaggtgccattgggcgattggactctcgtcaaattgttgattgaatctctccgcaaatggaaacccttctccacacagtccctttgctctccgcccgacaccaacagcaactcggtcgccgaccccgtcgttgttgtccaacctcaacaacaaaaacaccttgtacaacaccatgacaatggtgaatttggtcaacagaatgaacaacgcatggcactgttgcggcgcattgaagaggagggaaatgggcagacgatgatgaacaatggcgagacggaggaggagaagcggagaaagtcgacaaaaagtggcgaaaaggaagagaaagagcgaagagaaacggaggaggagatgaacagcgtggcatctgtggcgggctcttctgagcagcgatcgcttctgaggtcgtccacatccccaccgaaggactaatcacagacgaatggaaaacgaaacgaaatgatcatcaatcacaccactttttcattctttctagtcatacaacatatcagggattgtcgcaatctatgcttcatttaaattaaatctcaagcgcatttttgcatttcattaaaaaattggtaaatttgtgtaaaaaataaacaatggaaagtttcgctttcatttagaggcctttattaaaattaaaatttaattaaaatacgtagttgttatatacataccagggatggcacggaattccgacctccgaaaattttcggtgcctcggaattccatccctgaaacatatggtaaaaacccaaacttgttttcaaccccctcgaaaaaggggggggggtctaattcaataaatacggtatatatttttaaaacgcgaaaaacagattaaaaacattttatttacctttaaacacaccgtttcaaaaaacgagacatgaaccaataaatagagagtgcagagaaaaaaacatctctctttttggcgtactatttctttatctctgttaatagagaaaaactgaatttacttcgccacatataactttttttctactcatacaatttacaccaaattttgcatgtcgatagagaaaaaaattacgaacaaaatgtaagggtttttaaaagcaaaaaaagggttaactaaaaagttattcgagaaacaaaatttcgaaccctcatatctttttcctaatcaatccaattgcttagcatttgcttagaaaaagcttctccccatcaagggctttcgaatgatgtcaagattgtacaatttggttggtaaaaacctccaaaaataattcccaaaaatggtcattttttaattttttgcacaaaaataaataaaaatattcatgttgcacaccggactcgaaccaacaccctttgtccctttactatcttacaaaaaccactgagccacacatgcaaatctttttggaactgggaggccaaaattgaaacggtgtgtaaatgtagtgatggatctataatttatttattttttttctgatatgcataattattttttccactgctgttgtttggttttgtggtgcgccaaaatgagttatttttcactgactttcttcccaactgattcatcacattttttgagtcggtgtgtaaattgtcagccccattaatcgtatcactttttctgttcacttgcttcattttattcatttttcttgctttaggttttctgttgaacataggatttgttttgtttttttatatgtacctatatttttttattttaacagattttctaaaataatggcgatccaagccttggtaatgcttttttgaaatgttaaaataaatttaaaaaaatatagaaatgttttatatttgaggggatactgtagggtaggtggtggtgtctgtgtggtactgtaaggcccttaaacagaaatgctcggatactgtaaacaagacaattaagttcactctcttaagacggcccctacattctggacaccgtgtccgacttcgcctccaccgataaccagcagtgcaagtgccactttcgggagcgatgacacagcaattggatttgctgtagttttgggggcagcagcgctttgttctgccgcactttgtaagaaatccgccagtttggtggctgaattatacaaaaacgaaattcagatgccatcaaaaaatggctattgtgaagggcagtgacacagaatccgacaaaacagccgacacacagagaaggacgaagaggagatgagagtggaccaaccgcgttccgatcacacttttgatcccccccccccctctcgtcccatttccattttttgttcgcccccgcccccattcgtgatccagccaatctaatgtattttttaggccttttctgttatttttaattttgaaaataataacaattgaaaattggtttttgtttctgttaatatatgatagcgtttttcattcttctcgtcatcagcaaataagcaagtgattgtgtattttgtgaacacctgaaaccatgcaaaataagacgaatttggttgactttttgttctgaaaacgaacatttccatcaacaaaatttggtggttggcaatcatttgctgaagtccagtgacaaattgccggctttgatcaactgattgcttcagtttggatgcatttgcaataagaatttctcggaccaataattggtaaaaatggacatgcttttggtggcctttgtcagcaaaaaacaaaagccaaacaatcagacgttcgatgtaaatcagctcaatcccccgaacgacagcagaaactaaagaaagaaaaacatgggaaaagtacggattatttattgttattttacgttgtaaaatgggaacggattcgaccactctcctcgtcagtttggcatcgttgagccgaagtgccaacgaaatggctttcgcgtgttcgccggaaagagaaaattggacgatggagttggggaccacgtcaatttccaattggaaggggtcgaatcttcgcatttggaacagagagtaaagtgcaacgccttccgttgaaacgacggcgaaagaaccacctaaaatggaaagcaaacggctcaaccagttcaatatttatgtttatttacgcagcgtctgaaaaatgagagatgtacaaaaaatagaaagtgcagagaaaaaacatctctcaattaaatcgcttatcatttgcttagaaaaagttttttttaatcaaaagctttcgaatgacaccaaatttggttggcaaaggctttaaaaataattttcaaaaatggactttttcaatttttggacaaaacttaaataaaactattcatgccgcgcgacggactcgaaccccttacaaaaccacttcgccacacatgaattcttttttggtacaggagttaattttccggacgctgtgtttagagcacattaagtaccagttggacaaaagcccatcttggtaacagtgacgggttggtggatggaccgttcggccatgtctgtgtgccgtgtgcccgggagtttgatggcttttcttggattgtgccgttcgtcttccgagtcactgatgtcaaacaagtcaatgttgccaaattctgtttgtcttcgtgaattgatgtcatccttagacaaattaaacattggaaatatttaccaaattaattggtctcaaataccttaaccccttccaaactcgcgttgaaactcaatttgaatgtacgcaatcgaatacgacccgcgacgctatacagacaaaaagtgttggactgaccaccggccaaaagcaaagaaccgtcgggggagaaagcgatgcaagtgaaagtccttaaaaaggggggggggaattatggacaaacgattaaaggacactgaaaaaacgtacttattccgctctgaagacgctttcttcactttgtccgccttttgtcgggccgcgtcaatgtcgagtttggtgtcaattgtacccaattgttgggtgttcacagtgtcgaacaaagcaattgacgagtcgtaacaaagcacggccaaaagcatggcggaaggactgaaatggcaaagtcattttgagatttgtgagctttgggggcgtggaataagaaaatgttggtcgcggacaattgaaaaaatggaggcatagcagtcactctgttacctgtgcttcacatccaatccctcactggtcaattggacactttccaggcaattcccttcgataatattccacagtttcagcgtgccgtcagaagaagcagagaaaagcgtgttttcggacagtgccaaacccgtcacaagattagtgtgtccgttgagcacctccaacaaatggccggtggccaatgccttgaaaaagcaacagattgtaatatcctcgtccctctctttgagccggtcattcgttcgttacgttacccacccaaacgtaaatgtcgaagttgtctttgctcgacgctatcaccaaatcgcccgctttgtccgcgcacaatgcgttgagctgtgtctgtttcggggcgaccatcgtctgaaaattgcgatacctaaaaaacaaatacacacaaaaatgggttatgcagagaattgaggagggtgtcacctcttcaagtcatgggctcggacggcgccctcgagcgaagcggaaaggacggctttgccggattgggtgaagcaaacgtcggaaacgccggtgccgtggtcagagaatgtgacggtgcaaaacgaggaggagcagtcccatattttgacctttcatcaaatattttttggtataattagggttcgcagttggcaatttgcctttccgtcctccgcgcccgtcgcgagcagtgcaccgtcgggcgaataggcggcgacagtgacgttctgacggtgcgactgctgcctgagcaagtacgactcgctctgccactcccagacgagcagttgcgactcgctgccttggccacagccaatggccaaccaaccgccggccgaattgatgtcgacgctgttgatgcgcacctcactgatgctgaagcgaagggataaccgatgaagcaattggttagcatttccacagacaaaaaatcaccgaaagttttgcagcaaaaccaattcaggaagctcaaaaatgcaaaagacgccgttgttgaaggcggttaccaaaaactttttggctttgtgcagggaaattgcggtgagttcaatggaatgggacgacgtcggattggcatttttgctcaaattgactctgaaaagggaaaaatattaatgaaaaaaattcagaaaggaaacaatgccttttctttcgggcaaaggaaagtctttccgactccaattcggcaattgccattcgctttcgttccttcgtccgcgttattatctgttccggcctatgcgaactctcccaaatgctgcaacttccgattttgtcaacgcaaaataactgagacggaaaagtaaaataattaaataaaattatgtgagttgcactgacattgtattcgtcaaagaaacgtgccccgacaagtgaggccctttcattgagcacataaactccaacattagcaaaggtcgacttaaacgcggcaaaaactttgaccacgcgattctcaccggcagcaataataagtctgaaaagattttaaagttgtcgggttcgaattggctagagaaatttttgaaattaatggatacttccgtttactacaatatgatatttttgattggtaaaaattaaatttgctatttcatgtttttttggaaatgataacaatgacgaggattaacatttgttttcttcgctttgaataaaagagttaaaataaaagaatgatgaatatcaaatgacctgccatcgtcggaccaatccaacgaattgatgcgatccgcagaatgtttgaacttattcactcggatgaacggattgaactgaactcggtggaatggaactatcgaatagacgtggacaaagccagcgacaccaatggcaatgaatctgtgcgaggcaacaaatttaaaagtgaaagaccgaaaaggacatttgggggcatttcctaaaaggacaaaaaagcaaattgcgaaccgtccatcgggggaaaattttagtgcacgaacacgctcagaaaagagttgctgatgaagaacggtgtcgctgaacaagttcaaataaaagccatggccagctaaaaaaaatcaaaagatatttgcttacatttctaaaattacgactaactttctgtcataacaaaggcatgtgtcccggcaaaattaatgtcaaaatgtgtgatgtttgaccgtaattgcgtggcaagtgaacatgaagagtttcttaaaatattgtatactcaaaaacccattatttattggtgcgtaaaataaaacagtcaaaaatcattatgtattaccgcttcaaatccaacgtttttatccgattcccgaccggactaagcaaaacatttccatcgggcataaatttgacttggccatttttgtaaacagtgccaataatgtcagaaaactaaaaatgggaaacaaaagttagatggaataaataaaagttataacaaacttggtaatttatgttcatttctgagcatcagttttagaagaacaaaatttataattcattaatttgaatctttaaaacttaaattaaattgaatgcaaaaattgaatttacgcaaattaaccaaggaaaatgctttataacattagacaagaaaaattgttgatttctctaatgtttactatggcaaatgcggtcatttctcaattttagtgagagaaatttatttaatgggcaacaaagaaagtcagtttggcacaagatacgcagttgatggccgagacagccaaactctcgacccgagtctgatcagatcattcacagagattcgggacagtgacactgactttgcattggacaaattccaagtatttttttcttatgtgtatgtatatattaaagtatattcaagcaaaattcagattgtcaggatactttccaatcttcgccaatatcgccttctgtcgggtctctacgaaaaagcaattcgtctaaatggaaatgacaagttcgcttggcttcagttttcgctttcactttccgccgatcgacacttccttcgcgtctcaaagattttgcaacaatttatttctatggaagaggaagaagaaacgaatcaaaaaggaggtgctgacgaagacgcaatcgttgcttacatgcatttggcacgcattcaactcgaacattttggcgactgtaatttgggtacgtttgttgagttaagcattaagcagcattggagaaaatgtgtttatggcggttcaccaaaaaaataaattgttttcgctatatggaaagtggccgattttggattttatcaaaaagtaaaaacaaaagggggggtactagttgggtttgtatcctagttttggatcaaattttttcaaaatttttttttttatcgcaattgctttaaataacaaataaaaggagatttatgtgcttattgggtacaattccgcgatttaaaaaatttgacccaaaagggggatacaaactttaactagtacctgtaattttatgtgtgttaaaaatgtttaaaaataaatttaatattaaaaaagatttaagcgttcatttagaatttatggactgttgcatttttattagtagatttaaataaattttacgcaaaaatgggaattgtgaaaaaaaaaattcgatttgttcgaatccctgtccggggttcggaattagtcgaaatggatgtcatattcgtgatcagcgaccccgaatacctctggaaacacaggccattttcggctccgaattcaaaagttgttaaaattaggttagggagttaaaatttatcagaaaagagccctttaaattatgtatgtaaatatatattgctcatcgtctgcaactttaatcccacgaagcgacgtgcccggcgcaacaatggcaagagaggactactgcttcgatgcaacggcggcggagcagtctcgagcacgaatatgacatttacaaccaattcattttgaacaaaaataaaagttaattttggtttgcatatttttgaaaatgtttaacacagactagtgggtctggaccaatccacctaaaaacaaggttttaaccaattgggcaaaacagttccatatcattgtagagcatttgcgatccaacttaaatgaattgcgggcaaatttgctcttctctccttgctttcacgtgtttttctcaaaaatattttgtcttgctacaaaaaaggaaccaattttttttgcctgt

SEQ ID NO: 2319 - DNA, 9951 bp, Heterodera glycines
acaagacgcaaatgtccagcatgggagcgaaaccatggaaaacaggaaaaggaatatgaagactttttttgcttttcgaccaccaaaaaatgtttgatttttttcaaaattatagacatggaggctaatttttttcaaatttcgaacctaaaataataacgattttgttcattttggtcaaattttgaaaaatttagtgaaattgtcgtcaagaaattttttgtaaacattaaatacttaaaaactgataaaatttcaaaaaagcaccctcttttccttaaatttttttttatactaaaaagggaggccttcagggagcaggacaaaacgtcgccagccgaaacgtcatcgggacataatgtcgccacaaaattgtttatttaattttagaaaaaatttatcaaaaatttttgttacctagcctgcctggtttgaaaaaaaatatagaaaattcataaaaattttttattaagaaaattcaagaaaaaatttttcatattttttccttcttttttctgagaaatcagcaaatttagttttaattaaaatttctaattttcaaaaaagctaaaacaattttaaatttttttttgcggcgacgtttcggagtgtacacgagtagttaacatcccgtacttgtcgtcagtgcgcgaaatgtttttcgcgcacaaacgccagggtgtcgggcggttttgtgtttgaagttgccgcttttggcatgtgttcgggattggtgggggcgggattctctttgaaggggccgacatcccgagggtattggcgggtttcgggaagtgattgattgattgatttatggtcgggagagggggagggggtgctaattgcgcgaaattttgattgatttatggactcgaaaaagggagggtggtggtagggggaatggggaatgcagcgcgagttatcgcaatgcgcgaaaacaatggaaatgaatgagggggagtgcgctgggtggcggcggtgacatctggcaacttgtcgtcgctcaacggaattttgacaggatgcggggggggggggggagagatgtcagagaaaggatggaagggtataatatgcagtggatttggctgaggggggggggaattcaatggaaaatttggagaaggaaatattattaatgtgaagctggcggcaccgtcttttgtatatggcggccattgttcggacacttctgttgatcgttgacagaattgtaagtatctttgggagaaatgggtcgcttggacatcactttctttccccaataaacatttttgtactttttttcgcttttccaataaattcccctagagaaatgaattaccctactgatttttcttggcttcccgtcaacaattgtgtttgtcctgtgaaggacaatttatgttatcactttcccggctacaaaaagccggttatttgtgcccataaactggtgcaaaacattaccgcattcctttcaactccccctcacattcctaatggtattttttctgtttgtttatgatttaatttttcaaacaattttccagaatcggcacctgcgtctctttcctcgggctccgtgttgatgctgcttactgtgctccaaattttcatcattttgcttacggtgagtaaaaattgtttatcattaaatttaaaaatattttaatttctttaaggtggctttatgctgctgtttgatcgtttttgccgcgcgaggccgaacttatgcggtgaatggtcgccgccgttccattcgacgccgcgctgccgctgcgactttgagcgccttccaggcgcgcacttcgggtgggaattttaaaattgttataataaaaatattcattatattcggggaagggatgaatttcaaattaaaaaaaaattcttccattttcagcgcttggtcttggcaccgctggtccattggcgattccaaaccgccccgcagggtgcacttctcatcgtgtgccgggtagtgtggcatttcacatttattttttttgttttaattttcattcattatttaggctgaatggtgtcagctggtcaacgaaagaatgatgtgtgaagaaaaggcggataaaatttaaaaaaaaggaagatcgaataatatttttcttttttttattctcttcattttttccaaataacaatttaaataaaattttgggatattaactgaatgtactaagtctatcagcttaggttctgcaaaataatataattatctacccgttaaagtttatacacaacaatatgttttcattaacccgctcttcctcaaacacttccttgacaagcaaactgaattttattaattgaaaaattagcattacaaattaatagtattatgtaattttgggtctttttttactgttttttcggatttattcgatgcgcttctttgctttcggcggcgccaaaatgtcggttgcgcgaacattggccagagcgcattcttcgcacagttcaaaattgacagcgaaacggccatcatccttgcgcaacaccctctgcttgttgttgtacaatttgttccaatcatctgagatttataaatatttaacaacaaaaaataaatagttattcaccaacgcagaggtagaagcccagcatgtattttcctttggcgagtttccacaggtctcggtcctcgacttttcgctttttcattgacggctgctgctcctcaccaccattcattcccacattttttgacggctgcttacgggtgggcgctttcaaggaaggaacaacaaattcagcttttccaacattgttctcctttttgacgggggagctttttgtcggagagaatttgcttggggaggacatttcaatagaattttttgaaaattttgcaaatgaatcctgattttgggtgggtgaaggttgggaagcgaaaaatgggcggagcttcgaactgtcgaaaagtgggcggagcctaatcgaatgaaaacatataaaatcggcacgcttttgaacttccgccaaattttgcaaatcattcatagttctatctacaaaaatggccatcaacatgagcgacaagcggagcttgctccgacaaattctcggcgaagcggaaattaccgtgacaacatcgggcctgacgattagcggcccccgtctgtccactccacggttcctgccgtttgacgagagtggccgctgccgctcatgtaaggcaactgaagtggaggtcgacacaatggttacgaaggagggggtcacgatttggtgcacacgcatcgacaaagtccaattcgtgccattcgatgtggtctacgaattgccaggtcactgcttcttccgactgaagaacaagtcgcgtgtgttcaatcttccatacggcgaccttccatctgaatccagtgaaattccgctaacccaacacgtagacgaagaacgggacctcaagagaaaggcaaaagctgcgctcgaattggtggaggccggactgattgcggacagcactgtgcaggacggggcccgtttgaaaaaagccaaaactgcgatgaaagtgatcagtgacattctgctctcggaaccgatgggggaaaaccaaaagaagacatctcaaacaccagccgttgaaaagcagcaacaaccaccaccacaacaacaacaacaagaccaacaatcatcccctgtacaagagaagcccgtcacggcacccgctgtggaacagaacactgttgaagtgaagacggaagaagaaaagaaagatgatcttggtgacattgacaaaacactcgacgatttttttgcgagccttaaagccgcaaccaccagtatgtaaacgaaaacatatttaaatccttggaatttatttgagcaccatttcacttgatcacaataaaaaatgttaaattcacaagcgttttcaaataaagatatttgttttaaattgccctttgggttaattatttcggggccctcatcctctggtaaaacccaatttctactaaaatttattgccgagtcctccgagttaatctcacccagcccggtctccattctttattgctttggtgaaatgaactcagcggtgcccgtacttcaaaaagcgggggttgacgtttatgcgggagtcccgtcagaagaattgatcaaacgtttgcccaagcctcttttgttgatactgaatgacctcatgctctccatggacgagcgatacctgtcagatttgttcaccaaaaaatcccaccaccatcaatttgcggtagtttttgtcactcaaaatttgtttgagaaaaagctcaaagtggcgcgcctatcctcccagtacctggtactgatgcgagcacccaactctctgttgtccatcagaaatattggagtccaacttttcccgcgccagctcgacttctttctggatgcgtatcgccaagcgaccgaccgtccctacggctatttgctgatcgacatgcatgcatcgtcggacccatcgttgcgtctgcgcacaaacatatttaaggaagagcaggaggaagacgaaggcattgttgtgttcattcccaaaaatggaggaccttagtcaacaacagcaacagataaaaataggacagctaataaaagacaactcggactggctgtgtgctttggcgaggaccaaatcctctaaaaagtgtaggaagattttacgtcacgcgaacagcgatcagctattagcgctagtggaaatttgtctgaatctcgtcgcttcacgtttccgattgactacacgacagaaaaaaagattgatgccctatgttgagactgtgcgaaggatgagcagagcgagaagtgaacgcggcgcgagacgtgtgcttgttcagaaaggatcgggatttggggggttgtttgctgccctcctaacacccgtgttaattgaagtagcgaaatcgtttgtgaccaaaaacgcataaataccccacaatttgttgttcacgctcacatttttgcaaaatggctaataaatttttgcttgttccacaagaaatttaccgagggctaacctcagcgtcggatacgggagtcattaatttggatgcggtaaggcatgacctggagcgtgccaggcgtgaacggactaatccgacaacaaaaaatgtccggtacaatcaacagcttaggcgttatctgcaaatgagaagggagcttgccgatagacctaccaaagttgagttaaccaagggcttgagtgttttgctcaagcgagatgggggtgttgatgatgacgacggcgaagtcgtcaacactcagccacggcctcccgctccaccaccaccaccaccaccaccaccatctcctccacctcatcaataccaccgtcaccatcccagccctcccgatcagcaatcttcctcgtctgacgatagtcatccgcctcgcccccctcgtccaccacgtcctcagagaacaaagaaaaaccatcaatcttctataaaacatggtcggttgaaccaatggaagcaaaggcgtcgtgacttgcaacaacaaccggtagtacgtgatctactcgctgaggcagcagctgctcctttacctgaaagtgacgatgacgatgaacaaatgctggaaggtgggtatctgctgccaacaccatcacaaaattatggagacatgccaatattgcctgactatgcagatgaaattgaggaaatggacaccgcccaacaaagacttgcaagcagaagaaagattaaaggagaggagggaatagataaaaacaaaaaatacaaaatttactattctcctccaccatctcccacactaccacccgtgtacaaacgaccagaccatccccctcctccgcctcgttctatacccaaagttgaactgaaaagggatccacaaccaacaaagttgaaaaaatccgcctcgccaccgcctccaccattgcctccacatcgcgcaaagagagaaccaaaaatagagctcgcccctcctccacctcctcgcaatgtctccaaaagggaaccgaaaattgaactagctcctcctcctcctcctcctcgtcacttcgccaaaaaggaaccaaaatttgaagttgacccacgaccatccacatcgaagcaagccgggtacttcccgcccccgaaaatcaaaaccgagccaaaacatgagttacaacctacaaagaggccagtgccataccgtatcccgaagaaagagccaaaaattgaagaaaagccattacagcagcagcaacaacaacctcctcctcctccagctgttgtcgtcgaagaaatgccctatattcctccgcctaggagggggaccaaacgcacctacccccagaatgatgatgatgaggtgcacataagaaaacgagtgaggcaaccgagaagggtaagagtacagtactcgcccgagccagggccatcaacatctgcacaaagtgaagaagaacgacaacaacaacgtcaactgtttgctattccgtcaaatcaactgaccatgacacagagaatagaacgattatatctcaaatgtaaccattatgccgatcgtatgggtgttcgggtgaatacaattaacaccgccaacggcaagccgttggcgcatagcaatttacgaatggccatcaagtatataatagaccgaagagcgggccgtcccaccattaaaccaccgggagcagacctattggagcagcggcttaggcgggatccaattttgtattcatggacggctccaccaaagagaccatcacagagcaaaaccacccggacggcacgggcaatcaagaaggagtttcgcccgaaaaaatggagctgatcaacaccactcttgacaaaatgtacaatgacccatcctccccagcggcgtttgcaggtgttacagcactgtggaaagaagcgcggaaaaagattaagcatttacgaaaagaagaagtgcagagatatttggagggacatcgcacctatacattgatgcgcccccgcagggtgcggtttccaagagcaaaaactatagctgctggattcatgaccgatgtccaggtggatttggctgattttcaagccctttctcgtcataatggaggccaccggtatctgctcgtggcggttgatgtcctgtcaaaacgtttgtttgtcgtcccactgaaaaataagagagccgaggagatgctggaggcattcaaggagcttattgagcaaatgcccatggccccccatcgaatattctccgacaaaggcactgaattcaaaaacaaactggtcaaagaattctttgaggagcacgagattgcgaagcacgagcccgtgcattcatcagtgaaagcctcagttgctgagcgagccatcagaaatgttaagcagcgactatacagatattttgcagaaaagcagactctcaactgggtggatactgtacagcaaattgttgatggaattaacagtgcaccgtctcgtgttcacgggatgcgaccaattgatgtcaattttcggaatgctcaaaaggtgtggaaacgaatgtatggacaacaattacttaaaatttcacaaaggcgagcaccacgtttccgtaaaaatgaatttgtgcgcatgagcagagagaaggggcagttcgagaaggggtacctgcccaattacggcgatgaaattcttgaggttgaccaagtgttgaaggcagtgcgtccaattcggtacaaacttcgtgatgatcgcggcgaaaagttcaggggcactttttatgagcaggagttggcacgcgtacgtaaggatgatgagacaagctaccgaatagagaaggtcttcaggaagagaagaaaacccgatggttcagttgagatacttgtaaaattcataggctatcccgagagggaatggatcgatgaatctcagcttgtataaaagcattcagtttgttcattattttttacatttggataaatctttttctaatgacatcaaatagcttctttgtgtttttgccaagtaatgtatcggattaccccgacaatcaaccgaacaaatatagggtacgtcttccaaaacctctacattttagtgggtcgtgggtttgtgggttgcatagcatcagctatccctactcatggcactctacaattggtaccttggatgaccaatggattgacattcatttcaccaatctccattccgttgatgaggaccgacagcgtgtcatcagagtacctgtcccacaggcgtcgcacaaaaaagttgagcaactcagggattttttacaagcaacattgaagagtcaagaaaaagtcagacttaagccgcttgcgcatgaagaagggtacttcgataaaccggtagtgctcggctcgcctccacacgccaagcgcctcaagagatcaacaattgatgatctctcttcactgccctctccccccgagatatgatgagacagatgagcaacaatcacagcagcagcagcctcagtctccccccagattcgatgagacagagaaagaggataaaaaagtcaaagaaacaacccctccttctgccgctaagcaaccgataccgccggctccaacacttgctcctccttcacatcctccaactgaagcgccaaaggcaccaaaacaggcagctccaaaatctgctacagtacctccccaaaagccaagtgtgacacctgctacaaccaaaacttccccggctcccgctcccattccacccattaagcaagctccatcggccccgaagccttctccgtccaaaacagcggctgtgccgaagccaactccaacacccactccagcatctaaatcaactattccgactcctgcttcatcgaccaaggcgcagaatatccctaaaataccaccacctctggcagctaaaccaaaggagccaaatgtcgcaaagaagtccactgtaccaactaccgtatctacaacatctatttctaaattaacttctcagatcgaatcatcaccaacaacaccgaaaccaccgccgcctcctattaagcctattcctacttcaattccggcaccatcaccgcccccaaagagtatagcaaaggacataaaacgctcagtcgaagctccaaacgaaagcaaaaaggaatcaaagagattggatgtggatgataggttttttggcggtttagctgccggagacgagtttcccgacgacgatgacaaagagtccgaatggccatatgatcctttcaaaaacattgtcgatgatgtagaaatacaatatcttgatgactttgagcgattcaaggtggtgttcaaaaatccagtgatcagccacttgtcattctcacctcagctaggctatgtgcttggatttgaaaacccccaacacgttgggcctcaagaaatctcaaaatacggctgtgacttacggggtggcttctcaagtttcgcagtctactcaaaaggactgaccgagaacatgattgttggtaattcgctgagttcgctgcttcgcgtggtgtcggtgagcggtgccacacccggtgactacaatgagaagatttatgattcgccaatatacgctcgagtgctgccacgggagatcagcgaaattgaaattgagctgcgcacgatggacaagggacgactggtgccattcgcctatggcacgaccatggtagtattaatatttaagaaagtgataaatttttaaaacccactcatttttgtattcattcactcattttacgcaaataaaatggttcatattgtgttcgacccaagcattatcggatatgatgagtacatgcaatacggaagtggcatagaaagcgaggattacttccgagggtccagccccttccaacgagggtatggacaacgaggcgcaggggtgggggatgtgtttcgcggactttggcgctttttccttcccattcttcgtcgtgttggcactacagtaggatcggaggcactgagcacggggcagcgagtgctggagagagtgggaaacgaaggagtgccatttaaggaggcatttgtcagcgagggaaagaaaggaatgatac

SEQ ID NO: 2320 - DNA, 2161 bp, Heterodera glycines
gaaaggattagtggggttcatttaggcgctcgcgtttgtccgctggggtcgtatgggcacaataaattttcttttttcatgacatttccaaaaatttttgatattcatagtgattttggagtgtctgatcagtgatcaccgtaaaaaatttttaatggacgtcaaaatttctcgtttcccaaacatgagtgcctaaatgtaattccccaaatgctattttcaaggactggacagcataaatccacttgaaatggtcattcctcaacatttggaggcaaatgtgataacaaatgaaaatgtcaacattggtggccaaatgcgtaaaatcatagttttttcaacacaaagtgcaattgaaatgcttgatcgttaccgtaacgagatagcaattgatgggacttttaaggttaaaaggatcgtatgaattaaaattaaagcttaattggttatttcagactgcaccgaggggttttgggcagctttttaccattcatgtcgtggttgatgcatgcgctgttccatgtgtgtttgcttgtttacctaccaaacatatgcaggggtatattcgtgtgttcgagtcgattcgcaacagaattcaaaattggtctccgggaagagtaatgtgtgattttgaagcctccgaactctctgctatccggcaaatatttccccaggcaataattacaggttccggtaataaaaatcatttaatagaccaattttacaagggtgctcctttcacctcggaaatgcaattcataaacacatccaaactctccctgggttgtacaaccgttacagaaataacagggatgaccgacatttatttcgatcacttcaatcgctggcttttgtaccaatcaatgaagtgtacacctttttgtgcattttgatggacaatttgattggccctcccgaaattgaaattttgggtatgaaagggtttttattatttttttttcacctgattttagaattactcaaatattttgtgttaacctacattggtccttcctatgttgttgctcatccccaaataattgctggtgaacaggaagcgaattatggacagggatgtgatggatggttgcgtgcctggatagctcatgagaatttggcacatcgaaatgccttgtttccaatagcggtaaaaaattcttgactatctacttttacatatttctgtaatttagctatggaatctgactcatcgcctcgaaattggtctttcaagaagcaacaattcgttagaagcgtggcataacatttggggggcccttcttgaaccaaacccactgttcagcaaatttgttaagcgaatgcttaaagaatttgaacgttggcagcacattgttgccgattttcacaatgcaccggcaaatgggataaggggaaagggccttaagagaaagtccatttatctacaacaagacaacaatttgcggcattctgaattccaacaacgagcgggtcaagacccattgcaatatttaagagcgatttcatatcacttggctcaaatttaatgcttttttattcaaaaaataaaaaaaatattttgcgtattgtttaattttttaaaattttatttcagtgacgaaaggttcagtgacgaaaagttcagtgacgaaaggttcagtgacgaaacatcagggagccaaaaagtggaaaagccaatagacgctctgtttttttatttgaatttggcgctttgttttattaaataatttttgtcatttttttatcctccacttccatcagctgaaagaatttttttttaaacacattttctgctgctgcttgaaaaatatgttaggtcagaggtgcgatatctgaggatttttcctcattttgtggtcttttagagggtcaaagaggattttttgaaaaatgaggatttgcggattttgtggtcttttgagaaaatttgaggatttttgtggtcttttgagaaaaaagtgacaaaaacgcatattttttgaaaaattaggcatatttggcaaaatgttcgaactttttcttcaaatctcaaacatttttttcgaaaaatcttcagtcaaaatcattttttgacaaaatctgttaacaaatagcactcaaaatctcaaaaatttccggcagcgcctatcggcactgccggacccctcccaattcccaaaaa

SEQ ID NO: 2321 - DNA, 3077 bp, Heterodera glycines
tgagcaatttaaggtgtgattggaagaaatggtttttgattggctattgcgatcactaaattcagttctccgctcgccaaaatgcgcgccttttggcgtttagcattggtgcagaaacggctgtccgattatttcaatgcgatttgcgaattcaacgggaaaaagtaagttttggatgggaatgatgcgtttcaaaggccgtgaggaatgtcaaagcaaaatgaacgaacaaagatcactttctttgattttagccacaataaaccatccgccaaagacaaacatttgtaaaaccttaatttattctcaaatgacatttattgcttgaataattagggaccattaaattttgggcatttcggtccggtatggagaattggagaagttgtctgatcaattctgctttactctgaacaaattccgcatttttagccctttttacgaacattgggccttcatgcgctgcgacagttgttgtgcttttttggccggctctcttttggctttgaatgctttcgatttcgatttgtccattgaaaatgaccatttggaagtataatctttctttttccgtctcaattactgctaatgacactttttttcatttgaggagcaaataaattcgttcgaattggccccttatctccgtctgcccacccttcccggccatgtgccaaattcggccaaggaattaatcgccaacggaagtgccgtagctggagatgtttctgtcagtggtgatgcgttggcattggtattaagccaaaagcaatatttggaagagcggaacagacaattatggtggggggagggagagaagaggagggcaaatggcacaacgaattcagtgccaacaatggacagctgaagatgaagttggagcaattggaagcgcaaaatggggacagaaatatggtaaaaaggggggggggaccgaaaaagtgccaaagcgattcagtcgaatgggccgctggaaggcgagggccagcctttgaccttcactgatcggctgagggatttggagcgagaaagggacattttgagggcaagacttgccgaaaaagaggactccgtccggacaaggtgacgacaattgggggaattggccaattaacccaaattgggatgttaattagtcatgagcaattggtggacatgaaaaagttcacggaggatctctacgagaaattgaaaacagctgagagtcgggtgagacggcttaaaagcgacatttgtcagctcaacgaattacacgaaaaggtggtcaaacttgttctggctcataataaagattatcatttggcacaattcctatcattttttatttattttgtttaaactttttgggtacaaatcctttggacaatttaatggactgaagagggcatttttacccacttttagtgctaatacaaacatcaaaaatgggaattggaaaattattgatcataaccaccagagccaaaaacaacaaaaccaattttatagattttcttaggtgctctaaaccgataaaataaaaataaaagtgcgcaaagcgtttaattaatttttgctccgttttcgcgtgctcctttttgagtacagtctgttaataaattatagcgccaagatttttttttgctactccacctacttcccatggaccaatcggtctgaaatttttaccacacataccctcccataaatattaagaacacacaaaaaatctaaaagtgtaaaaaaaaatttatgaattttttccgaaatttgccccaaaatttgctgttaataaattatagcgccaaaacttcgaagacatataaattttttattagggtaagaaaaaatctgaaaaaattcatttccatataactttttgtgctgatcaaaaaattcaattgtaccaacgtgatcagatcactccttcatggtgatctgaaaacactaaaatagcttgaaaccttgaaattttcagaaaaaaattcctagggggttggagaaattttttcgtgaaaggcgaatacgacggatagaaagagcacaaattttcctaaaaaaaggcttcatatgatattagatcgattcgacctctgcttttagaattagctcaaagagctttagaacgttaccaaatttatgaggataaaaacattaaaaaaaataaaagtgtaaaactttttcattttcgagttttgaatcggttcaaaaaggtgtttggacgctttgctgcagaccttgttttcaatcattttcagcatctcagaaaacctacaaaagttgttttgggtgattttggctctgctgtgacaatatttattgggaatttgcctacaaaaggcacaattacagtacccaacctcttactgtctaattaaataaacttaattaattaatttttgctttgttaggaagtgaaggcgctgaatgcttctctttgtgcgcttcaacaaaacgaaggggaagccatggaagagaaagcgcatgagaaacgactgaaagaggagttggtggagaagacgaagcagtacatggaagtaggggagaagagaaaatggaaaggactattggccataggtgatgagtgcagtgaaaaggaagcagcaggaagtgagcgaagaacgcgaacagaacgccacactgaggagacgcgtcgcggagcaagaggcacgcgcagagacaatggccaagacggagaaagtcaggcagagaaagagggaaaggcaccgaccgatcgatcaattgctaattgttaaggagctgatcagcctgaaggaggagcaccggaggagcaagcagcagctgctcgactgtcagatggccctccaggagtttagcgaagcattgtccgagtgagccgttgagagaagggcggctgaccgatcagaagggtttattcaggtccaagctgcgaatggtcgagttgaaggaggagattatgccgttgagtgaagccgcctgggtggaggacagccgtgtgatccaatgccgaatgtgcgacgtccatttcggagtttggcaccgcaaacaccactgcaggtggtcttctcccctcccccgcctcctacccctttagcattactcagaaactgggccaa

SEQ ID NO: 2322 - DNA, 3038 bp, Heterodera glycines
ccctcttttttcttaatcgaatcgaattgtgaagtgtttggaccatcgcgagcagtcattgcgattcgtcgccgaccaaacattggacgcactttttagagtaaaaattaccaaacgcaaaatgctaaaaacttagataattgcagaaatttttcttgaaattccaagcggaaaaagttgtggcatttctgctcagcgaattgaacaaaagaacgaattcggcacgggcaatttgcgcggcactgcaaaaactgagttggacaatcggaagtgcgaaggcacagcggacaaagtgaaattttaaagagaaattccactgaatacaaaaaaaaattccaatttgggaatttcctctctctttccccttatttttgcctccctttcctctctctttccccttatttttgcctccctttcctctctctttccctccctccctctctttccccttatttgtgcctccctttcctctctctttctctccctccctccccttctcctcttgctttcacctatccgccttgatcaaaattttcaaaaattcttaaaggaattagtccgaaatgccatccaattccattcagcacttttctgacccatttgttgaatggcatcggaatttgtcttcaacgacccgaagagtctgtgcatattgcagtcgaagaacacttccccacaatttttgcccaaattgggccatcatttgtcgcaacaaatcatgccgaaaaggcggaccaactcttagcaattgcattggaaaacatcgaattgaaaggcgcgaaaaatcggtaaaacgattaaaaaagttatcggtcggccttttaaatgtctgctgatttgatggttcgtttagtgctgccgcagtggcaattgttcaattggcaaagtttgtgccctcaattttccacgagtctttctgtgcgctttccaaaattgttttcgaatcggaccaaagagagcacaaaatgcgtttggttggcgcattgaatatttttcgaatgctttggccccattttatggaacatttgacggaaaattcccagccaattcttcaaaaagtaaaattcattttattttaaatttgtctggtgaagtgtccgtccgattgtttcagtttctgtccaaagtgttgcgttgcatttgctgcgatataaacgaacttttggtgtcggcgttggaattgttgcgcgactgcgcccaattggccgtccaaaaatgtccccccaattcgccctcacttttcgacgtcctttttcgacttccattttttgtttacccttccccacttcagttcaatcctctcactgttctttccgatcataaaatcacttccgatttgttgcttaattttccattcgatttaccaaacgatggacggagtgggaaaaacgcggcggaaacgatcgaaaggcaaacgattggagacggtaggggctgatcggaaaatgcggctgatcactaggccaagacttgatcggaacagcagcatatccgatgacgttcctcatcaattgcttttttgacagatgccgaaagtgttttctccgttggcacttccaaaatgagcgcgtggagttcgctggccgacttgggcgcagttgaactgggcacttcgtcacagatgcaattcggcatagaagatttgaacacggcactgaccagaataggaatcaacattgaaagaggggatgaaattggcaaaattggggacaaaatagcggagagggaaagtgccgacgaagaggaagacaaattctccgtaatttctgccgaacttttcgttgatcctttgatgaattgtttccaccaacaaaaaatgcaatcagcggaagaagaaaaacgagataaaacgataattggccaaaggcaaaagaagaaaacggaagaaggggccgaccaatgcgaaaagaaagacaaaattcaacaacggaatgaggggacaaacgatgccaatgccggccaaagatgggaaggaatactgcgcgaactgtcggaaaacggtgagcgacggcatttcgccataagcgagtcacttttgtgcctgcttagtgcctttcgattcgaatgggctcaccttttggctccattcttcgctgtccgttgctcgacgctttttgttgtccggccacggcaatttgtacggcgaagtgcgcatttcgcacaaaattttggccatggaattcttggccaatgcggcaatggtcgagccaaaattggcatcacctaattgtgtggttgtccacggtaaacacagccttaagctaaatggagtagcaaagtgccaccaaatcatcacttttttgaaattcctacaaaaagtcgtttagaagacggtcaccaccaaccaatcagcgacctcttcaatttagccggccatgaggatgataatttggccatcgctgcactgaaatttgcttttaatattgggaaatggaaattgtggaagttggcgagtgaacagaaattggacagtcaacaacggcacggaacagaggagaggggtcggactttgttggcactttgtcttccatttgctcttttgttgtcaggtcgtttggcatggcttttgaaaaaaacgcttcacgcaaatcgcggcccgaacagagtgaagagtgtgctccgcctttgttctcaatcgctcgcactgttcagctgtccctttgacgacggacagcttttagaggccgcctgcgaatgcgcaatttcatcgggcgaatgcgattactttttggttaaggtaaaacccaaaagcgaagttggcatggccaaccaattgcattttaatttgagtcccttcggggttaatcggccaattaagaattgccgaatcgaatttctcgccaacattcgctggtcgcgcactttgcccaaatgtcgtcgtcggcttcaaaatgtttgtatgcaactctttcttcggcatctctttgacaacgacccgcgggttcaaatagacttttttatttatttttaatatatcctaagattgtttaccgatacagaagcgaactacggcacgaaacgctatgccaaagctcatt

SEQ ID NO: 2323 - DNA, 1554 bp, Heterodera glycines
  misc_feature (9)..(9): n is a, c, g, or t
tgctctacncaacggatggctggtacaaatcaatcgttctcttcaaattcatagacaaaataccattggcactttgactgttcatttcctttttgatcagattgacttttcgcccgccaattcggcgcgtcttatccaccagctgctcaaatgcgtgttcaacacaaatgcccaaaatttgaacggaaaagccatgcgacagaacgaaatttgggagcagcacctaatccaatcggacggtaaaatcaattcgaaatgattaatttttgaacaaaaactaatgggctgtgcccattgtttcggccggtatttgaccatttggccattaaactatggcaaattctgcggttggtttttgccttttccatttaaaaccctcaaggtccgctggagaggcatctgttcggccccctcaacaacttcaccgtgttcactgcctttgttctgcgcactgaatttgccgatgcattcgttgcgcgactttccggatggattttgccgaacagactttgccaatttccgtccgaagtgctgaaaacctttactaatttctaattccgtttttaaaagaatgcgcaagtgctcggtgagctgcttcaccagttcgagccgttcatcagccacttgctcaagctgtacccactgaccaattcgacggacaccaaaaaggcggtgaatttcatttcatttctaactccatgaaaaatctggccaacctccttttgtgagcagattctcgactgtgtctgttccctctgcttgtgcaacgtcagttacgagcttttggaccgcaacggcaaattccacgcgcgcattttggcccaattgaagcaactttcgcccgtcgacgacgtccctttgctgcccaacattttggcgtttctttgcgttttggagcgaattaattttacgaaattttctgaggttaattccgacgacagctcaaaaaggggtagctcctccgccagaccccgaaaatttaagccattttttggggatataccccgatcccgacgctccttttctcgactaactccgaccccaacttttctcagccgaagggtcggggccctaacctagttcaaaatttaataatttagagagaaaagttcagattgaatctgtgatgacggaattattcgaccgatttgacgacgcaaacggcgctttcattttggaagcgatgcgaattgttcttctgagcgtttgctttaatttggaaaggtaaaaaaaaaacaaattcataaaatttaaatgtttaaacatttaatccgatggaaagaaagggcaaacgccccgaggaaaatttgcaatgtttgacgcgcctcaaaaccctactgaccagccaattttcacgcacattttgtgcctttccgattgtgtcggctcaatgttggatcattctgatgaacgaccttcggcagcaccgccaatcggacgaatggtacggtagaacgtactgactgtagaaggggtactgtaacagacacctgctgttgtgttgaacttcccaagatgatagtggtgatagtgaaattgagaaggtggggactg

SEQ ID NO: 2324 - DNA, 1266 bp, Heterodera glycines
cagttaattttcagagaattccaaagttctcggtatgccagaaaaatggctatctctttttgggacaaatttttagcgaacaaatgctcgcgagcaagagccgcggagcggtaagcaactgccagttaattttcagagaatttccaaagttctcggttatgccagaaaaatggctatctcttttttggaacaaatttctagcgaacaaatgctcgcgagcaagagccgcggagcggtaagcaactgccagttaatttttcagagaatttccaaagttctcggttatgccagaaaaatggctatctcttttttggaacaaatttctagcgaacaaatgctcgcgagcaagagccgcggagcggtaagcaactgccagttaatttttcagagaatttccaaagttctcggttatgccagaaaaatggctatctcttttttggaacaaatttctagcgaacaaatgctcgcgagcaagagccgcggagcggtaagcaactgccagttaatttttcagagaatttccaaagttctcggttatgccagaaaaatggctatctcttttttggaacaaatttctagcgaacaaatgctcgcgagcaagagccgcggagcggtaagcaactgccagttaatttttcagagaatttccaaagttctcggttatgccagaaaaatggctatctcttttttggaacaaatttctagcgaacaaatgctcgcgagcaagagccgcggagcggtaagcaactgccagttaatttttcagagaatttccaaagttctcggttatgccagaaaaatggctatctcttttttggaacaaatttctagcgaacaaatgctcgcgagcaagagccgcggagcggtaagcaactgccagttaatttttcagagaatttccaaagttctcggttatgccagaaaaatggctatctcttttttggaacaaatttctagcgaacaaatgctcgcgagcaagagccgcggagcggtaagcaactgccagttaatttttcagagaatttccaaagttctcggttatgccagaaaaatggctatctcttttttggaacaaatttctagcgaacaaatgctcgcgagcaagagccgcggagcggtaagcaactgccagttaatttttcagagaatttccaaagttctcggttatgccagaaaaatggctatctcttttttggaacaaatttctagcgaacaaatgctcgcgagcaagagccgcggagcggtaagcaactgccagttaatttt

SEQ ID NO: 2325 - DNA, 6092 bp, Heterodera glycines
  misc_feature (1316)..(1316): n is a, c, g, or t
gtgaagtttaaacatttattttttatttttaaaaaatcaaatccatcttactcaaactttgaagctgttttttaaattttattatgcttgaattttaccatgtggcataagtgaggaagaagcgttccaacaaaaacggtactgttgcatcgggatagagaagcataatttttgctgcaagaatggccaatgatgtgccgttaaagaaacccaacgcattgttgtaaatataatgagctaaaaacggtaatttaggaccgtatttacctcttaataccgtatggcaaatcaaaattttcatgtaaaatacttacattttgcccacagtttaagcgtcaaaagcaatttttgaaaattttctttgtctgtgaccatgtcaaacaatcgaagattggagtgaaacccttaatcatagcaattagcataattaggataattgtgaagtgtcagtaatttattacccgcgagtgagcggagcgatcgaagcatttgttccttcgtgtttattagaacggattgatcatttttgtcatcatctttttgcattttggtttcttggtctaccgctccaatttggttgcccaatttttcaatcatttcctcaatttttgacaaaatattttgctgccattggtcaccgtcattatcataattatcatcatcattaaaatgaatttgtttttcgccaggaattgatgcgaatacaatgtcaatttcgtgatggaagttgataacttttaatcttatcagtggaacccaatttgattggattcgttgcagcgaatgaatttccggatactgaaaatttatttttgattttttcgaatttcgaatccttatcaatctttccattgaaaatatttttaaatatcatttgaatgatcgaaacaggtcacaccacccaatgttaaaggtgaaaaaacttaaatataattttttggcttaacccaggtgagcttggtcaaatttaaaggccaaaaaagtcagttttatcattttttcattactttgttttataaatccaattaaatttttagtactttttaaattaaattccaataatatttaatatttgaaaatttaaattagggtaaatttcttagataatgacaatattgccagtttgcttttttttgtacgcattaaatttacgaaccaataatgtgactgaaaaaacccgtgaaccgtgaatcgtgactgtgaccgtgaattgaccaatgaaccgtgaccgtgaataggtcccgtgaatcgtgaccgtgaccgtgatccaaaaaacccgtgaaattcacgggtttcgtgaccgtgaatttttattntaagaaaaaattttttggcggcgaatttttttttaaactttttttgtggtatcattttccaaaaatttttttttgggaaaaggggggtccataggcgccgatagacgccatcgcaaaaattttttgaaaatttgagtcttatttgtgcaccgattttgtccaaaaaatgaccaaattttgcgaatttgagccagttttttacgaaataataaattttggggggccggaggtgccgataggcgccgccgggggtaaaattgaaaatttgagtgcaatttgttaacattgttaacagatttatccctaaaattagcaaattttacaattttaattagtctaaaagtcaaaaaacgatgaaaaatgcaaattataggtgcgcttgcatatttaaagtttaaaaaatcgggtaagaagtgtccattggcaagcacgcccataatttgcatttttcgcataattgtggacgttctaaattgaatccgaccttttataaatggttttgtgagacatatttacccaatttttaagaaaaatatgggttttagtggaaacttttagaaaatgtgatttattaactgattttacccaaaataactttatttcgagcgaatttttttaataaacttaatgaattttttaatttaaatgggctcatatgtacttgaaactttgctttttatttgttttcgcacaatattgtttttgactttgctcaaaaagtttccggaatagagattgggccggcggtgccgataggcgccgccggggaaatttttgaaaattttactctgtttcttaccaaaaatttcccaaaaaaaagaccaaatttctctatagaaaaaaattatttcataaatattcaattttatccagtgtaaatttttcacggaataaccgtgaattggtaccgtgaatcgtgaccgtgagtgaaaaaacccgtgaaattcacggtaaccgtgaccgtgaccgtgaatcacggcacatctctactggatttctaccgtatttcaagggaaaatggtagaaaatcagtcatttttatggtagtcaattttgacaccctctcttgctctgcgggtattcatcgtagactcaccatccaaaagacaattttgtagagaattttgtgctctttttcataggcctactcaaattttccagaaaaattttcctaacctcctaggaatttttttcgaaaatttccccgatttcaagccatttttggcttttcagatcaccatgaaggagtgatctgatcaagttggtgtaaaagccttttctgatcagtgtcaaaagttagcttagcaggaattttttcagaattttatctcaataaaaaattgagttataagttttttgccaccattcatttttgagaaaatcggatttaaaaaaaaaattgtttttcgctccaatacttttgaccgtgactgtaattaaaattgatattttaaaaattaaaatcgaaattactcacaaaaaaaaaacaaacaaagaaaaagtgcgattttttattattgcatcattttcaatcgtttcatcaacaaaaattattttttggcattttgttttttcgcgttaatttgaatggcccttttttgtgacggaaactcaaatagtatatttaagattaaaaagagcatgaaagcattgcttctcttttctgtttcaattttcttactcaaattgctctgtttgttgcccaatttcgacttcattctttcttcccaaactcatttccatcttccccctttttttccagattattacgatttattttctgcctccaacatgtcaagcagttttggcgtcttcaaactgacggacgatgacgcaatgaaatttttggtgatcgaatcgcacatcggcaccaaaaagatggactaccaaatggagcattatgtgtggaagcgtcgatcagacggtttatttttcattttttgcacatcaaactcaaaaacgatactgcaaaaaagaaacacgggccataagtatattcaaaatttggaaatttttccattttctgcccatcatttttgaaacttttgacttttgtcatgcctaccataacatgccgagtataaaatcttacggatttgtaagaaacaacccccccccccccgcgttaaggcattcacatcatcaacattcgcaaaacgtgggagaaactgttgttcgccgcccgtgccatcgcggccattgaaaaggttctaaaatttgaattttcgactttttgttcgaatttaggttccgggattcggaattgggcgaaatagaagtcgttttcgtgatcagcgacccagaaaacccctggaaacatgttttcatgatttttgaaatttaaaaaaaactcgaaaaatgttcgaattcgggttcaggatttgaaattggtcgaaatggaggcccggattcgtgctaagcgcctcaaaaacccttaaaacgtgttataagaatttccagaaaaaaatataaagaaaaaatgttcgggaccaataatcttggcgattgccaaatttttttcgctccaatacttttgaccgtgactgtaattaaaattgatattttaaaaattaaaatcgaaattactcacaaaaaaacaaacaaagaaaaagtgcgattttttattattgcatcattttcaatcgtttcatcaacaaaaattattttttggcattttgttttttcgcgttaatttgaatggcccttttttgtgacggaaactcaaatagtatatttaagattaaaaagagcatgaaagcattgcttctcttttctgtttcaattttcttactcaaattgctctgtttgttgcccaatttcgacttcattctttcttcccaaactcatttccatcttccccctttttttccagattattacgatttattttctgcctccaacatgtcaagcagttttggcgtcttcaaactgacggacgatgacgcaatgaaatttttggtgatcgaatcgcacatcggcaccaaaaagatggactaccaaatggagcattatgtgtggaagcgtcgatcagacggtttatttttttagtctaaatttctaaatttttttggttcctccaattcaaagtttcatttcagcaacgcttcgtcgcctttttcgagaagaaggagcgcggcgtggacatgcacgcgagcatcaaacggcgcaaggactacatcaacccggcactttacgaggcgttgcgcaacgcgtacggcatcgacgagaagggcacttacttcgccgtgccgtgtacgacccgaacacatttcgctgccgacgacttttacaacgcattggatgaggtaaatacggacggagtataatcgctcccggaagcacccccccccccagtttttgaaaaccaactgtagctgctaaaaacctggatagcgttttttattttcgattaattatcgattagttaaaattaattattttggatttgaacccgtaacatcaaaaaagatgtatttaaccaactgagccaccaattctgctcctttttcggctctaacgcactttatgaattatttagagctatatcaattatatcatttgaataatatagacaatacagacataaaacgtatacacgaaatgaggaatcagagatggcagattctcggggggacgaactgtccaagtgaatcaattgtaaaaaacaattaaaaatcttaaagggttcactttgaacaaggaaagtgcaaaatgatgtcacttaaaatataatttacggatgcaaaagacacaatttgctcttgtgggtgaagagtatcacaatggctttttgggaaagggacggacaatgggaaaaggagaaaagacaaaagaaaggaggggggggggggaaggggtcgaaagactgttttaatctgtgctgatattctttaaagggtcgttttcggctgggggtgggagaagctctctctctgctaattgtcaatcattagagcggctgcagcaccaccttccgttccgcggaataggagggcggtacgaaagggttgttgccgctgtccgtgccgttgtccgttccgccgccctgccgcacccccgcgccggtcgcctgttgttgttgctggtggttgtgctgcgcgtgcatctgctgctccgtcgccattccgccgccaagcgccgcgacggcggcggcgccctcctcaaagaattcgtattttgggtagccgaggaatttgtgtgggtaattgttgttgttattattgctgttgtagaaggccatctgttgaattatacaaaggctttgaattaaatggatttgtttttgaaatgattttaaacatttcgccaaaattatttattttaatgccaaatttaattcaataaatctcagttattaatcattccctttccttacattgttaaaattgtgctgattttgctggacggacggaaagccggcggcagcggcggccgcaagcgacgccatttgctggtcgaaggagggggcgccgtaggggacgccgagtgggacgagcatcggttgcgtttggtgggcgacgacggcactttgctgcgtcgacggtggccaaaagggacgcgcagcgcccaaaagcatttggtgctgggaaggcggcgtgtcggacaaagcgccgccattttcactgaccggtgaattagtcctgcgggaaaaagaaattaaactgagacataatgccaaaaaaggggcgaaaagaagcgatggaatgaaagaagcgccacagctgtcgcggggggggagcaaaagcccaactcacgcgctgttccccccggacgtga

SEQ ID NO: 2326 - DNA, 2953 bp, Heterodera glycines
ttttaatcattgttttaaatttatgtttttcatacttccggtgaagcaaacttttgttttgagttttcgaagagccttcagcctgcccgtttcgctccctgtgaaccccctttgatccaaatgtagaaactaaccaatttcactaacaattaatttaatcattatgtaatttcatttttgccttaattttgatcttattttttgttttttgcttgtttaataaaaaagtgattgaaaaacttgttcacattttgaatttgaaataaagttgcttaaatggaggagcgcgcaattgccaggtaaaaaagcccgtggagcccccgacaaagcatggatgataggtggtttgatgggtggactttttttgacaaattgggttacattaacaatgaaatggttgcacttcattttgtccttcccaaaaatttacaaagagcggattttgtggccataagttattttgaaagtaatcaatctgtctaaaaaatagcagttcaccgtttctaataataagaaaggcacatcagaaaaagagaaacccttttgcttttttgtctgattttttttaagtcagagccctaattgtctggcatttaatacccgtgtaagcccatcgctagggaaaatcaggaaagttttatgaattttgtgtatttgtacttttttgaaacagtgtaaatatgttatggcccaaaatcaaccgtgttcgtatacgatttgatttcatttttacgctcctagtttttaattttaaccaccatttttctgaaagtttccattagccatttattggctgacaatattaaaaaattcacaggacggagtgcaaccaaattcatggatattttttgctcatttttagacttgaactttccccctctgaaatccttatgctaaaatgggcccataaaccttggcgttccaattatttggtcgttccgcgagttttgagcgtgtacaacgcgtcgttctgcagcaccatcgtctttgttgttcggcttttttccatcttgcttattcccgtcgtcgacaaaattttgtttcattttaatgccccacccacctctttccctgtcagaaatggaggttcgaaggctttttctagcgattaattattgaaaaaaaccggtagtatggatagtaatcaaacgaaaaacttttttgaaagtgaaattaagcataataatggcaaatttggcacaagcagaattaattcatatgggaggaccagcgctctctttttgagcatgatgcgcgttatttttacattttaaacactagcgtcatatacgcaaaggaactaacactggaggttatttcattatatgaaaatcttagaaaaacatctaaaaaggaatattggggtcaatatgtattttggtttcctatcaattcatcgtaatttaaagtctgaaaatttgaaaatgaatttttatgggtcgggtcatagtgctttttactagatggtgctgcacctgcaccgcgagataatgtggacgactaacccactcatcgcgggagacctccgaacaacggacgtcggtgtgcgcgagcatgtcgccgtgccttgggaagaagtgacggcgaagatgtcggaattcgtcgagtggtttaatttacaacaacatactactaccatccattcactaaccgcggaagtccattaccgcctagtaatgcagtttacttatagaattagcagtaattttaaaagcaaaatatgtaattaaaagacaaaattcttgttctgaaaagctaatttagtgaaattcatacacaaacaaaattatctgttcaaacaatgcataatacataggaaatattgtttttattgatcctttactcacccaatcaatatttagacatacattcacccctttttcgacggcaacgggcgctgtgctcgacttttatcgaattttgtattggcccgaaagggatttaaccctgtaatttttgatgcaaatatgcggtctgaatataatgacgcccttaccaatttcactaacaattaatttaatcattgtgtaatttcatttttgccttaattttgatcttattttttgtgttttttgcttgtttaataaaaaagtgattgaaaaacttgttcacattttgaatttgaaataaagttgcttaaatggaggaggaacgcgcaattgccaggtaaaaaagcccgtgacagcccccataaatggttggggatttgaaaaaattgggtcgtattcacgagaatcggttgcacttcatttcgccctcttctaaaaaccgtttttgtgcccataacttattactaaattatttctgctgttttttgtacagtaggcccacgtaaccagcggggaaattcccccccccccccccgcccccgaaatgaaaaaaatttcagaaaatgggtatttctttcaaggttactgtattttactcaacgatttgagcataaatttttccaggtgccggaggcaccgccgggtcccaatcaaaatggctaaaatttggcggaatggctaaaattacacattttcccaaggcgccaaaattttggtaattacactgttttttgggccggaagacaaaaaaaaatttggcggaatggctaaaattacacattttcccaaggcgccaaaattttggtaattacacttttttgggccggaagacaaaaaaaaatttcggtcattgcttaatagatttgaaaaggtgtaaatggagtgcagccgaaccgaggacatttttctcgtatttttggtgtaaactccgaaatccttgtgttgtgatggacccataaaccttggatttccaattttggcggctgttttcgttttgtgagtggcaaaacagctcgtttagcagctccattgacttgtttttgctcgtcgtttccgctggcttctttgtcgtcgtcgttgccatttaacattcaatccccccctttcctctcgaaatttggttg

SEQ ID NO: 2327 - DNA, 3803 bp, Heterodera glycines
tatgggcttttcaaggtcgctgaccatgacaagatttttgtatcgccgaagccaaattcgaacaataagtcttaaattcgaaaatctgttttttacccattaaatgatcgttataaaaagttaaaaggaattacttgtttcgggtttcaatttttgtctaagatttatctacatgatcgcttattatagtattggcgattttcaatttatttctatgcattttagacagttttagacccaaaagttgaaatttggaaaatttcaactttaaactatgttcgaattcaagtctatcccatatcgaaattgtgatcgcgaccctgaaaatccaagattaacaaagtgttttcaacacaagaatttatgataaatggatatatatgaaaagtacagtacccatcaaacttaataattaccttaacgcattcattatgaacaaatgaaccaaaatttacaatattttatattttttcattttttgtattaataaaacctctagaaaaaaagaatcgagtaaatgtaattcagcttaaaacaaagatttcataatttttaatgaaattaattatttttttatcttttctactgacagatttacgaaagtgtcttttttatcacctttttcagggccatcattgtaaaggtaaaatcccaaccatttctcattgtttccgactttcgttttgatttgtgcccatattttccatgaaaatccccaaatgtccacggcatcgctaagtcgactttcaaccggctccagcccaaattcggacactttttcaatttccattgaaattgtttctccctttttgtaccgttgttgagtgggaaatttcaatgggaaaagcgcctggacatcacttaactttggattggaatagtactgataaatgctgatcacttctttaattgttaacacatcagttgaaactgaagtttgatttaaatggataattaattagccaattaatacattatgaaacgaatcattagttttgttctgttccagaccaagtctggacccaggcttgaaatcacggattcgcactacttggattttctgggatttgtccaaaaattcaggtccaggcccaacattgaaatcagaataggtccaagatttttttcgaaataccaaattctctagtcatcatatataatttattaccaacgccttttgtgaaatcctcttttgggattagtggaaaacgaattttgaacaatgccgggccgagcatttcgcgtcgattttctgcggaacattcgatgccattttgaaggcactgttcgtccgcccaaactttattttggctacttaaatgatactaacttcacatattcaaaacaactaactctacaggttcgatctttttacgtttaaaaaagcattttatttgtaaaaatggtctatttaatccaaaatagcacgatttagtgcattatttttggtattttacgaaaattacagccagggaatttgccaaattgaggtcatctggaatttctaagtcattgggaaaatatttttaataaaaaattgaagaaacaatcttagagtcgccgtaaaagcattgaaagttttacaaggggcttgtttccaatttttatggagtgggcaaggtcatgatgatgcattgtttagatgctggtcgacttacacaaacatattatgtggacaactaacccccttgttgccggtgaactccgaagaattgacgtcgaagtgtgcgggcacttggcatgtccttacgaggaagtcccggaaaaactaatggaatttctcgattggttcaactgccacgagaacactactgacattattacactaacagcggagacgcattatcgactagtaatgcagtttaattattagattagcagacattttaaaaacaaaatatgtaattaaaagccaaaattctgttctgcaaagcaaatttagttaaatgcataacacaaatggcaaaataagctatacacacataaaaatataattcaaataatgaatgataaatagaaaaatgtttagttttattgtctcttttgttcacccattcaatatttagaccttcattcatccctttgccgacggcaacggacgctgctcgcggctattagcaaattttgtactggcccggaagggatttaacactgtacttcttgatgaggataggcgtaatgaatataatgcctccctccaacacgctaacaacaccggggggcccggcgcccacacgctggaacttacccgtttcactaatttatacgcccacctcatacagaatgcagagttttactaatggataaatatttttggtctgggaaatttaaaataacattttgccaaattctggtgcaatatttaaaaaaaactctgtattctgtatgagttctcaacatactgttctcataataattctaatgtaattccatatttctcataataattctaatgtaattccttatttctcatattaattctaatgtaattccatatgtatcccccccccccttcattaattaatttaatgtataaatatataatttatcccccccattcttattaatgttctaattaatttcatatccccgcctataattattttattttcatgtccctcccctctttgtatatatccctaattaatgtattatcatacctttctccttataattaatgtattttcgtatccccccccccattttcttatccattctaatgtattttttctcgtcgttattatgttttattttttttttcatataatatattgttatttattatacatcttatgtgatttttgtgtgagtaaaacacatttaaaataattttataagggttttcggggtcactgatctcgaatccggcatctatttagataaattccgattttcagacccgaattcgaacaaaaattagaaaattccaatttttcgaaatggcaatggatgatcagtttgttttttttaccttatagcaccacataattcttttcatttttaaaaaaaatttagttttaatatcctcaaaaataggcattttccttccatttaacaggcaagacaaaatcgatattcattagacaagttttgtttcagctttttgcgctaattaaaatgcaaaattccgtcagttcattttgaaaaatcactggataattaacaaaattcaattagcaattaaagtcaattccttgtttagcagaaactcatcaattagtggacaatgaaaaattttgggtctttgattgatggaagataaatgtgctaatctaattattctctaattatcattttcattaatatttgagcgaaatggtccattgcgccgagaaaattcactaaatctgtaatttatcgtcattcgatatcataaaaaattttaggtttattataatataaatcaaaaaattttttattcggaattcttgctgatttatcttcgaaccccttttcaattcttcttaaaatctttccgctaatcacatgtaaaatcaatggccaagctgagtttgtcctcgtctttgttgtacaaccctttgctcggctccatcaattccttaattttggtgatttttttattggagctaaaaatagaaggcgatcaaatagggaacacaaaaattagtaattttattgtgagaaataaattaatttgaatcaccactcaccgcaaaactaatgaaattgtgaaatccacggcttatatttttattaaaaatgcgatcaccacttcttccaattaaattctcagtgcctttcttttgagaaataattcgaaatattcccgaacttttacaaga

SEQ ID NO: 2328 - DNA, 1704 bp, Heterodera glycines
aaccgggaaaaacaagcactggtaagaatgggggtctgagtgaaaaaatagagatgaaaattgaagctaaaggaaaaaataataattaatatagtctttaaaatattcattgatttcctatcggcaaaatatgattcctcaaatttttttaattgacatattttttatcatgttttaaagaaaacccatacaaattgagcctagtaatcccaaaaaccagcctttttgttgaaaaactgttaacaaattacactcaaattttcaaaattttccccggcggcgcctatcggcaccgccggaccctcttcatccccaaaagttttttgaaaaaagcgcgccgcaaaaaaagtgatatgaaaagtaattctgtatttctaataatattcgatcagagtcaaaaaataattaattgtttcaaatactggagtaaatttgatttgaaatttttaatttaattttgcattattttcacttgaaataaattaaaattgagttgtttaaaatttttacggtataaattaaattatttaatattggagaaaatgtataaaaacaaaatttttcatttttgaatttgttttttatacataaatttcctatttattttttaattactatttcgacaaaatacctaaaatgaaaatttttgaaaaattttcggtccttggaaattcaagggccgctttaatagaagggccgttttaatagataacaactgtggaatatatcttgcgcaacgtttatctttaaaaaaattttcgaaaaaatcctaatggattgcaattttcaggaaagccacattaactaattggaaaattgacaaattcattaattttacggtgagttgcgaattaattcttttgctcattaaaacccctacttttgtgttccttatttatgataaagttggtgcaaaagactttgtaggaattttttcagatttttctgcaaatttagaactaagttttatcgggtcagtttttggatatttgttaatgcactaatatacagtcatggtcataagtgttgtcccatcatgctttgaaaaaaataattgcgtataaaattgtcattttccaatttcaacagataagtagcataccattggatagcattttttatgggctttccaatgataccatatttgcatttgtgacataaacatttatttgatttattttaccatattcacaatttgatcaaaatataggtggtcaaaagtgttgtcccatttcatttttaaaatattgcttctctggatcagcattaaaaaaatctaaaaaaattcaggtaagcataactttggatgctgatcagaaaagttttacaccaagttgatcagatcactccttcatgccgatctgatcaacccattttggctgttaactatggagtacttttcaaaagaaatttctaggcagttgtagagaattttgctggacattgtcaatctcgcgcattttatagagcaccaatactcaacaataaatggaaaagcatatagcatctgagcaattatgccaactgaggaatggaccgtcggacgtctgctgagccctgtgggcacacttaacaagcggaggacgaggaaaagtcttgggacataaggacgagtaggggaggggggaaagtccaccccacaaacaacacctgacagactctgactgactgatgggcttttgctgatcccataagatggggggg

SEQ ID NO: 2329 - DNA, 4092 bp, Heterodera glycines
ttcatttacattcattcattcatttccctttttccgtttaagtgccaattccgtcgatgttcaattcgcctccgtttgtcgcaactgcacacttttgatggagaaagatgcgcctgaattgggcgaacacatcatagaaaagggatgcgcagaagtggacatttccgcggaggtaaaaaattaaaaattgccaaaattttccaaaagtgaattttaaaggcggaaaagccgtgccttggcaaagggaaaagtgtcggcggacggtgccaatgcgaacagggcttttccggggaacagtgccaatatcgaggtgggatcagacgaaataaacccattgggcgacaggagggggagtgctaactaacgttcccaccagatgactgtacggaggacggcgactgtggccacggagggcgttgcgtcgcgggagccattcaccacgggcaacggagctgcttctgcccgtttggcttcattgggacgaattgtgaacgaagtcactgacccggggggggggataattgtggctgaaaaacggcgaacattctcagaatcgagcataacgccaaaggacacgcactgtttcgcccacggggggccacggaacggaagtgccaatggcaatggcagcgaagtgttcatctacggaatattcaacccgaactgttactcgtcgagggagctcaacgaggacggagaccgaatctattggcgattggtcggcggggaaagacggcacagccaaagacaatgccaacaattccaataggtgggcaatcagttggaactgctgctcgacttccgcaccaactcgtggctgtccctgggctggcgtcccctcaacatccctccttcgtgtcgactctttccccaaatgcacggcacggcagccgaaggtcggcacggggaggacggagtgcagacgagcggatttggttggtggtgacatggccaacaaatggccattcattggctgccaattcagcaaagtccgcgctgagtttgcctttgcatccaatggactgcaccgacgtaataatggcctcggtgctggagggcaccgaccttttgcacattgccgacatgtactctcgagatcggtcgagcccgttgcgggacgcgtggttagacggcgaagactctctgtcggcagcctacggattggcaaccgacgacggacggacggtggtgatgttccgtcggatggtgcccggtcagaaatcgaatttggcattccattggcattggccttaacccataattcaaatcagaaatcgaacccaccgaccatccgttgggtcccggcgaattgtttctcatttgggcaaaaggtcagccgaagaagccaaaggacaaaggcttttattcggacggccaatggaaataccacggaggtgaaaattggaggggggggggaaattcggaggataaaaatgccatcaaacgaaagacagcggcagcggacgagggcacatgcaaatggaattcgtttcattggagcaaatgggaaaaattcgggggcccctgattcatttggacccgccgcaggggccgaccaacacaagcgaacaacgaacagcagagaaagggtgggaggaagaaggaaaagcaatgccaacagcagaaagggtaaaaaggggaaaagcaaaggaaaaaggaaaagcatgaaaaaggaaaagcaaaggaaaagggaaagcataaaaaaggaaaaataaggaattaaaaaattaaatgttcatcaggtgactaaaacaacaattgccacgacttcgtcagtgccaacaaccgaaagtgatcaaacgacaaaagtttcatcgcccgaggcaacaacgaactcaaaaagcactttgacaacgcaaagtcaaacgacggacaaagaacaaaatttaacgaaaacagaagcaaaaaatgaacaaattcagacagaggaaaaggaggaaattatgcaaaatgaaaaggaaacgacggcacaaaacaaaggacaaggaaaagtgccggaggggacggaagaagccgaagaggaaacggagggggagggggaagagaaggacgagacgagcagagagggcgagcggaagacggaggaggacaacggcacgccgcagcggacgagcggcacgggcggagggacgggcggaagcggcagggcatccgacgcccatcggttgcttttgtgcggtgcttttgcagtcgccgcactgctccctctgctcgtctgatcagtgccattcatccctttcacattttgccaccatttttgctcatttgtgccaatgtattgaagcgattataaatattatttctttttaaattataaatttcaaaaaattaaacgataattcgttaaacaatggtggaacacggcactttcgattcattgaatgttccctatataagaagtttctacccatgatccaagcttaaaaattttggttcgggtccggaaagtgctctaaaaagggaggacaagcacttttggtcgggatttttccaaaaaagaaggaaaagggaattaaacggggaagaggcaagcgacccggtggtcaagtggttagtgtgcttgcctttgagtatgtgctctcatgggttcgagtcccattaatttatggtattttcccgtcaaatattatatttaaattattcggtttaaaatttgtttttaatgtttttcttataagaaattttatgagcgagttaaaagagaaagaaaggcataataaaaaatatggagcaaagtacttttggataaaaattgattactttccttttttttatatgtaaggcacactcgccagtggtctttaacctcgccttttcaataagcaaaaaatgtctcctccttttctttccccagttcattatcaattgtttccatttacatcagttttttactgctcctacttttattcaataaatatttccaactaaattattgctgttttaatagcataattttttagagacttcatttatttgcactttttgagatgttccatttttgaacgttttttgcataccttaaaaatggtcaaatcaaaaaacaaagatgtttgtgcacatctacaaactcttggctttcgaatgataccagggttgtttgggtccgggtccgggaagtgccctaaaaaaggagctcaagcacttttttcatacatattttagcatttagataagaggaagggaggcgaagaggaatgaagaggaattgaaggcaaagaggaagcgaaagggaatgaggaacaggagaagaggaagaaaaaggggaagagaaagggggagagcaacagaagggaaaggcgaagaggaagagaaggggaagaggaacagaaggagaagacaaagaggaacagaagaggaagagaaagggggagaggaacaggaggagaaaagaggaagggaggcgaaaaggaagagaaagggaagaaaggagggaaaggaaaagaggaacagaagatgaagaggagcaaaagacgaacagaaagagaaacaggaggggaatagagggaaaaagaggaagagaaggggaagaggaacagaaggagaagacagaagacgaagaggaacagaagaggaagagaaaggggaagagaaagggggagaggaacaggaggagaaagaggctattcccggccattaaaaaatctaattcccctcttataaaagctttttggcgcgtagcacttctctagagacagtgtttaatagcaaagctatttcaattttttaaaaataaattaaaatcgtctctttcagtgcccgtagggcactggttaaatgtaattataaatattccccaatcattcaattgaaattgggccgtattttctcaaaaattatgcaccattaaaatttatcagataaatttgaataaataataaaaatttgtaaagtgaaaatgttgcgacgaggtgaaaatgggcgattaaatgagcaaagaaaaacaaacaaagaagaaaaaggcgtaatattcacactaacaacgcttaattaattaaataaaatttcccagttttcctaaattttaccttcatccaatttagtgctaaactccctattcttaaacactgcaaattttttcccggcgggaccggt

SEQ ID NO: 2330 - DNA, 5532 bp, Heterodera glycines
ttcaaaatttagaaaaataaataaaataataggagactcagaaggttgaaagatttcgcataaaatctgatcgcaagtcaatgtgatgaatcaacggtcttatcttccccataaaacttgttttcacgactttttagaacagaaaaaaaaattttccaaaaaggggtgaccatcggcagtattatcgattttgctgttatttacgcatccctaaatttattattttagatgtaaattccacaaaatttgaccaaatttgggattcgtttgaccattcaattctggatcgcgtcccttatgttgctattcgacttgctaaggacactgaaggcgcaaatcaattcgctcaattctttcccactccggtttttcctgtctgttactttctcgggctcaatgctcaaccgctcgaagttctgactgccgttgaacagatgaccattgaacgtttgaacagttcgctcgctaaggctatttcggtaattcaccaactatttttaattcgttaattataatttttagctatacaatgaccaaatgaaggaacaaggctttgccacagatgcagtttcatttcaatcgaaaagcagtgagaatgacagtggcaaaaatacttccgaaaatgttcccgagcctctcaatgccacttcgaatgacgagaaactcgaatagttcgctctaaagaactctgcaatcacatccaaatttttaaaattttacagttatcgcaaacggctcgaagaaaagcacaaagaagacgccatgaaaaaggagcaggaggagcgggagaaggagataatgcgcagaaatgaaggttggaaaagacatgacatttggaagttacttttgattaaggcaaagcactcgctgaagttcgtgagaaacagcgcgagagggaattgaaagagatggcggagcagcgacggaagcaaaaggaggaggacgcacaggcactgaagcgcattcgggaacaacttcaacaggacaagtggggcaattgacaaataaatttgcacctaaatgcttctccatttcatagactaggaacactttggcctttcacacttacaattaacgcgtcattagtattcttgacattattcattttcggaactgtgatttttcctgtccattcagagaagaaagagcgaaacgaaccaccggagggacagtccaagcggagcctgagagcaaaacgcccgaaatggtggagccaattagggccccggtgaataggttcgtcgttttctgattgaagttcgagtcgtcatttttcttcgatggttatctgttttatccctctttcagtgaacagtgtcgtatccaatgcaaatttcctgatggcagcactttgaccgatgttttcccgtccgattctccccttcaggtggtccatgacgctgtttctcgtgtgagttcggactttcttacctcttccaatttttacatttcatttttaggattcgcgtgctccccccaacttctttttggttcagccttaccctcgcaagaaactcaacgaatttgagaaaactttgcttgtgagtcgctcctcttttttaattgcaacactcattcattcccaattaggaactcgatttgacgccgtcttccgctatcctcgtccttgcagtaagttccacaaccaaatttcatattttcaccatacattaaaaaaagggggcgggggtcaaccaaattttttgcgaaatggtccagccatgtaaattgacaaccttttttatgcttttcaaaacctctttttttgcgacactctttttccaaaaaaagaaaagttcattttttataactgacagttttcattttaaggccttttccatcgccatccgttccgatcatagatgggatcgaatacgaaaagacaattttctgtctccaactttccctgtaagttttgaaaatgcgtatatttgtacattttaaattttagtttccatttgtcgtagataggatcgaatacggttctttggtgcattacgttcatgtgtgcaaactgtgcgccctactcggccgtcaggttaccccctattcattatatctaaacgaacaaaaattcaatttttaaaaacgaaaaagtaaattctgcagattcttgggttttggtaaaaaaaaaaactcgggtgaaactatgaggggaataaatgcacccatttgttcattcattcgttttcctctcaaatcattaaattggtactcataatgtatttgtatttgactgttttgttcggagtctaaacaattaatcctttttaaggctgccaaacagttgcggctcatcaaagacccattggaagtgcggacgcgcactggcgaattgctgatgggcgtcagcaaagagaaggttctatttcattttaagttctttaatttcctattgttcagatcgatattgtaggcccacacgggcgcaccttcacgaggtgtgtggctgtgagtaaccgcccggttcagccgggcggtgaaaggctgtcgcctccacccaatttgaggtttcccgaatcttttttattatcattactgaacaaatttagagcacttacgcccgcaatgcctttccctgttgatggtggtccgatctttggctcatggagggttttgctgcattcatggaatttttgttcaccgacaaatactaccctgaatttaacatttggtccgattttgtcgacgcggaaatggtcaaaacgctggcttttgactctaagcgcagtacgcatccaatcgaggcaatttctataaattgatattatattgtaaatacagaatttttaggttcctattgataacccaaatgaacttgaagaaatttacgattcgatctcttacgcaaaatcaaattcaatcattcggatgctcttcaatcatttgggcgaagcgatttccaaaaggccattcgcgattacttgaaaaagcaccaatacgcaaatgcagagaccaacgacctgtggaagagtttgtccgacgcttctgggattgtgagtttaaacaataaattcaatgtcgaagcaaagaatttccgcacattaaatatatttgcaactttatttcaaagaaacaaaaacactaggaaaggaaaatggttttacattttggtttaggatgtcaaagcactgatgtcaaggcgcttcgcacacgacggaggaggaagggaaactttcctccgccaacttcggctcctgctcgccgccttccaactccgtgatggaatgctcaacaacgacggagcaacggccgggcaccagcgaacacattgacaacgacgaccactgctcatcgccgcccgttaaaccggtgggtgggtctgtttgacattaattcgctttatttaatcagcctaactaaatttgaacgtttagtaaatgaataatcatgactaatttcctttcagttgacttatgcgcaagcagcggccaatagaccgagaagaaatactgcgagcaatttggatacaaaatccttccctttttccaacgtcaaatgattgaatttccctataatttctgattttttccatcactgattgctgattgtgagataaacaaatcgaaactaaattttcgccgttcgatttccaatgtttcggccgaattcgcttccctcttttcttctttatattagcttctcctcgcctttatgcagagaaagggcgggaggaagaaggaaaagcaatgctaacagcagaaagggtaaaaaggggaaaagcaaagaaaaaaggaaaagccaaaaaaagaaaaatagggaatttaaaattaagtaattttcattaggtgacaaaacaaaaattgccacgacgacttcggatttggttggtggtgacatggcgaacaaatggccattcattggctgccaattcagcaaagtccgcgctgagtttgcctttgcatccaatggactgcaccgacgtaataatggcctcggtgctggagggcaccgaccttttgcacattgccgacatgtactctcgagatcggtcgagcccgttgcgggacgcgtggttagacggcgaagactctctgtcggcagcctacggattggcaaccgacgacggacggacggtggtgatgttccgtcggatggtgcccggtcagaaatcgaatttggcattccattggcattggccttaacccataattcaaatcagaaatcgaacccaccgaccatccgttgggtcccggcgaattgtttctcatttgggcaaaaggtcagccgaagaagccaaaggacaaaggcttttattcggacggccaatggaaataccacggaggtgaaaattggaggggggggggaaattcggaggataaaaatgccatcaaacgaaagacagcggcagcggacgagggcacatgcaaatggaattcgtttcattggagcaaatgggaaaaattcgggggcccctgattcatttggacccgccgcaggggccgaccaacacaagcgaacaacgaacagcagagaaagggtgggaggaagaaggaaaagcaatgccaacagcagaaagggtaaaaaggggaaaagcaaaggaaaaaggaaaagcatgaaaaaggaaaagcaaaggaaaagggaaagcataaaaaaggaaaaataaggaattaaaaaattaaatgttcatcaggtgactaaaacaacaattgccacgacttcgtcagtgccaacaaccgaaagtgatcaaacgacaaaagtttcatcgcccgaggcaacaacgaactcaaaaagcactttgacaacgcaaagtcaaacgacggacaaagaacaaaatttaacaaaaacagaagcaaaaaagaaacaaattcagacagaggaaaaggaggaaattatgcataccaagaatttttatccaaaaataaccatttaaaaaattttatttacatattttagtacatggaggtttttgtacatatttcatatatattttagcattttttatatatattttatttacatatttcgcgatttttcttacataaaattcccagccctagtaattataaaatattccccaatcattcaattgaaattgggccgtattttctcaaaaattatgcaccattaaaatttatcagataaatttgaataaataataaaaatttgtaaagtgaaaatgttgcgacgaggtgaaaatgggcgattaaatgagcaaagaaaaacaaacaaagaagaaaaagaaggcgtaatattcacactaacaacgcttaattaattatgctaattaccggcattgtatgtcaatttgtcattatttcgtaaatatttatttgcgcatttttctgtccatgcagtggtcagtccgtcccatcgtccgttccgtcacaccacagttggcattttcaaattcgtcgccattccgccgccatttgccgcaaatgacggcactgtgccaccgttggcactgttcaactttttgcgacggggcaatgactttttgaagtgattgtcagggggagagacgacatacgaagaagcggaagggggaggaaaagcggaagaggaaaaaggaggaggagggagcagctg

SEQ ID NO: 2331 - DNA, 881 bp, Heterodera glycines
ggggggggggggaatttgggatggaaaaagcgaaaacgaattggcacttacggcagaagaagcggcggaggaggaggcaccgaacgaagtggggcaggggatcagcgaactcgggcacggcatttcgcgagttgttcagaaacagcggcgtttggccgtgtcccttctccgtcgtgccctcctcgtcgccgcccctttccatcttcagttgcgcggtcgccgctctgcgcttcatcgaattcaaagagaaatgcccgttcggctgctgcaacagactctttgtcgtccgcgttttttgtccgttttccgtcgatggcatttgttgttgcggttgttgcgcggcaattgcagcggtgcgttgcttcgggggactgttgccgacgaaaggcattgcccgtggcaatttgctgccgttgttgccgatgccgctggtcgacgcaacgccaatcggaatgcgactgtgcacgaggggagacagaatctgttgctgttgttgtgttggtggtgctgctggtggtggtgatggtggcatcaccaccggtttggcactgtttggcgctgccggtggtgccggcgacaaaacggcaaattttcggctgtcccttaagcgaaattctgttgaatggcaaatttcaatttttcgcttatgcttacatttctgtggagttctttagttggatgttcatcagaagatcctcgtcctccctttcgccttcgtccgctgaattactgcttggagtcgtcgaagtgtcgtcgtctgacaaattttcagccgtctgcggaaatgggttgagactgaatgggccacgacgagctgagcatggcgacggcttggcaatggtattggctgttgccgactccgtccccgcgtccgtcttctc

SEQ ID NO: 2332 - DNA, 1979 bp, Heterodera glycines
tcggatccattcgacagatttattttgatttttcttcaaagtataattccaccaccaagcatctttttattcagttaattttttatttaaaaaataaatataatgacttgtctatttgtgaattattgaaattattggggtgttccgttctgagaagacaaacatttgagggcaaatcaaaactcacccccatttggaacgactgtcctcttttgtcgatagctttgcactgctccaggaaaccgcatcagttgcattttccacccgagcgaaacgttcgactgcagaagcgaagggcgagcgaccgtcggaagagtcttctggcctattgcgactttcaattgctgaaagtatcaatcaatgtttgggtttgagagagggataacaaacagaaacagtcgccgaaattgggccgaagtcgatggtcaacgtttaagcgcacattagccgacgatttggagaaaacatttgattcttcggcattttcctcctcttcgtcgcccaaaaatgagtacatggacaatgcggatggcaattgtggtttgtattcgcctcgttgagtcgagtcaattattctttttgcgtttccgcttttgttatcgccgctgtcggagtcggagtcaaaggaactgaaattaaaaatcagaaaatggaaagtttctgaactttaactcgaggaatccaccagcacttgtcttgtgccttctgtaacgctgtggtctttcgtgcgatttctcttccgttgcggcagcgcccaatgccaaaatgtcgtcggttttcaatgcgggcaaatacgaagcgccaaaatccgaaacggcacgttggcgtttttgtggggacgaaatggaatttgttgtgccgccgcttgccgaactgagtctaacagtaaaagtgaacaattaacaaaacactctttcccctactcacttgctttcattagtcaccgtcgactcttttttccgcaatttgtcctctcttctctcttttaccgatgcattggcaaagtgtcgtctcactgacccaaccgacgaccgtcgttcattatgttcattgtctttgttcatcggattgtccattttggcaatggctgcaaaatcggacaaaaaatttcatataaatcaccgatgataatcaaaactgaagaattggacgtactcggaggagaaggggaggcccgagcgagcacctcagagacggaagggaagcgcaaaagttgaagacgcacttccctggcggaatgggagacgagttggacagcgtcgtgtcggcttttgttgaagagagaaacgcctgaaaagcacaaagccatcagcggaccaaaggacacacaatattagcatcaattaatcattcactcgttgatattttaccatttacactcagaagacagtctccgaccagcaaacccttccgttttccgtcgccctcggggctaagcgacttcacaaacactgtctgaaatagcaaagttcggaggatggtggtgcaaaaagcgcaccttaaccccattcatgtccccgtcgatcagagtcaatcccaagccgtgcaatgggtctttttccagaagaacgttgatgcgttgtgcctcagacccataaaagtactgtaaacaaatcaatgaagaataaaaagggtatgggaattgcctcgatgtattccttctccgtttcgaacatcaaccgacttccgtctgccaaacggtcaaagttcggtgtccgttcgaactctttccatttgggaaatgacaaaatgattaatttagagagaaagggcacactttgtccaattcccatctgcggatgagaagcgtttctggcgtgaaaatgacgcgattcttcggcagattcaatttgctgttcatttgaaacttctaaaaaaccgttttcattgtttctttcttaaaacgaggtcattttaaattccaaaatccgcccaattcccccccccccccccttacaaatggctttttccgctttgtc

SEQ ID NO: 2333 - DNA, 1992 bp, Heterodera glycines
  misc_feature (1948)..(1948): n is a, c, g, or t
cccccccccattagaaatggctttttccgctttgtcttccaatttccccgcttcgctcgtcgaccttcgcttcgcctcctttgttccacgccgacgtccttctgccactccaccaaatgcattctgttcagcgtcccctgccattggcgcattttcagcatgaatctgtgctgagaggcggcaaaacgaaccaaataagaggcccttatgaaaattgcagttggacaaaacaaaaaagaaggcatcacttcgaatggtgatccgtgtagaaaacgtggtccacggcgatgttctcttcgatggtgcccaacagaaagcgttttcggtcgaattggagtgtccgaatcgtatgcctaccaatttgaaaatggacggtaaatgtcataatatgtctttaaaaaacaccagtcgaacgaaccattcgtgtgttgaatttagcaggcgttgtgcgccgtttcgctcctcacgacaaatgccaatgccggaaggaagcacagcaacaatccgagtgtcagacaaaaaaggacgggaaggcgtggcatagccacgcttaggctttatcttgtgcacacggtaaaaatgggcaccataaaggggctaaagggagaaaaaagggagtgaatgaaagcagcggaattggcggaacttcggcttggcatcgcgcgatgaactgttcttccgcctccaaatagccaaaagaggcggcgaaacggcggtgcctttcggcaattctttgctgtgtttgaaggacttcgtttgcttcgattgcgtaaaatttctacaagaaaaatcacaaaataatctttttgagcaaatggttaacaaatagctcatcaggatttcgtaagttcgagtttgttttaccgttggcatgtaatcctccattctgaagtactcctcgtccccttttggaattgaattcgcttcggcacacaatgccaacgccgccatttccatcgcgcgctctttgggcgaaaagcgcagcgttccgctgagaatgtcctggcgcagttggaggtacaattggtgcgctgtgttcgccgttctgcaaatttgtgaatggagtcgtggcacggcacaacaaatatttgattaacttgacaaattcgcgttttttgggatagtaacggaatcgcaacaaaagtgcgaactgttcgacgccaccactcgcggaggggtcgaagtgacgggaaagagtgcctggacaaatggaaacgaaacgacgcggtaaatttaaatttgcattggcaccgccggctccgaagcttcgcctcagcccggccccgcccttccaccccggcggcgcccatttctcaagtcgctgatgctcctccagaaaaatgttctccccaaattgcctttggagggccaacccgaagaacaaatgttcagttatgttcaaatgctgaaattttggattaataacggatttattcgcaccgaacttcggcaacggtgtgaaagaccgagccaatcaaagtgtcggtccggcaattcacttcgacactgtgcccattcaaaagacggacgaaaaccacggccgagtcagaacggtgcaatgagaccattttcttctaaaaaaagttagaatggaggtgaagaaagaatgcgatgaaaaaccacggaactcttttcatactctgcgctctgagccgaatgataggccgaacatttggactcagaaattcgggaacagtcggaagaagcgaaagggactaaaaaggggaaactcagaaggaggtgttgaatcgcagcacatttggggcccggaagtgtccttctcccgccgctttccctccttttgctgcaacgcgaaggttcgagtgaatttttgcgttgaaattgcgcgttttgctctttcgtcgtcgtttcgtccctttgactgtccctttcatgcgccactttttcgtttcgtccctggcgaaaagccactgacaattccatcggncgagtccaaaaaagagtcgtcgagtcgccctttcgactcatcag

SEQ ID NO: 2334 - DNA, 2294 bp, Heterodera glycines
tcttcttcggcatcatccctttgttctcttttcggaattggcgttgattccctcggcgttgatccgtcttcgtccgttgaactttcgtaggttttcggctgccgtgtcggtccttgcaaatgttgctcaaattcggtgtccaaatgagcgtccgtttgaagttttattggaatttccacggagtttaattcgtatctctaaacgttaacaaatgtgctaattaaccaaacgttcccactcatcgaaagttctaaaaaatttaatttttaattttcttgctttttttagtccattaaacttggtcttgatgacctccattttctatttatataagagcacccaaactcgaattcgaacaaagccgagaattactgtcggatttcaggatacaaaggcaatactggagaagttgggtccacccgaaaaaaagcacttttttattattaaaatgtccatccgtgggttttcggggtgttgatcacgaatatgatatcatgttccaaatgattggtaataaatgctgaaagtttgtttatttttatgcgattggtcttgtccatccatgatggtcatcattcgaatttcgaaaaggtgcatcgaaaagatggatttttaaatcattgggatggtccactcaaaaaactctgcaaaacccatatttgatatttttgtgaaaattttcgattttcctagttggtagtcctccctcctccctcactcaatttcacaaaaaattactaaattttttccaaaaaatccacagaaatggcttaaaatcacaatttgtcatttttaggcaaaagttgcactcaaattttcaaacatttgaacccatggatggatattttcataaccaaaaatgattttttcatgatgagcccagattcatcaaaattacccgaaaatttacagccattaagaaacaaaaatgctgattgtgagttgtgtagaatataagaagaagttctaacaactcatgtttccgcttggtttgaagtaataaaaaattaataatttggtaacggatgaatggcttaaagcatcggattcccaatgtcaaatggttttatacttttgtttcgttcattcaaaccaccaacttacggcacaatcagcaatggaattttcagttgattcgctagccaacaaattcccgtgcaaccgatcagcgatttgtgaagcattttgaaggttggcactcgtgccacctgcaaagctaatcacagtacacaaaatgggcagacgaagcgcaactcttttgctgctccggcgcaccggggccgggaataatgctaattttggaggaacgactggaggagaagcgaatgtcatcgtcgaaagggtcggccaactgaaaagaaagcgtcgaatgtcatcaaaagtttgtcgcaccagctcatccaagtcgcccatcacttccttgaacaaattggaaataacttcttggactttggccagctgaacaatgccaatttggttgcggaccatttgccagactttggcaagagtcggtcttgactggacttggccaaccgtcatcagattaagcaacgaggagagggaaacatcgcgatggccagcgggttggaggaccttcaacaaaacagacaatgcacgggtttcgaatcaccaatctcaccctaagacagctcatgcctaaacaccaaaccaaattgagttcttccgaattttgatgttcttccgacggatccggtggaataaattgatttgttgacaaagtggaagtcaacagaatcttaattaatgatgagaagaattaattaaccactgactaacctcaacccggccgtcgctcgtcagaaagatttggttcaaagaaaaaaaactttttgggctttcattttgttttatgcgagtgaggaaatcacatgaactcgaaagcaccgaaagaagttcaaacggtgcaagaccaccgatacgcacctctaacaattctgccaaattgattttctgttgagtgttctcaccaaccattgaggaagaattagctaaatgcaaatgcaaatttattttcagttttatttttatttttttaatacaatgcttcaaagaaatttgttaaagttaaaaaatttaattttaattcgtgagtctgttaagtaaacgccataataaatatttaacccatcagctaaaacagaaaacatctgcgaatacaattttcataacattttgtaaggtcactgatggattttgaaaatgttggcacttccgtcgctgctccatttttggcaccattgagcggaatcgttgtcacatttaccggattgagc

SEQ ID NO: 2335 - DNA, 3830 bp, Heterodera glycines
  misc_feature (3671)..(3671): n is a, c, g, or t
  misc_feature (3776)..(3777): n is a, c, g, or t
  misc_feature (3805)..(3805): n is a, c, g, or t
  misc_feature (3819)..(3820): n is a, c, g, or t
ggtttatttaggctgtttagcaagagttaacttgtttgctgcacgaaatgggagcgcaaagtatggcggcgatgaattgcaaagtcactcatttgatcgctgagagatgcgaccccgaatccgagaaatacaaggcaacttttccagaaacaaacggcgccgttttgagttgccttgcaaccacagctatttagtttgctttaaggaagctcggcgcaggaaattgccggtgttgttgccttcatgggtttttgctgccaattccatggaccgccgtttaaaggacactttaaatgtcatcacttcagagaaacaccttgacactcataaaactccactttttgctggatgtgtatgtttaataatcttccttaataaattcggtgcagccttcgtaaattgggtttcacgtcttttacttatttctattgacttgtactctctctcacttcagggtcattcaataggtatattatctttttatttgcataaaactgtttaagagcagaatttatttacttttcctttctcagaatttttgtaataagatttaaaaaaggacaacagttggtttttcggttgattcattgttcgtcttgccattttccaggaaatcacagtgtccggcttccccggcgccgaccgcgttgacattggccgtctcgtcgagttgcacggcggggtgttcaccggacagatgaaccgttcttcgtgtacgcatttaatcgcagccacaaattcgggcgaaaaattccgtaaggcgcgcgaatggggcactgtttgggtggtgacgagccgatggcttcgcaaatgcattgaaacggcacgaccgattatttaattttaatttcttcattttattttccagggatatcgtttatcggagagtcgttttgcgcattcacacgacgaagacaaacagcaaagggtttccccaagtttttctctgataacgaaaaaatgaaagatatttgaattcgtatttgccgttcgaattaagtcgaaagagaaattaggatcggattccccgacactggaaccccagaaaaactatatcaaaaatcttttttcggaaagagagcccattacattattcccgaccatttttattgagttttatagccattggattgttgtgctaaatatcaaaaattgctaattatatcattgtttttatttttttaaaattattttgtgcttaataaatgctcctccgttcttcaattaaaatggctgtggtggtaaattttcaggtctatttggtcgaaaagttagctgatgtagaattccgcttatttcttgtaaattcaagtcaaaaatgatgacgagtttttggcataaaagtgattggccatttttggtgaaaatctgttaacaaagcacacccaaaacttcaaaaattttccccggcggtacctaacggcaccgccggtggtcccttctataagttatcattagagaccgactaaaaatgcacccaaaaatcgcaaaaaaggcagcaaaaataaaaaaaggcacgaaaatcccgaaaaaggcatgaaaataggtatttaattttttctttaattttataatttttttcgaataagaaaattttcaaaaaaagtggaaaatgttttttttttttgctcaatatatcggaactaatgcgcagaaaaaaggcatatgcctcaaaagtcggtctctagttatcatgtcacacatttggtttagaattcgaatgttagccgtcaattttggagataaattgaaattcagagtgtgagataacacggtaaaaacccaatttcgttttttgcggattcgtttttgtaacgattcgtttttattatcccgattcgtttttttggttaaaaacttcattttcaatgaaaatttttatgtattacacgctactgcttaataaaacaagactcagcgctaatgaattgcagtctaaatgattctgacccaattttcatgtattttaataacaatgtaaaatttaagcatcttcaaatataaaagttaaataaaaattcatatgaattaattcatgatatccacttctccatcctctgaattaacatcaggcgagttttcatcttgcacttcattcaaacccatttcttcaaagtattgatcaacaagcagcccattttcatccaaactttgttcaagcaaaagccttgcatcttcttcaattatcatttcttcagcttcattacggtttgacggcggattgaagccaaccaaatgtccaattcttccataataattagacatggcttcaacaaattcatcattgcagtaatccgtgttcaaaaaagccaaaatatccgccttcgctgaggcaattcctctgtccaattcaagagttaattcaagcgggcgagctggcaattgtcttccttcatcaacggccactgcggtttcttcttcagcatgccttagttcctatcatttacgatacaaaagttagagacaaacaagtacctgaaaacttgctatccatcggccgagcaagaaaccaggctggtaaaagcgttgctgtcgtccgtggtaagactcagcatggttgattcttttgagctgtacaattgcataaatcccattgattgaattcggcgatttatcgcttgcttcacatgaaacgcgcacatttttggtctgacagttggaaaaacatcgcaaaatgcattcactgacgcagattcgtagtcaaaattcgcttgggaaatctgagcaaatcatgccaatggaacacaatgcgtttgtgcaataaatccaaatactcggtaaatctggatgagcatattgaattaatcaaatatattcacattaaacttgataaatgcctcgcggtgccattttgaaagtgccatcacaaacaatcgtttccgttcgtttaaaaagcgccaaccgacggggcgaagaaaagagtgccatcacgtccgtacactctagcaaaaaaagttcttggaagtgatcgctttcctcgtgtgcaattcttccacgataagtcagccatagaggcttacttgtttttcgaatcggttcgcaaaagtgagggtactttgcaccatcgctggcccatgatccattttcaagcacttttctggttggtaattttctgtcgcttggaacatctttccggtccttgattttccggcaaccagcacatacaaagcgttgaccgtcatcttttttgactcctgcagatgtccatttgtagcaataattcggattttcggagcaatcagttgtcataactgttttagaaccaatacgcttgctatataatttcattatggcactaaatataattgtttacgtttttttttataatcaagaaattatgaattagaaaattgcaggcaaaaaacgaatcgggataataaaaacgaatcgggataataaaaacgaattgggtcaaaaacgaatcgttacaaaaacgaatccgcaaaaaacgaattgggggtcgttcagataacactggtagaaaagggacgagaggagaacttgctaaattcacaaataaggaacagaacgcgttacaaaaaatcacaaattaagaagccataaaatcaaatcctttcttttatcacttgacaatgttctaacacttgtctacgcgcttgtgatttgatggtgtggccttgaaacaataaatttttcataaatgaacttgncgcatttcgtgttttctcattataaattttctgagtcacccccaactcatccatacccaactcatccatacccaactcatccatacccaactcatccatagaccnnactcatccatacccaactcatccatacnccactcatccatannccactcatcc

SEQ ID NO: 2336 - DNA, 3624 bp, Heterodera glycines
tgagttgggttaccccaaattttctcttacttttcttgtatttataattctagaaacaataaactgtagtagagccgaaaaaacacaatacatataagtcaaaatacacaatcaattaaaaaacagttaggctatttttgcgaaaattattttaaaaaatcaggactctattttaggaaaaacggtataaaacaaaaaatgtttttcttttaaaaaatgtgtaggtagtatgtattccaaagcgaaattaatgaaaaagaagagagaaacgacgccagagtgtaggcttttctctgcacctatatctctctgcccgtgatgcattcgaccttgcaaaattacattcctaacttgcctatttaatcaattgattgtgagactaatcttccttcagcttattcaggtcttcaaaaccggcataagctgcaagggagcgagaatgtacaggaggagcggagccagacaaagggtctgcggcccgtggttaatattttgcctattcgttagcacgcgttcccatccctttctgattaatgctaaaatacccaacattaatacatattttggtccttcttttaagattgagtacaatcattcaacagatttcattcttatcgtgtgtgattttagattttaacgttctattttcatctttggatttaccgctgatcgaatcgcaaaagggaattgtttggtgcttcgttttgtttcggttcgatcggcactgggtttataaataaaagttctttttcagttgtcttcagtttattgagatggatgccggcttttacagagggacctcttcagagcaggacatccgtttcactgacaaggaacgcaaattgttaaggcaaatgaagttcgaaaatgtgcttgaaacaaaggttgttgtcttcatttttgttgtttgactgcagttgactaaggtcgacttggcaaagataaatcttgatgttatcaagccgtggataacgcttaaactgaacgaaattctcgggatggaagacgacgtggtggtggaatatgtgttcacgcagcttgaggagaaggagctgaacccgaagaaaatgcaaatcaacctcaccgggtttctgaatgcgcgcagagctcgcgaatttatggtattttttcatctcttggatcaccttttgtcattttaggcagaaatgtggcaaatgtttgtcgaagcccaagacagccccgaagggattccaacgagtttagtggagaagaaagtgcaggaacttaaggtaggctgaataattgatttgagaaaacggcccataaaatttgcaaattcttttgcttaaacgtttttaaacactgccaaagtttaaattcgagaaaacagcataaataatcatattgcgttaaggcatcaaattcgaacaaacagccaatgcagacgtaccacaaagcgacggaagtggactggaaccagcggtaccaaacactgacgggcggacgctatgggaaaatggacccaaaagcccaagtgagcaaatcgcatatgtctgatacttttatgaaaggtggaggaagacgacccccagcgaaggcggcgcgatccggaagatgacagagatgaaagagcggagagacggatgaagtacgaagaggggcgattcaaagagaggaaggcaagtgggcacaaatacatcggttagtacccaccttaccaataagttaaatttaaggatttgttacgtgagaaacaacggcacgaagaaaaacaccgagaacgcacttcttcgcccgagtcaccaccgtcgatccgccgtttcgagcgagagcggaaaaagtggagaagaaaaaaaggcaacggtaggaggcggaccgaccagtaaatctcaattaaagtaaggtggggaaaaagcacttgaggaagagattaacgaattaaggggcagacaaaacggcgacgatgaaaaagaaaagtaccgcttaaatttgtttattaataaaacaaaatttgtaggaggaagaaaaacaaaaaggaaaagagtcacaagagacatcgcagcgactcggacagtggggacgaacgtaagaagaagaagcacaagaaggaaaagaaaagcaaaaagcataaggagagggactgagactgccggaaagcaatcgctgttttgcacaagcactattcgcaacagccgttttcattgtttcatttatcaagcgataaagatatgcagtgacgttatctcaatcattttagcagtttgaaccgggtacaattttggggaccgtatgtgctcaggtacaattaatgtacaggctaatcattgttcgcatttgtcagaactgaaaaattaagatcgattcgatcgacaaaggccagaaaaatgcaatgtgtaaaagtttcgtccgcttaaatgtttagcgattgcaagtcattcccccacagcatttgccttcgctcaactccatgtccaacattacctcctcctcctctcttttcttctgccgctccgcctctctttgtgccaattctaattccgctccaattcgatgctgagaatgccaaagatcggcgtatttaccacctacaaaaatgactccgcgtcagtacgttcattggtcgaattaagtcgtacctggcaaccccaccagttgggagtgcgtgccagactcgacgaccatcccccgatccaacacgtaaatgatgtccgcgtcgacaatggtggccaaccggtgggcaatgaacaacgacgttcgaccagagaatgctttcttcagcgaacgcattatattttcctcagtaatagcgtccaatgacgaagtggcctcatcgtaaacaatctgagaaaaagacggacgtcccttttctttaaaataccccaattccaattctctcatttctttgactcccttacaattggcgcgtctttgagaattgcccgtgcgatggctactctctgtttctctccgccggaaagtttcagtcctctctccccgacaattgtgtcgtatcccgcgggcatccctaagatggcattgtgaaggtccgcagtctttgccacttcgaatacctaattcgttttgatattttaaaatttttaaaaaattataatacagaaaacctttggttcaatttcaagcaatttttattttatttttctaaaaaccttcttcactggtgctgcactgtccccataatggatattgtacagaatggtatcatgaaacagcacactgtcctgggggacaattgcaattgcccgacgaaggctgtccaatttgacggcggcgatgtcctgtccattaatgcgaatttgaccgctttgtgggtcgcagagacggtagagcagtcggacaatcgtcgatttgccggaacccgaaccaccgacgagggcaactttcttgcccgaaggcacgtcaaaggacaaagaacggagaataggtttgccggggatgtaactaaatataaatgaaattaactttggctgacataccaagcaaagacggacgcgaaagtgatgtcgcgaaaagaaatttgcgaattggggggagatacattcaaaatgggggcatcgatgcgatcgacgacgcgactctccagcttaatcaacgagaacatcgtctacatgtcgagaaagcatgaaatagagaaggaaggggcaa

SEQ ID NO: 2337 - DNA, 4304 bp, Heterodera glycines
  misc_feature (21)..(21): n is a, c, g, or t
tagtttcaaatggcaaaattntggcaaaatgtaaaatttctcgtttttttcccggaaccaaaaatttaggaaaattacacttgacaaactatttttgggatggaagagcaaaaataaaaagctctttgggtgcgcacctcccgaaaattttctggttacgggcctgtacagtattccctaattgattaccatacaaataaattaaaattttcttcaatttttgttgatgtaatattctacaaagagaagttcaactttagaatttacaacctaataattattaccagcctgttataatttttttgaatcatataatggcacttttaaaatttaaaaaaaaaaaaactaaaaaaaccatttttttcacatttcatagtgaaaaagatgatgattaaaaaaacgaaaatttatctatttaatttaaaaatattgtccattttttattcaaatttttgccttttttaatcaaaactttagtacgaagaaatttcttctttgacttcgggcagcagatgcttttcccaatccgatatgctttgtccatccaatgcacttgttggtggtggtccatcattatttggcgagaatggcaccgatgaatatagcctaaatgttcacggatatatgacacaaaatcatgtgatttaatccctttttttcaaataattttatttcaattaaagtcatttattatgtcggcggcatattcccatccgattggctattatcaattaattgacagcaataatgccccaacaaatcaagaacagatccgagatgaatttcaaacatcagcaattcatcgcgcagcgcaacaagatgccaatggtaaaggtaaatgatgccaaattgaattaattattttgtaaaaaataaatttagctaattaaataaaaacaaaataatttatgtatttcatttttttatcaattattttctaattaaggaaagtcagcagctaatgaccaactaagaaatgaggcacaacaaaataatgcgatgcatgccgaagttgttgcgacacaaatgccacaaccagcgacatcagtcaattatgttcataatcactctaatcatctgatgcacaaccgatcaccgtttgaaccgttttgcacagttccaggcactttttaaacattttatttaaattaattaattattatttttaggtcgtatgagtttgttgagcagcacaacaaagtacaaagtgagcattggtgatattcaacgtcatatcaacccgcctgaatgtttgaatgcatcattaattggcggtattttgagaaagtcagtaattttgggggattttgtgaatataataccaccttctaaatttagtgtaagacaaatttagtaaataattgtatttttagagaaaatttaattaattttgtaaaaatttattaaaaatttttatattatcaagaaatgaaaatatttttatgctaaataataaaatcccgcatcataaaaaagaaaattatagaatgtgagtaaatattttggaatttcgttttactcaaataaaagccccccccacccctcaattagaagctcccccctatatgccaaccttcgaggggggttgaaaaatagaaaatactctgaggcttagtttcagtaaattttgttgttcattttttttttttggtttaatgagataaaacctttaaaaaaactaaataattgatcattattttattcattttaattaattgccattaaattttttccctaaaattagggctaaatccaaggacggcggcaaagcattgagggaatcgttgaagcgaattggcctttcattgccggccggacgccgaaagtcggcttgtgtgaccgcattcactgcattagttgaggaagaagccctccatatggtcgggcattaattaaaatttgtgccattaaaaaacaagcatttttaattttcaaatttatttgtccaaatcaattttaaaaaatgccaaattttatatgatttattaaaatgacaataaaaattttaatttaagcttttttaattttatagacattaaaaggagaatatttttttacgccatttaaattaatttctttaacagtttattaatttcaattattttttaaataattttattattttatttaaaatttgaatttactaatttttgattacatagtatttttgacactttaaatttttaacatttaaggccaatgattttaatgctgttctccaacacgatttcccggccaaggacatcggttttttcctcaatgcgcaattcctcagatatgttggccaatcgccgatggattccgaattggtggccagacgtcgtacaattttaaattgttcaaggtttttattgcaaaatccgaaccttatgattagtggatttagctgtccttggctttcataaatacatacatctcccgtatttaaaaaggctaatttgtaaggaatattttccgtttaaatgtcgtttttttaaaaataaattgacattgaaatttatttatttaacaatcgttgttatttaaaattttcattaatttttcaaatttattttcgggcaaaaattttagtgaatataataactcaaaaatcagaggttttgaaattgagtttctattatttgtactaatttcttcatctcttattaatgcgttacccatattttcgtaaaaaaaataaataaagaaattacaaaaattgcattttttaggatttttatcaaggagatcaccagccttttggctgcggaccgaagcccaatttgcgatcgtcgacctgaattgatgttggacccgagcatacaaaagcaactcacgcatttttcaatggcaatttttatgggttttttgtaaaatttttgaatcaaaatcttattaaatgctttaaattttttaaattcccatcgataagctctgcgttttctgccgctaccgtctcacaaaaaattgaaaaatacataaattttttaaacaaaataattgttctaacttttattaaaatgcgattatttattttagattactcatggctttggaggaattgcaatggtatttttcattatatgttttttttttgaatataattaataaatcttataaatatttatttataaaaataaaaatttttgcagatttcattgttggaagcattggccacctgcttggatgaatcattaataaatttggaaaaattggtcgagacaagaattggtactattccacaacaaacttccagcagcaatcattaaggagaaattataaaattatgataattaattcattaatatatttctaaaataatcattttttcaatttttttatgcataaacaaatatgatcaacaatttgaaatagaaattatatcactttccgttatagcataggaatatagtaaagaggtataaataggatatactgtagccctaaaaataaaatacctgcgaaaccctataagcacaagggatgcgccaattaggggcccaccacagactattggcgcagaagggggggggggggggaggggtgcgccaggactaaatttctaatctaaggcccacaatttttttttcgtccggcggcgatcctttttttgctattaataccgcctcttttgcggcttgctatttctaaaaaaacttttgttgtggaacaggggagggcggggggggcggcggtgccggcagaggccgccgataaaaactttaaaattttatgaaatttgtagagaaaaagtcaatattttcaggcatttccctcttttcctcttcaccaacgacccttccccgtcccaccttttatacagccgccccccttacggcgcaacccctgaataaaatcccataaaatcgtagtgcgacatttgcggaccgacatttgcggaccgacttttgctgaccgacatttgcggaccgacttttgctgaccgacatttgcggaccgacttttgcggaccgacatttgcggaccgacttttgtggaccactatttctgggttgaactgtcaaaaaaaaaacaaaaaaaaaaaataattttttaaaaattgagtgactaagtagttttatttgtgatttttaccaagttgaacatcgcccttcaagagtaattgatcaactttctgcaatcaacatcgaaagaacccattttttaaagaagtttagtttccatagataaatatagtatgtagttgctcatttttaattttggacccatagttttaataacagcgaattacggacaatttttgagaaaaagataaactatttaagtgtttgtttgttaatttaattggtttggcatgccggaaa

SEQ ID NO: 2338 - DNA, 4902 bp, Heterodera glycines
cggtccgcaaaagtcggtccgcaaatgtcggtccggcaaaagtcggtccgcaaatgtcggtccgcaaatgtcggtccgcaaatgtcggtccgcaaatgtcggtccgcaaatgtcggtccgcaaatgtcggtccgcaaatgtcggtccgcaaaagtcggtccgcaaatgtcggtccgcaaaagtcggtccgcaaatgtcggtccgcaaaagtcggtccgcaaatgtcggtccgcaaatgtcggtccgcaaaagtcggtccgcaaatgtcggtccgcaaaagtcggtccgcaaatgtcggtccgcaaaagtcggtccgcaaatgtcggtccgcaaatgtcggtccgcaaaagtcggtccgcaaatgtcggtccgcaaaagtcggtccgcaaatgtcggtccgcaaaagtcggtccgcaaatgtcggtccgcaaaagtcggtccgcaaatgtcggtccgcaaaagtcggtccgcaaatgtcggtccgcaaatgtcggtccgcaaatgtcggtccgcaaatgtcggtccgcaaatgtcggtccgcaaatgtcggtccgcaaatgtcggtccgcaaatgtcggtccgcaaatgtcggtccgcaaaagtcggtccgcaaatgtcggtccgcaaatgtcggtccgcaaaagtcggtccgcaaatgtcggtccgcaaatgtcggtccgcaaatgtcggtccgcaaatgtcggtccgcaaatgtcggtccgcaaatgtcggtccgcaaaagtcggtccgcaaatgtcggtccgcaaatgtcggctaacccataaaatatatgtttacaaaaaatcaaaaataaaatcatttttcttttttttcattcattttcatcctcaaattcgttgagcatgcctatcgtactttgaatcatgaattgcatttctaagtcgtcatactgttgttgtacgtcagcattttgactctgtatatctttcgtacaatttttctggcgcaatggatttggactgatgccaaaaactaaaatattaaaaattctaattaaaaaataaaattattattttcataatatccctccttaaaaattggaataaaatatttaatgatacaacattttttagataatttatgtatttttttttaccattttttaattcgaattcgtttggtagtggcggtggcgatggcacttcaagctttaattggacacttttttcgtttttcgctttcatttttaataattttgcgtctcttccaccatcttttttacgattttgcagattttttgctttatttgccgattcaattaaatatttttgtgcatttttcaaattttggtatgagttttttcccaatttttcgtcactttttaggcgataagtccaaacatttacctatcaaattaaaataattataacaaatcaaaaaataaaattaaaattacataatgaaaatccgtttgttcgtccttttttatcttctggtcaatttcgtagataaatgcccatattgaaacctgtaaaaaaacatcaaagcctaatcttttcattttttaaatccttgcaaaaaatctcaaagcctaaccatttttgtttataaaactcaaaaaatttcaaaaagcctcaaaggcctaattattaaaacatgaaaacacaagaagaggccaaaacatgcaatatataaacgaattttggattatcaaaccttgattgaatcttctttgttttcaaaattcatttctgaagaatttcttcttgcttaattatttttttgtaacaatttcggaaaattttttcacagtttcccatgaaaatatttttgtatgcttcaacaatgttagccattgccttggcaattggcaaaatgccatttctgtttggcaatgtaaactttggcttcagtgaaattgacattagcaatgcttcgccattaactgatttaaaaaaaaattcatttttttcctattttattattttaaatttaaatataccatttttagaattgatatatgttttgagattttcacaatagttgaaccaacgttcaatagatgaatagcgaatttgccactcaattaaagtctcaaatttgtccataatttgctcattgtggataattgttttgatatgttgccaatctttagtgtttctgtataaatttgcttcatcattttcagtcaactctttgcacataaattcgtgtaatgtaataatttccttaatttgtttaaatattttaataatttaaaaattaattaaagtaattaatcaatctaagtttaccttttcattcgcaccacatactaaaatgataaattgttgaatcaaaatagtggcaagaagataattcatgtcggcttctttaaatgcttaaaagtctctgcaaaatcatattaaataaatacatataaataaaaaattccgtagcaaatatgcaatatataatttgtaaaatacaacaacaaagaaataatcaattgtatatggaatcaaaattattccctatataagaataatatacccatgatccaagcttaaaaactaatttaagactttctagcgagttttacaggtcgagcgtggggtcaatcgacgcagtttttcaagggctataagggaaaaatagtgcggtttcgatcggtttagaactgttcgaactgtgttcgaaaaatgactcaaaaaatcaaacttttttgaatgtcccatttttgaacgctttttgcatgccttaaaattggtcaaaccaaaaaatgaaacaatttcttccaatctacaaagcctgggctttcgaatgataccagggttgtttgggtccgggtccgggaagtgccctaaaaagggattacaagcacttttggtcggaatttttcccaaaaaagaaggaaaatgaaaagggaattaaaagggatggtcgcaagcgacccggtggtcaagtggttagtgtgcttgcctttggtcatggggtgttgtgggtgcgagtcccaataatttatgagattttcccgtcaaatattatatttaaattattcgttttaaaatttttttttaatgttttttataagaattttatgagtgagttaaaagagaaagaaaggcataataaaaaatatggagcaaagtacttttggataaaaattgattactttcttttctttcctttttttatatgtaatgcacactcgccagtggtctttaacctcgccttttcaatcagcaaaaaatgtctcctccttttctttccccagttcattatcaattgtttccatttacatcagttttttactgctcctacttttattcaataaatatttccaactaaattattgctgttttaatagcataaatttttagtttttgccattggtggtggtggtcgacggttcgggtcccacctattctgggtgttttcatccattattttattaaattttttgaatgattttattttttttaattaattaagtttattaaaaataatttattttaaatattaaaaataataattctttctttctaatttagcccaaaaatctattgtttgaccttttttgtgcaaaatcatttaaaaatggagacaaattaataagttacctaaacataaaattataaatattttatgccaaaaaagaaggaaagtgaaaaggaaattaaaaggaggcaagcgatccggtggtcaagtagttagtgtgccttcctttggtgctggcttcccatgagttaaagtcccatttcttctgattattttaaagcaaatattatattgaaattattctaatttttgtttttttaaatttatttttttaattaattaactttatggtattttaaattaatgataatgattttttgaattaataaaataataaatatttttaattaatagaataataaagtctaaattaaatattaaaattaatcgaataaaaattaaaaataaacaaatattaataaatatttaaataatttataaatctcaaaatgagttaattttagggttagacgaatccgggtatttgggcaaaaccgggtccggatatttccgggtccagaaaagccgggtccgggtccaagtttttaaaccgggtacgggaggaagagaaagtggaagaggaacagaaagtggaagagaaagtggaagaggaacagaaagtggaagagaaagtggaagaggaacagtaagtggaagaggaacagaaagtggaagagaaagtggaagaggaccagaaagtggaagaggaaggaaagaggaagagaacgagaaataggaagagaacgagaaagaggaagaaaaagaagaagaggaaggaacgtggaagaggaacagaaagtgaaaagtggaagaggaacagaaagagaaagaggaagagaaagtggaagagaaagtggaagaggaacagaaattgtaagaggaacagaaagtggaagaggaacagaaagtggaagaggagccagaaaatggaagaggaaaagaaagcggaagagaaagtggaatagaaacagaaagtggaagagaaagtggaagaggaacagaaagtggaagagaaagaggaagaggaacagaaagtggaatagaaagtggaaaggaacagaaagtggaaggggaacagaaagtggaagaggaacagaaagtggaagagaaagtggaagaggaacagaaagtggaaaggaacagaaagtggaagaggaacagaaagtggaagaggaacagaaagtggaagaggaacagaaagtggaagaggaacagaaagtggaagaggaacagaaagcggaagagaaagtggaagagaaagtggaagataaagtggaagaggaacagaaagtggaagagaaagtggaagaagaaggaaagaggaagaggaagagaacgagaaataggaagagaacgagaaagaggaagaaaaagaagaagaggaaggaaagaggaagagga

SEQ ID NO: 2339 - DNA, 4905 bp, Heterodera glycines
catttattatttgctcgattgtcaaccgatatatgggtggtcatttacatatcataaaatattttgtatttgtgcctcgtttttgctaattttataatcctgtatgtttatttataggtggtcgccagcccttcattctgcataatctctgaatttctcttttaaatttcttaccaggggtggagcgcgacgcagcaatttggatccgggctgcgcgaccgcgtgagctttctgtcctcgctccatccctgtttcttaaataattttgtatttctgcattttgagtatgttgatgctattacctaatcattttttgtctccaagtcgaatcataggcgtctggcgatcacgtatggaagcgacctttaccttttcgaatgtgttacgagtagctgattttcgcgtagcccagatgacggaaagtgggcacgtgaaaagcacaaataaaaatggattcggcattgcaacaatttgagaaatcttatagaggactttgcaaatcgtgactcgtttaaatatttacgggcctgttcttatggctcgaatttttgaatttttttaatcaatcaatcaatcatttatacgcaaaagcgtgacgccgaaaaataaagaaataatgaaataataatatcaaaacaatcaattggtcacttttggagttggggtggcaaagaaatcaacaaattaagatcagatctttcaagaatggcaaactcattaggatttagtaatctcgtctctttaggtaaaagtctatagagacgagaggttcgaataaagaacgagttgtatctaacattggttgagcaataagctgttcttacagtgaattcgttttttacagggtttttggaaaaagaaaaggattcgttattttgtaaatttattttacctaaaattatttcatgaaaaagttttaagtctatttttaacctacgactctcaagcgacttttgatcataaatgtttaacaattcagcataattaggtaatcaacagtataattgttacgtctaaatattactctcaaaaaagttttttgaacattctccaatttttctatatccttttttaaataaggattgaaaattggagatccgaattctaaaattggtctgcaataaatattaaacaaatttacaagtattttcgtatcacgagttttgattgactttagtatagcgaaagcagatcgtaatgcttttttcgagataatgttaatatgttgtgcccatttcaaatcattagtaaaataaatgccaaggtctctgactggttcgtttccgggatttttaggaattggaaagtcatcaataaaataatttattttttggtttttgtgtcctaaatgtaaagttaaacatttatttgaagcgattttaaggccgttaaatttacagtattgattaaatttgttaataaaattttggagtggagaaaaggaaatatttgaaagaacatgataggccttaagatcatcggcaaatagtttaattttaacattttcagtttcgcagaattttggtaaatcgtaaatgtatgcggcacaccactgagacagggatattcatcagagaaatcagacccgcttttgacgaaaaactttcgattttctaagtaattttgaatccattttaataaggaattatttataccaatgctttttagcttagatattagccggttatgtggaaccgtgtcgaatgctttagccaaatcaaaataaattacatcaattgattttttattttctaaagcaaaactaaaatcatccaccacttcaagaagttgaatggtaacagaatgtgctttacgaaaaccatgttggcaatttggtaacaaattatttttttcaacaaaattttttatttttcctgctatattttcttccaaaattttggaaacagaacatagcagagaaatcggacgaaagtcgattgggtttaccggattttgaatttttgggtcagggcaaataattgactttttccatatttctggaatttgggcagtcatcaatgagaaactaaaaatatggaaaagtggtcggactaaattttctttacaatttttcaaaaaaatgttgggaattccatcaatactagtgttgttagaatttgaaagtttggaaagagagaaataaatttcatatggggttatgttaaaatattcgatgtttttttcagtattttctaggcattgaaattgttctaaattttgatctgtaaaaacggaaaaaaattgttgcgctaatgcattcgacttttccttatcagagaagaggatcagaccatttttatcagtaaatgcaggtatcttagtatttttaattttaaggaaagaatttataaattgaaaacgttttttagagtctaaggtccgcaaaaacttattttcacgatttttataaaatttatttatttctacatcgattttttttgaaacttccaaaaattttatttttatatggtctttgtgaatgtccttccaaagctgtttacgatagatgattagtttcaaaatatgttctggtagtttttcaacttttttcgttgtttgtatgggaacataattccttatcaaattatttaggaaaaacataaatttttggtaaataagctctatgtccgggcaatcagaaaaaaataaattccaatcaaccattgagagtatggcatttatttccaaataatttgcttttttgaaattataaaatttttttgaagcattactattaacctgtaaatttatgctgaattgaattgcattatggtcactattaccaaatgggggttcaactataacattattcaatagattttcgttgtttgtaaataataaatctaataaattgtttccccgtgtaggggagttgaccattagtcttaatttatatccctctaaaaatgaaatgaaaagtgattcaaggtgattgtttcttttttcaaaatgttggatgctaaagtcttttgcttttaaaagaggaaaataattaaaatcacccaacaaaatgcatttttcagaagccgagactaaaacagagagttgttcgaccaatttttcgaaatcttcttgtttttcatgggaggtgggtctatagaccaaaataaaacgtatttttgtgtggttaaggggtgaaaataggtcaacacaaagaatatcggaatttttgttttttgtagttttgataatttcaaaaggaattaaattcgatattatgaaagcaaccccgccaccttttttgttaagtctatctgatcttattatagaataggggagattttccaaaatttgggggttttctattttgttactcaaccaactctcagatacagcaatgattttaaacctattttctaataacaaaaaccttaacttgtccaatttgttcgccaaacttcgtgcattgaaatataaacaatttaaaaaaggaggtgacctcaaaagtttttttcattgcctccgcgtcgcgtcgtgatgttttcccccgttttcttctttccaaattccatccacttcttttggcgctgttcccgctcaatttccaactcctccttcgtcagggatggcctgaccagaagacgctcccatccaggtctcttcttcagctccgtccgacgacgcccccactgcatcagcgcaaaacgttggaaagttgaagccggcaggaccaccttcaccaagcgcggtcctttcctcttctcgtcaatcctcctgcccatcctgtagaccatttgcgggcacacttccacgtccagccggtccaacacttcctccaccgttttcgcgtcatccttcgcacgcagtgatgacacttcctcctccgattccggaagaccgatgagcacaaggctcctttttcgttctttctcctccgcgctgccaatgccattgttgttaattttgcgctcaatttcacccaggcgttccgcaatggcgctgaactgcgcagtcatttcggttgatattttatcattttttaaatgaaaatccgtacaaattgagcctagtaatcccaaaatccagccttttttgttgaaaatctgttaacaaatttgtattattttcacttgaaataaattaaaatttgaattttttaaaatttttttgaatttttttaaaaattccctgttggtcccggttcccggtcccggacgaaaatcgaggtccccgtcccggtcccggcttctcaggtcccggcaagtcctggtcccgattttgccaaaaattcccagtcccgtggcactctacaaaaaataaataatttatagtttaactctaaaaaaatttaaggaaaataaaaatggtttaatttaaaaggaacaataaaagaaattaggaaaagccagaaaacccattgaatttcgcgaaaacaatgaatttttttagaggaaccgaaagcaccacatgtggattcttattgaaaaatcaaaaattctttttgaaaatcatctgcttcgtcattctttttccatgtcgcttttacctcatttaatctttgtcggattatcgcactggtaatttattatttaaaatcagcattattatttctatgttttaatataaaaattacattaagaaaaaagtagatttggataatcctaggatggtcaatcactattttaaataattgcatcataatttaataataatattcaaattaaatgaggtaaaaaatagatttggataatcctactgatgatcaatcaacattttaaataattgcatcataatttaataataatattcaaattaaatgaggtaaaaaatagatttggataatcctactgatgatcaatcaacattttaaataattgcatcataatttaataataatatttcaatttaaatgaagtaaaaaatagatttggataatcctactgatgatcaatcaacattttaaat

SEQ ID NO: 2340 - DNA, 3657 bp, Heterodera glycines
cgaaaatgaaaaaaaaatattcaattttatttaagcctttttattaaatactcacggatgctttttcgagcttatctcagaactatagtcagttcaagaagcaaatttatagaatattgtttttattattaaatatttaatagttcttatttcattcagttattatgcatttacagaatatttttgcgaaaaattttattaataataacattaatttttatcctattaagtcccggattataccttcaagatgttttttctttgtattccattggcaattaaaatttcattattctcttttttcaatcttatttagttcttttataaaaatgaatgatttttaatgattttcaaatccgattttagtccctctataaagaagagtgatttgccattttttcatttaataattatttacttttcttaattcgacaatacctttttaattagaaaacaaaaatcaaatattttttacaattttttgatttaactgctatttgtctttgtttaatctattttaattaggtcgatgataatatgctaattgcatttatgtaagggcagcaaagaaatcaaatctgtgaatattcaatggaaaaatatgaagcacatcttggaattatgtattttatgctaaacaattgacaatatgacaaaatatcagggaaatttgaagaacgtgaacgtacagaatgccaaaaatcgaaaagatttggatattttgtacgaatatttgtacagagaatatgccggaattccaacagtgaagccaaaatttgtatttaaaaatgaaattgaaattgaaggaccaataatttatgcggtgaattatttggccagaatttcgcaatttttttcaaattgaattattattataaatacaaatttaacaatttgttcaattcttattttgatccaaaattgttgaatgaggagaggttgaaatacgaaataaaattggaaaatcaaccaaaattaccaattaatgaaatgattttgcaattagcaattgacacagcgaatgaatgtcaaacaaataaaagtttagacggaataattcgacaaaaatttaacaaaaaattggaggaaatgttcaaaaaggcagaagaaaaggcaaaaaaagatgcaccatcatggaaagccaataaaattaatgatgataagcatgaaataattttggatacaaaattcgatgaccaaaaaacattggtgagacttaacttaacattcaataataataataataataataataatccaaatttagattgaagatgctctattttcggaatttgtcaaaggattagcaacaaattggaataaattttttgaaatggctaaagaatattcaaattatttaagtcgaaggaaaaagcaaagaaatttttatgggtattatgatgagcaacgaatgatctcttatggattagacgaaattgacaaaatgaaagagcatttgacgcaaaaatatgaagcacatcttggcattatgtatttgatgagagagacttggcaatgtgaaaaaattgtggatcaattaactaaatataaacggaaagaatatttggacattttatttgaatatttattccggttgtacgttgaaggtttgtttgaattttacataaatttgaattttttgatttaaaaaaatttgttaagctaaaaacccgaaggtgtcgaaacaattgccaccactggtgaagccaatatttattatgggagtaacttctcaaggatattcttacagactaattgaaattatcgaaacactgaacaccaattcaaaattgttttgggaaaaagatgaatatgccactttaaaatttgaattggtaaatgaggaggaattaaattttgaaaataaagaggaaaaaaatttgttccataaaaatatacaaaagggaaaacaaattttaaaaggaccaacggacattgaagaaagaattcgggaagaatttgaacaaaaaatgaaaaaaatgtatgaaaatgctaaagaaaatgccaaagaagaaaaggccaaaatggaaaaagcaattgaaaaggcggcaaatattgacgaaaagggagctctgaaagatgaatacaatgaaaaattcggcactttcatttcttcgccatttttataaaaatgcctttttcacaaaacgattgactcttctggtttttggaattttatatgccttttcctttcgaatgattcttctgtcttttttcaattttcagcttattttttgttttgttattttccttttcttttttaaatatatatttgattttatttaaacttttttcgaatgttttcatagtttaccataaaaaaaggcggcgcgcaacaattttaaagctgtataataagcaatttatatgtaaatttaaagttctgaaaaaaagtacaatcaatttttatttcatatttccaatgaaatggctaattattagggctgctaattttatgtaaatacatattttttcctggcttctccatgctctaattagtaggaaaaactctttcttttttgtgtttgcgaacaaaaccgggaccgggccgggaattcccggtcatccgaggtcccggtcccgggttttgaaaagctcaggtcccggtcccggtagggcaaccgggaaccaggaaaaacaagcactggtaagaacgggggtctgagtgaaaaattagtgatgaaaattggagttaaaatggaataaattttaaaaaaaaataattaatcgtaagcaatttacttaaaaatcatacaataaattcattttaaattctaattgtaagttcaaaaaaaagtgatgcgatttggcgctcgagccgactccaaccgaatgcaaccgctggagctcatatgttatgtgcggctgctagaaccaacgacatgttctatgccattgccaggccattgtctattccaggcacgtttttcctgtcccaccgctgggtcccgcgaccgttcggatgccaattgaaagaataatttttttttagattgctgctagcgtgggatgttgcgcggtttaacttcccaaaaattgctaattatgaaaaaaataaaccacaaaaagtggaaaatgttttatttaacgtgcttttcaaaacaatttagaattaccatatttattaataggatttatcaaatttggagaatccaggacccgaattggagcaaaaacagaatcgaaaaaaaatttggcgatttcgctcaagccgactccaaccgaatgcaagcgccggaggagcgcccatggggtgtcgcgtgtgggtgtggcgactgcgatgcgcgcgaggccctttgccagagcctatgcgtatgcgcccgtctttgccgttaagctcgagacggcgagtggagcgcgaaacggcgtcggcgagcaatcgcacgtcgtcactagcgagttgtttattttatatacagtgagaaatgggcatttcttttttgttatgggatataaaagaggcgaggaatgggtgccaaaagtgggctgggtcgatgcactatttctccgctgcactcgtttctttaccgactaattaagcaaatgattatgtactatttcttgcatttttgaatatttgttcccttttgttaaattttaaaaagacattatgatcgcggggaaaaaactttattggccttttaatttgctgaaatt

SEQ ID NO: 2341 - DNA, 1185 bp, Heterodera glycines
tgcagggtgtcgcgattgccccttcgcgaaaatcaaataatttgatttgcaattatgcacaaattgtgcaaaattgaattggccccaaaaaccaaaaaccaaattaaaacaattttcaaatttggggccaatgttcgattgagtgacattccttccccaatccttatcaccggctgtcactccccccagcaattctccgttcctcccgccttatcagcttcaactcgcccattctctccccactttttggccaatataaataagtgttcaacaccagcgcttcatcaacacaccaatcatcagcagcacaccaaagtgctgcttcaactctctctctctctctctctcctcctctcgtcccccacaattgttccacaagcgccccgctccccaatcaatcaccatcacggcgccccccaagccatttccatgcattgattgcgccccctcacacatttccgttgttgtactgctccaactccttgctctcccaatttcccccattttgaccaatttcaatgcaattttttgtgatgggctaatagggccaaattgttcacatttttcactttgtggcccatttggccgatttttgcccccctcaattgtcctcccccattgttcacccatttcgggtttaattacccaagtttgagataatttggtggtaatttttctgtgcttcctttctgtgcggcccaatccgaccgtagtcccgtctcgatcgcccccggcccctttgtgctctccctccaacttgtcaaagtcctgcacccaagtgcaggcaattgtcggactccaccgcgcccacacccgcacacaaacaaggagttacgacaacttgattaaaaaaaatttcatgactatacttgcgaacaagcaggattaatacaactcgaatatgaattcaaataattgctgatcgaagaattgataagaataaagaatttatttcattgaaagaaatcaaagcaagaaaaaattttgttgattttttttttgcaaggatttgacagtcttaaataatttctgaatttaatttaacgtcattctcctcatatttctaaattaagcacaaagggcatattcaaaagacacaaaacctttgaattttctggcaattttaccaagctgtattaaatctaaaattatactatgctcatatctgttagttaatgcactaat

SEQ ID NO: 2342 - DNA, 821 bp, Heterodera glycines
ctctaattacgccaaagaatctgattgtcgttgccttccacaattcgttttattagcactttattgctttatttttattccaccattccttcattaacaccaagcattttgtttatggattgaaaaacgaattatgtgaaccaaaatttattagtgaacataaaattaagtttcgaaacggattagtatttcatttctcatttgtttactccttttaaaaattatttgctgaattgaccttaacgttcttgggtattatttggtagccccaagaatcctctaaatagtctcaaaggctgaaaaatgcacccaatattatggcaaagattcagaaaatcaattttttgaagttttctggtcaaaactttttgaaacataacgaaatggtcatgtctctctcttttttatggtcgtgtaaactggaatagaacacaaacatttgcattgttattaaaaatccataaaaagaagatataaacagatagtaccacacaaaatttattaccttttatcactttataaaacggcagtctttttaatttgtcaatggtttaccgcttattttgacaaatgtaccaacaattggtcaatttaagccctccctcgcaacaacctccacaatcgtcctccgcgacccatcaaggaggtcatcatcgccacacatcttcaggccatcaccgttcgtctggaatgactgcttcttcttcgcgtgctccgaataggacacgtaccggagatgacctgcacattggcaagtacaaactgctgaaaacaattggaaaaggcaacttcgcaaaggtatgttattgcggttataagtt

SEQ ID NO: 2343 - DNA, 9461 bp, Heterodera glycines
  misc_feature (9407)..(9407): n is a, c, g, or t
agggaataacgaatgcacagaacacaataccaccgaatgcccagcgcgggtctttcctttccaaactcacgaaactaacgaaaaggtacacaattcgcttattgtcagttctgtttactggcaattgccaaggtttcttcatcccattttcagaactggcatggacccggcgagtccggccgcacaatcactgagcggttccaacagtcagcagccccctctaaagacacacggagtaatgcgagcaggtaccatcggttcagctgcaggaacggcttttacacaaccgcagcaacaacaacaacagcatgttcaacaactttttcaacaacaacaaccaccaagcgctttctcagcgccgaacaccccaaaccaacaacagcagaacatttcccagcaacagctgacgccggcagctgcgcagttgggcacagcgaacagtccatgcccattgggcatcgaagaggtgaagccgcgttctctgcgctttacttggtcaatgaagacgacttcgtcacttgcaccggacgaaataatgaagtccgaagaacaaaggagtaaatgttacagagaatgcatttttagagaaatacgaaaagtactcgacagcaatggatgcgaatatgagcaaagggagaggtcgtcttttctgtgttttgaatgcattttttcctttaggtatttgttactttgtgcacacggcgacccaagcaaagactcattgatacaatgggagatggaggtattgtttcaggctgaatattttcggagtatttttttaatttaaaggtttgcaaattgccaagactttccctcaatggagtgaggtttaaacgtaagtttctcatttctttactgtcaaattttatcgcatacgttcttcttttaaagccctccaatcataacgttatttttatgcaaagttatataatgcgtatttattttattaagggatttctggctcttcgatcgggttcaagaacattgcttctaaaatcgctcaggagcttaacctctgacggttttgtgaaatcggatgctgcctccaaaccatttattgaactttgtcttcgatgttgtggattctgtttctcaaataactaattattgctaacattttcttctgcatgcttttgctctgttcgtgcttctctctctattcgtttgttttatcttttgccactatcgcttttttggtcggtcggtaaccaattttcttcagtttctcagcgacaatattcttattgttcgtgagtatttaaagataatttaactttcatttaaatgaaataattctacataaattgctataaatgtttggttaagttttatattagcattaataatattttgtgagagcacaaaaaattttgtttatcagggcgacggtgtaaaaaggtcgggggggaggagccggcggaggagtaaagggcaaaccttgaataaattttcttaacattcagaaaaaattcaccagagaaggggaaaaagaaaaatgatttctccatgttttggttttacgaggctaaattccctgtttttgcttgcccatgtccgccttaattcccaccagcaattatttgtaaagttgcgcactttgccaccagcgcacagtccgcccgattctcccgtccaacttctaccttattgattctaagactaattgggtttatactattttaacaaaaaatcatttgcatttgaaaattatatgcttttcaaatgaaaaaaccacaaatgtcattgaactaaaacccaaatttttctcaaaaaatcttaaattctttgacttatcattaacgttggaaggagacaatcttttattataagcaatttttacaagatattagtattcaataagtagagagtgttacggaaggacttcacttggcatttttttcatctgttgggacattccctgcagttggggagaaaagggtggactttccaaattgccacaagcgagaaagggtgggtgagagggtgttggacgctgattgtgagttgggctgtctagaggtggcgggtgccgaggaggaggacgcattcgcaggggacgacgattgatcgcagctggggttgcgccgttggaacagccgccaaccgacggtgtaagacgaaggccttgcggtggaatcagtcgaaacttaaaatgggaacacactcacaaaacaaaacaatacaaaaaattaattaattaattaacgggttttttggcaatcaacattttaaaaatgcctaaaggccgagaatttatttagattctaaggataaaatacttttgaatttaaccaaatttacagtcctttcgaacaaaacaaagttttaattttcaaaatttgatcaaaatcgcaattaaaatcgataaaaaatgcggtcctaaccattcaaaaaccttttgtcgaattcgggttagaagtttttcagagagaataaaaatctagggaaatatgtcttcacgaatagcaatccttgaagtttcatttggccaactcaccgtccgctttcgtttcctccgggacactcagtgccgccgtgctgatgccattttgtaagggaatactgcgcgaccgcgaatccaacgactgttgaagggcgattggagtaagccattccttgaaagaataacaaatttaaatgtagaaatcggaggtggcacctgagggatccatcgctcgacaaatggcaaagaaccggaaatgttggccaaacggttaatccacgggggcaactcctggcccgttagaacctgaatggaccaagaccagagtaattgcttaagaatcgctcaagtttaagaagccctttagagttcaatcattaccagctaacgagtaatccacgcaaaaattcttaagtggaccgtcttttagagaatcgtgaatttagttttgatgcccttggtgggatttccgaaccatacacaagagacaaaaacctggaccactccgctcataaattgctacgaattttaattctcaccttgctaaggatggcagagaaatggttacagtttttagtgatcaaatggtagctgtccccccggtactcttggcccaaattctgaatcattttgttcacatcttcagcagaaaaatcagtttcgcccaaaggaatgctttcccttgaataaaagagcatcagataaaaactctcaaacacaacaacctgaagttgaaattctcccccaattcttcagcatcgcgtggcgtattttcgaaaattccggaaaaggggaagggatgtccaccgtaggcatattctgaaagtgttttgcaaaatataagacaataaaccgccttcacatttaaagtgggaatacgttaaaatgcaagaaaatagaaatagtcagaccggtatcgtacacttcgatcccgctgtgaaacactccaatgcccaaactcgaaaagacgatgtcgttgagcttatacatgtcataaacattgaggaaaacaggcgcacgagccatcgtttgaaagctgtggctaaaatgaatcaatttttttaattaacaaggcggatcaatgtgaacattaaagtcaaaagcagaattgccgataaatattggacagggcaaacacaattaagagtacttctgacgataaatggaaagtggtcaagtttaaaaacgaatggtgggggtcaactgggcaatgtcaaatgggcgacgccaactgggtaacagcaaacgtaccgggcaagtactgcaagaacttgaaagataactgaggacttgaaaaaaaaattctgtcggcatttcagttatctgattggcctccagttagtatcgcacggtgtctctttccgaaaacgattatcaaggagttggtttttattttaaatgaattccctgaatacaaagaaaaggacaaaaggggaaggactccgggttcctccctttgttttgattgatttttattcgaactttacctttcaatactaattagcgcagcatttatgggaaggacccaattttttttttggcttaaatcattttttatacacttttttggtttgaacctgttggaaattgagatgaattcaatgaagttttaatgttattttaagtttgccagattaaaattatttgtttctatcgactttcatttccacaccgtcctttaataatatattttgcattttatttgtggcgttgtcgctttcttttgaattatgaaaatggtgtgcaacaacatttgttacggaattttgatgaggagaaacggccagaaaatccgccttttgctttgctttggtttttgccgcatttcttcgcttaacacacagccgcccattctgagatggggcgtgttgtttagccatcaaataattctccctctccccaccattttattcccagtgatccgctttgcacttaaatatctgatcgatctttttcaccactgattttgctatttctcagttttgtttcatttttactcacttttatttttactaatttttcagcaaatggcccacctcatccaggacggttttgtcgtcaatgacgcaacatggaaactaggcattttcatcaccgatatgaacatatcgcgagagttattcgttcgcggtgacatgaccatcggtagtctgatgatgcagttggtggggcaaattggtatcagaggcaaaagcagctccgctaatcagttcactgttcttaggcgagactcaggactggagtgaccattacatgtggtggcctgaccgccgtaagtggctgaaacacacgcgaagcacgttggaccaaattggaatcactgcagcgacttacttggaatttacaccgatgcataaacatgccaagtaaagggattaattattgcgtaattgtcttgttgattatttcatattttctgtaacatctttcagggtccaactccccgatttgcaggtgttcacatttaatttactttgttcaggcttttgattatttctctatatcttcttgacttttgtagattatcgatgcccgactcgatttttccgtgcccattttgaaggtcacccaaaaaatctgccaagaacttgccatccgtcacccggaagaactgtcgctgaagcgtgatattccgccagatattttgcgaaaaggcgcatctgtcgaatcggaggctcagattcagccatacatgaagccgggcgaggagtccattggacccggcactctccgaacggccaaacccatccgcgcttcaactgtcaacctcactagcgggcgaggctcacctgcactttcgcaggcatctgcaatgggccccggtcacttgtttaacgcttctgaaattggcacactgccgaagatgggaacgattccgcgcggaatgagccccggtccagccgcagtattcctttcagtttccaacatttttaaaatttaaatttgctccattagtatcgcgaagtgcttggacgaacaccggagcccggttactctgaaggaggcggtctcgaatgtgaccagttcgacgaaaatttgataaactcaccgaaaataactccgggtcgtgaaacattcagaccccaaaattatttggagaaagccgcgttgaaccggggatggttggactcatcgaggtgggccttcgctttaatcaaattatgtgccaattattaaacaggtcgctgatggaacaaggcatttgcgaaggcgatgttgtgcttcttcgttttaaattcatgcagtttttcgacatgaatctgagatatgaccccgtccgtatcaatcaattgtatgaacaggccaaatggtccgtccttttggaggaggtcgaacacacggaggaggagtcatcattatttgcagcgctgcaggcaggcacttgactaatacatttgaattatattattgcttcagttgcaagccgcgcttcagcgaaactctccggaccgcgaatctccggaacgtgacgaggtcgatgtactgcttgatgagttggtagggaccagaattttttctcaatgattaaatttttcttgaatttgaatcaaataatagtttttataaaattttcctgattataggaacagactttggacaccactgcctcactaagtcgccgtgatttaacatacgtgcctgagttgacagaatatctcaaatatttgaagtttttttccaataatgtttttgtatatttgtttttactttagacctaaaaaattgggttttaacaacttcaagagagcttactttacatttcgagacctttacttgagttattacaacacagctcaagatgcaaatggttataaatgtatttttaaaaaattaaattcattgtttaagggcctccacttggtcactattatctcaaaggtttatcattcggtgtccgcatatttcttgacttcaaacaattctaaaggttgcgaggtcagccaggatttgagcgtctcgcaaggaaagttcaacataaaattgcaagtgccgagcagtgaagggatgtcggaactgatattgaagtgtgacacggagcaacagtttgccaaatggatggttagttaccaaaatgagtattgacaaatttcccgctttctaaggccgcttgtcgtttggcatctcgtggaaagacaatggccgattcttcgtacaattcggaggttgaatccattaagaaagtgctgcagatgcaagcaggaagtgagcatttggttgcgaaaattttttggtggtaaaaatttgtggcgtctaaaaccattaggcggatttacaatttctattttacagtgctcaaaaatgtaatcttcttatttttgcctgattacctgataaactaattaaataagccctaacaaataagacacgcttaaaggggcagcggcagcgcaaaacggtgcacaaaacaagaagaaatcgcaaccggtgcagctgcccacggatttcaattcggaagagttcgtttgtcagcgatattggaagagatcggggaacaaaagcgtaagtcaaacagaggaccggggtaggggaggaaagaaagtgttaaaaagttttattcaaaagatgcaacagcgcatttcggatgcccattcaaacgtgaaaacattgagttgcaccgaagcgaagcttcagtacattcgcaattgggaggctctgcccgagcacggccttcactatttcatcgtcaaattcaggcattttcttttccattatacaatttgcgttttttttcaaatttaagtggtactatttatacttcaaaaatgccaattaaatgtactcatattacaaaacttattacccaaaactttatttacaaatggtttttgcaaaagtatgtaaaaaatatcccctaaactctaaaagtatcctgcttatgcctttttgattttacagaaatgggaagaaagctgaactcattgcggtggctcacaataggatgatgaaagtgaacagcgacaacggagaatcatcaaagacatggagattctctgggatgaaaaaatggcacgtgaactgggagataaggcacttaaagatacaattcgacaacgaggatgtcgaattcaaacctttgtcagcggactgcaaggttataccgaattgtaaaaaagaaagctaataaagatcaaacaggttgttcatgagttcataggcggctacatttttctctcaatgcggagtaaagaccaaaaccaaacactggacgaggaagggttccatcgcctgactggaggatggggatagaaaattttatttgtaaaccacaactgccatttcaatttgtcatagtttctcacatttaaacaaaataaaagcgacaatatgcaaagtacgagaaggtattcataaatgttacaatacataagttgcacaatatcgtaccagccccatctgaaatcataaaacgctttcgaaatcgcggtctaggagatatccataagattaatccagcgtcggaaactcggcataaaattagacaatacattacttcaaaatgtagtagatgtatttagaaaaacctttttcatcatcacatctatcattctgccaaaagtggtcgaattactaagaaaaaataaaataagaaaataactgtattttagaacacaccctaagtattgctgcatgaatttcttcgcgtgttcatgtttttcgaagatcagatgaacatttgattcactctcctgccagattttcttaattaagtcactttaatagaaatcctattatggtgccacgaacttttatgggtccgattttgctggcaatgacttccactcttctacaggggtcgtccaaacctgacacatttgtcacaacaactgctaggtacggtctcaatcggtttgctgtcatcttttgccgctgtgttccctccgtttcttctgctttctttcccttcccttcgttcgtttcgtccttttgtccaccttctcttgcataaatttcttttcggtgttggttttttttgcgcgcaatttcttctctcagtttcttttgttcttcgattttccttaggtagtcactgtcaagtccaattgccttcgcacattccatcgtttgctttgataaatgcgcctaattcacaaattaaaaggaattgttgccttaagtgtgatacaacctctttcgtctgtctttgcgttcttttgccttgtgaaatattgtgcttcaaacgccttttgcgtgtcggtggcgatgtctttcgggaatttcgactgttcgatcgcgtcgaagggtgagaaacgggaaaggaagaatcggaggatggggaacgattcttcgggtaattgcgtggaggaactaaaacagagttcgaatgagacaacaaaagatgtgataaaataatacccgaaatagtttttttaacgaaatcatcgaccatcaaatgccaattttggctgctttttgaggaaaggtgttgtaactgattgctgtgaacaaaggactggtcgtgagaagtattgaaaacagatgggtttatgtaaatgttgcttgcaattgttggattaaaagaagggtgataatgtgcgacgtttgaaaattgagacgttgagcaaggaaattgcggagcttttaaaggcaatgcattggatgagttaatttatccgagaatacctaatagatttctcgaagcattctgcgaaaattgcatcaatgggaaatcgttcagtccggctcgctggcttatattttgtgaagtttgataattaaaaagctaaatcaataatcagtcgaacagttttcgtggtaaataaacatacattggtgggaagtacgactgaaaaagcattgagacttggagctaaattttcctataaattattttgtaaatggattacatcattattaataagccaaagatcaaaaagtagcaacaatgaaattaaatttttagtaattacgaattaacatttaacaaatttgaagttaagaggaactcaatgttttatttaatatnccatttttgattaagtgatgttttgcaaatttagggtttaggtaacattggacg

SEQ ID NO: 2344 - DNA, 848 bp, Heterodera glycines
  misc_feature (807)..(807): n is a, c, g, or t
aaaaaatgatttcgactgaggatttttcgaaaaaatgtttaaagatttgaagaaaaagttctaactttttgccaaatatgcctaatttttcaaaaaattatgcgtttttgtcacttttttatcaaaaaaaccacaaaaatcctcaaattttctcaaaagaccacaaaaatccgcaaatcctcatttttcaaaaaaatcctctttgaccctctaaaagaccacaaaatgaggaaaaatcctcagatatcacagctctgtttattgtgaagcatttgtttttcatgaaaatgtatgtgctaataaaatttgaccatttctttcctttttttattcattaccaaattgaaacgctcaaaaaccgtttattaatgtcttcaatttttaattaattccgatggctttgtttcactttataattaattgcctttcaacattgtacagcaacaacaaccgatttcagtgtcactttggcgtccgattgaacgccaattaaaaaacagcgcaattttgacggccgaacgcccaaaacatcactggacgaccgacaaacaacggaatcagcagcagcagccattgattttcaacaaattggtgagggagttaattcattggaataatttggctttctaattactaattagtgtgtgcaaattatctctcggcttttcattatccatttctgccgatcacctaaaaatggacatgtattatgaaatgttatgactcattgagcagttgttgtcttttgtgattggttgtcatcgctctgtctgatcagttgatcacgtcatcagaaaaaccccattncaaatgaataggtcgctcgagcgggaacaggacaaaatcac

SEQ ID NO: 2345 - DNA, 4320 bp, Heterodera glycines
gtcctgattggctgtcccccggggggtggggaagggactctcgagcgtttttgccctcactaatcacccattaattcttaatcttccttttaggttcacacaccgcaggaggaggacagcagcagcatcagatagaggaggaagagcacagcagagtgaggacggaggaggcgaacgcgtgactgacgaaggaagagcagcgggaggagggcggggccaacagccgacgaccgaagcagcgagaaggaggaggaggcggagtcacaaacagcgaccgaccggcgaacgaccgccaaccgtcgataacaacaaaaaaacagcacagcgaacgggtcggctgctggtgtcccaaccctcaatcgatcatcatcggccggcgaccgggcggaatagcggcgccggggacagcgacgacagaaaagaggcggcggaggcgagcggcggcgggcggggagcaccccaattgatgcgctgttggtggtggttgtgctgctggggctgttggttggccattccttcgaccatcgtcatcatcatcaccaccacctttactagcaccacaaccgcagcggacggcgactactctttggttgaccacgagcaggagcagaaacaacagcaacaccaccaccaggaggaggaggggtcgaacgcgttcaaatcgttgtttttgttggcggtggacaaagatcatcagcaagacaaggagtttttattgaacgacgacgacgacaacaaccagcaccaccgagtggaggaacagttgccgttgttgttcattgttggcagcaccgttggcaccgcgttgcaccgactgttgttgagcattgcccgcacgacgcccatgggttggcccgactggctgcagccgcacattggtcagtctcagtgttccgtgtcgatccaaatgtggcgatgtttctgctgctccccgttcatatccaacgaagcggaccccccccccccccccaccgccacttgagggcttttattgctaattgactataattagaggcaattactacgtgaattcatttccatttttcgctaattggttgggattgttttccccaagtgtgtctgactgctggtcaattaccaaatgtttgtttgttttatgaggtaatccgtaattagcgaatgctttatccctgtagataatgtcacggatatgaatgtcttttttccaaaaatccgctgcattaaattttcaattcttatccctcgctggttgtgagctttagtagtttttgttaatctctttcttctgtgtgccctgttttacaaagtatgcttttcaagactctgatttttcaatcaattctccaataaaacactatgtggctttctctcaatgaaagtgcatttgaaacaaaaatcaaatgagcctcatttttctttttttgcgaaagaaattaaaagccatttgacgaagtgatgagtcacatgcattttaaaaatagaaaatgagacaaaatgcaatcccctattttttgttgcacattccacaaaaattacaatgattcaacaatagcaaatgtttttgctgcaaattcggggtaactttcgcttcatttcggccggcattttcatctattttcaaaatgccgaaatttccaacaaaaacaaatcccccattttcagatgccttcgtgctctgggtgaatgggttgctcgagtattggcatctcggctacttggaagtgcgttgtttttgagaggggttgcaaccccgccccgaccccgaaccccgacatttttggccattttcgggaaaaaccccgaaccccgacgcttcataccccgacaaccccgacccttaaccccgatcggggtcggggttaaatatacacccctaagaatggcattttcgtgggagaaaatgcaaaaaagttagacgaaatttgaattttttttaaccatttgccaaatttttattaaataaagaagatttgctcaattttggacatttggaatgtggtgtagaggttagtgccatgacattactttctgtcgtgatttcgataccgttcgacgttttcttctttaattattttccagggcccaaaaagtcataaaccttattaaaaaattggctcaaaatcgcaaaagtttagcatattttggacaaaatctgttaacagatctaaccaaattttcaaaattttcccgcggcgcctatcggcaccgccggacgccgtaccctttctccttaagtctttagaaaagagcgacgtgaaaaaagatgttatggaaaacaaaaaagtaataaaaattttaaaatttcaagaaaaaaattaattctatacaaaatttctgataaaaagaaataaaaaaatataaaaacaatacaaatattattatggaaattaataaatattatttccgaaaaaatattaaaaaaattttgactatttggcataaggcaaaaattgaaaaaccccgaaccccgacacttccaaccccgaaccccgaattttccaacctcgacgtcggggttgcaacttgcaaccctatttttgagtgttccgcccgtgccattaatcccccgtccgtttcagtacctcgtctggcttctcctcccaattttcattgtgttcgttttgcccattgtttttctgttcttcagctacggttgtgtgattttcttgcgcatttacaagcatcggaatcgtatccgagaagcggtgaggggtttttttgccgttttttcagactaataaaaacggattgacgagtttttgcaccgatcagaggccgagaggagtcggcctttttggccattagtcatatgaaaagatggcttggcactgacctacgttatcaatcagatatatgtccaaaaatgcaaattattattttttatcgaattaatgacatttttaaatttattttttggtaaaaatttaatttcaattttcgcttttctttttttgtttgcgatgcttaaaaagcactctgttgaaaatgcattaaacaagtcaacatcttaaatttccaacattaatcggattaaattctgatgaatttcaagcattgaaacactgtttttttttgtggtgatgatctctgaatcttgaaattattaccgtcttttttacagtatgcctccagcgtttgggacggtgcccgggcgagcattgccagcttttgggaaggcgtcggttacctttggcatggtgaggaagtcgcgtgagtgaataaatgaatgaatgggtttttctcgatggcttattttttactgatcccgctgagattagtctctgatcactcacatatcataatctcatcactgatccagatcgggtttctcttagacgctgctttggtgatataaccggggaaaccagaaaattttttctagcgatttttcaaaattatgcgatgaactattaattaactttttttttacaaaaaccgctgaaatttttaaatatgacctgatcaattaatcaccgataaccatatacgcggcctgctgatctgatcttttttctactctttttccgatcagtacttttcaggttgtttggcttgcgtttttaatttaagcctttgaccagaaccagaaattttcactttttttcactttcctttaaacccccaaaattcccatcaaagttaaccaacaacaacaaactcataatcactgcctgataaataaatcacttttcaggctacgaaattgatgggttggagaacattccggacgaagggcccggcatgatcattgcctaccacggacccacgcccatcgatctctattatgtggtcagcagttttgatagtggtcacccaaattcatgccaaaccgaacaactttgaacagattgccaaaggcattctctacaaaaagcgcaccattcactgcgtggcggacaaatttgtgttcaaaattcccggtgaatattatcttaaaagggagggattttcagcatttttggtaaaacttatttttgtcgagactctcaacttacaattattgccttcccccatgtccccaggctggaacatgatctgcaaggtgttctgcatgacgcccggcaccgtggaggactgtgtggccacgctgcgccagggccatctgctgatcatcgccccgggcggcgtgcgcgaggcgctcttctccaacccggtcacctacgagctgatgtggggcaggcggctcggcttcgccaaggtggtgatcggcgccggcggcgtggtcagttttattgccattcttgttactgtttttggcacaaatttcccatggcatttccatggaacactgtgattagtgccggccatgtccacccagttgggcatattttgtaaatc

SEQ ID NO: 2346 - DNA, 1986 bp, Heterodera glycines
  misc_feature (33)..(34): n is a, c, g, or t
caatctgtatactcctcgaactccccccccccnncccccgcccccctctaatctaacgcttctcttgtcttcaatgaaactgcgttctgagcaaatgtcatggccagccttcttcagcccgtcattccgatgttcaccgaaaattgccgagaggcgttccgcacgccgcgctggggccgtcgcctgacgcggcccatctacgaacacacgcggctgcccgtctgtcccatctacggcggattccccgtcaaaatggtcacccaccttggcaagccgttgaacttcgagatcggcgacgccgccatgacagatggtcgaccgccagtgtccgcggaacagatcaagcgggcggtgcgtgacgcggtatgtcgtgccgcgttccacgccgatccctcccggaatcccttaaaatttgccagaaattccaaattctatttttgacgggtgaccatgtaaatctacggttttttaatggatttcataccgttttttggcacgctttttcaaaaaaagtaagtttttggggaaccaggggtccggcgatgccgatttcatgtcattttttatgatttcaaaaaacatgtatgaatctaatcccccctggtaccacgattccaaggtggatatccaaggactttaggattcgtagtcggtcactgtccggaggctctattcattacatatcgccacccccccccccccatttttaggtggacgtgctcatccaacggcaccagcgtttgccgggcagcatttggcgtgcaatgttccaacggataggcgccaagcggacaacgcccagcgggctggacgacggcgcgctgctgccagccgacgcggaggcggcacgcaaagagtggcggcgacggcaccgccggcggaccgaccgtgaggacaacgagctgcagcaaaatgccgaagatgacgacgacaaggatggcaccatcgatcaatcgcggcggggacatttcggcacggcggtgatggtccgggacgaatcgtcaattgttgtggacgcactgagcccaagcgacaaagagctggcggaagtgccgttgttgctgccttcgtcctcctcgtcgtcctcggcacggcatgccgaccggcggttcggcgacggtgaggatttggaccgggaataattgattgacgcacgcgggatgaggcacaatttgatcactaatgttcagtcccgccggcggcaacgggctctgatcaaaatacatatttgcgttattaatgtgttctctctccattttcgattttctctgttttttgcgcgccttccattgtaaattattttgctttcacatttcgtgctttgaaaatgattttgtgtttttgtttgttaattgaaccagttaaaaaatgtgcagttttcgtttgcaacaatttggtttggttggtggcataaattggtgtcatgacaactcgtctttacttcagttggaccctgaacgtttggccccagacatgtttttggctataacttttttctttgtcaaccaaactcaacaatgttggtatcattcgatagccctaagggtaatagtttagatgctgtctctctttctttagagaactatctctacattatatatatgctaaaaatacatttctactgcgctctatacaacttttttttcgccttacagattttctttagattttgtatgaattttatacacaaataaggctcactcaaaagttatttggagaaaattatgtgaatttcttttttctctttttggcgtactattttcatgtctctaacacatgaaaaaacataaattcgaaaattctaatgattttggttataaggggacaaaatcactagtgacatttagaatcaatagaaaaacgaataaatttagcattttgggtagaaagagctgcctaggactttgattataacatgataaaagtttgaaattcccacaactttttttctgagaagacaaattacttaccattcgcttagaaaaa

SEQ ID NO: 2347 - DNA, 2678 bp, Heterodera glycines
catattaaaaatttttcgtgggagaggtaaataaagtgcacccaataaattcaccttatgtaaatttttcatgaaaaagaaaattctaaaatgaattaatgatttttttttgtaattttggggcaaaaaaaaatgtttttcagtaattcctttattccctgcttttcctcgcacctgtgaccctgagcacgggtgcgtccaggtagtcgaacgcgtccgactcggccacctgcgcggacagttcggcaccgatgccgcagaagggccagcccgtctccaccgtgaccatgtggtgcgtcttcagcaccgaacggcgcaccgtttcgaagtccaacggcctcagtgtgcgcagattgatcacctttggagttgaaatgaaagtaaactcaatcgaatcgaatgcaaaaatttaaaaaaaagcaacaaaaaagtgccatgattttaccaagagattttaatcgaaattttttttgccaaattttcttagatttttcttgtaatttttttcattttttcgatcatgctccaatgccattgtttcccaaaattgaatgccaaaagattccgtgtgccggcccacctcggcctccacgccctccgctttgagctgatcagcggcctccaaacagttttggaccgccttggagtaggagaccagcgtcacgtgagcgccgacccgttcaattttggactggccaatgggcagcacaaaatcggcattgagtacctcgtccgagacggggaacggcacgccgtacaacagttcattctcgaggaaaatcactaaacggagtgaaaatttgggggaaaaagtcgcaaatttttgttaccaggattttcgtcacgaacggcagcctttagcaaacctaaacagagacaaataaattattacatatttgatgcatccaaaatcctcgtccggttattttctggcaaaaatatggcgataaaatattttggcattttaccgagaccaaaatgtcatcccttttttgtcgttacaattcctttcggtagggcaaacaaatatcgggccattttggaattttcatagcaacaaaatttggatgaaacaaccctctggtgccccctttttggttcatcccatggccaatgccctcctctccatggttacttacccttggcatcctcggcgctgtacggcgcgaccactttcagtcccggcacatgggcgtaccatgccgcatagtcctgactgtctgaacgagaaaatggacgcgttatcccaaacaaaaaagccaacgttgtgcagcgacgccggcagcgaaaccattggggccacggaaaacaattgggacggtcacctgcaaaaattttttgttaaacttttaagcgtcaaaaaccaataattggaaaaattcctaaaaccacagggggaagaaaccctattaattggtgatttttcgaatttttttcccccaaaaatcaggtctaaataatgtccatgaatagagaaccatgataatgtaaaattcgtagctttcactgacccttcccgccgacatgtaataggttttgcccgcgctgttcaccagctgatcaattgcctgcatggcgaagttgaacgtcatgaactcgcagatgggccgcaggccggcaaacgcagcgccaacagcaaggccggcaaagcctaaacccatcaaaattcaatgcaaaacaaacattgcaatttcactcagataaaaacgtataattcatttttgcttatgtcttgggcaagtcggaaataatgcaaatattttgccaaaaacattggaccgttcacagttgaataagtcccgataaattggtagtgaatgctcggacaatttttgcccggaaggaacagctccgacccgacaggcacccgcccaaatttagggcccgatcggtaattttcgttgttttttcaattttttgtggccagttatcccaggtcgatggggtatttttgaaaaatacccaatcggtacggtcccagtacgagtcgaaaaatttgttttaaaaaatcaaatttggacgcacccatttcagtgattggtgtgtccacaatgcgctcatcgccgtacttcttccacaagcctttgctgatctaaaaaaacaacataaatttagaaaaacaaccatttcatgccattgttttcaaaattgaaaatgaaaaatttggcaaaaattagtgcaaattgtctgtgccgactttgtatgcgccgtcgtacattgccacctcttcaccaagcagaaacacgcgctcgtcccgctccaattcctcgtccattgcctgcaaaagaggggtaaaattgaatgacaaaaatttccggttttaatttgtattacaaaaacttatattttcattttcggaatcttttcagggttactggacgacgaatatgaaaaaacccaaactttcttgaaacgatttgaattttaaaaaccccaatttaaaacccaatccgatttacggtcgaatttcagatcagaaaatgatgtaatcgatatgccgaatacatgaccaaaaaccctaaaaacttgcctggtttaatgcgtcgcgaattgtcagcgtcgaggcggcgcgcgtcgcaccgacgcggccaaacgaagcggcgacagaaagcgaaagaggccaacgacgggcgaacaaagtgacaaatttcatggcaaaaatcagagaaaatgtaagc

SEQ ID NO: 2348 - DNA, 4610 bp, Heterodera glycines
  misc_feature (4018)..(4018): n is a, c, g, or t
  misc_feature (4033)..(4033): n is a, c, g, or t
  misc_feature (4038)..(4039): n is a, c, g, or t
  misc_feature (4052)..(4052): n is a, c, g, or t
  misc_feature (4055)..(4055): n is a, c, g, or t
  misc_feature (4066)..(4067): n is a, c, g, or t
  misc_feature (4090)..(4091): n is a, c, g, or t
  misc_feature (4096)..(4096): n is a, c, g, or t
  misc_feature (4110)..(4112): n is a, c, g, or t
  misc_feature (4116)..(4116): n is a, c, g, or t
  misc_feature (4122)..(4122): n is a, c, g, or t
  misc_feature (4126)..(4126): n is a, c, g, or t
  misc_feature (4133)..(4133): n is a, c, g, or t
  misc_feature (4161)..(4161): n is a, c, g, or t
  misc_feature (4167)..(4167): n is a, c, g, or t
  misc_feature (4173)..(4174): n is a, c, g, or t
  misc_feature (4179)..(4179): n is a, c, g, or t
  misc_feature (4182)..(4183): n is a, c, g, or t
  misc_feature (4186)..(4186): n is a, c, g, or t
  misc_feature (4188)..(4188): n is a, c, g, or t
  misc_feature (4195)..(4195): n is a, c, g, or t
  misc_feature (4204)..(4204): n is a, c, g, or t
  misc_feature (4207)..(4207): n is a, c, g, or t
  misc_feature (4216)..(4216): n is a, c, g, or t
  misc_feature (4231)..(4231): n is a, c, g, or t
  misc_feature (4234)..(4236): n is a, c, g, or t
  misc_feature (4239)..(4239): n is a, c, g, or t
  misc_feature (4249)..(4249): n is a, c, g, or t
  misc_feature (4262)..(4262): n is a, c, g, or t
  misc_feature (4265)..(4265): n is a, c, g, or t
  misc_feature (4268)..(4268): n is a, c, g, or t
  misc_feature (4272)..(4272): n is a, c, g, or t
  misc_feature (4276)..(4276): n is a, c, g, or t
  misc_feature (4279)..(4279): n is a, c, g, or t
  misc_feature (4298)..(4298): n is a, c, g, or t
  misc_feature (4300)..(4300): n is a, c, g, or t
  misc_feature (4310)..(4313): n is a, c, g, or t
  misc_feature (4320)..(4321): n is a, c, g, or t
  misc_feature (4323)..(4325): n is a, c, g, or t
  misc_feature (4330)..(4330): n is a, c, g, or t
  misc_feature (4333)..(4334): n is a, c, g, or t
  misc_feature (4336)..(4336): n is a, c, g, or t
  misc_feature (4348)..(4348): n is a, c, g, or t
  misc_feature (4354)..(4355): n is a, c, g, or t
  misc_feature (4357)..(4358): n is a, c, g, or t
  misc_feature (4370)..(4370): n is a, c, g, or t
  misc_feature (4376)..(4376): n is a, c, g, or t
  misc_feature (4380)..(4382): n is a, c, g, or t
  misc_feature (4389)..(4389): n is a, c, g, or t
  misc_feature (4391)..(4391): n is a, c, g, or t
  misc_feature (4400)..(4400): n is a, c, g, or t
  misc_feature (4402)..(4403): n is a, c, g, or t
  misc_feature (4418)..(4418): n is a, c, g, or t
  misc_feature (4427)..(4427): n is a, c, g, or t
  misc_feature (4431)..(4431): n is a, c, g, or t
  misc_feature (4461)..(4461): n is a, c, g, or t
  misc_feature (4466)..(4466): n is a, c, g, or t
  misc_feature (4475)..(4476): n is a, c, g, or t
  misc_feature (4482)..(4483): n is a, c, g, or t
  misc_feature (4492)..(4492): n is a, c, g, or t
  misc_feature (4497)..(4499): n is a, c, g, or t
  misc_feature (4515)..(4515): n is a, c, g, or t
aacgtaacgccaaaacattaattaagcactaatttaaaaaatacaacgatcaaggatccttaattttcctttttgttttgtttttattttgatcagcttaactcgctacaataatataaatcggagtcatttctttccactgcaatggcgcatcgatttttaatattattgcaatttacctaatttatttacaattttgattcgatgaattcacctattaataaaataggggacaaaacaccgagagctgcgagttcgaccccgtccgtcatctgtgccgggcgattcgtgccctccccctccacatattactttcaaagcacccaaatttacaattaaattttcgcaattattagattagcaaataaaatataaaatttcgtcgtcacaactttcggcttcattcactttttcttccgcccttttcctccgccgttccttccgcttcgtcttcccttccctcttcctgctgttgttgtgcttcttcttctccctcctcctccgcttcatctcctttgacccaattctccattatgtaattgggccaacacttcgttttgatcacatagcctttgcgttggtcaaaacgacaccgcacaatgcgcagacggtgcaccgtggcaagccgcgcgttttcctcgtacggcgcgtcccacacttccaccaagtcgccctgctctatctgtgcgatacacagaaatgagtatttatttgttgatagtctcggagtcaattcccgagagtctcggtccggaagggaactaattgtaaatactttcgtagaaagtttgaagaaaccaaagattactaaaaacaaaattttttgaaaaagtattcaatggtaaattaattggtcattgacccatttatttgttcacccctcactattttttggatataaaaattgaaattcaactccattttgctcaattccgttcaattgttggcccaataaaatgtccgtgaatgattaatgcgtccaaatcgttcaattagcgaataaatacttttcaaaattgaaaaaaatcgtacctcgtgcgcctttttgatgaccacctaaaccaattggccaatttattttattatttttttacgttttcctaccgtttcattgacccgaacgcggccctgcaaaatccaattgccaagtgcgctgaaatgaatgggaaacacaaaagaaagaattgtttttgttttaccgcactttctcaccttatgctcgttttgagtgccactccgaccacagtgtccaatctgaacaaaaaagctggaaaatatgcacacaaattgcggaaaacagaaaagtcgtgactctcgggaatttgttttttggttttgtttagagcctagccagacccttggcttcgggtggaggggggactgaattcaaagtttgaaaaaatttttgaaaaaaaattttttttttaatctcgggggggggggggctttagtcccctcacaatcagaagaagaaaatgccaaaagaggggcttttgtctatacccgctacagttgcttgttgtataatgtttcctggggatctatcggaaactgtcaatgttggaaattgcgcgcatttggtcccattttgggttcgaagccgaaaaattatccgtttttttttggcaatttcatccaatagagatagttttttattttgatgccccccccaattttcggcacctccgcgaaagcattgtgaattctttggtccggcaatcggttggcattccttcgtcctcctcatcttcttcttcctcctcctcctcctctgcttcgtcgtcctcctcatcctccgattgttgtgccgttctgttccattgccgtttctttttgactgtcgcaaatcgccgacgatcgatgggagcgatcagtggagacggattgagacactgctgctgttgacgatgagaaattatttaatacgacaaatgcatgatggtatgtcacaagcacttaaaaatctgcaaaaatggcaccgagggaaaaacaaaattttcggcacgctttaattttgtgttaccgaaactcatttcatggaatctgttcggggttgctggacgatgaaaatggcaaaattcggacttgcgtgaaacggtttgaataaaaaattatcaatttaaaacccaacccgatttacggtcgaatttcgggtccggtaacccatgaaattgattgaaacgatgccgaatacatgaccaaaaaccctaaaaacttgcctggtttaatgcgtcgcgaattgtcagcgtcgaggcggcgcgcgtcgcaccgacgcggccaaacgaagcggcgacagaaagcgaaaggggccaacgacgggcgaacgaagtgacaaatttcatggcaaaaatcagagaaaatgtaagccaaagtccagttaggtgcctaactttgaattatgtataaaataccgtttttgacgggaaaattccgttaaaaataaacaaaatacactctttttttgttgaattttatacggaaaatgtcttttttccaggggaaaaacggacaaaagagaacagatggaaaacaacttacaattagctatgtatgtgaattaaataggaatataggtgaagccgaattactgaaaaatgcaacaaattaacatggaaattggaagggcttttttatgccaaaagcattgagaaaagcatcacaaaaaaaggggggatttgaatggaattaatgtgaatgaaccaacaaaaagcggagagagaaaagtcaatggaaaacggaacaaaaaacagtaacaaaaacaataaaaaacagaaaaaaacaaattagctgcagcagaagcgaatttttggtggggatttaacagaattagaagaagaccaatggaaaaaaaaattaaaaaaacaaaagtaataataataatcatttgttcgtcgtcctcattaacaacatggctaatttgcgcaatacaaattggaatggccgttgaacaaaaagtgacggcccccatttctgccaccatcaccggcaaaggtccgtgccgtcgtcgtcaccaccttgtgccgttgattttgctgtcgatggcggtgacagttgtttttgctgctgctgttgaatgccaatgccatcctccgccgcgcgcagtgacacaacgggcacagcactgagacatttgctgaccgacggctccaactgttcgcccagtgtttgctcaatgctaaacacaaaaaggatggaaaatgagacacgggtccatgactttttacatttttaaaacccaaaaatctatcgtcgaacaaaagaagaacgggagttggacgcagaaaatttggaaattttttgggaaaatttaaaaaaaagtaccaacattttgatgctcctctccagcatgtcccgctggttgtgtttgatgcttttccgtgcctcgtccatgcccatccatcgtcgttgtcgcccattctcacaattttcgccccattccgtgaacacttcgcgcaccgtcaagaagaacagtgttgtgtggtgaaagcgctggtcgtcctgaacaaaccaaaaaataaaacggagcaaaaaatatttggtacaaaaatgggtaaaatgatgaaatcggagtgtcgtgggcatgtatgacgagtagagttcgacctgaacctagtgtagagccaggcctgcatttttcctggaatccaggacaaggccattggatttttgtccgggaaatccaggtccggaactctactgacgagccatgggacaataattttaagcgcgcccctccaaatacggtgcggtcaaatcattttaaattgctgtgtcctcaatcatgggaatcggacttaaaaaatttaaaaattattttatttatttcttacaacgaattcgccgatgcaaaacagcactttgccacggatgccggcctcctcgcgcaactcgcggagcacagcctcttcagtgctttcctaaaaatagaaagagcgtcaattgcgacacgcaaataattttgtgcacatcatggggttgtaaccatgaacaatatgctaatttttgatgaaaatatgantaacaaaaacttctnaattnnctttcacaataanccntacatttttcnnaattttattttaaattttcaatnnatttnaaccccctcccctnnnattntcccancaanttttcanatttactcaatttctcaaaaaatttctnttcctnatacanncctanccnnctntnacaaatnttcaaactnttnctcaccatnttctccactcctccnccnnncancacccaatanccttcctcccccnccnctntccntccnctnaccattaccacttccaacncncccaaatttnnnnaccatcnncnnnccacnacnncntcattactaccnccaccnntnncaccattctcanccaatnaaannncaatccntncacaaaaancnnccttcaattttaaantaatcacancttnaccattttttatttaaaaaaaactaaacanttcantcccaaaanntatttnnccacttcantcccnnnactataattccatttnctttccataaaagaagggtcactcttttcaaaaatttttttttctgtgactagttaaggaaaataaaatggtggcgaaaagcattaaagttttta

SEQ ID NO: 2349 - DNA, 926 bp, Heterodera glycines
ctctagagtccattttaacgatgaatataccacagaattggggactcacttgccattttctaaaacaacaagaatgggaaaaacaattgcgaagagaattgatattttactatcatggtcaatgatgggttagggttttttatttctaattaatatcaccgtatttataaaaatactttgggacagctatagctgggccaacataaatgcattatctttcattctgaaatgaatttgaacagtctttgtgtactgtaattacttgagctcgggcgggaccggggccccgccgggacttttccgggactcccggcccactcccggttttattggacaacccgccgggaccgggagccccggaaaacgggagtcccagtcccgagatccgcttgggtcgattttccaagtcccagctccgctcccggtcccagccatttgggccgggacaaacagaataaatttcgcccagtgaaactgcctcaaacttgaaaaaattaatattttgtcgacatatgtatttaagttttttttagacaaaatcttctaacaaatcgtattaaaattacctggcgccttcgctttgcttcagtcccagaattgcttaggttcataaattttccagttttactacgtgtagataccatttttatgctaaaaaggttgtgatatattgaatttgttgtccttgaaaaaaaaattttcctattgaccaattttcttgaaattttgtataggcctatattttgaccccttctagcgattccaagtttattttatggaacttaagtttttaactcgagatcggctcttccgtttttacaagggaaaatctcgataaaatttttaaattcgcgtggttttttggcgttttgtccttaggcaatatttgtcaaattgatgatatatgcggcggtgaaagcaatgtt

SEQ ID NO: 2350 - DNA, 4471 bp, Heterodera glycines
ccagtaagtgtaggcacaaaaagctcaaataggtataaagttgaaataagcaactttgcaatttcaagacatttttcagcaacaaaagacgaaataacttctattttcctaattttatttgaaatgaagagaaaatttttgaaaaataaaatttggttgggacgaaatttgaaattttaaaggcagaggcgggttttcataattttgtaattaataaattttacaaaatttaggtatttaattattataatacactcattgaatttaaatgactaattaaggccaagatttcgaaatacgattgaagttatccgtggtctgaacagcttttcatttgattatttcgttgggttagaagaattggaaagaatcaagggaaggtcaaaaatactaaacttgacaaacgaaaaagaattgaattatggtaaaatttcaggtaaacggaagggtggcgggcactctctctccactagagaccggacaactggggtcggagggatcccgagtcgggatcccgactgaatcccgatcccgatcaatcccgaacattttggaaaaacgatcgggacggatcccgggtcgggatcccgaccgaatcccgatcaatcccgaagattttttttcgggatcccgcgggattatcgggatttgctcaaacccaattttttttacattttgtgccaagttttgttcaaatgtttatctaatatttataattgatcaattcgattgaagaaaaaaagggatgtgaattatatcagatttttatagaaatttttcaaaattgaatatcatgcccaaaaaatcagattttcaaaaatgagaacatttaacaacatgccttaaataattttattacaatttaatcaattaatatcaatttttgtattttcgcctcagataatcatttttaataattttgagaaacggaatcaaaaaatcagatttttaagattttttttgctgcaaattttttcaaaaactttagaggaaccgggggggggaggtcggcggtgccgataggcgccgccgggaaaattttgaaaatttgaaatgtaattgttaacagaatttataaaaaaaactgtccatatttagtgattttgaactaatttataagaaaataatgggttcttgggtctggtgatgtccgattgcaccgaaggaaaaatgcgtagacaacaatttttatctgattattggacagaattcttagaaatcgttgtgccataaaactacctaataagatttagaataatgttttagaaattaaaaaaaaataattctttttatgaagaaataaaagtcacgaaatggccaacgtttgcgtcaaattttgaaaattttagtggaattttggagacctgtaaaattttttgggatttttaagggattttttaagaaaaattagcaaatgacaatactttttaatttaaaattcaagatcttaatttaaaaaatgtagattttttgaaaaattatcgtgacttcagtcccgcgggatcccacgggaggtcgggagggattccgattcgggatcccgatgaaatcccgatcccgatcaatcccgatgaatttaaaaaatcgctcgggacggatcccgaggtcgggatcccgaatttaatcccgcgggatcccgaagaaatcccgcgggatcccgatcccgtctggtctctactctccaccgatgcctctgaaaaatttaaaatttttaaaaatatcaatttaaatgactaataaaaattaagaatttctcatttttcagcgatgcgctagaatgttattatttatgacaattttagaatttcgattaggaaatccgaaaaaaatttaaaaatagggaatttacaaacagtcaaaattataaacaaaaagtgctgggagactttgcatatgttttatttttttgcgaaattctcaagagagaaaaaatgaaattaaattgcatggaaaattacttccataaattatttattttgcattgaaattctaataaaaatatatccctaaaatataagtaaaaatccattgttttttttcaaataatttctcattaactctttgaagattaatttattcattttcataacaattaaagtagttttcattattttttcactcataattcttgcaattaaatttttgtttaatgcctaggaataattttaaatattttaagtagttcgctgtcaaattgtctacttctgtcggattatccattcacgaaaaagtttacggggaatgaaaattaaggcaaacttttttcatctgcttttggttgccatgattcaattcaaatatgtcaaaatatttttttattttaaataaaaaaccccattcattacgattcggggatggattagggatgaacttaatatatttttatggtaacttataagtaaaattggagaatttaaatttgctttatttgtacaacgaattaaattaaatggcacttttaatggtctttttcctccattctaattgctcttctgttcaattagcccaatactctcgagagaggcggcggcatctcacttttgtcgaaccaaatagcaaattcgcgcactgcatcctccgcagagtccgaaccgtggcagaccgtgtcatggtacttgccgacatcgctgttgttccggaattcggcacggagagtgccgggcgggggaactttgtccggcgtggcacccaaaattttgcgaattccttttacaacgccgacaccttaaaaaatttcgcatttccattttaatttgaagaagtttcgtttaaaaataaaattaagtttgaaatcatttgcaatttattgaaaatacaaaaaaaaaagttcctaaaacataaaagagaagctcaattaattgtcttttttggcgagtgatcagaacggcacaaaattttttgtttttaaggctcaaaataaaaacgaaacaaaaaaaatcttttgtatttgttaaatctctgaaatttatgttaaaaatgcttatatttctcaatttttaatcctttgattgtcagtataatcaaaattgaacaaatttgtctaccttcccaaatcatggcaaccacaggtcccgatgtcatgtaactgatcacttttgggaagaagggctggtcggagcatccaatgtaatggtccgcagcttgtttgcgtgttgaaacaatctgaaagcatcgcaaatgaagagagtccaaccaattaaacaaaattagcaaaccattttaatggcaattagccgaaatccgtgggcctcaaatcgctcaatgattttgccgacaaggcatcgtcgaacagattcgggcttaatgcagacgaaagtgcgttccattttggcaatttgtgtttgttatacgatgggttgggggtcggtttggtaattatgttaatggcgaatttgtttccatagaatgatcccaaccgttccgatcgctttgcttaaataccccctaaagtggtcacaaatttttgcttgcttagcaattatctgatgtcatttgactccctctcatctcaacacattcaatcatggcgataagccgccattttgctaataagccctttcaattagcaattaattaattaattaaattcctatgacttttctccaatttgagtgttgctgataaggaggaatggtggggcagctgagcgctggctgatcagcctatcggtgacattgtgaaatgggacgaagaaagacggctaatttgctaatttggcaataattcattaggtgtcccatgattttgttacatataaaacgaatttgaatgaagagtttgctgataagggagtgattacttggtgattgttcacgaaacctatcggtgacattgggaaatgggacgacgacatgggaccaatgcaaatgatcaaccacagctaatcagtcagcagatgtcatggacaaattttggggaggggggggggtcgtaaatgtgagggtggcgagggtgggccaaaccgaacacagcccaacacggccaattgggtgggcagggccaaacaatatttgctcacaaatgaaacaaagtatagcaaaaaattagaaaccaagaatcaagtttttcttatattctgattttcggaagaaaatttctaatatgatcaaatagagctgggatttttaggggtgagatcccaaaatatgggcctaaataagtgaatagcaaagacagggggcacaaaggcaacaacttaacgcaaaatctcatcaaattcatctacataaaccatcgaaactaggaaccactaagtgattttatgtgtcaaacacagacgatacaatgaaaactcctaatgtaaaatttacaaaagttttgaggtgggatagggcagcataaattagtgctgtcgaaagcctagagtcgagaaaagtctcagtccactgctgcaagggcgaggaaacccaaaaaagtaaaaattttcagtaaatttttttgaaattttaagtaattttgttaacaaaagtgc

SEQ ID NO: 2351 - DNA, 1303 bp, Heterodera glycines
aaaatttgtgcattactaagattgtagtgatgagtaatttgatactaataaatgtattgaagtctatgattttcgttctcatataaaatatgtgtactatgtaagattaaataaatattgcatatataatctaagaaaaaaacaatccatcacgccccttaaatctcactcccaaaaactttgtaaagataacaaatttaaaaccataaacataaaaaatctttacaattttaggcatcatattgatgaaaaaaaaagaaattttcttgttttttttttaatattgtactattgcgagaaaaaagagtatagcaggactttaaaagtgttctaaacttggtttgaagcttctaacttacatatatgttatgactttttttgacatttttatacttttgggatttttatcactgttatagtgacttttttcactttataaagcaaaatttgacttctagtgaagaaaaattccgaaaaataagtttaccttcgagacgataccgaaatttcgtattccaataggagtaaagagtggtccaaaccgaaccagcccaacacggccaattgggtgggcagggccaaacaatatttgctcacaaatgaaacaaagtatagcaaaaaattagaaaccaagaatcaagtttttcttatattctgattttcggaagaaaatttctaatatgatcaaatagagctgggatttttaggggtgagatcccaaaatatgggcctaaataagtgaatagcaaagacagggggcacaaaggcaacaacttaacgcaaaatctcatcaaattcatctacataaaccatcgaaactaggaaccactaagtgattttatctgtcaaacacagacgatatgcgtgatcagtagtgacaatgaaaactcctaatgtaaaatttacaaaagttttgaggtgggatagggcagcataaattagtgctgtcgaaagcctagagtcgagaaaagtctcagtccactgctgcaagggcgaggaaacccaaaaaagaaaaaattttcagtaaattttttgaaattttaagcaattttcttaacaaatttgcattaaaatattcaaaaaattttccaggcagcgcctattggcaccgccggacccccattttaccaaattttgaaaaatggaggccaaaatgtcaaaaaatagtaattttttggcgaaaaacggcaaaaatttttgtaaaatacacaccataattcgggatttcaaaaaagcaaaaatacacccccaaaaatcgacttaaaaaagaaaaatacacccctaaaaatcaaattttggactt

SEQ ID NO: 2352 - DNA, 1786 bp, Heterodera glycines
gggtaatttaaaaagtgagtcctttatatattgattttttaattgattggcgccatttcgtcgctcagctgatcagttactccttggcgtcatccgacaaagtaaatcaatgagaattatgatgatgaggccataactaattttcatcgagaccgaaaatttcactaaactctaaatctcgaagagaagctatcaattaatctgggttcgaactttttgcttagctgcctttgacttcggcatgttccgcacgtttgccctacttttagctgtggtcaaagtgtacggagggtaattaatttaattttgaattaatttgagtagagctaaatccttggtcaacctttcagagtctgttctgaatgggataaatgtgaaccgattaatgcaaatgggaaaacgtcaattcaattggatggaaacagtaaaaagtgagtgggcaaaaaaaaattaaattatataattttcatttttcggcacctgatctgttacccgagcaagttggcaaaaaatttcggaaattggaaagccagtggacggttgaaagttgcaaaagtggactaccaggaattaagcaagaaatgtgccgaaagtgacgggccaaaacaggacggcggatggcacggcttaatgctaacgaaacaaagtgacgggcatttggcttttcaatcatccctcaggtgagtagtttccattttttaattatttaatttaattttgttaattttaattatagtgccaatttttccggcatattagatgagcaattctttagcaatgccgagctcaatttcacccaaggtcaatttcaaaccaagttttttttcatctcatgttgggctacagtaaaaatgcatctgacactgtagcttacaattagcaaaaaaaaaatgtcaacgaatttattcactaaaaaatccatagttgttttttaaaggtttggtttggtttttggctacagaaagtgttggtgatacagtagatttggcttattttattttaggaaatttctggttaataaaatgatggaccttttgtaaattaatttacaatatctgtttttaatagagaatttatgacgcattcaccgtttccctgttccagctttgctcaagcaaaatgggcttctttcgccagatgagtttcgagaggcacttcctcttggcgcctttttgtacgattttgatgggatggcattacgtgttgtggcattggaaattaccaacggcatcggaaaaataaacgggacaaaaatttgcaaaataaagtccagcacgtcaagcacttccagcattgattgttctctggacggcatcgacatggcatctcttcccgattttaagcggccctgtgaagagcggtggcccgagttggccccaatttattgctacggcaaaattcttgaagtctgatttaagcagctttgagaaattcaaatgaattgcataataaacagggaacggatttttaggtgtcaaaaatcgcgaaataggcacctaaatagttgctaaaaaactgccaaaatagttgctaataaattgaaaaacgccaaaataattctaaaaaacagaaaaacgccaaaataattataaaaaactaaaaaacgccaaaatagttttggataaacatgtcaataaatgtgtgaattttccaaaattgactcattctttatccttttcggttgcacaattgtaaatcaaacacatttgaagattttcaagcgtaaaaagttttcgatcgtccgccaaatcatggccagaatttttgctttttgaaaaatcgattt

SEQ ID NO: 2353 - DNA, 2192 bp, Heterodera glycines
  misc_feature (6)..(6): n is a, c, g, or t
ctttangggataattttcaattgaaatcgttcctatttttgtaagtgtcaattttattcagcccgttggatcaaggaggacacagaggacaaaaaggacccatggaaattgctcaatttgaggaccactcaaattgtgccggttgacttgaacgcactgatctgtgggaattacaggaagctgtcggaactgttttccaaaattggtcattttaatgtggatcaaatgcgcaaaatctaaaatatttttatatcgttttttaattcttaaatatttttttattgtttaaaaattgattttaatcataaaaacaagcccccggcacatttacggtttcgcatccgaaatttaaaatttttctatcttaagacaacagtgaaaagtcggcatcgtacaacaaaacacattcggaatttcgtaagaattttgtcgccgtgttcaaaagtgatggtggcacgttcaacgattacgaattggacacaaagaaagtgcgcaaaaggacctattatgggagcaccgtggtgccacttttcacggggtgcctaggggacgacaaagatgcggaaaaggcggcaaaacgaatgtttaaaggactgatggagattgacaagaagcatggcattttcaataattacccattcggcgttccgaccaggtccaatttttggggtttgcgagtgcatgaggaggaaaatggggaaattgaaattaattgaggattcggaaaagaattactaagcgttaaatttattttacgcttgagactaatcaatggcatgaaaaaccaattggttaaatatacgcagggttcgcaaatgatgtgaatttatcagcgagtcaaagctgattttttaaaatgctgttttcttgaattttgctgcttttttaaatttgattgtttttgtggtttttagggggaaattaagaaaaaaaattcaaaaaagttttgcttgctttttgtaatagaaaaattttgaatgcttattttttgtcacccaaatactgatttttgaaaaatttcaacggcgcataaagaatgaaaaaaatgtgcccgtttttttctaaaatatccttcctgattttggattggatgtcatttataaaagtgcaaaaaataatatggttttcagctctgtgctcaactccgcacagcagtgggatttcccaaatatttggccggttaatttttcgcctatttggtccgcccaattagtccccttttaagccggtgagtcacatgatggtcgaagcatttcgccggtccggcagcaaacagtaacagaccaaaactgtacttacagtgcaccgagactgttcaaattcatttacagaatgcagaaattcgcatttgataaggcccagcaatggctgtctgccaactataagctgtacaaaagctgccaaaattttatgtggatgaaaatggctgcccaaacgggcacccccggggcaaagggagatttccatgcgcaagtgagtgacagctaagtttcatttggtcgtttcctaaatctgctagattgagcatttttactcaaaaacaatcgttatagctcataaactgtgactaaaaacaaaaaaagggttatatttttcaaaattgttgttattagggacctaatttaaatggacaaaaaaaatctaaaatatgggttatataatatggactaaacaattgcaaaatggacgaaatatggtcaagcgctgaaagatgtacaaaaaatacaaaatatgaacaaaaatgatttgaatttttgaaaaaaattcctaacctaaaatttttaaaaatattttaatattgaattagataattgcataattaagactagggaccggacaagagggtcggccgaactgtttcggttaaaaaccgaaaaaaaccaaaaccgaaaaaaaccgaaaagctcaaaaaattctcggtcgaacggtttcggttaaaaaaaccgaaatcgaaaaaaccgaagaaaatttttcggtttatttcgatttttctgtttttttttgaatttgtttatttttttcaaaaaagcaataaactattctattatgtaatagaaaaagcaaaaatctctagagttcgacctggacctggatccagacctggatttttgctggatccaggtccaggtccaggtcatttttcggcaacctggatttttcctggacctggattttcctggatttttgtccag

SEQ ID NO: 2354 - DNA, 6312 bp, Heterodera glycines
ttttttttgtaaaatttaaattatcagagtagatttttaagggaaaataaaaaatcttaaattcaaagattgtgaattttggcggcccaatcaacaaaaaaatttgttgggaattgtatgggaatattttgcccgctgcaccaaactgatcaaacgctgccattttggctcgcttttatacaccccggggcgcgtgattatggcgccccaatcgccgcgtttgggtgacatccaccaccaccaaatttgttccgccccccccccccgcccaatttgtccacccccaaatttgtccccccgaaattttccatcaactttttcttttcgcgccattaccattcactcaatttgcatcatcatcaaagttttgcagattcaatctcgcaaaaatgtgaaaatttcactgaatttcttcgtcccatttgaccctcggacggaaggggcgatgattttgcacatccaattttttttagtttaaatttccccccccccccccccgtgccaccaaagtgcattcaaattaagcaatttgtaattgctgaaacaaacaaaatcggcaaggcacaagtcgaagcaattaatgaaatgaccttcaaaaaagtcaatgattcgaatttgaaaattcttttgcaaaaaaagcaaaaaaaaaattaaaaattaagaaaacaagaatttaattttataattgcatattttgtgagcaatttcaaatttaataataaaaacagactaacaaatttttttgttcagtatatcaaaattcaacgatttttttttaaatttttatcaaaaaaagcgcgaaaaacatttttgtttttttatcaggaaataggtagtcttttaaagcatttattcgtaatattatatatcctaaattgacatgggttattaatgaagcgaaccaaaactgagtttgagcgagacaactttaagaagccaacatttattttgttgttgtttcttttgtttggaaaaaaaacgaaaaaaattcgctcaatttgcatcattatcattagggacaatatttttgggtgctaaaaactgccaaaataggtaagttttagtcataaaaaccccccaaaaataggtactaaaattggaaaatcggtgccaaaaaagttttaaatttatgggtgtttaaaatggtaaaaatttatccaaaaagcaacaaaattaagtaaaatcagtattgagagatgccgtatattctctaattatctatcctcaccccagaggcattgggggggggggggtaaagtgattggcgacgtaccagcagaggtgtttttgacagtgattgatttcgacactgattggtggtttcgacagtagtttttcaattattttttctatatattttactgtatatatgcattaatatatttaatatacaatttgtataaacaaaatttataattttaagtaaataataaataaaaatttaatgatttttttaatttcaaatgccgggtttgatgagtgccaagatgcaaatctacaagctctttactgtcgaaatcaccactgtaaacagcaccattggagacgggcggataactaggatatacggtacataatttaataatcaaatttttgagatgaatttttaagaaaatttttcgtttcttatgggtgtatttttctgaaaattttgggctcaattcttaggggagccggaaaatccgacaccgatggaaaatccgatatcaactttaaattaaaataaaattagattgtttgagttaatatctctgcctaggcttagcaagttctcgaattgaatttaccgagaattgtttttttttgtgtcggttttttcacgaatttaatcaacttcggttgcctggggaggattaggtccagttgaattctcatgaatttcgccctcttcggaagacattgtgacaaactcagggggtttggtggaaccaaatgattcgagaacagaggacggaatagcatgcaaaatggaggatatccctcatccatatgttaaaaattgttaggcactatttacattctcgtttcccaaggatcacagagattattcgaatttttctgcttgtgtcggattttccagtgccggattttctgcttgtgtcggattttctgcttgtgtcggattttccagtgccggattttctgcttgtgccggattttctgcttgtgtcggattttccagtgccggattttccgcttgtgtcggattttccagtgccggattttctgcttgtgtcggattttccagtgccggattttctgcttgtgtcggattttccagtgccggattttccgcttgtgtcggattttctgcttgtgtcggattttccagtgccggattttctgcttgtgtcggattttccagtgccggattttctgcttgtgtcggattttccagtgccggattttctgcttgtgtcggattttccagtgccggattttctgcttttgtcggattttccgcttgtgtcggattttctgcttttgtcggattttccgcttgtgtcggattttctgcttgtgtcggatctttcgcttaaaccaaaagtttttcgtgcatttaccatcaaaataaagcttcagaaaaaaaatctactaataatcatcatcatcatcatcagattttgcacatttaattttgcaacaaaaaattgaatttgtttcactaatttccgcccatttaattagtgaccctcggggcgatttgtgcgaaacattcggtcttcgcctgagggcgatgatcaattcatatgtcacatccaattttcgtttaaatgttaaaaagtacgagcagccaaattaggaaatgcatatgctgaaagaccacttactctaaatggtttatgttattgaagcggaaaatcggaaatttttttttgtttgtgatgattcaatttaagttcttttgcgtgcatttgtagaaaaagcaaaaagtaaataaataaaatttttaaaataatttaataagaaataacaaagaataattatttttaatttttatttaattaattgcatattttcatcagatatttcacatttaagaaattaaaatttttattgtaatttgtttgaaaattttaagaaactataaatttttatttcttttgccagaaaacaatttaaaaaatttattttttaattattaaatcaaattttttttcattagaaagttcttgacaatctcaattagacagaaatctgcttgcggtacggtaaaaactaattattaaaattaatatgaagtaaccgtgaagaaatattttaaaattttgttttattttatttgatcagctatttaaatatttaaggataaaattattattttgtaaatttttttttgtcattgtggtttgtctgaaaaatccatcttcagacaatggtaatactgttggaaattctaaactggatttataggattgatcttgaaaaattaagagtacttgaaaaaaatataaaaattcaattcttaagcaagccatttaaattcaaaatttaattcagaatagaaaagcagagaaaagaacacaaaaaataaataaataaataccgaaagatgaacacttaaaaacaaatggacatataaacaaatttacaggaaatcatcaagggcattccttgaaaatgcggtaaaattcgagacggactcaagtgtgggactcgagaaaatttccaatttgttttctacacaaatgttaaattagcaaattatgtggcaaattttgccaaaatttaaaaaccgatttaaaaacagtgccagcaacggaacgggccaactccgtctgagccaactttgagtcaatataactcttgaagttattgaccgaatcaaacaatcttgatatcaatcgaaagctcttcacaggctctattagcctactaaaaattacagaaaatttcgaactataaaaaaagatagaaataaaaaactttgaaaattctgccttttttgcggttttaaactgacaacttttttgagagctgattaatcactgagaatagcttataaatatcttctaaacatctagggctttcgaatgataccatgattgtggagtttggccaacaaagaaaaaagttatagctttttgaacattgctgagacggagttgacccctaccggccagcaaagagttaattgaaaaaatagaaaatcagagaaatgaaaaacaaatgccaaaaaatggtttaaaatatataaatataaaaagatagcacttgaaaatgggtaaattgtacagaaaaatagggaataaggacagtccttgaaaaaaatggagagaattttaacccgaaaaaacgatgttatgaagttagtcaaaaaaccgatcaaaataaaaaattatgcttagaaatttgatcaaaagcaaccaaatctaacaattttgatatcattgattttttgagtttctttggccataactttgtttaaaattaaaaaaaaatttttccttttgatggttggttttttgactaacacataccctcacaaatcgggtcggggtcgttttcgcgccggtcgttttcgcgccagcctagtttttgaactataactttttccattgtcaaccaaatctaattttcttgatatcattcgaaagcccttcacatgctctattagcctgcaaaatttcgaaaaatttcgttaaggttcaaaaaagttatggccaaaaaagctgaaaaacccggtttctgatgtacttttggtcataagtttgttgaaaattaacgaaattttttgaaattttgtaggctaatagaggatacttagggctattgaatgatgccaagaaagttggatttggttggcaatgaaaaaacttatagttcaaaaactaggctggcgcgaaaacgacccggtacgaaaacgtcctggcccgccactgggccagagacgctcacattggcttcacattctttataaatgatattgatatagtaaaaaggaaaagcttcatatctcggccagaagcttcattcttgggtaccactcccttgttagtgaagaaaatttaaattatatttacgaaaaaacgccaaatatttacaaaaatattaataaaaattgcagtgcaaaaaataattgactcggcttttctcgagttgagtgagactcgagtcctataattttttaaaattatatttaaaaaccaataaaactaatcaatttgtaaaaattggaaatttcgctgtgtgtaaatgtggcatttattgccgtgttttccccggttgtccatttcacatggcaaattgcattattctcatgtgtttattaaatggaaaaaaagaaatttaaaatttaaacaaaaattgactaaattttaaaagaaaattgacaaaatgtttacaaaattaacaaaattttatatattataacatatttttaatataaaagcaataagagaataatttaaaataaattggcaaaatttttacaaaaattgacaattttttataagaaaattggcaaaatttttacatactctagcatatttttaatataaaagcaataatgaaatagcttataatgtaatttattacatatttggttttataatcattagcgttgtgcgtttgtatgctaaaaaaatgccaaaattataaaaaatatgccccaaaaatttaaaaaatggatttaaacaaaaaaactgcagctgtataaattcaaaattgacctggataaaaaaatcacaaaaatttttttattttataaattaacgtatgaaaagtttgaatgtttttaaatttgtatttaattatctggcaaatgcaattatattgccaaattgagaaagactttcttccgttaaataattttacgagttttttggagcagatttttgaaaattccataacccgaacgaatggaggggcaccgtatccaaaccgaatcgagaaatttcaagttttccattttaaagtttcggtttaccgaccccttgaccggtctatattattaatgacactaattaattataggaaatgtgttattatgctatatctttttattttatcaacgttatagttcatttttttattgcaatttcaagtgcaacgtcaccggtgagttgtttttttactttgccataattccccatttaaatttaataggttgaggacaatgcactgcttgcatttatgaaaagctatggtttgcacaagcagaatgaaattcagaccggtgaatattcggcgcaaaaatacgaagcacaccttggcattgtttattttatgagagagaattggcaatgtgccaaaattgggacaaatttgacgaatttgaccagggagatgccaaaatatcgcaaatatttg

SEQ ID NO: 2355 - DNA, 1657 bp, Heterodera glycines
caatccgatcagatcagatcagatcagatcagcagcattcattcataaatttgatgttgactttcttttccaatcgttggataaagtcatccatcctttttaggatgctatccactttgaagtgttcccttttttccgagtcaattttttcaacaatttttttcagactgttattcttggcatcattttttaccaaagtccacaaaaatgtgcgggacttggcaccaggctcactggttttggccgaagctgaaaatgcgcaataaatctcttcgattatgaaaaatttgaaaccaaaaaatcagtccataaacccttgggacaattttatggcattgatcaaatttatgaactttggtgactagggatgccttttttcaggattttcaagaaaatccttaacaaaaatgcaataaaatatacccctaagaattgaaaaaattttctctaaaatttattcactaaaatattttttttttggtaaaatttttggtttaaaaattgtccttatttgaaaaaaactttaaaatatttaataaaacatttacaattgaattataaaccaaaattaaatttgtttaaatttataaatcgtaataaaatttaatttatgaagcattaaatgtttttcgtaaaaaatgattattatcactgacgaaatcacttctgacgaaatcacatgttaccgctatttcatgttaatcccatttttgaaaaattaaaattaagacgaactttcaattgccgacaaagttccgcttgaacaaaatatccaacagcagccgcaaccatcgaatgtcagcaattgccctgcaaatgacgagggcggcggcggggacggaattggcgacgaattggcccattttttggccggccttccgcccgtggacgaaatgggccaattggtgctgaacaagttcaaatactcgtgcgaatttgctcaacttctctacaccggcggaggccatgtcgactcggtgttctgcaacattttcagcggatatccgcccactttcttcgaagaattggtcgaggcgagtgcattttcaaccccttttagagcccattttgaaaagttttttggctatatgatgccggatttttttaccacatcgtactctgctaaatactttaaattcgaaatctcaaaaaatccccatgggattggataaacgtttcaataaaaatccattaaagctttaagtccctctttttgcatttgccctttgacttatccctaattagctaattagcaattcttaattatgccttctatacagtacgctctcacaacgcatcgtcccgacgcgttggtccgtcgcatttgcgtttggctggccgcagatgagccttggcctgacatggtcaccctttttccctccgctgtccaacgccgcgtcagcaacgaccgcgtgctgtacgaattccaaaacattggcaaaagttgcggccaacagcagcacaaactgtccgaatttgtgcttcgcattcgtgcgccttcgcggccaatgctttttcgggcgatgagcaatttttcgttgagccgaaaatgaaaaatttggcaattttttggccattccctttaatttgtattgtttgtatccaatggcatttcatttgaccgtttttgaacttatttttttcttgccccattgtt

SEQ ID NO: 2356 - DNA, 4527 bp, Heterodera glycines
  misc_feature (4497)..(4497): n is a, c, g, or t
gaaaaattcaaattttgaaattgaaggccccgataatttatccggtgaattgccttgcccaaaatttcatggttttttaattttggctcaacaccgaatggaagaaaattaaagaactttttctcttggaattatgaaccaaaaattgttgaatgaggaaagattgaattattttgacaacaaacggctaattaacgtgaattattatgacaaaaatcggtcaattaatgaaattattttgaatttggcaattgacgcagggaatgaacgccaaaagaatgaaagtgatttcgaagaaataatttgcagacaatgttttgacaagaacatggaggagatgttaagaaaagcggaagaaagggcaaaagaggaagaagacaaattgttggaagataatcccgaagaatttgaggatgaagaaatagaagaagaagaaggagaaagaaagtttgacgtgcataaaattgtcacgaactcaaaattcgatgacgcaattaattgggtgagtttttttaatacatactagggtaggccgggtcggggtatttaggcaaaaaccgggtccgggtattaccgggtattgaaaagtcgggtaccgggtcgggtattagtttttaaaccgggtgccaggtcgggtattagtttttaaaccgggtatcggctcgggtattagtttttaaaccgggtatcggctcgggtattagtttttaaaccgggtatcggctcgggtattagtttttaaaccgggtatcggctcgggtattagtttttaaaccgggtaccgggtcgggtatggtgtaccaggtgaaatcgggtattgaaaaaatttttaatttttatttccttctaaattattactatacagaaattttttttactgtaataaatgctaaagaaaatagttcaatcaaaaattttcatattattctccaaaatcttcaaaaagcttttcatcgacaatcacttttttctcttaaaatatgtgcataaaataataattattcattttttattttatttcttaaagaagtcaattttagacggatgaagccatttttactgaatttgtgaaaggaaaggcaacaaaacttgagaaattcttctttttgatgaaagcattcccgaaaattattgattacctgaatacgagcgcttttagtttctttaaatttgggtattgtttggctggtcccttaatttggcaattttctcaaaatttggttgattgcttaattttttgaaatttttatcaaatttaatgaaaaattgggcaccagccaagcaaatcattagctaattacccaggtctaatgagcatataaaagagcattttgtgcaaaaaatggaggctgagcttggccttgtgcatttgatgaaggtgaattgggactgtaacaatgtgagaaaggaacaggaaagtgaatgcttaaaatatcgcaaatatttacattatttgaacaattatttattcagaaaatatgtcgaaggtacgattttattcatttctttatgaaaagtaatgcgaattttagtaaaaaatcgcaattagagcttaaacaggaaaaaattcaaaaataggcacaatataagaggaaaattgcaattcagaggatcgatccatttctaaaaaaattttcattaattgaaggatgaattaaagggattgaatgttgtcacattaaaacgatcctttatgactttaaccgttattttaagtgttgattgaatatttataaaaatattgataactcactcaattaagcaaaaaacccggagatggcagcacaattaacaacagtgaagccagtgtttttatatggcgaaaaaattatgagtttatttatcattgtcaaagaattgaattttgttacgaaatgtttttgggaaaaatgcgaaaacaaattggagaatgtggatctaaaaaacgagaagatggaattgctaaatgagaaggaaataaaagaggagaaaaatggaggaaacacaccgaagagaaaagtcaaaaagcaaaaaacaaaaaaaattattgtgccaacaaaaattgaaaaacttcaaaaagaatttgagcaaaaaatggaaaaaatgtgcgaaaatgtaaaagaaaaggcaaaggaagaaaaggcgaaattggaaaaagcgatggtaaaaaatgaaaattacaagaaagaagaagcagaaaacatggaaaaagaatacgagcacaaatttggcactttcaattcgtcgccctttttataacaatgccttcgttcgtttgcctaaaaacggcgaattttccccaattctttcggcttttccttgggaatttctcttgttttttatcttttatttattttttgctttttgttccttaagatttatttgcattttttatgtaagaaaatttatataaaatttctcttggcataaagcctttttaagaattgttgacatgagacggtttttatctttaatctatcacaagctcactcccctatatttttattcgagaccatctcgcccagtctatagaaaaaaaaactatttccatgctattatttattgtcatggcatttttcttcattttctcaaaaattaattctatttttttacattgaaagaaagacaccataataagcaaaataaaaatcttcacaaatacactccctccaccctcagtaaaaatgcaaaattttcagaaatttatcctttatttttatttgacaaaatttggttttttataattttttttactcattttcaagatctgaattattgattttatttaatttaattgaaacatgaaagaaccgtattgttgagtcttttttaggtgctaaaaactagagatcggaccggtcggttttttttcggttttttcggttttcggtttcagttttttaaccgaaaccgacagaccgaaaattttttgagtttttcggtttttttcggtttttataccgaaaccgaccgaccgaaataatcaaaaaaccgaaaaaaccgaccgacttttttcaaaaaccgaatcaaattggagcgatataacctgttaataataataaatttattgcttttttgtgctctttttcattttgaagaattttttgtaaaatattttctgctattttgaaaaaaattattaacaaaaatgcaataaaaacgaaaaatacacccctgagaaatggaaattttatcaaaaattcatattcaaaatttatttatttatttacttgactacatttttgattttaaaatatttatctcatttccattttgattaaagtgaaaaaaggaagatttcgagcatttaaagagaaaatttggtctttttttttgttaaaaaagtttgttgatcactactcgatcggggtccccggcccacgacattttgccccccgaggggtcggggagcaaccctagtttataagaagaaccaggaagctaacaaacgttttttggctgcccttttcaattattttcccaacttatacaccattgatagagcttcaatagctctacaattttactcagaggtgatctttcgctttttctattgataaaaatggtttattgtttttttgggaaaagatttaaaaaattcaaaaaaaccgaaaccgaaacggtataccgaaaattttgcttcggtttttttcgatttcggttttttttggttttttaaccgaaaccgaccgaccgaaaattttttgtgtttttcggttttttttcggtttcggtttttataccgaaaccgaccgaccgaccctcttgtccggtctctactaaaaactgccaaaatagttagttttaggttttaaaaaaaccccccaaaataggtgctaagaatgggaaaatagtttctaaaaactttcaaatttaggggtttaaaataaatcgatattgagataattttaaaatcaaaaattttcgtcaaaaaaaaattttggaaatgattttttgagcaatttgtaatttattaggggtatatttttaaaaattttaggatcagtaggtaaaaatctaaaaattgcatccctaattattattattattattaaagtaaaaaaataaaatccttgatttcttaagttaaaaatggattaattcacctaattaggaccctgatttattcaatccgctgaatgtaacgatcagtttcatgtcgccatcattttgatcggatgtataattgcaaccgtttcatcaattacttcattattgtttattaaggatattcaagaatatactcaaaatgttctgttagtaaattattttttggtttcttttatttcttgtattccaattttggcttcagccagcggggcacccattctcatgttgaggtaaaaaatgttcaaattattctttattcttttaatattcgaaattttagccaaaattatcgcgaggcatacaaaaaattgttgaagcgcaactcaccatcagcagctgttggaccattattcacaaattgagaatttttatttcatattttgattttcaattatttttgtaccacanaaaattctcacgcaataaaattgtgggaaa

SEQ ID NO: 2357 - DNA, 2486 bp, Heterodera glycines
  misc_feature (2433)..(2433): n is a, c, g, or t
tttttgttagtccgttgatttttcaaagtgcagagaaaaaaacatcactcgttgtggcatgctattttttatcactcacaaacaacacagaaaaaactgaattcatttcgtagtgtttaatttttttttttttttttacttattaaatccgcttcaaattttacatactgatagaaaaaaatcgggatctactatagttatagagcaatttaatctgaaaaatgttggttcgaaaaatttccaaaaaaatttttgaatgcccatatcttatcagcaaatcgctttgtgactcgaagacagaaaatgataaaacagttttaaaaagacaaaaaaaaaaccttttttttcctggttaaaaacggtttatttttgccatttccgtagggaccgatttgttcatattaaattcgccgagcaaaaaatcttgtaggtacatcatttaagtatttaaccatttctaagcgggtgtctgtcgttcactataaacaaacatggatggtcccgttcttaaaacaaagtctaaaacattgtccaaaaaatgcctttcacaatgctcaattgtgagccctgattaattaactaatttttaattattttttttttgtaaaagtgtgtccaaattgtcaacgacttttccgcgtcttgttgttccaacttctattagtggtgttgaacttcgtcttccgtccaaattcaatgcgcctcgatcttttgcaatttttcttcgtgaaaaatttggttatcagactggcttagcgaaggaaattgttaaaactgtcagtgttaattggaaaactttgagcgatgctgaaaaacaggtagcatttattttatttattttttgtctataaaaggaattgtttcccaaactttcttttaatctgtgtttccaatgggtgcacacctaaaacaagtcaagaaattttttttataataatattttaaattaaaaatatgaaaggttttctagcgtttttcggaattttatgatgatttactagtttttaaaaaaaatttccaaaaaatcgctagaaaaaataaaatttctttgaaaaatttttttcaaataaaatacatatcaggaagggggggggatggattactactctttatacaattttgtgaaataattaaatttaattattcgtgaattatttggattactaaagttacggcgaaaaaattttgtcctgtttcggtttccaatcggcaagtggaatgaggatgttgtcgaaaatctttccgaacgaggagagagcgggtgggtggggctaccaccaccacgggtaatctcgatcaactggcccaggaacggctcatgacaaaacgtcgccgggaatacataaatattgcaataaccattttaagttttatgctgacagagcaaagcaaattggcgatgaaaagcgtgagaatttcgagaagctttccgaagagcaaaaacaaaaattgattgagctacacgaggtcaaaacggcaaggcgtcgactatttcgacaaaagaaaatgcttcgcaaggtaatttttagctccatatcaggcccgtatcagggaaggtgttgggagagggcgagattgccacccaggcccgtatctagggggggggggatttttttccaaaagtctgttgacacttttctgaaaataaattctatactcatgtattttccacttattagattttgcaggcttattgctgcatgttctttgacacttcttcaaaataacctatgccctttattcgttcaaaacagcatctttgttgtttcgctttggattgacaagcccgatgataaatagctcgagcgcaaaacgcgtgcatgtttggaaagtatcgttcataccaataattgagggtttatttttaaatgaaattttatgataaaccttattatctcagaagctatttaattgattcggatgtttttatcgcggttaattagagcaacgaaaattggtttgaatcgtgaagtttctaactcacttctcaaaattgttgataaattgcaaatatatattccaaaagtctgttgacactttctgaaaataaattctatactcatgtattttccacttattagattttgcaggcttattgctgcatgttctttgacacttcttcaaaataacctatgccctttattcgttcaaaacacaatctttgttatttcgctttggattgacaagcccgatgataaatagctcgagcgcaaaacgcgtgcatgtttggaaagtatcgttcataccaataattgagggtttatttttaaatgaaattttatgataaaccttattatctcagaagctttttaattgattcggatgtttttatcgcggttaattagagcaccgaaaactggtttgaatcgtgaagtttatcatttctaactcacttctcaaaattgttgataaattgcaaatatatttttccanaaagtctgttgacactttctgaaaataaattctatactcaggtattttccact

SEQ ID NO: 2358 - DNA, 2501 bp, Heterodera glycines
gtaatctcagccaacagtaatataaccctaaacatgaaaatgatggttttaaacgaaaaatgggaaattgaaaaaatttgacaaattcatgtcatcaaaattctacaaagacatgttttacaataatttaaaaaaataaagaaataaatgttaattttttttgtaccaattgccattgtgtggtgacccatatattattttcagccctatgtcaccgagtcgagacacaatttggcaatttacaaccaccaggttgaagaatggaaggaaaaatatgcggatgaaattggtgaatggcgcaaagcgaatatgccgaaaagaaagaaaaagatggcgatgaaaggcatgaaaaacaacaatttttattctaattaaaccaaaaaatcaattttttaatgtgttagggagtccatgtttgacaaattcataggcaaacgcaaaatgaaagcagcgaaaaaggtcggactgaagaagaaggagacgaagttggcaagcgggcagaaaaagggacgaatcgctaaaggcggcggcacttcgacgacaggcgccaaaaagggagacgaagaggcggcgacggaactgcttcactctgcgactttgagcgaaccaattattttgggtgggacgaatttcaaaaatttttttttcgttttcaaaaggcatgaaaacaaagtgtcgacagtagaagggatactcctgtgttaattttcaaaaattttcagcatcgggcgaaaaacaggaaaatttgtggcgttttgcgccaaaaatgacaaattttgctattttggagtcaagttttcaaaaaataataatggtacaatgataggcgacaccatgaaaattttttgtgaatttaattagatatgacaaaaaatagtgtaaaatttcaacaaaaaaaagcttgccaatttcttggaaaatttattccaagtcaagaaaaaacccatggaaacatgtgttcataattttgaaatactaaaaaaaagaatttttttctagcaataaatatatacacatgaatatttttaaaatcttttaattcgtcagtgacgaagggacagcccaaaaagaatgcttcaacgggaaaagccgccaaaaaagtgaaaaaagcggatgtcaaaggagcggttgattgaccaaacaattcttttttgaatgtataattttttcccagtgctcccaagtgtgcagtttttcagatttatgttaaattttaaggatttgagtgtaaaagttgtacgggacctggacacggacaactgagtacctaggtcccggttttttcccggaagttgggagcactgttttttccatatttgcgatcagatagacaataattgtccactcaatgttagtaaatgaagtatgtatgtttaagttggtatgaatataaaacatgttttttcaaagacaaatttttctatattttgtcaatattttgtgcatttctcacactactaaaatgcgataagaaagatttatttgatcggcaatggcggcgacatcaaagctgcaaaaaagtggacgaaagcggttgagatacgattcagaggagtcatctgatgatgatggcattggaggaggtgaatgggatttcaaatttgcaattagtacttgaaaacgggttgacctgaaatttgattgcgctcgttagccaacttttcgctttattgcagttaacacgaccataaaatttggcaagtttattacaccataacattgtgtaaacaccaaaattaaacattcttggtatcattcgatagtcccgagaggtctttattaggcccataattgaaaaactactttttatgactggttgattttcatcagatggggccactgttgcaatcattccgacgccgagcattgatttggtcctgcaaaatttggcaacaaatgcactcgcttctacagcggcgcccgaaatggaggagaatgaagagcagggcgatgccattcaattgggtaataatatctgacgaattttgctttttttttttgggtaaaacgctttttggcattattttcatgattatttgttgggtattatgacgttaatcaaaacccagaaaaaagtgtgtttggtcaaaaaaccatcaaatgaaaaaaaattgttgggttcgatgagagctataggccctagcataagataaaaaatgaattgattgcttactgcatatagacagcagatgaccgagaccatccattacatacattatctgattttaaaatagaaaaaaaaaatttactaaatttcaaattgggtctgcagatggcagtggttccagtgcagcggaagaggaacaccaacaccaccaacaacaaccaaatgggcaaaccgttagcagcggctgctcctccagcagtcgtccgtccactgataaggagggggaacaaaagttgcggagaatgcaagcgcaagcgcgtcgtcagcgtgtgagcaagtggaaaatcagtgagacggcgcaaaagaagaagcaaatgcagaaaagcaaaggcac

SEQ ID NO: 2359 - DNA, 6109 bp, Heterodera glycines
ccccccccccccccccccgcccaagcgctcctcgcatcccctcacaaacaatatgtttttttttgccatcaaattttcttttctataaaatgcctctaaaattattccagctcgtcaggcctcgtcaacaattggtgcaacgataaacgatgttgttgctgcacgatcagttgcaacaaaaccgtcatcatcggcttcatcatcatcgcttgtctcctcatcacggcacacaaccaccaaaattgccgacggtggtgtttctgtttcttcttcctctctttggccgttgtcaacaacaacagtgccaaaaaggaagtttcgcggtgatggcagtggccgaagcattgttggttgttcaacaacaaaaaatggagcaaatcaactgcagcaaattgctgctggtccaaccaccgtgacaaccgtgggacgacagcaggacgatggggacgtggtggtcttggaggatgacagtagtggtgaccaacagcagggagcagaggaggacgacatggatacggatgagcaggggacggcggaggaggctgcgccgttttgtaaaaattgtgccagtgaaattcctctcattttgaagttagtttgcccctcccgcctattgttgtttgcatttttatttttgtcatgttataatcttcggagcaggtcgtgccccccccccccccgccgataaattaaaagagtttttttataagaaaattccaagaaaataaattttgaaaaatttttcagtgatttttcaacttttatgaagttttccgggagggggaacgatccagagagtaacttatatgggatgcactctataatcccccctttcccgtttataggaatttggaccgccttgacaacatggtcacgtcaatgatcgattccgtggagcaaaaaattcaacaacggcggcacccgccgcagcaaccaccaccatcgtatgctgttgttcgtcctcataatgatgctactgttcaattcatgccgtacaatggtagtgccgctggtccatcatcatcattaacaacatttgctccccatttgtcaccagcagaaatcattgccccaaaaaaccaccacaactccatcctgctgggcatgaatggtgggaacgaagcggcgtcgtcctcgtcaacttcggcaccaccaaatgcgaccatgctgcagctcaatgttcagcaagttcaacaacaacatccacaaaaccagcagttgttcatgctcaatcatccaaatggactcgtcgtcaacatcggtgaccacgttcatggcgatggtggtggttatcaacagcagtcaacaagtgcctcctccatgccaatgccgacaaaatttttggacgacgacgacaattcaccgcctccctcggttgacctcggcgattgaacaggacggcgacgaaattgttttatgatgcttttttgtaccttgttttgtttggatctctttgcctgagaaaattcattttaccattctgttgggtaccatttacataaaatgttaatttagaaaatatgtgtgaacttatacaatttgtatttgtgcatatgcattttatttatacattttaaaatttgatattatgtatatgctgaaatcgttcctctcattaccgaaaaaatttaaaaaaatcttttagaatttaaaaaaaaaatttttttttgaaaatttgtctttttattagaaagttaataactttgaaagcaaaatttttctggtgagatggaggggaaggagcgaaaaacagtgtcccattttgctctaattgttgcaatttaagccttgttgtacaattgtgggatcggtttgccatgcgcgtcctctttgccttgccctgccatcattgttttaaaccgttgtttgctccacaatggacgatgatcaccaggttgaattggggttttagttccacgcaaacccacggttttgtacagttttcgtgccgcctctgatgtgccgtcggcggttggcttgccccccgattggttgtcagactcctgtcaattaatccacaaaagccgtttgcccacttatcatttccaggtcaattagtgttttttgtgtttctacacacaaatcattaccaaaagtaaaaaaaaattcggcttaaaattttgttttatacacgtttttgtactatattaaccgcatccatttactcacctaaatctgtttcagaaatcgcttttccgattaccagtgcccagtttggaacactcttgcgaccgatatctatgctctgttggtgctgtgtttggcgaacattcagacgaatttgtggactccaaggaattggtggccgattttctcgatggcactaaaggcggagggccgggtaaaaaacaaaaaattgatcattttaagtgtttaatttttaaatttaatttattcagcgcttcaagccgaactcaaaagatacgcccaacacaataaacatacctcatacatagttagtttttgggggctttttgaatttaaaactatttttgggagtcgggggcgagctgttcacctaaaaacacatattgttattccagtcagaaccatggtttgacatgtatcttcgttcacgcatcccatgccccatcaacttcaacccgttcatgatgtttgcacccgaccctgagcctatctacaacgaccaggtgcagctttttttggaatttatttcgaaaataaaaatttattgcattattttagcttatacgagcaacaaatttggtcatttcctgtggccgcttcaaaaaggcgttggatgctgaattgctgaaacccgaagtattccacatgaatccgctcaaaagtgacaccgaaaaattcgaaaacatttgtcggtcggtttttgtcttttgcgcaagaaattttttggttttaaattatttgcatcgttttcaaaggttcgcccccaatgcaattcgatggcttgtggcagcgttggctttcaaagcgtacccattggacatggtaatttttcatacaatggcaaagcaacatagcttgggacaattttgttaccaaaaatctcgcacaaaaatttaaaaaaattgtgaaatttaaagaaaaaaatactctgataaatcatttgtccatgtaatacattttttaattggctcagagtcaatatcaatcgctgtttggaggttgtcgaattccgcagcgggacaaagatcgtttacatctcaacagaaattcgtaagtcaatttttcagatattttttttctttgacccacaacgttttccgggctaattttttaaaattatggtctctattggcgaaaaacataatgttttaacagtttttcgccgaatgatgaccaatttaaaccgaatttatttaacaaaattgatacaaatttgttcaaaaaatggcacccactttctttgatttttttccccaaataattcgtcaccatcccctggtttttaaggaagcattttgttgtttcacgccatggacatttctacactgtcaagctgtttgatcagaatggttggtttgaataataataattgtcttaaaatgagattttttttcttgtaggcatgcttctcgagcccaaacaaatttttgccagtctttcccatatttgtaaatcgccgccgtcgtcgtctgctagcaaaaccaattttgcgccagcagacgaatgtgttggctcattgaccacattggtttgtgttaaaattcaaacccgaactaataacaaccaccatggtctaaaatttcagtaagaaataaatttgaaaattaagggttttcaaaaaaaaaatcagcagttaattatagttttttttccgaaaaagacatctcatttgctaaagaaaaacaatatttatttaaaagtttaatccattttttattaaattattattattattattgaaattctgatcgtttttttttttgaaaaaaaatcgtgacattatgaaattttattcggaataattgtttttgttttttcaaaggaccgtgacacgtgggcggacattcgttctgaactgattggcaccgactcgagaaaccatgaagcgctgactgcaattgaggatggcctgttcctgttgtgcttggacgagttgcacagcagcgatccggaaagactgatgcattcgctgttgtgcggcgatgacgggagcaacagatggtcagtcagttcagttattgtttaatttcaatggtttaggccaggggagaccctccatttggggggggggtgagatgggagtaaaccggaacaggacaaaacacagccgccgaaacgcagtcgagacataacacagccgggaaaaaattttcaaaaaattttctaacagaatttttcatgaaaaaatgttagaaaatttcttagaaagttcaaagaaaaaaaaatttcaaaaattttccagcgatttttcaaagtttaatgttgaatgttgcattactaagatttacaaaaaaatttcaaaaaaatcgctggaaaattttttgaaaattttttttcctttgaattttctaagaaaaatttttctgagatttttttcatgaaaaatttctgtttgaaaattttttcccggctgtgttatgtctcgactgtgtttcggcggctgtgttttgtcctgttccgcctttttacttgcctatctgtacatatcaaatttaaattggtgcctttgtctccgaacattgcccaatttaataattaaaaaaaagtacgtttattttcagaaaattatccgtgtcgatttgcacaacggaggccaatggacgtgcatcccaacggaacatttggagggcaattgggttttgttggatgttttcttcgacattttgcttgctcaacactcggctcccaaccgtccgcactctttgcatattgccgacagtgccactaacggcgacgacaatgacgccgaacacggtacggtactcattgtcagccaaaatggcattttttaattgtttgtaattgtaaattctgtcagttgcttggcacaaagtggacagcgcatgtcgaagggccgaagttggcagcgcgtgggactggcgaaccgtcgcattcaaacgcgaaggtaattttcatgacaaaatttatcggttctctgataaattgccgtcattaaacagaggacgagcaatacgatggcattctgatgtggcccaacaaagggagacaaagcgatggcgcagaacaaaagaaactgctccctttggtggtcactccccacgggggcccgcattccgtttcgacttgcacgtaacaaatatatcattttgtagagttttttctaattttgttgcccccagatggccccatcgtgcccagcaattgctgctcgagaatggctttgctgtgctgatggtcaattaccacggctccacaggctacggggaccgttttgtgcgttcgttgcccggccgatgtggcgaactcgacctggaggatgttcatgtcagataataaattggataatgaaggggctaattggggaggaaatcgaattgggaacgacaaaagttaaaaataaacatcgaaatgggttttattggataaatggtcgaaaaaaactcaaccaaagtctgcaactaattaattctcattaatttgtgcagtacgctgtcaaaacgacgttggcttctgcacccgaccttctcgacccggcccaagtggtgttgttcggcggttctcacggcggtttcctcgtctcgcatttgatcggccaatatccggtgagaaagtgtgcagttcagcaccagttgacaaagagttttgggtgtttgttcgatttcaacataatatttaatctgtttttgcaggatttctacaaggcatgcgttgcgcttaatcccgtcctcgacatggtttccatgtggtctattactgacatcccggattggtagggccaaaggcagatagtttttttttcttaaaattggcaattttgccataggacgatttacgagggcaccggccgttttcccgactattggccaaccggcgaccgtcgtcgttcgcctgccgaattggccccgtcttttgaagagcgcgaacggatgtacaaagggtcgccaattgcccacgcgcataaggcaataattgggcgtagggagacaattagggggtcaaa

SEQ ID NO: 2360 - DNA, 1176 bp, Heterodera glycines
tattttagacgttgaaagatacggtcaaaaaccgtttcattcatgctggtggaaaggaggggcaagggaattcggaatttgatgcagtcgacgaatttgttcaaaaaatcggtattatttatttattttttattggggcaactcgttcagccccctggtcatcctcccccgattattccttttaatttaaaaaatgggaatttttagttcgtttaatttctttgaattgtcacaagaattaatttttttccggcattgcatttctccaaaatttgtatttgctttattttgatcacaaaatcacaacacagagtggaagttgaacgacagtttgcgcgaaaaaattcgaaatgcgcagaaagtgcaccttgacaacaccagcaaattggactttggcgttgtgctgcacaccgcgatgagcaaagaggacatcaaaagagcaaggctttcgcccggtacaaaattgtgcatttatttttattccaaattcattccttttaaattcattacacacacagacgcaatgatgcaattggcatttcaaatggcattccattccgtgtatcgtgaatttgtgcccacatatgaagttggtgcttttgtttttagacttggcaaaaacccccgtaattgtttttaaaaaaatgtggggaaaacccccgtaattgtatttgcaaaaaatgtggggtgcattaggtcccactattcgccctcatcacgtttttcaaaagtaaaaatcccattttttacattgctactttaaaaaatttctaaaaattggaaaaaaaaatttttttttactggaaacgagcacttcctaaaaatgatgataatttatttatatttatattaattaaattgtttttcattgtcagagttgttcaactgccgccttcctcaagggcagaacagaatgtaatcagtcaatcaaatttcaatttttataaatttaaagaaaatatttttcatgtacttataagaattattcttattgttaggtgttcgttccgcaacttcggcaacacgacatgcggttgaaggtgttgttttgggatacattttgccctccccccccccctcgtcgttcagccgatatttaaataaaatttttagaaaaaaggattttttgtttaaattaaaaaatcttaagaattctagaccttctctggctgtttt

SEQ ID NO: 2361 - DNA, 1218 bp, Heterodera glycines
  misc_feature (565)..(565): n is a, c, g, or t
agattttcgttttgatgctctttaaaaacccaaattattaagtgattgtttgttatgcaaatcaagcaaaaaagcaaaattctctgtgtgtaaataattaatatatttaaataatttatcattagcagctaacagcgaataaaaaggcgcaaaaattgcaattcttgaaaaattttcatttaaataatacaataatctagcgaatcctttaataaaaatatatttaaagataaaaaattctttttcatgtccaaatacacaaaataaggcaaattccaatttggcaaatttatttgaaccatttcatttgcagcattgattttgtattcaaagaaattggggtttgcatagctaaatttagaaaaaggaattgtttaatttttatgaataagctttagcaactgagaccgaagaccacttatagatagggagcgaattatttaggcgagaaaatggtaaaatatgggcaaatttcaatgaaaataaataaaaattgctgtaaatagcgtattattcagcagcaatttttcgtcgcccttttgtcgataaaattccatgtgaatgncaagttgggcaatattttgcgccacttcctcttggacaattttgaattaattaaaaaaagaatataaaatccaattttgattagtttaaaaaattttttaattaaattcgcggtttcttcaccataccatatttagtcatttaaatataactatttgtaataaatagggttaggaatatatgcacatgcatatttttttcttgaactgcggtaggcctgaaacgcacgaaaaacatgtttttagcttggtttgaagcttctaggacgtacttccatatgcatattttggcatttcgtgcatattttatgtgggtatttgagcattttttgaacaaatcctctattaaaacagccccctctattaaagcggccattttgcctctaatgaccaaaaaattttcaaaatatcatttttggagggttttctaataaaaaatgtaacttttttttaaaaattagaaatttatgccaaaaaaaatttttctcaattttattttacttttattttgtatttttgcttctaaaatgcttattcataattatttagctattttgagatttttatgcttaaatttaacaaatttgaagcatttgggaaaattttgccaacaattggaaaaatttatgtgcatatttttcattttttatgtgca

SEQ ID NO: 2362 - DNA, 1541 bp, Heterodera glycines
  misc_feature (1498)..(1498): n is a, c, g, or t
aaatgaaagttggctaaaaatatgttcaaaatctcaatttttccccgccggcgcgggctatcggcacgccgggaacctaaatttttttttaatttgctcaaaattacaaaattggccattcttgttgacaaatctgttaacaaatgacattaaaaatcaaataaatttcataggttgacggtgaattgttatgcaaatcaagcaaaaaagcaaaattcgttaaataatttatcattagcagttaacagcgaataaagaggcgcaaaaattgcaattcttgaaaaattttcatttaaataatacaatgatctagcgaatcctttaataaaaatatatttaaagataaaaaattctttttcatgtccaaatacacaaaataaggcaaattccaatttggcaaatttatttgaaccatttcatttgcagcattgattttgtattcaaagaaattggggtttgtatagctaaatttagaaaaaggaattgtttaatttttatgaataagctttagcaactgagaccgaagaccacttatagatagggagcgaattatttaggcgagaaaatggtaaaatatgggcaaatttcaatgaaaataaataaaaattgctgtaaatagcgtattattcagcagcaattttaattataaaagaagataaattttatcttttgccctattatgagggcgaaaagttcaaatgaaaaattatgcaaaaaatttaaaaaaaaacataaaatttcgtcgcccttttgtcggtaaaattccatgcaaatgaaaatgttggcaaatattttgcgccacttccttttgaacaatttgcaagcacaaacaaatggccaatgagaagagtaattcaaaacagtcaatgctaacatccggcccaatagccttttgccgcttttgtgccactaatttttgttcatcattttcaatcgaaacaaccaattgaattgtttaatacgaaattcctgaaaagtccaataaattcgaagatttttagtccgtgaaatactagtcaaatttgacgaatttagaatttaaaattttaacatgtgcaatgtaaattaattgcattttattaaatgttttattctttttgctggaatgaatttttcgagcatttaataaaagtttatcaactgaaaaatctttaaaaagacacagaagagaatcaaatacatcacagaaataatcaaaaagttgacaaattaaaaaataaaaattcatttggttgggttcaaaaatcgatttcgtctttttcgaaaaaagttaatttgttccattgatcatcgaatgtccattcaatcgcttccctttcccacttggcccatttgtgctcatctcgtgaaattggacaacgaatcagcaaaaggcgaatctttttactagggagcgaatttgaaataaaaagacaaacgattagtttagacaattttattaggcttttttggctgctctgatccacaactcatcaaaaaattggtcaatgaaataccnaaaaaaccctaatcaccaaaaaagtatatatttatatatcttt

SEQ ID NO: 2363 - DNA, 2462 bp, Heterodera glycines
  misc_feature (120)..(120): n is a, c, g, or t
  misc_feature (123)..(123): n is a, c, g, or t
tgtagcaatcaaattttttattatggattggtttttcctattttaagatgataacatctcgttggagtgtccctgtcgatttctaacccaatgatcatcgcttcaagccgtacaattcgnaantagcaaatggtggtgggacattgattatgtttccttgctaaaagtagaagaacaatttaattatatgattaagtcgaagtggggataaaatggggtcaaattgggtgtcaacatctctatataaataaagaggaagatgcattaacgtatgcataaaaatgtttattgcgccattcactctaattttgtcgggggccactggtagtggcaaaacgcaatggttgatgaaattgttgagaaattacagggaactaatagacccgccgcctgcaaaaattctgtactgctactcggagttgaatgagtcggttcttgatctgatgaagcggggaattgagacgtacaacggtttgccagaccaagcgttgatccagagccaaccaaaaccactgctcctcgtgcttgatgatttaatgttaaatgtgggaagcgattttctggatctgctgttcacacgtggttcacataactggaatatcagcgttatttttgtcacccaaagcctatacgggcgtaacattagaacagcgcgagctaacagccattatttggtgctgacaaggaacccgtctggtcaactccaggtcagaacggttgggtcacaacttttcccaaaacgactcaattactttatggaggcgtacaatgaagcgactagtcaaccgttcagttacttggttataaacatgcacccaaatgctccggaaaatgagcggttgacaagcaaaatattccctggggagagccgtgaggtatatttacctgtagaataagcgtaatgaacgaaacaagtgcgcttaaaaactatttaaggaagggaaatttttttggttcgcaaaatgtacgagttcagtccatacattcgcgcaaattcggatttcttcaaaaaattagcctcaacaaaatcggataaaaggaaaaacgatttgctgaaaggcgcatccgtagaacaaattctcggattggttgagatttgtgcaaatattttaaaatttaactttcgcctcaaccggcgacagaggagacgattggccgtgtacgcagactattaccgagcaattgcacgttcacgtagtgagcgcacagccagacagaggctacaacagggcagcggaatagctttaggagctattttggcgccaattttgagcgttttggctgaacagctggtccagaaaattgttgcaactccatcggcacaacaacaacaaaatgaagcacactaaaaagatgctacttgtaccggagagtgaatatttggcgcttatcaacctgctgaaagggggcgcaggtggaacggactcacttcaagccgaaaaagcagcgatcgatgccagcatccaaaaaaatctaaatgacaataaaacgggtgcggacgtgaaaatgaaacgccactcgtggttgtacaaacagaggcatcagctcaaggacatgattgagaacaaaccacaaaaggtgattgtggaaaacgctacaggcacagcgccacaaaacattgccccgtatatgggcatacagaaaccaaacctcaacaagcttgaagaattgaacgggcaggatggcaaaaaaataaataaataaataggacgaaaatctgtgaaagcttccagaatccaaactcacaatggtgccagctttggtgaagaaacggatacgtctgcgcctgagacagatttgcggctaagcaaaaagagacaacaaaagtttcttgaacttaaaacaagcccagagcattacgataagctacaggaaatgattgaacgaaaccccgaaaagtacggagtagataaatcgtccggtgaaattttaactaacttcaaaaagccggtgattaggtccaactacattgattctttaatgtacctgacaggacagagagcagatgtgccgaaaggtcatcgattttttgttcaaaaaggcggcagtgacccggaaatggcgaaattttttcattcccaacggggagagggtgatagtaatcggagcaagcgcaaaaagttcgttcttgttaaagcaaaagctataaaaacggttggactcagccgaatggagcaaccaaataacacgaagcgtaaattctttaaaccgcttctatgggcaaagctgtagtacaaaaattattggaacaagtgtattacgatcttaggtcaccggcaagttacgctggtattcaaaaagtattgaaggaagcgaagaagcgaaatccgagcattactcttcgtgatgttgaccattttttgcataaacagcgcacctacacattgtttaaaccgcgcaaaaaccgcttccgcagactaaaatatgtgcccagtggactacacacggactggcaatgcgat

SEQ ID NO: 2364 - DNA, 2543 bp, Heterodera glycines
  misc_feature (2533)..(2533): n is a, c, g, or t
cctgcgctcttaaagtcgaccacttccttcagatttttcgtttttgccggggcgccgtcaaatgttcgtttttgctttccatcaccagcagcactagagagttggaaacgggaaaggccagtcattttgatgatttttaagtaatataaaatctaaatgaaggattttgtgtttatgaaaatgaataaattgatgggaaacaaccgctttaataggtttttaggtcgagaaataaatggggtcaagcgcgtaataggtgccgcttgcaaaattgcaaaatattttttggcatcatgatggttttaaggaaaattagccaaattattcataaattcccaaattagcatttgtaaaatagaggtaattggaaaaaagcagttccatttcataagatattatgtaactaactataaataataaaaataatattaaatcttcgtgtaattaattgcttttaatacggtagcaatttgtgcgattcgttttttaatatggtatcaatatgttcgattcgttgttaatacggtaacaataggtgagactcgacgagccctttggtgctcatttgaaccaacatggggaaacacttcgtcaaatttgtggtccaacaaatttgaaaagtacgtgagcagttagcgaatttgggcgcccgtattgaaaagaaattcgatcagtcccatcagttccacgtaccatagggcactcgcagcgggtacacctgaaaagtgtaatttcaaaataatccagttaaatgttttagtataaatttaaaaagggcagcaaaaatcggggaaaatgcattaataatagaattaaaaatcggaaggcacgaaaatctcaaaaaagaaaagtatgaaaaacggcatttaatttttaaaaagttagggagcaaaaacctaaaacttaatcaaaaagcttaattttcctcatttaaatgtttttaaaaattttataatgtttttcgaaggaaaaattttaaatctaaaaattttatcaagaaaaatgaaatttggagatcaatttttgagtttcaattcttaagggtatattttctaaattttttcagttttagggggtgtatttcccaattttattgcccttttaatggaatttttcgaaaaacgccaaaaaggtaccaaaatggcaaaatggcaaaatgccaaaaaggtatttaaggcataaaaatccttaaagggcaaaaaaagcataataaaaaagtgctaatgcgtttttcatgcttatattcggaactaatgccagaaaaaaagcatatgcttcgaaagtcgaactttaataataagatatttgttcggctaaaatattcatgcttattatttaagtgataatgcaaaatattgcactcgaggtatatttgaaaatatatttttttggattttctttgaattcaaaattatagcaagttcaagccacataattaagattcatttttgtggttcacattactttgacaataatgtatttttatcaattgtaattttgagtctttttctcatttgtgattttgagaggttaatgaggcgataataaaagccaaataatggtacagcatatcccatttttaccatagaattagtttttgggactcagaattttcaaaatgttgctttctgacaaaaaaattcgatgcgattatgaaaggcgaaaacatttcatcaattatattttttctttattaattgaaattggccataaataggcatttttgcctgctaaaataaggatttagaaagagtaaaggcaaaatttgacttaaaaggtaccaactgaatttaaatttggcattttcaatttagaaaatttcattatttctcacttattttgacactcctcacggttttcattcgattgagtccaaagaccggtcacagcatacaattaatggaaccacacattcatcgccgccagatatcttcatcggagaaggccatcacaaaaacgtaaataaacaaaaacatttttaattatggacttaacatttaaacccttttaattatggacttaacatttaataattgattttatttataaattgtgacgataagctagcacaaagatggctttatactgccgtcctttttttgtggaagttcattcttttaactcaaaaaaaagtggtgtaaaatgcagcgtccaacggtttgtatttactccgtttgaattgcttgtggcaaaaaatacaatagacagtggaccaaaccaaatggttggttctggtcggcagcattcggcgaaggtgaaaggatacgggcatactgatttgttataattatttaaattattcatattttaaataacatttattttaaggtgatatctcaatttaataaattcatttgaaagtccgatgcaaaccgagatgattgtggatgaaaaacttcaaaattttagtaaagcaaaaagtcgatgatccattttttatgaacaaaaagcgtggccaattttatgtctactttctttagtttttttttgcgattttaaatagattaagtgaaatagtgatatacaaaagaantaaattcaca
